United States Patent
Budworth et al.

(10) Patent No.: US 7,550,578 B2
(45) Date of Patent: Jun. 23, 2009

(54) RICE PROMOTERS FOR REGULATION OF PLANT EXPRESSION

(75) Inventors: Paul Budworth, San Diego, CA (US); Todd Moughamer, Durham, NC (US); Steven P. Briggs, Del Mar, CA (US); Bret Cooper, Laurel, MD (US); Jane Glazebrook, Durham, NC (US); Stephen A. Goff, Tucson, AZ (US); Fumiaki Katagiri, Maplewood, MN (US); Joel Kreps, Encinitas, CA (US); Nicholas Provart, Toronto (CA); Darrell Ricke, Winchester, MA (US); Tong Zhu, Durham, NC (US)

(73) Assignee: Syngenta Participations AG, Basel (CH)

( * ) Notice: Subject to any disclaimer, the term of this patent is extended or adjusted under 35 U.S.C. 154(b) by 142 days.

(21) Appl. No.: 11/253,199

(22) Filed: Oct. 18, 2005

(65) Prior Publication Data

US 2007/0056055 A1    Mar. 8, 2007

Related U.S. Application Data

(63) Continuation-in-part of application No. 10/260,238, filed on Sep. 26, 2002, now abandoned.

(60) Provisional application No. 60/370,620, filed on Apr. 4, 2002, provisional application No. 60/325,448, filed on Sep. 26, 2001, provisional application No. 60/325,277, filed on Sep. 26, 2001.

(51) Int. Cl.
| C07H 21/04 | (2006.01) |
| C12N 15/82 | (2006.01) |
| C12N 5/10 | (2006.01) |
| C12N 15/00 | (2006.01) |

(52) U.S. Cl. .................. 536/24.1; 435/320.1; 435/419; 435/468

(58) Field of Classification Search ...................... None
See application file for complete search history.

(56) References Cited

U.S. PATENT DOCUMENTS

2004/0016025 A1*    1/2004    Budworth et al. ........... 800/287

OTHER PUBLICATIONS

Sasaki et al., GenBank Accession No. AP004113; Jun. 29, 2004.*

* cited by examiner

*Primary Examiner*—Ashwin Mehta
(74) *Attorney, Agent, or Firm*—Bruce Vrana

(57) ABSTRACT

The present invention provides promoters from plants capable of driving gene expression in plant cells. The promoters vary in strength and in tissue specificity, and can be used to facilitate the development of transgenic plants in which tissue preferred expression, constitutive expression, and the strength of transgene expression is either more or less critical.

4 Claims, No Drawings

US 7,550,578 B2

RICE PROMOTERS FOR REGULATION OF PLANT EXPRESSION

CROSS-REFERENCE TO RELATED APPLICATIONS

This application is a continuation-in-part of U.S. patent application Ser. No. 10/260,238 filed Sep. 26, 2002 (now abandoned), which itself claims the benefit of U.S. Provisional Application No. 60/325,448, filed Sep. 26, 2001, U.S. Provisional Application No. 60/325,277 filed Sep. 26, 2001, and U.S. Provisional Application No. 60/370,620 filed Apr. 4, 2002, each of which is incorporated herein by reference in its entirety.

REFERENCE TO MATERIAL SUBMITTED ON COMPACT DISC

The sequence listing accompanying this application is contained on compact disc. The material on the CD-ROM (filed in duplicate herewith), on CD volume labeled "COPY 1" and "COPY 2", each containing a text file named "Updated 60111-NP_SEQ_LST.txt" created Mar. 31, 2006, having a size of 9.11 MB, is hereby incorporated by reference in its entirety pursuant to 37 C.F.R. § 1.52(e)(5).

FIELD OF THE INVENTION

The present invention relates generally to the field of plant molecular biology. More specifically, it relates to the regulation of gene expression in plants such as monocots.

BACKGROUND OF THE INVENTION

Manipulation of crop plants to alter and/or improve phenotypic characteristics (such as productivity or quality) requires the expression of heterologous genes in plant tissues. Such genetic manipulation relies on the availability of a means to drive and to control gene expression as required. For example, genetic manipulation relies on the availability and use of suitable promoters which are effective in plants and which regulate gene expression so as to give the desired effect(s) in the transgenic plant. It is advantageous to have the choice of a variety of different promoters so that the most suitable promoter may be selected for a particular gene, construct, cell, tissue, plant or environment. Moreover, the increasing interest in cotransforming plants with multiple plant transcription units (PTU) and the potential problems associated with using common regulatory sequences for these purposes merit having a variety of promoter sequences available.

There is, therefore, a great need in the art for the identification of novel sequences that can be used for expression of selected transgenes in economically important plants. More specifically, there is a need for the systematic identification of genes that are expressed in a particular manner, e.g., using microarray technology.

SUMMARY OF THE INVENTION

The present invention provides an isolated nucleic acid molecule (polynucleotide) having a plant nucleotide sequence that directs tissue-specific or tissue-preferential, or constitutive, transcription of a linked nucleic acid segment in a plant or plant cell, e.g., a linked plant DNA comprising an open reading frame for a structural or regulatory gene.

In one embodiment of the invention, the nucleotide sequence of the invention directs tissue-specific (or tissue-preferential), or constitutive, transcription of a linked nucleic acid segment in a plant or plant cell and is preferably obtained or obtainable from plant genomic DNA having a gene comprising an open reading frame (ORF) encoding a polypeptide which is substantially similar, and preferably has at least 70% or more, e.g., between 71% and 89%, and even 90% or more, e.g., between 91% and 99%, amino acid sequence identity, to a polypeptide encoded by an *Oryza*, e.g., *Oryza sativa*, gene, with each individual number within this range of between 71% and 89% and 91% and 99% also being part of the invention, wherein said gene comprises any one of:

(i) SEQ ID NOs:2275-2672, 5959, 5972, 5973, 5977-5990 and 6001 (e.g., including a promoter obtained or obtainable from any one of SEQ ID NOs:2275-2672, 5959, 5972, 5973, 5977-5990 and 6001) which directs seed-specific (or seed-preferential) transcription of a linked nucleic acid segment;

(ii) SEQ ID NOs:2144-2274 (e.g., including a promoter obtained or obtainable from any one of SEQ ID NOs: 2144-2274) which directs root-specific (or root-preferential) transcription of a linked nucleic acid segment;

(iii) SEQ ID NOs:1886-1918 (e.g., including a promoter obtained or obtainable from any one of SEQ ID NOs: 1886-1918) which directs green tissue (leaf and stem)-specific (or green tissue-preferential) transcription of a linked nucleic acid segment;

(iv) SEQ ID NOs:1919-2085 (e.g., including a promoter obtained or obtainable from any one of SEQ ID NOs: 1919-2085) which directs panicle-specific (or panicle-preferential) transcription of a linked nucleic acid segment;

(v) SEQ ID NOs:2086-2143 (e.g., including a promoter obtained or obtainable from any one of SEQ ID NOs: 2086-2143) which directs pollen-specific (or pollen-preferential) transcription of a linked nucleic acid segment;

(vi) SEQ ID NOs: 1598-1885 and 5960-5971 (e.g., including a promoter obtained or obtainable from any one of SEQ ID NOs: 1598-1885 and 5960-5971, respectively) which directs constitutive transcription of a linked nucleic acid segment;

or (a) a fragment (portion) thereof which has substantially the same promoter activity as the corresponding promoter listed in SEQ ID NOs:2275-2672, 5959, 5972, 5973, 5977-5990 and 6001, SEQ ID NOs:2144-2274, SEQ ID NOs:1886-1918, SEQ ID NOs:1919-2085, or SEQ ID NOs: 1598-1885 and 5960-5971;

(b) a nucleotide sequence having substantial similarity to a promoter sequence listed in SEQ ID NOs:2275-2672, 5959, 5972, 5973, 5977-5990 and 6001, SEQ ID NOs: 2144-2274, SEQ ID NOs:1886-1918, SEQ ID NOs: 1919-2085, or SEQ ID NOs: 1598-1885 and 5960-5971;

(c) a nucleotide sequence capable of hybridizing to a promoter sequence listed in SEQ ID NOs:2275-2672, 5959, 5972, 5973, 5977-5990 and 6001, SEQ ID NOs:2144-2274, SEQ ID NOs:1886-1918, SEQ ID NOs:1919-2085, or SEQ ID NOs: 1598-1885 and 5960-5971;

(d) a nucleotide sequence capable of hybridizing to a nucleic acid comprising 50 to 200 or more consecutive nucleotides of a nucleotide sequence listed in SEQ ID NOs:2275-2672, 5959, 5972, 5973, 5977-5990 and 6001, SEQ ID NOs:2144-2274, SEQ ID NOs:1886-

1918, SEQ ID NOs:1919-2085, or SEQ ID NOs: 1598-1885 and 5960-5971 or the complement thereof;

(e) a nucleotide sequence which is the complement or reverse complement of any of the previously mentioned nucleotide sequences.

For example, in one embodiment, a plant nucleotide sequence is the promoter sequence for a gene, and preferably is obtained or obtainable from a gene, comprising an ORF encoding a polypeptide which is substantially similar, and preferably has at least 70% or more, e.g., between 71% and 89%, and even 90% or more, e.g., between 91% and 99%, amino acid sequence identity, to a polypeptide encoded by an *Oryza*, e.g., *Oryza sativa*, gene, with each individual number within this range of between 71% and 89% and 91% and 99% also being part of the invention, wherein said gene comprises an ORF comprising a nucleic acid sequence selected from the group consisting of SEQ ID NOs: 1-398 and 5928-5939 (constitutively expressed ORFs), SEQ ID NOs:399-464 (green-specific ORFs); SEQ ID NOs:465-720 (panicle-specific ORFs), SEQ ID NOs:721-800 (pollen-specific ORFs), SEQ ID NOs:801-1019 (root-specific ORFs), SEQ ID NOs:1020-1597, 5927, 5940, 5941, 5945-5958 (seed-specific ORFs), and a fragment (portion) thereof which encodes a polypeptide which has substantially the same activity as the corresponding polypeptide encoded by an ORF listed in SEQ ID NOs: 1-398 and 5928-5939; SEQ ID NOs: 399-464, SEQ ID NOs: 465-720, SEQ ID NOs:721-800, SEQ ID NOs:801-1019, and SEQ ID NOs:1020-1597, 5927, 5940, 5941, 5945-5958.

In another embodiment, a plant nucleotide sequence is the promoter sequence for a gene, and preferably is obtained or obtainable from a gene, which is substantially similar, and preferably has at least 70%, or more, e.g., between 71% and 89%, and even 90% or more, e.g., between 91% and 99%, nucleic acid sequence identity to an *Oryza* gene, with each individual number within this range of between 71% and 89% and 91% and 99% also being part of the invention, wherein said gene comprises a nucleic acid sequence selected from the group consisting of SEQ ID NOs:2275-2672, 5959, 5972, 5973, 5977-5990 and 6001, SEQ ID NOs:2144-2274, SEQ ID NOs:1886-1918, SEQ ID NOs:1919-2085, SEQ ID NOs: 2086-2143, SEQ ID NOs: 1598-1885 and 5960-5971, and a fragment (portion) thereof which has substantially the same promoter activity as the corresponding promoter listed in SEQ ID NOs:2275-2672, 5959, 5972, 5973, 5977-5990 and 6001, SEQ ID NOs:2144-2274, SEQ ID NOs:1886-1918, SEQ ID NOs: 1919-2085, SEQ ID NOs:2086-2143, and SEQ ID NOs: 1598-1885 and 5960-5971.

In another embodiment the invention relates to a nucleotide sequence for a promoter, which is preferably obtained or obtainable from plant genomic DNA, from a gene comprising an ORF which is substantially similar, and preferably has at least 70% or more, e.g., between 71% and 89%, and even 90% or more, e.g., between 91% and 99%, nucleic acid sequence identity, to an *Oryza* gene, with each individual number within this range of between 71% and 89% and 91% and 99% also being part of the invention, wherein said gene comprises an ORF comprising one of the sequences selected from the group consisting of SEQ ID NOs: 1-398 and 5928-5939; SEQ ID NOs: 399-464, SEQ ID NOs:465-720, SEQ ID NOs:721-800, SEQ ID NOs:801-1019, SEQ ID NOs:1020-1597, 5927, 5940, 5941, 5945-5958, and a fragment (portion) thereof which encodes a polypeptide which has substantially the same activity as the corresponding polypeptide encoded by an ORF listed in SEQ ID NOs: 1-398; SEQ ID NOs: 399-464, SEQ ID NOs:465-720, SEQ ID NOs:721-800, SEQ ID NOs: 801-1019, and SEQ ID NOs:1020-1597, 5927, 5940, 5941, 5945-5958.

Hence, the isolated nucleic acid molecules of the invention include the orthologs of the *Oryza* sequences disclosed herein, i.e., the corresponding nucleotide sequences in organisms other than *Oryza*, including, but not limited to, plants other than *Oryza*, preferably cereal plants, e.g., corn, wheat, rye, turfgrass, sorghum, millet, sugarcane, barley and banana, but also non-cereal plants, e.g., alfalfa, sunflower, canola, soybean, cotton, peanut, tobacco or sugarbeet. An orthologous gene is a gene from a different species that encodes a product having the same or similar function, e.g., catalyzing the same reaction as a product encoded by a gene from a reference organism. Thus, an ortholog includes polypeptides having less than, e.g., 65% amino acid sequence identity, but which ortholog encodes a polypeptide having the same or similar function. Databases such GenBank may be employed to identify sequences related to the *Oryza* sequences, e.g., orthologs in cereal crops such as wheat and other cereals. Alternatively, recombinant DNA techniques such as hybridization or PCR may be employed to identify sequences related to the *Oryza* sequences or to clone the equivalent sequences from different *Oryza* DNAs. For example, SEQ ID NOs:2673-4708, SEQ ID NOs: 4768-5229, and SEQ ID NOs:5230-5926, which represent wheat, banana and maize orthologs of some of the rice sequences disclosed herein. The encoded ortholog products likely have at least 70% sequence identity to each other. Hence, the invention includes an isolated nucleic acid molecule comprising a nucleotide sequence from a gene that encodes a polypeptide having at least 70% identity to a polypeptide encoded by a gene having one or more of the *Oryza* sequences disclosed herein. For example, promoter sequences within the scope of the invention are those which direct expression of an open reading frame which encodes a polypeptide that is substantially similar to an *Oryza* polypeptide encoded by a gene having a promoter selected from the group consisting of SEQ ID NOs:1598-2672, 5959, 5972, 5973, 5977-5990 and 6001.

Preferably, the promoters of the invention include a consecutive stretch of about 25 to 2000, including 50 to 500 or 100 to 250, and up to 1000 or 1500, contiguous nucleotides, e.g., 40 to about 743, 60 to about 743, 125 to about 743, 250 to about 743, 400 to about 743, 600 to about 743, of any one of SEQ ID NOs:1598-2672, 5959, 5972, 5973, 5977-5990 and 6001, or the promoter orthologs thereof, which include the minimal promoter region.

In a particular embodiment of the invention said consecutive stretch of about 25 to 2000, including 50 to 500 or 100 to 250, and up to 1000 or 1500, contiguous nucleotides, e.g., 40 to about 743, 60 to about 743, 125 to about 743, 250 to about 743, 400 to about 743, 600 to about 743, has at least 75%, preferably 80%, more preferably 90% and most preferably 95%, nucleic acid sequence identity with a corresponding consecutive stretch of about 25 to 2000, including 50 to 500 or 100 to 250, and up to 1000 or 1500, contiguous nucleotides, e.g., 40 to about 743, 60 to about 743, 125 to about 743, 250 to about 743, 400 to about 743, 600 to about 743, of any one of SEQ ID NOs:1598-2672, 5959, 5972, 5973, 5977-5990 and 6001, or the promoter orthologs thereof, which include the minimal promoter region. The above defined stretch of contiguous nucleotides preferably comprises one or more promoter motifs selected from the group consisting of TATA box, GC-box, CAAT-box and a transcription start site.

In case of promoters directing tissue-specific transcription of a linked nucleic acid segment in a plant or plant cell such as, for example, a promoter directing root-specific, green tissue (leaf and stem)-specific, seed-specific, panicle-specific, pollen-specific, etc., transcription, it is further preferred that previously defined stretch of contiguous nucleotides comprises further motifs that participate in the tissue specificity of said stretch(es) of nucleotides, e.g., for seed-specific promoters, motifs selected from the group consisting of the P box and GCNA elements, including but not limited to TGTAAAG and TGA(G/C)TCA.

The invention also provides an isolated nucleic acid molecule, e.g., DNA or RNA, comprising a plant nucleotide sequence comprising an open reading frame that is preferentially expressed in a specific plant tissue, i.e., in seeds, roots, green tissue (leaf and stem), panicle or pollen, or is expressed constitutively.

One embodiment the invention provides
(a) an isolated nucleic acid molecule, e.g., DNA or RNA, comprising a plant nucleotide sequence comprising an ORF that is constitutively expressed or preferentially expressed in a specific plant tissue, i.e., in seeds, roots, green tissue (leaf and stem), panicle or pollen and which is capable of hybridizing and thus substantially similar, and preferably has at least 70% or more, e.g., between 71% and 89%, and even 90% or more, e.g., between 91% and 99%, nucleic acid sequence identity, to an ORF expressed in a constitutive (e.g., an ORF comprising one of SEQ ID NOs:1-398 and 5928-5939) or in a tissue-specific or tissue-preferential manner, for example, in a seed-specific (or seed-preferential) manner, e.g., an ORF comprising one of SEQ ID NOs:1020-1597; 5927, 5940, 5941, 5945-5958
  (i) a root-specific (or root-preferential) manner, e.g., an ORF comprising one of SEQ ID NOs:801-1019;
  (ii) a green tissue (leaf and stem)-specific (or green tissue (leaf and stem)-preferential) manner, e.g., an ORF comprising one of SEQ ID NOs:399-464;
  (iii) a panicle-specific (or panicle-preferential) manner, e.g., an ORF comprising one of SEQ ID NOs:465-720; or
  (iv) a pollen-specific (or pollen-preferential) manner, e.g., an ORF comprising one of SEQ ID NOs:721-800; or
(b) a part thereof still encoding a partial-length polypeptide having substantially the same activity as the full-length polypeptide encoded by an ORF listed in SEQ ID NOs.1-398, and 5928-5939 and 399-1597, 5927, 5940, 5941, 5945-5958., e.g., at least 50%, more preferably at least 80%, even more preferably at least 90% to 95% the activity of the full-length polypeptide;
(c) the complement or reverse complement thereof.

The invention also provides
(a) an isolated nucleic acid molecule, e.g., DNA or RNA, comprising a plant nucleotide sequence comprising an ORF that is constitutively expressed or preferentially expressed in a specific plant tissue, i.e., in seeds, roots, green tissue (leaf and stem), panicles or pollen and which encodes a polypeptide that is capable of hybridising and thus substantially similar, and preferably has at least 70% or more, e.g., between 71% and 89%, and even 90% or more, e.g., between 91% and 99%, amino acid sequence identity, to a polypeptide encoded by an *Oryza* gene with each individual number within this range of between 71% and 89% and 91% and 99% also being part of the invention, wherein said gene comprises an ORF comprising any one of the sequences selected from the group consisting of SEQ ID NOs: 1-398, and 5928-5939 (constitutive); SEQ ID NOs: 399-464 (green-tissue), SEQ ID NOs:465-720 (specific); SEQ ID NOs:721-800 (pollen); SEQ ID NOs:801-1019 (root); and SEQ ID NOs:1026-1597, 5927, 5940, 5941, 5945-5958 (seed),
(b) the complement or reverse complement thereof, and
(c) a fragment thereof still encoding a partial-length polypeptide having substantially the same activity as the full-length polypeptide encoded by an ORF listed in SEQ ID NOs.1-398 and 5928-5939 and 399-1597, 5927, 5940, 5941, 5945-5958, e.g., at least 50%, more preferably at least 80%, even more preferably at least 90% to 95% the activity of the full-length polypeptide The invention also provides
(a) an isolated nucleic acid molecule, e.g., DNA or RNA, comprising a plant nucleotide sequence comprising an ORF that is constitutively expressed or preferentially expressed in a specific plant tissue, i.e., in seeds, roots, green tissue (leaf and stem), panicles or pollen and which encodes a polypeptide that is capable of hybridizing and thus substantially similar, and preferably has at least 70% or more, e.g., between 71% and 89%, and even 90% or more, e.g., between 91% and 99%, amino acid sequence identity, to a polypeptide encoded by an *Oryza* gene with each individual number within this range of between 71% and 89% and 91% and 99% also being part of the invention, wherein said gene comprises a promoter sequence as given in any one of the sequences selected from the group consisting of SEQ ID NOs: 1598-1885 and 5960-5971, SEQ ID NOs: 1886-1918, SEQ ID NOs:1919-2085, SEQ ID NOs:2086-2143, SEQ ID NOs:2144-2274, and SEQ ID NOs:2275-2672, 5959, 5972, 5973, 5977-5990 and 6001
(b) the complement or reverse complement thereof, and
(c) a fragment thereof having substantially the same activity as the corresponding promoter listed in SEQ ID NOs: SEQ ID NOs: 1598-1885, 5960-5971 and 1886-2672, 5959, 5972, 5973, 5977-5990 and 6001 respectively, e.g., at least 50%, more preferably at least 80%, even more preferably at least 90% to 95% of the activity.

The invention also provides
(a) an isolated nucleic acid molecule, e.g., DNA or RNA, comprising a plant nucleotide sequence comprising an ORF that is constitutively or preferentially expressed in a specific plant tissue, i.e., in seeds, roots, green tissue (leaf and stem), panicles or pollen and which is capable of hybridizing and thus substantially similar, and preferably has at least 70% or more, e.g., between 71% and 89%, and even 90% or more, e.g., between 91% and 99%, nucleic acid sequence identity, to an *Oryza* gene with each individual number within this range of between 71% and 89% and 91% and 99% also being part of the invention, wherein said gene is an ORF expressed in a constitutive or a tissue-specific or tissue-preferential manner and comprises a promoter as given in any one of the sequences selected from the group consisting of SEQ ID NOs: 1598-1885 and 5960-5971; SEQ ID NOs: 1886-1918, SEQ ID NOs:1919-2085; SEQ ID NOs: 2086-2143; SEQ ID NOs:2144-2274; and SEQ ID NOs: 2275-2672, 5959, 5972, 5973, 5977-5990 and 6001
(b) the complement or reverse complement thereof, and
(c) and a fragment thereof having substantially the same activity as the corresponding promoter listed in SEQ ID NOs: 1598-1885, 5960-5971 and SEQ ID NOs:1886-2672, 5959, 5972, 5973, 5977-5990 and 6001 respectively, e.g., at least 50%, more preferably at least 80%, even more preferably at least 90% to 95% of the activity.

ORFs which are expressed in a constitutive or in tissue-specific or -preferential manner, may be useful to prepare plants that over- or under-express the encoded polypeptide product or to prepare knockout plants.

The promoters and open reading frames of the invention can be identified by employing an array of nucleic acid samples, e.g., each sample having a plurality of oligonucleotides, and each plurality corresponding to a different plant gene, on a solid substrate, e.g., a DNA chip, and probes corresponding to nucleic acid expressed in, for example, one or more plant tissues and/or at one or more developmental stages, e.g., probes corresponding to nucleic acid expressed in seed of a plant relative to control nucleic acid from sources other than seed. Thus, genes that are upregulated or downregulated in the majority of tissues at a majority of developmental stages, or upregulated or downregulated in one tissue such as in seed, can be systematically identified.

As described herein, GENECHIP® technology was utilized to discover rice genes that are preferentially (or exclusively) expressed in seed, pollen, specific, root or green tissue, as well as those that are constitutively expressed. Specifically, labeled rice cRNA probes were hybridized to the rice DNA array, expression levels were determined by laser scanning and then rice genes were identified that had a particular expression pattern. The rice oligonucleotide probe array consists of probes from over 18,000 unique rice genes, which covers approximately 40-50% of the genome. This genome array permits a broader, more complete and less biased analysis of gene expression. Using this approach, 812 genes were identified, the expression of which was altered, e.g., specifically elevated, in seed tissues and 367 genes were identified that were preferentially expressed in endosperm, 91 genes were identified that were preferentially expressed in embryo, and 137 genes were identified that were preferentially expressed in aleurone; 618 genes were identified that were constitutively expressed; 335 genes were identified that were specifically or preferentially expressed in panicle; 265 genes were identified that were specifically or preferentially expressed in root tissue, 80 genes were identified that were specifically or preferentially expressed in pollen; and 90 genes were identified that were specifically or preferentially expressed in leaf and/or stem tissue.

Generally, the promoters of the invention may be employed to express a nucleic acid segment that is operably linked to said promoter such as, for example, an open reading frame, or a portion thereof, an anti-sense sequence, or a transgene in plants. The open reading frame may be obtained from an insect resistance gene, a disease resistance gene such as, for example, a bacterial disease resistance gene, a fungal disease resistance gene, a viral disease resistance gene, a nematode disease resistance gene, a herbicide resistance gene, a gene affecting grain composition or quality, a nutrient utilization gene, a mycotoxin reduction gene, a male sterility gene, a selectable marker gene, a screenable marker gene, a negative selectable marker, a positive selectable marker, a gene affecting plant agronomic characteristics, i.e., yield, standability, and the like, or an environment or stress resistance gene, i.e., one or more genes that confer herbicide resistance or tolerance, insect resistance or tolerance, disease resistance or tolerance (viral, bacterial, fungal, oomycete, or nematode), stress tolerance or resistance (as exemplified by resistance or tolerance to drought, heat, chilling, freezing, excessive moisture, salt stress, or oxidative stress), increased yields, food content and makeup, physical appearance, male sterility, drydown, standability, prolificacy, starch properties or quantity, oil quantity and quality, amino acid or protein composition, and the like. By "resistant" is meant a plant which exhibits substantially no phenotypic changes as a consequence of agent administration, infection with a pathogen, or exposure to stress. By "tolerant" is meant a plant which, although it may exhibit some phenotypic changes as a consequence of infection, does not have a substantially decreased reproductive capacity or substantially altered metabolism.

In particular, seed-specific promoters may be useful for expressing genes as well as for producing large quantities of protein, for expressing oils or proteins of interest, e.g., antibodies, genes for increasing the nutritional value of the seed and the like. Panicle-specific, root-specific, and pollen-specific promoters may be useful for expressing genes that confer pathogen-resistance, e.g., insect resistance, to those tissues, or to silence other genes that are expressed in those tissues.

For instance, pollen-specific promoters may be employed to introduce genes into pollen for the purpose of arresting pollen development thereby rendering a plant male sterile. Such genes may include those coding for proteins toxic to pollen. It is also contemplated that chimeric plasmids may be constructed which allow the expression of antisense mRNAs which are capable of inhibiting expression of genes which play a role in pollen development. It is also contemplated that expression cassettes or vectors of the present invention which comprise a pollen-specific promoter may be useful for the introduction of one or more useful phenotypic characteristics into pollen including but not limited to pesticide resistance, resistance to insect pests or toxicity to insect pests, or which optimize other pollen functions. One embodiment the invention comprises genetic manipulation of plants to potentiate the effects of gibberellin or other hormones involved in initiation of fruit set. The invention comprises the temporal expression of a structural gene which encodes a plant hormone such as a gibberellin or cytokine, or proteins associated with the production of such hormones (i.e., enzymes, biosynthetic intermediates and the like.) which are associated with initiation of fruit set. The structural gene is placed under the control of a pollen microspore- or megaspore-specific promoter such that the expression of the hormone is timed to occur just prior to pollination so that fruit development and maturation is induced without the need for fertilization.

Root-specific promoters may be useful for expressing genes including but not limited to defense-related genes, including genes conferring insecticidal resistance and stress tolerance, e.g., salt, cold or drought tolerance, genes for altering nutrient uptake and genes that are involved with specific morphological traits that allow for increased water absorption, uptake or extraction from soil, e.g., soil of low moisture content. For example, introduction and expression of genes that alter root characteristics may enhance water uptake. Additionally, the use of root-specific promoters in transgenic plants can provide beneficial traits that are localized in the consumable (by animals and humans) roots of plants such as carrots, parsnips, and beets. However, other parts of the plants, including stalks, husks, vegetative parts, and the like, may also be desirable, including use as part of animal silage or for ornamental purposes. Often chemical constituents (e.g., oils or starches) of maize and other crops are extracted for foods or industrial use and transgenic plants may be created which have enhanced or modified levels of such components.

Green tissue-specific promoters may be useful for expressing genes including but not limited to genes involved in photosynthetic pathways, and for those which are leaf-specific, for producing large quantities of protein, and for expressing oils or proteins of interest, genes for increasing the nutritional value of a plant, and defense-related genes (e.g., against pathogens such as a virus or fungus), including genes encoding insecticidal polypeptides.

Panicle-specific promoters may be useful for expressing genes including but not limited to genes involved in flower development and flowering such as MADS-box genes that, when expressed in transgenic plants, result in such phenotypes as, for example, reduced apical dominance or dwarfism and early flowering.

Constitutive promoters are useful for expressing a wide variety of genes including those which alter metabolic pathways, confer disease resistance, for protein production, e.g., antibody production, or to improve nutrient uptake and the like. Constitutive promoters may be modified so as to be regulatable, e.g., inducible. The genes and promoters described hereinabove can be used to identify orthologous genes and their promoters which are also likely expressed in a particular tissue and/or development manner. Moreover, the orthologous promoters are useful to express linked open reading frames. In addition, by aligning the promoters of these orthologs, novel cis elements can be identified that are useful to generate synthetic promoters.

The present invention further provides a composition, an expression cassette or a recombinant vector containing the nucleic acid molecule of the invention, and host cells comprising the expression cassette or vector, e.g., comprising a plasmid. In particular, the present invention provides an expression cassette or a recombinant vector comprising a promoter of the invention linked to a nucleic acid segment which, when present in a plant, plant cell or plant tissue, results in transcription of the linked nucleic acid segment. The invention also provides an expression cassette or a recombinant vector comprising a plant nucleotide sequence comprising an open reading frame of the invention which, when present in a plant, plant cell or plant tissue, results in expression of the product encoded by the open reading frame. Further, the invention provides isolated polypeptides encoded by any one of the open reading frames comprising SEQ ID NOs:1-1597, 5927, 5940, 5941, 5945-5958, a fragment thereof which encodes a polypeptide which has substantially the same activity as the corresponding polypeptide encoded by an ORF listed in SEQ ID NOs:1-1597, 5927, 5940, 5941, 5945-5958, or the orthologs thereof.

The invention also provides sense and anti-sense nucleic acid molecules corresponding to the open reading frames identified in SEQ ID NOs:1-1597, 5927, 5940, 5941, 5945-5958 as well as their orthologs. Also provided are compositions, expression cassettes, e.g., recombinant vectors, and host cells, comprising a nucleic acid molecule which comprises a nucleic acid segment which is preferentially expressed in seeds (e.g., SEQ ID NOs:1020-1597, 5927, 5940, 5941, 5945-5958), root (SEQ ID NOs:801-1019), pollen (SEQ ID NOs:721-800), specific (SEQ ID NOs:465-720), or green tissue (SEQ ID NOs:399-464), or constitutively expressed (SEQ ID NOs:1-398 and 5928-5939), in either sense or antisense orientation.

In one embodiment, the invention provides an expression cassette or vector containing an isolated nucleic acid molecule having a nucleotide sequence that directs tissue-specific, tissue-preferential or constitutive transcription of a linked nucleic acid segment in a cell, which nucleotide sequence is from a gene which encodes a polypeptide having at least 70% identity to an *Oryza* polypeptide encoded by a gene having one of the promoters listed in SEQ ID NOs:1598-2672, 5959, 5972, 5973, 5977-5990 and 6001, and which nucleotide sequence is optionally operably linked to other suitable regulatory sequences, e.g., a transcription terminator sequence, operator, repressor binding site, transcription factor binding site and/or an enhancer. This expression cassette or vector may be contained in a host cell. The expression cassette or vector may augment the genome of a transformed plant or may be maintained extrachromosomally. The expression cassette may be operatively linked to a structural gene, the open reading frame thereof, or a portion thereof. The expression cassette may further comprise a Ti plasmid and be contained in an *Agrobacterium tumefaciens* cell; it may be carried on a microparticle, wherein the microparticle is suitable for ballistic transformation of a plant cell; or it may be contained in a plant cell or protoplast. Further, the expression cassette or vector can be contained in a transformed plant or cells thereof, and the plant may be a dicot or a monocot. In particular, the plant may be a cereal plant.

The present invention further provides a method of augmenting a plant genome by contacting plant cells with a nucleic acid molecule of the invention, e.g., one having a nucleotide sequence that directs tissue-specific, tissue-preferential or constitutive transcription of a linked nucleic acid segment isolatable or obtained from a plant gene encoding a polypeptide that is substantially similar to a polypeptide encoded by the an *Oryza* gene having a sequence according to any one of SEQ ID NOs:1-2672, 5959, 5972, 5973, 5977-5990 and 6001 so as to yield transformed plant cells; and regenerating the transformed plant cells to provide a differentiated transformed plant, wherein the differentiated transformed plant expresses the nucleic acid molecule in the cells of the plant. The nucleic acid molecule may be present in the nucleus, chloroplast, mitochondria and/or plastid of the cells of the plant. The present invention also provides a transgenic plant prepared by this method, a seed from such a plant and progeny plants from such a plant including hybrids and inbreds. Preferred transgenic plants are transgenic maize, soybean, barley, alfalfa, sunflower, canola, soybean, cotton, peanut, sorghum, tobacco, sugarbeet, rice, wheat, rye, turfgrass, millet, sugarcane, tomato, or potato.

A transformed (transgenic) plant of the invention includes plants, the genome of which is augmented by a nucleic acid molecule of the invention, or in which the corresponding gene has been disrupted, e.g., to result in a loss, a decrease or an alteration, in the function of the product encoded by the gene, which plant may also have increased yields and/or produce a better-quality product than the corresponding wild-type plant. The nucleic acid molecules of the invention are thus useful for targeted gene disruption, as well as markers and probes.

The invention also provides a method of plant breeding, e.g., to prepare a crossed fertile transgenic plant. The method comprises crossing a fertile transgenic plant comprising a particular nucleic acid molecule of the invention with itself or with a second plant, e.g., one lacking the particular nucleic acid molecule, to prepare the seed of a crossed fertile transgenic plant comprising the particular nucleic acid molecule. The seed is then planted to obtain a crossed fertile transgenic plant. The plant may be a monocot or a dicot. In a particular embodiment, the plant is a cereal plant.

The crossed fertile transgenic plant may have the particular nucleic acid molecule inherited through a female parent or through a male parent. The second plant may be an inbred plant. The crossed fertile transgenic may be a hybrid. Also included within the present invention are seeds of any of these crossed fertile transgenic plants.

The present invention also provides a method to identify a nucleotide sequence that directs tissue-specific or tissue-preferential transcription of linked nucleic acid in the genome of a plant cell by contacting a probe of plant nucleic acid, e.g., cRNA from rice, isolated from various tissues of a plant, with a plurality of isolated nucleic acid samples on one or more, i.e., a plurality of, solid substrates so as to form a complex between at least a portion of the probe and a nucleic acid sample(s) having sequences that are structurally related to the sequences in the probe. Each sample comprises one or a plurality of oligonucleotides corresponding to at least a portion of a plant gene. Then complex formation is compared between samples contacted with a particular tissue, e.g., a seed-specific, probe and samples contacted with a different tissue, e.g., a non-seed specific probe, so as to determine which RNAs are expressed in the particular tissue of the plant. The probe and/or samples may be nucleic acid from a dicot or from a monocot.

The present invention also provides a method to identify a nucleotide sequence that directs constitutive transcription of nucleic acid in the genome of a plant cell by contacting a probe of plant nucleic acid, e.g., cRNA from rice, isolated from various tissues of a plant and at various developmental stages with a plurality of isolated nucleic acid samples on one or more, i.e., a plurality of, solid substrates so as to form a complex between at least a portion of the probe and a nucleic acid sample(s) having sequences that are structurally related to the sequences in the probe. Each sample comprises one or a plurality of oligonucleotides corresponding to at least a portion of a plant gene. Complex formation is then compared to determine which RNAs are present in a majority of, preferably in substantially all, tissues, in a majority of, preferably at substantially all, developmental stages of the plant. The probe and/or samples may be nucleic acid from a dicot or from a monocot.

The compositions of the invention include plant nucleic acid molecules, and the amino acid sequences for the polypeptides or partial-length polypeptides encoded by the nucleic acid molecule which comprises an open reading frame. These sequences can be employed to alter expression of a particular gene corresponding to the open reading frame by decreasing or eliminating expression of that plant gene or by overexpressing a particular gene product. Methods of this embodiment of the invention include stably transforming a plant with the nucleic acid molecule which includes an open reading frame operably linked to a promoter capable of driving expression of that open reading frame (sense or antisense) in a plant cell. By "portion" or "fragment", as it relates to a nucleic acid molecule which comprises an open reading frame or a fragment thereof encoding a partial-length polypeptide having the activity of the full length polypeptide, is meant a sequence having at least 80 nucleotides, more preferably at least 150 nucleotides, and still more preferably at least 400 nucleotides. If not employed for expressing, a "portion" or "fragment" means at least 9, preferably 12, more preferably 15, even more preferably at least 20, consecutive nucleotides, e.g., probes and primers (oligonucleotides), corresponding to the nucleotide sequence of the nucleic acid molecules of the invention. Thus, to express a particular gene product, the method comprises introducing to a plant, plant cell, or plant tissue an expression cassette comprising a promoter linked to an open reading frame so as to yield a transformed differentiated plant, transformed cell or transformed tissue. Transformed cells or tissue can be regenerated to provide a transformed differentiated plant. The transformed differentiated plant or cells thereof preferably expresses the open reading frame in an amount that alters the amount of the gene product in the plant or cells thereof, which product is encoded by the open reading frame. The present invention also provides a transformed plant prepared by the method, progeny and seed thereof.

The invention further includes a nucleotide sequence which is complementary to one (hereinafter "test" sequence) which hybridizes under stringent conditions with a nucleic acid molecule of the invention as well as RNA which is transcribed from the nucleic acid molecule. When the hybridization is performed under stringent conditions, either the test or nucleic acid molecule of invention is preferably supported, e.g., on a membrane or DNA chip. Thus, either a denatured test or nucleic acid molecule of the invention is preferably first bound to a support and hybridization is effected for a specified period of time at a temperature of, e.g., between 55 and 70° C., in double strength citrate buffered saline (SC) containing 0.1% SDS followed by rinsing of the support at the same temperature but with a buffer having a reduced SC concentration. Depending upon the degree of stringency required such reduced concentration buffers are typically single strength SC containing 0.1% SDS, half strength SC containing 0.1% SDS and one-tenth strength SC containing 0.1% SDS.

A computer readable medium containing one or more of the nucleotide sequences of the invention as well as methods of use for the computer readable medium are provided. This medium allows a nucleotide sequence corresponding to at least one of SEQ ID NOs:1598-2672, 5959, 5972, 5973, 5977-5990 and 6001 (promoters), SEQ ID NOs:1-1597, 5927, 5940, 5941, 5945-5958 and 2673-5926 (orthologous open reading frames of wheat, banana and maizeor fragments thereof), to be used as a reference sequence to search against a database. This medium also allows for computer-based manipulation of a nucleotide sequence corresponding to at least one of SEQ ID NOs:1-60001.

BRIEF DESCRIPTION OF THE TABLES

Table 1 provides the SEQ ID NOs and corresponding description for *Oryza* genes which are expressed in a constitutive manner and further the SEQ ID NOs for the corresponding homologous sequences found in wheat, banana and maize.

* identifies a first subset of genes.
*" identifies a $2^{nd}$ subset of genes.

Three subgroups of constitutively expressed genes can be distinguished based on the expression level of those genes. The levels are ranked from highest (1) to lowest (3). For example, promoters with the highest level of constitutive expression include those having an open reading frame corresponding to SEQ ID NOs:1-24, the next highest include those having an open reading frame corresponding to SEQ ID NOs:25-142, the next highest include those having an open reading frame corresponding to SEQ ID NOs:143-293, and the lowest include those having an open reading frame corresponding to SEQ ID NOs:294-398 and 5928-5939.

Table 2 provides the SEQ ID NOs: and corresponding description for *Oryza* genes which are expressed in a seed-specific manner and further the SEQ ID NOs for the corresponding homologous sequences found in wheat, banana and maize.

Six subgroups of seed-specific genes can be distinguished based on the expression level of those genes. The levels are ranked from highest (1) to lowest (6). For example, promoters with the highest level of seed-specific expression include those from a gene having an open reading frame corresponding to SEQ ID NOs:1020-1021, the next highest include those from a gene having an open reading frame corresponding to SEQ ID NOs:1022-1025, the next highest include those from a gene having an open reading frame corresponding to SEQ ID NOs:1026-1030, the next highest include those from a gene having an open reading frame corresponding to SEQ ID NOs:1031-1048, the next highest include those from a gene having an open reading frame corresponding to SEQ ID NOs: 1049-1165 and the lowest include those from a gene having an open reading frame corresponding to SEQ ID NOs:1166-1597, 5927, 5940, 5941, 5945-5958.

Table 3 provides the SEQ ID NOs: and corresponding description for *Oryza* genes which are expressed in an aleurone-specific manner and further the SEQ ID NOs for the corresponding homologous sequences found in wheat, banana and maize.

Table 4 provides the SEQ ID NOs: and corresponding description for *Oryza* genes which are expressed in an endosperm-specific manner and further the SEQ ID NOs for the corresponding homologous sequences found in wheat, banana and maize.

Table 5 provides the SEQ ID NOs: and corresponding description for *Oryza* genes which are expressed in an embryo-specific manner and further the SEQ ID NOs for the corresponding homologous sequences found in wheat, banana and maize.

Table 6 provides the SEQ ID NOs: and corresponding description for *Oryza* genes which are expressed in a leaf- and stem-specific manner and further the SEQ ID NOs for the corresponding homologous sequences found in wheat, banana and maize.

Four subgroups of leaf- and stem-specific genes can be distinguished based on the expression level of those genes. The levels are ranked from highest (1) to lowest (4). For example, promoters with the highest level of leaf and stem-specific expression include those from a gene having an open reading frame corresponding to SEQ ID NOs:399-404, the next highest include those from a gene having an open reading frame corresponding to SEQ ID NOs:405-416, the next highest include those from a gene having an open reading frame corresponding to SEQ ID NOs:417-456, and the lowest include those from a gene having an open reading frame corresponding to SEQ ID NOs:457-464.

Table 7 provides the SEQ ID NOs: and corresponding description for *Oryza* genes which are expressed in a panicle-specific manner and further the SEQ ID NOs for the corresponding homologous sequences found in wheat, banana and maize.

Three subgroups of panicle-specific genes can be distinguished based on the expression level of those genes. The levels are ranked from highest (1) to lowest (3). For example, promoters with the highest level of panicle-specific expression include those from a gene having an open reading frame corresponding to SEQ ID NOs:465-469, the next highest include those from a gene having an open reading frame corresponding to SEQ ID NOs:470-535, and the lowest include those from a gene having an open reading frame corresponding to SEQ ID NOs:536-720.

Table 8 provides the SEQ ID NOs: and corresponding description for *Oryza* genes which are expressed in a root-specific manner and further the SEQ ID NOs for the corresponding homologous sequences found in wheat, banana and maize.

Four subgroups of root-specific genes can be distinguished based on the expression level of those genes. The levels are ranked from highest (1) to lowest (4). For example, promoters with the highest level of root-specific expression include those from a gene having an open reading frame corresponding to SEQ ID NOs:801-809, the next highest include those from a gene having an open reading frame corresponding to SEQ ID NOs:810-846, the next highest include those from a gene having an open reading frame corresponding to SEQ ID NOs:847-885, and the lowest include those from a gene having an open reading frame corresponding to SEQ ID NOs:886-1019.

Table 9 provides the SEQ ID NOs: and corresponding description for *Oryza* genes which are express in a pollen-specific manner and further the SEQ ID NOs for the corresponding homologous sequences found in wheat, banana and maize.

Three subgroups of pollen-specific genes can be distinguished based on the expression level of those genes. The levels are ranked from highest (1) to lowest (3). For example, promoters with the highest level of pollen-specific expression include those from a gene having an open reading frame corresponding to SEQ ID NOs:721-728, the next highest include those from a gene having an open reading frame corresponding to SEQ ID NOs:729-743, and the lowest include those from a gene having an open reading frame corresponding to SEQ ID NOs:744-800.

Table 10 identifies the start and end point and the nucleotide sequences of tri-nucleotide repeat units in the coding sequence of selected ORFs.

Table 11 provides Swiss Prot information.

Table 12 illustrates the promoter designation, probe set or gene, gene description, PCR product size for a promoter containing PCR product and primers employed to amplify promoter sequences, for exemplary constitutively expressed promoters.

DETAILED DESCRIPTION OF THE INVENTION

In accordance with the present invention, nucleic acid constructs are provided that allow initiation of transcription in a "tissue-specific", i.e., seed-, root-, green tissue (leaf and stem)-, panicle-, or pollen-specific, or in a constitutive manner. Constructs of the invention comprise regulated transcription initiation regions associated with protein translation elongation, and the compositions of the present invention are drawn to novel nucleotide sequences for tissue-specific as well as constitutive expression. The present invention thus provides for isolated nucleic acid molecules comprising a plant nucleotide sequence that directs tissue-specific, i.e., seed-, root-, green tissue (leaf and stem)-, panicle-, or pollen-specific, transcription of a linked nucleic acid segment in a plant cell. Preferably, nucleotide sequence is obtained or obtainable from plant genomic DNA from a gene encoding a polypeptide which is substantially similar and preferably has at least 70% amino acid sequence identity to a polypeptide encoded by an *Oryza* gene comprising any one of SEQ ID NOs:2275-2672, 5959, 5972, 5973, 5977-5990 and 6001 (seed-specific promoters) and SEQ ID NOs:1020-1597, 5927, 5940, 5941, 5945-5958 (seed-specific ORFs); SEQ ID NOs:2144-2274 (root-specific promoters) and SEQ ID NOs: 801-1019 (root-specific ORFs); SEQ ID NOs:1886-1918 (green-tissue specific promoters) and SEQ ID NOs:399-464 (green tissue-specific ORFs); SEQ ID NOs:1919-2085 (panicle-specific promoters) and SEQ ID NOs:465-720 (panicle-specific promoters); or SEQ ID NOs:2086-2143 (pollen-specific promoters) and SEQ ID NOs:721-800 (pollen-specific ORFs) which directs tissue-specific expression. Thus, these nucleotide sequences exhibit promoter activity in a seed-, root-, green tissue (leaf and stem)-, panicle-, or pollen-specific manner.

Also in accordance with the present invention, nucleic acid constructs are provided that allow initiation of transcription in a "tissue-independent," "tissue general," or "constitutive" manner. Constructs of this embodiment invention comprise regulated transcription initiation regions associated with protein translation elongation and the compositions of this embodiment of the present invention are drawn to novel nucleotide sequences for tissue-independent, tissue-general, or constitutive plant promoters. By "tissue-independent," "tissue-general," or "constitutive" is intended expression in the cells throughout a plant at most times and in most tissues. As with other promoters classified as "constitutive" (e.g., ubiquitin), some variation in absolute levels of expression can exist among different tissues or stages. However, constitutive promoters generally are expressed at high or moderate levels in most, and preferably all, tissues and most, and preferably all, developmental stages.

The present invention thus provides for isolated nucleic acid molecules comprising a plant nucleotide sequence that directs constitutive transcription of a linked nucleic acid fragment in a plant cell. Preferably, the nucleotide sequence is obtained or obtainable from plant genomic DNA from a gene encoding a polypeptide which is substantially similar and preferably has at least 70% amino acid sequence identity to a polypeptide encoded by an Oryza gene comprising any one of SEQ ID NOs:1598-1885 and 5960-5971, respectively (corresponding to a gene comprising an ORF comprising one of SEQ ID NOs:1-398 and 5928-5939) or a fragment thereof which exhibits promoter activity in a constitutive fashion (i.e., at most times and in most tissues). Tissue-specific, i.e., seed-, root-, green tissue (leaf and stem)-, panicle-, or pollen-specific, and constitutive promoter sequences may be obtained from other plant species by using the tissue-specific and constitutive Oryza promoter sequences or corresponding genes described herein as probes to screen for homologous structural genes in other plants by hybridization under low, moderate or stringent hybridization conditions. Regions of the tissue-specific and constitutive promoter sequences of the present invention which are conserved among species could also be used as PCR primers to amplify a segment from a species other than Oryza, and that segment used as a hybridization probe (the latter approach permitting higher stringency screening) or in a transcription assay to determine promoter activity. Moreover, the tissue-specific and constitutive promoter sequences could be employed to identify structurally related sequences in a database using computer algorithms.

These tissue-specific and constitutive promoters are capable of driving the expression of a coding sequence in a target cell, particularly in a plant cell. The promoter sequences and methods disclosed herein are useful in regulating tissue-specific and constitutive expression, respectively, of any heterologous nucleotide sequence in a host plant in order to vary the phenotype of that plant. These promoters can be used with combinations of enhancer, upstream elements, and/or activating sequences from the 5' flanking regions of plant expressible structural genes. Similarly the upstream element can be used in combination with various plant promoter sequences. In one embodiment the promoter and upstream element are used together to obtain at least 10-fold higher expression of an introduced gene in monocot transgenic plants than is obtained with the maize ubiquitin 1 promoter.

In particular, all of the promoters of the invention are useful to modify the phenotype of a plant. Various changes in the phenotype of a transgenic plant are desirable, i.e., modifying the fatty acid composition in a plant, altering the amino acid content of a plant, altering a plant's pathogen defense mechanism, and the like. These results can be achieved by providing expression of heterologous products or increased expression of endogenous products in plants. Alternatively, the results can be achieved by providing for a reduction of expression of one or more endogenous products, particularly enzymes or cofactors in the plant. These changes result in an alteration in the phenotype of the transformed plant.

I. DEFINITIONS

The term "gene" is used broadly to refer to any segment of nucleic acid associated with a biological function. Thus, genes include coding sequences and/or the regulatory sequences required for their expression. For example, gene refers to a nucleic acid fragment that expresses mRNA or functional RNA, or encodes a specific protein, and which includes regulatory sequences. Genes also include nonexpressed DNA segments that, for example, form recognition sequences for other proteins. Genes can be obtained from a variety of sources, including cloning from a source of interest or synthesizing from known or predicted sequence information, and may include sequences designed to have desired parameters.

The term "native" or "wild type" gene refers to a gene that is present in the genome of an untransformed cell, i.e., a cell not having a known mutation.

A "marker gene" encodes a selectable or screenable trait.

The term "chimeric gene" refers to any gene that contains 1) DNA sequences, including regulatory and coding sequences, that are not found together in nature, or 2) sequences encoding parts of proteins not naturally adjoined, or 3) parts of promoters that are not naturally adjoined. Accordingly, a chimeric gene may comprise regulatory sequences and coding sequences that are derived from different sources, or comprise regulatory sequences and coding sequences derived from the same source, but arranged in a manner different from that found in nature.

A "transgene" refers to a gene that has been introduced into the genome by transformation and is stably maintained. Transgenes may include, for example, genes that are either heterologous or homologous to the genes of a particular plant to be transformed. Additionally, transgenes may comprise native genes inserted into a non-native organism, or chimeric genes. The term "endogenous gene" refers to a native gene in its natural location in the genome of an organism. A "foreign" gene refers to a gene not normally found in the host organism but that is introduced by gene transfer.

An "oligonucleotide" corresponding to a nucleotide sequence of the invention, e.g., for use in probing or amplification reactions, may be about 30 or fewer nucleotides in length (e.g., 9, 12, 15, 18, 20, 21 or 24, or any number between 9 and 30). Generally specific primers are upwards of 14 nucleotides in length. For optimum specificity and cost effectiveness, primers of 16 to 24 nucleotides in length may be preferred. Those skilled in the art are well versed in the design of primers for use processes such as PCR. If required, probing can be done with entire restriction fragments of the gene disclosed herein which may be 100's or even 1000's of nucleotides in length.

The terms "protein," "peptide" and "polypeptide" are used interchangeably herein.

The nucleotide sequences of the invention can be introduced into any plant. The genes to be introduced can be conveniently used in expression cassettes for introduction and expression in any plant of interest. Such expression cassettes will comprise the transcriptional initiation region of the invention linked to a nucleotide sequence of interest. Preferred promoters include constitutive, tissue-specific, developmental-specific, inducible and/or viral promoters. Such an expression cassette is provided with a plurality of restriction sites for insertion of the gene of interest to be under the transcriptional regulation of the regulatory regions. The expression cassette may additionally contain selectable marker genes. The cassette will include in the 5'-3' direction of transcription, a transcriptional and translational initiation region, a DNA sequence of interest, and a transcriptional and translational termination region functional in plants. The termination region may be native with the transcriptional initiation region, may be native with the DNA sequence of interest, or may be derived from another source. Convenient termination regions are available from the Ti-plasmid of *A. tumefaciens*, such as the octopine synthase and nopaline synthase termination regions. See also, Guerineau et al., 1991; Proudfoot, 1991; Sanfacon et al., 1991; Mogen et al., 1990; Munroe et al., 1990; Ballas et al., 1989; Joshi et al., 1987.

"Coding sequence" refers to a DNA or RNA sequence that codes for a specific amino acid sequence and excludes the non-coding sequences. It may constitute an "uninterrupted coding sequence", i.e., lacking an intron, such as in a cDNA or it may include one or more introns bounded by appropriate splice junctions. An "intron" is a sequence of RNA which is contained in the primary transcript but which is removed through cleavage and re-ligation of the RNA within the cell to create the mature mRNA that can be translated into a protein.

The terms "open reading frame" and "ORF" refer to the amino acid sequence encoded between translation initiation and termination codons of a coding sequence. The terms "initiation codon" and "termination codon" refer to a unit of three adjacent nucleotides ('codon') in a coding sequence that specifies initiation and chain termination, respectively, of protein synthesis (mRNA translation).

A "functional RNA" refers to an antisense RNA, ribozyme, or other RNA that is not translated.

The term "RNA transcript" refers to the product resulting from RNA polymerase catalyzed transcription of a DNA sequence. When the RNA transcript is a perfect complementary copy of the DNA sequence, it is referred to as the primary transcript or it may be a RNA sequence derived from post-transcriptional processing of the primary transcript and is referred to as the mature RNA. "Messenger RNA" (mRNA) refers to the RNA that is without introns and that can be translated into protein by the cell. "cDNA" refers to a single- or a double-stranded DNA that is complementary to and derived from mRNA.

"Regulatory sequences" and "suitable regulatory sequences" each refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences include enhancers, promoters, translation leader sequences, introns, and polyadenylation signal sequences. They include natural and synthetic sequences as well as sequences which may be a combination of synthetic and natural sequences. As is noted above, the term "suitable regulatory sequences" is not limited to promoters.

"5' non-coding sequence" refers to a nucleotide sequence located 5' (upstream) to the coding sequence. It is present in the fully processed mRNA upstream of the initiation codon and may affect processing of the primary transcript to mRNA, mRNA stability or translation efficiency (Turner et al., 1995).

"3' non-coding sequence" refers to nucleotide sequences located 3' (downstream) to a coding sequence and include polyadenylation signal sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht et al., 1989.

The term "translation leader sequence" refers to that DNA sequence portion of a gene between the promoter and coding sequence that is transcribed into RNA and is present in the fully processed mRNA upstream (5') of the translation start codon. The translation leader sequence may affect processing of the primary transcript to mRNA, mRNA stability or translation efficiency.

"Signal peptide" refers to the amino terminal extension of a polypeptide, which is translated in conjunction with the polypeptide forming a precursor peptide and which is required for its entrance into the secretory pathway. The term "signal sequence" refers to a nucleotide sequence that encodes the signal peptide.

"Promoter" refers to a nucleotide sequence, usually upstream (5') to its coding sequence, which controls the expression of the coding sequence by providing the recognition for RNA polymerase and other factors required for proper transcription. "Promoter" includes a minimal promoter that is a short DNA sequence comprised of a TATA box and other sequences that serve to specify the site of transcription initiation, to which regulatory elements are added for control of expression. "Promoter" also refers to a nucleotide sequence that includes a minimal promoter plus regulatory elements that is capable of controlling the expression of a coding sequence or functional RNA. This type of promoter sequence consists of proximal and more distal upstream elements, the latter elements often referred to as enhancers. Accordingly, an "enhancer" is a DNA sequence which can stimulate promoter activity and may be an innate element of the promoter or a heterologous element inserted to enhance the level or tissue specificity of a promoter. It is capable of operating in both orientations (normal or flipped), and is capable of functioning even when moved either upstream or downstream from the promoter. Both enhancers and other upstream promoter elements bind sequence-specific DNA-binding proteins that mediate their effects. Promoters may be derived in their entirety from a native gene, or be composed of different elements derived from different promoters found in nature, or even be comprised of synthetic DNA segments. A promoter may also contain DNA sequences that are involved in the binding of protein factors which control the effectiveness of transcription initiation in response to physiological or developmental conditions.

The "initiation site" is the position surrounding the first nucleotide that is part of the transcribed sequence, which is also defined as position +1. With respect to this site all other sequences of the gene and its controlling regions are numbered. Downstream sequences (i.e., further protein encoding sequences in the 3' direction) are denominated positive, while upstream sequences (mostly of the controlling regions in the 5' direction) are denominated negative.

Promoter elements, particularly a TATA element, that are inactive or that have greatly reduced promoter activity in the absence of upstream activation are referred to as "minimal or core promoters." In the presence of a suitable transcription factor, the minimal promoter functions to permit transcription. A "minimal or core promoter" thus consists only of all basal elements needed for transcription initiation, e.g., a TATA box and/or an initiator.

"Constitutive expression" refers to expression using a constitutive or regulated promoter. "Conditional" and "regulated expression" refer to expression controlled by a regulated promoter.

"Constitutive promoter" refers to a promoter that is able to express the open reading frame (ORF) that it controls in all or nearly all of the plant tissues during all or nearly all developmental stages of the plant. Each of the transcription-activating elements do not exhibit an absolute tissue-specificity, but mediate transcriptional activation in most plant parts at a level of $\geq 1\%$ of the level reached in the part of the plant in which transcription is most active.

"Regulated promoter" refers to promoters that direct gene expression not constitutively, but in a temporally- and/or spatially-regulated manner, and includes both tissue-specific and inducible promoters. It includes natural and synthetic sequences as well as sequences which may be a combination of synthetic and natural sequences. Different promoters may direct the expression of a gene in different tissues or cell types, or at different stages of development, or in response to different environmental conditions. New promoters of various types useful in plant cells are constantly being discovered, numerous examples may be found in the compilation by Okamuro et al. (1989). Typical regulated promoters useful in plants include but are not limited to safener-inducible promoters, promoters derived from the tetracycline-inducible system, promoters derived from salicylate-inducible systems, promoters derived from alcohol-inducible systems, promoters derived from glucocorticoid-inducible system, promoters derived from pathogen-inducible systems, and promoters derived from ecdysome-inducible systems.

"Tissue-specific promoter" refers to regulated promoters that are not expressed in all plant cells but only in one or more cell types in specific organs (such as leaves or seeds), specific tissues (such as embryo or cotyledon), or specific cell types (such as leaf parenchyma or seed storage cells). These also include promoters that are temporally regulated, such as in early or late embryogenesis, during fruit ripening in developing seeds or fruit, in fully differentiated leaf, or at the onset of senescence.

"Inducible promoter" refers to those regulated promoters that can be turned on in one or more cell types by an external stimulus, such as a chemical, light, hormone, stress, or a pathogen.

"Operably-linked" refers to the association of nucleic acid sequences on single nucleic acid fragment so that the function of one is affected by the other. For example, a regulatory DNA sequence is said to be "operably linked to" or "associated with" a DNA sequence that codes for an RNA or a polypeptide if the two sequences are situated such that the regulatory DNA sequence affects expression of the coding DNA sequence (i.e., that the coding sequence or functional RNA is under the transcriptional control of the promoter). Coding sequences can be operably-linked to regulatory sequences in sense or antisense orientation.

"Expression" refers to the transcription and/or translation of an endogenous gene, ORF or portion thereof, or a transgene in plants. For example, in the case of antisense constructs, expression may refer to the transcription of the antisense DNA only. In addition, expression refers to the transcription and stable accumulation of sense (mRNA) or functional RNA. Expression may also refer to the production of protein.

"Specific expression" is the expression of gene products which is limited to one or a few plant tissues (spatial limitation) and/or to one or a few plant developmental stages (temporal limitation). It is acknowledged that hardly a true specificity exists: promoters seem to be preferably switch on in some tissues, while in other tissues there can be no or only little activity. This phenomenon is known as leaky expression. However, with specific expression in this invention is meant preferable expression in one or a few plant tissues.

The "expression pattern" of a promoter (with or without enhancer) is the pattern of expression levels which shows where in the plant and in what developmental stage transcription is initiated by said promoter. Expression patterns of a set of promoters are said to be complementary when the expression pattern of one promoter shows little overlap with the expression pattern of the other promoter. The level of expression of a promoter can be determined by measuring the 'steady state' concentration of a standard transcribed reporter mRNA. This measurement is indirect since the concentration of the reporter mRNA is dependent not only on its synthesis rate, but also on the rate with which the mRNA is degraded. Therefore, the steady state level is the product of synthesis rates and degradation rates.

The rate of degradation can however be considered to proceed at a fixed rate when the transcribed sequences are identical, and thus this value can serve as a measure of synthesis rates. When promoters are compared in this way techniques available to those skilled in the art are hybridization S1-RNAse analysis, northern blots and competitive RT-PCR. This list of techniques in no way represents all available techniques, but rather describes commonly used procedures used to analyze transcription activity and expression levels of mRNA.

The analysis of transcription start points in practically all promoters has revealed that there is usually no single base at which transcription starts, but rather a more or less clustered set of initiation sites, each of which accounts for some start points of the mRNA. Since this distribution varies from promoter to promoter the sequences of the reporter mRNA in each of the populations would differ from each other. Since each mRNA species is more or less prone to degradation, no single degradation rate can be expected for different reporter mRNAs. It has been shown for various eukaryotic promoter sequences that the sequence surrounding the initiation site ('initiator') plays an important role in determining the level of RNA expression directed by that specific promoter. This includes also part of the transcribed sequences. The direct fusion of promoter to reporter sequences would therefore lead to suboptimal levels of transcription.

A commonly used procedure to analyze expression patterns and levels is through determination of the 'steady state' level of protein accumulation in a cell. Commonly used candidates for the reporter gene, known to those skilled in the art are beta-glucuronidase (GUS), chloramphenicol acetyl transferase (CAT) and proteins with fluorescent properties, such as green fluorescent protein (GFP) from *Aequora victoria*. In principle, however, many more proteins are suitable for this purpose, provided the protein does not interfere with essential plant functions. For quantification and determination of localization a number of tools are suited. Detection systems can readily be created or are available which are based on, e.g., immunochemical, enzymatic, fluorescent detection and quantification. Protein levels can be determined in plant tissue extracts or in intact tissue using in situ analysis of protein expression.

Generally, individual transformed lines with one chimeric promoter reporter construct will vary in their levels of expression of the reporter gene. Also frequently observed is the phenomenon that such transformants do not express any detectable product (RNA or protein). The variability in expression is commonly ascribed to 'position effects', although the molecular mechanisms underlying this inactivity are usually not clear.

"Overexpression" refers to the level of expression in transgenic cells or organisms that exceeds levels of expression in normal or untransformed (nontransgenic) cells or organisms.

"Antisense inhibition" refers to the production of antisense RNA transcripts capable of suppressing the expression of protein from an endogenous gene or a transgene.

"Gene silencing" refers to homology-dependent suppression of viral genes, transgenes, or endogenous nuclear genes. Gene silencing may be transcriptional, when the suppression is due to decreased transcription of the affected genes, or post-transcriptional, when the suppression is due to increased turnover (degradation) of RNA species homologous to the affected genes (English et al., 1996). Gene silencing includes virus-induced gene silencing (Ruiz et al. 1998).

The terms "heterologous DNA sequence," "exogenous DNA segment" or "heterologous nucleic acid," as used herein, each refer to a sequence that originates from a source foreign to the particular host cell or, if from the same source, is modified from its original form. Thus, a heterologous gene in a host cell includes a gene that is endogenous to the particular host cell but has been modified through, for example, the use of DNA shuffling. The terms also include non-naturally occurring multiple copies of a naturally occurring DNA sequence. Thus, the terms refer to a DNA segment that is foreign or heterologous to the cell, or homologous to the cell but in a position within the host cell nucleic acid in which the element is not ordinarily found. Exogenous DNA segments are expressed to yield exogenous polypeptides. A "homologous" DNA sequence is a DNA sequence that is naturally associated with a host cell into which it is introduced.

"Homologous to" in the context of nucleotide sequence identity refers to the similarity between the nucleotide sequence of two nucleic acid molecules or between the amino acid sequences of two protein molecules. Estimates of such homology are provided by either DNA-DNA or DNA-RNA hybridization under conditions of stringency as is well understood by those skilled in the art (as described in Haines and Higgins (eds.), Nucleic Acid Hybridization, IRL Press, Oxford, U.K.), or by the comparison of sequence similarity between two nucleic acids or proteins.

The term "substantially similar" refers to nucleotide and amino acid sequences that represent functional and/or structural equivalents of *Oryza* sequences disclosed herein.

In its broadest sense, the term "substantially similar" when used herein with respect to a nucleotide sequence means that the nucleotide sequence is part of a gene which encodes a polypeptide having substantially the same structure and function as a polypeptide encoded by a gene for the reference nucleotide sequence, e.g., the nucleotide sequence comprises a promoter from a gene that is the ortholog of the gene corresponding to the reference nucleotide sequence, as well as promoter sequences that are structurally related the promoter sequences particularly exemplified herein, i.e., the substantially similar promoter sequences hybridize to the complement of the promoter sequences exemplified herein under high or very high stringency conditions. For example, altered nucleotide sequences which simply reflect the degeneracy of the genetic code but nonetheless encode amino acid sequences that are identical to a particular amino acid sequence are substantially similar to the particular sequences. The term "substantially similar" also includes nucleotide sequences wherein the sequence has been modified, for example, to optimize expression in particular cells, as well as nucleotide sequences encoding a variant polypeptide having one or more amino acid substitutions relative to the (unmodified) polypeptide encoded by the reference sequence, which substitution(s) does not alter the activity of the variant polypeptide relative to the unmodified polypeptide.

In its broadest sense, the term "substantially similar" when used herein with respect to polypeptide means that the polypeptide has substantially the same structure and function as the reference polypeptide. In addition, amino acid sequences that are substantially similar to a particular sequence are those wherein overall amino acid identity is at least 65% or greater to the instant sequences. Modifications that result in equivalent nucleotide or amino acid sequences are well within the routine skill in the art. The percentage of amino acid sequence identity between the substantially similar and the reference polypeptide is at least 65%, 66%, 67%, 68%, 69%, 70%, e.g., 71%, 72%, 73%, 74%, 75%, 76%, 77%, 78%, 79%, 80%, 81%, 82%, 83%, 84%, 85%, 86%, 87%, 88%, 89%, and even 90% or more, e.g., 91%, 92%, 93%, 94%, 95%, 96%, 97%, 98%, up to at least 99%, wherein the reference polypeptide is an *Oryza* polypeptide encoded by a gene with a promoter having any one of SEQ ID NOs:1-350 and 1051-1551, e.g., a nucleotide sequence comprising an open reading frame having any one of SEQ ID NOs:351-700 or 1552-2052 which encodes one of SEQ ID Nos:701-1050 or 2053-2553. One indication that two polypeptides are substantially similar to each other, besides having substantially the same function, is that an agent, e.g., an antibody, which specifically binds to one of the polypeptides, specifically binds to the other.

Sequence comparisons maybe carried out using a Smith-Waterman sequence alignment algorithm (see e.g., Waterman (1995)). The localS program, version 1.16, is preferably used with following parameters: match: 1, mismatch penalty: 0.33, open-gap penalty: 2, extended-gap penalty: 2.

Moreover, a nucleotide sequence that is "substantially similar" to a reference nucleotide sequence is said to be "equivalent" to the reference nucleotide sequence. The skilled artisan recognizes that equivalent nucleotide sequences encompassed by this invention can also be defined by their ability to hybridize, under low, moderate and/or stringent conditions (e.g., 0.1×SSC, 0.1% SDS, 65° C.), with the nucleotide sequences that are within the literal scope of the instant claims.

What is meant by "substantially the same activity" when used in reference to a polynucleotide or polypeptide fragment is that the fragment has at least 65%, 66%, 67%, 68%, 69%, 70%, e.g., 71%, 72%, 73%, 74%, 75%, 76%, 77%, 78%, 79%, 80%, 81%, 82%, 83%, 84%, 85%, 86%, 87%, 88%, 89%, and even 90% or more, e.g., 91%, 92%, 93%, 94%, 95%, 96%, 97%, 98%, up to at least 99% of the activity of the full length polynucleotide or full length polypeptide.

"Target gene" refers to a gene on the replicon that expresses the desired target coding sequence, functional RNA, or protein. The target gene is not essential for replicon replication. Additionally, target genes may comprise native non-viral genes inserted into a non-native organism, or chimeric genes, and will be under the control of suitable regulatory sequences. Thus, the regulatory sequences in the target gene may come from any source, including the virus. Target genes may include coding sequences that are either heterologous or homologous to the genes of a particular plant to be transformed. However, target genes do not include native viral genes. Typical target genes include, but are not limited to genes encoding a structural protein, a seed storage protein, a protein that conveys herbicide resistance, and a protein that conveys insect resistance. Proteins encoded by target genes are known as "foreign proteins". The expression of a target gene in a plant will typically produce an altered plant trait.

The term "altered plant trait" means any phenotypic or genotypic change in a transgenic plant relative to the wild-type or non-transgenic plant host.

"Replication gene" refers to a gene encoding a viral replication protein. In addition to the ORF of the replication protein, the replication gene may also contain other overlapping or non-overlapping ORF(s), as are found in viral sequences in nature. While not essential for replication, these additional ORFs may enhance replication and/or viral DNA accumulation. Examples of such additional ORFs are AC3 and AL3 in ACMV and TGMV geminiviruses, respectively.

"Chimeric trans-acting replication gene" refers either to a replication gene in which the coding sequence of a replication protein is under the control of a regulated plant promoter other than that in the native viral replication gene, or a modified native viral replication gene, for example, in which a site specific sequence(s) is inserted in the 5' transcribed but untranslated region. Such chimeric genes also include insertion of the known sites of replication protein binding between the promoter and the transcription start site that attenuate transcription of viral replication protein gene.

"Chromosomally-integrated" refers to the integration of a foreign gene or DNA construct into the host DNA by covalent bonds. Where genes are not "chromosomally integrated" they may be "transiently expressed." Transient expression of a gene refers to the expression of a gene that is not integrated into the host chromosome but functions independently, either as part of an autonomously replicating plasmid or expression cassette, for example, or as part of another biological system such as a virus.

The term "transformation" refers to the transfer of a nucleic acid fragment into the genome of a host cell, resulting in genetically stable inheritance. Host cells containing the transformed nucleic acid fragments are referred to as "transgenic" cells, and organisms comprising transgenic cells are referred to as "transgenic organisms". Examples of methods of transformation of plants and plant cells include Agrobacterium-mediated transformation (De Blaere et al., 1987) and particle bombardment technology (Klein et al. 1987; U.S. Pat. No. 4,945,050). Whole plants may be regenerated from transgenic cells by methods well known to the skilled artisan (see, for example, Fromm et al., 1990).

"Transformed," "transgenic," and "recombinant" refer to a host organism such as a bacterium or a plant into which a heterologous nucleic acid molecule has been introduced. The nucleic acid molecule can be stably integrated into the genome generally known in the art and are disclosed in Sambrook et al., 1989. See also Innis et al., 1995 and Gelfand, 1995; and Innis and Gelfand, 1999. Known methods of PCR include, but are not limited to, methods using paired primers, nested primers, single specific primers, degenerate primers, gene-specific primers, vector-specific primers, partially mismatched primers, and the like. For example, "transformed," "transformant," and "transgenic" plants or calli have been through the transformation process and contain a foreign gene integrated into their chromosome. The term "untransformed" refers to normal plants that have not been through the transformation process.

"Transiently transformed" refers to cells in which transgenes and foreign DNA have been introduced (for example, by such methods as Agrobacterium-mediated transformation or biolistic bombardment), but not selected for stable maintenance.

"Stably transformed" refers to cells that have been selected and regenerated on a selection media following transformation.

"Transient expression" refers to expression in cells in which a virus or a transgene is introduced by viral infection or by such methods as Agrobacterium-mediated transformation, electroporation, or biolistic bombardment, but not selected for its stable maintenance.

"Genetically stable" and "heritable" refer to chromosomally-integrated genetic elements that are stably maintained in the plant and stably inherited by progeny through successive generations.

"Primary transformant" and "T0 generation" refer to transgenic plants that are of the same genetic generation as the tissue which was initially transformed (i.e., not having gone through meiosis and fertilization since transformation).

"Secondary transformants" and the "T1, T2, T3, etc. generations" refer to transgenic plants derived from primary transformants through one or more meiotic and fertilization cycles. They may be derived by self-fertilization of primary or secondary transformants or crosses of primary or secondary transformants with other transformed or untransformed plants.

"Wild-type" refers to a virus or organism found in nature without any known mutation.

"Genome" refers to the complete genetic material of an organism.

The term "nucleic acid" refers to deoxyribonucleotides or ribonucleotides and polymers thereof in either single- or double-stranded form, composed of monomers (nucleotides) containing a sugar, phosphate and a base which is either a purine or pyrimidine. Unless specifically limited, the term encompasses nucleic acids containing known analogs of natural nucleotides which have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions) and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., 1991; Ohtsuka et al., 1985; Rossolini et al. 1994). A "nucleic acid fragment" is a fraction of a given nucleic acid molecule. In higher plants, deoxyribonucleic acid (DNA) is the genetic material while ribonucleic acid (RNA) is involved in the transfer of information contained within DNA into proteins. The term "nucleotide sequence" refers to a polymer of DNA or RNA which can be single- or double-stranded, optionally containing synthetic, non-natural or altered nucleotide bases capable of incorporation into DNA or RNA polymers. The terms "nucleic acid" or "nucleic acid sequence" may also be used interchangeably with gene, cDNA, DNA and RNA encoded by a gene.

The invention encompasses isolated or substantially purified nucleic acid or protein compositions. In the context of the present invention, an "isolated" or "purified" DNA molecule or an "isolated" or "purified" polypeptide is a DNA molecule or polypeptide that, by the hand of man, exists apart from its native environment and is therefore not a product of nature. An isolated DNA molecule or polypeptide may exist in a purified form or may exist in a non-native environment such as, for example, a transgenic host cell. For example, an "isolated" or "purified" nucleic acid molecule or protein, or biologically active portion thereof, is substantially free of other cellular material, or culture medium when produced by recombinant techniques, or substantially free of chemical precursors or other chemicals when chemically synthesized.

Preferably, an "isolated" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived. A protein that is substantially free of cellular material includes preparations of protein or polypeptide having less than about 30%, 20%, 10%, 5%, (by dry weight) of contaminating protein. When the protein of the invention, or biologically active portion thereof, is recombinantly produced, preferably culture medium represents less than about 30%, 20%, 10%, or 5% (by dry weight) of chemical precursors or non-protein of interest chemicals.

The nucleotide sequences of the invention include both the naturally occurring sequences as well as mutant (variant) forms. Such variants will continue to possess the desired activity, i.e., either promoter activity or the activity of the product encoded by the open reading frame of the non-variant nucleotide sequence.

Thus, by "variants" is intended substantially similar sequences. For nucleotide sequences comprising an open reading frame, variants include those sequences that, because of the degeneracy of the genetic code, encode the identical amino acid sequence of the native protein. Naturally occurring allelic variants such as these can be identified with the use of well-known molecular biology techniques, as, for example, with polymerase chain reaction (PCR) and hybridization techniques. Variant nucleotide sequences also include synthetically derived nucleotide sequences, such as those generated, for example, by using site-directed mutagenesis and for open reading frames, encode the native protein, as well as those that encode a polypeptide having amino acid substitutions relative to the native protein. Generally, nucleotide sequence variants of the invention will have at least 40, 50, 60, to 70%, e.g., preferably 71%, 72%, 73%, 74%, 75%, 76%, 77%, 78%, to 79%, generally at least 80%, e.g., 81%-84%, at least 85%, e.g., 86%, 87%, 88%, 89%, 90%, 91%, 92%, 93%, 94%, 95%, 96%, 97%, to 98% and 99% nucleotide sequence identity to the native (wild type or endogenous) nucleotide sequence.

"Conservatively modified variations" of a particular nucleic acid sequence refers to those nucleic acid sequences that encode identical or essentially identical amino acid sequences, or where the nucleic acid sequence does not encode an amino acid sequence, to essentially identical sequences. Because of the degeneracy of the genetic code, a large number of functionally identical nucleic acids encode any given polypeptide. For instance the codons CGT, CGC, CGA, CGG, AGA, and AGG all encode the amino acid arginine. Thus, at every position where an arginine is specified by a codon, the codon can be altered to any of the corresponding codons described without altering the encoded protein. Such nucleic acid variations are "silent variations" which are one species of "conservatively modified variations." Every nucleic acid sequence described herein which encodes a polypeptide also describes every possible silent variation, except where otherwise noted. One of skill will recognize that each codon in a nucleic acid (except ATG, which is ordinarily the only codon for methionine) can be modified to yield a functionally identical molecule by standard techniques. Accordingly, each "silent variation" of a nucleic acid which encodes a polypeptide is implicit in each described sequence.

The nucleic acid molecules of the invention can be "optimized" for enhanced expression in plants of interest. See, for example, EPA 035472; WO 91/16432; Perlak et al., 1991; and Murray et al., 1989. In this manner, the open reading frames in genes or gene fragments can be synthesized utilizing plant-preferred codons. See, for example, Campbell and Gowri, 1990 for a discussion of host-preferred codon usage. Thus, the nucleotide sequences can be optimized for expression in any plant. It is recognized that all or any part of the gene sequence may be optimized or synthetic. That is, synthetic or partially optimized sequences may also be used. Variant nucleotide sequences and proteins also encompass sequences and protein derived from a mutagenic and recombinogenic procedure such as DNA shuffling. With such a procedure, one or more different coding sequences can be manipulated to create a new polypeptide possessing the desired properties. In this manner, libraries of recombinant polynucleotides are generated from a population of related sequence polynucleotides comprising sequence regions that have substantial sequence identity and can be homologously recombined in vitro or in vivo. Strategies for such DNA shuffling are known in the art. See, for example, Stemmer, 1994; Stemmer, 1994; Crameri et al., 1997; Moore et al., 1997; Zhang et al., 1997; Crameri et al., 1998; and U.S. Pat. Nos. 5,605,793 and 5,837,458.

By "variant" polypeptide is intended a polypeptide derived from the native protein by deletion (so-called truncation) or addition of one or more amino acids to the N-terminal and/or C-terminal end of the native protein; deletion or addition of one or more amino acids at one or more sites in the native protein; or substitution of one or more amino acids at one or more sites in the native protein. Such variants may result from, for example, genetic polymorphism or from human manipulation. Methods for such manipulations are generally known in the art.

Thus, the polypeptides may be altered in various ways including amino acid substitutions, deletions, truncations, and insertions. Methods for such manipulations are generally known in the art. For example, amino acid sequence variants of the polypeptides can be prepared by mutations in the DNA. Methods for mutagenesis and nucleotide sequence alterations are well known in the art. See, for example, Kunkel, 1985; Kunkel et al., 1987; U.S. Pat. No. 4,873,192; Walker and Gaastra, 1983 and the references cited therein. Guidance as to appropriate amino acid substitutions that do not affect biological activity of the protein of interest may be found in the model of Dayhoff et al. (1978). Conservative substitutions, such as exchanging one amino acid with another having similar properties, are preferred.

Individual substitutions deletions or additions that alter, add or delete a single amino acid or a small percentage of amino acids (typically less than 5%, more typically less than 1%) in an encoded sequence are "conservatively modified variations," where the alterations result in the substitution of an amino acid with a chemically similar amino acid. Conservative substitution tables providing functionally similar amino acids are well known in the art. The following five groups each contain amino acids that are conservative substitutions for one another: Aliphatic: Glycine (G), Alanine (A), Valine (V), Leucine (L), Isoleucine (I); Aromatic: Phenylalanine (F), Tyrosine (Y), Tryptophan (W); Sulfur-containing: Methionine (M), Cysteine (C); Basic: Arginine I, Lysine (K), Histidine (H); Acidic: Aspartic acid (D), Glutamic acid (E), Asparagine (N), Glutamine (Q). See also, Creighton, 1984. In addition, individual substitutions, deletions or additions which alter, add or delete a single amino acid or a small percentage of amino acids in an encoded sequence are also "conservatively modified variations."

"Expression cassette" as used herein means a DNA sequence capable of directing expression of a particular nucleotide sequence in an appropriate host cell, comprising a promoter operably linked to the nucleotide sequence of interest which is operably linked to termination signals. It also typically comprises sequences required for proper translation of the nucleotide sequence. The coding region usually codes for a protein of interest but may also code for a functional RNA of interest, for example antisense RNA or a nontranslated RNA, in the sense or antisense direction. The expression cassette comprising the nucleotide sequence of interest may be chimeric, meaning that at least one of its components is heterologous with respect to at least one of its other components. The expression cassette may also be one which is naturally occurring but has been obtained in a recombinant form useful for heterologous expression. The expression of the nucleotide sequence in the expression cassette may be under the control of a constitutive promoter or of an inducible promoter which initiates transcription only when the host cell is exposed to some particular external stimulus. In the case of a multicellular organism, the promoter can also be specific to a particular tissue or organ or stage of development.

"Vector" is defined to include, inter alia, any plasmid, cosmid, phage or *Agrobacterium* binary vector in double or single stranded linear or circular form which may or may not be self transmissible or mobilizable, and which can transform prokaryotic or eukaryotic host either by integration into the cellular genome or exist extrachromosomally (e.g. autonomous replicating plasmid with an origin of replication).

Specifically included are shuttle vectors by which is meant a DNA vehicle capable, naturally or by design, of replication in two different host organisms, which may be selected from actinomycetes and related species, bacteria and eukaryotic (e.g. higher plant, mammalian, yeast or fungal cells).

Preferably the nucleic acid in the vector is under the control of, and operably linked to, an appropriate promoter or other regulatory elements for transcription in a host cell such as a microbial, e.g. bacterial, or plant cell. The vector may be a bi-functional expression vector which functions in multiple hosts. In the case of genomic DNA, this may contain its own promoter or other regulatory elements and in the case of cDNA this may be under the control of an appropriate promoter or other regulatory elements for expression in the host cell.

"Cloning vectors" typically contain one or a small number of restriction endonuclease recognition sites at which foreign DNA sequences can be inserted in a determinable fashion without loss of essential biological function of the vector, as well as a marker gene that is suitable for use in the identification and selection of cells transformed with the cloning vector. Marker genes typically include genes that provide tetracycline resistance, hygromycin resistance or ampicillin resistance.

A "transgenic plant" is a plant having one or more plant cells that contain an expression vector.

"Plant tissue" includes differentiated and undifferentiated tissues or plants, including but not limited to roots, stems, shoots, leaves, pollen, seeds, tumor tissue and various forms of cells and culture such as single cells, protoplast, embryos, and callus tissue. The plant tissue may be in plants or in organ, tissue or cell culture.

The following terms are used to describe the sequence relationships between two or more nucleic acids or polynucleotides: (a) "reference sequence", (b) "comparison window", (c) "sequence identity", (d) "percentage of sequence identity", and (e) "substantial identity".

(a) As used herein, "reference sequence" is a defined sequence used as a basis for sequence comparison. A reference sequence may be a subset or the entirety of a specified sequence; for example, as a segment of a full length cDNA or gene sequence, or the complete cDNA or gene sequence.

(b) As used herein, "comparison window" makes reference to a contiguous and specified segment of a polynucleotide sequence, wherein the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally can be 30, 40, 50, 100, or longer. Those of skill in the art understand that to avoid a high similarity to a reference sequence due to inclusion of gaps in the polynucleotide sequence a gap penalty is typically introduced and is subtracted from the number of matches.

Methods of alignment of sequences for comparison are well known in the art. Thus, the determination of percent identity between any two sequences can be accomplished using a mathematical algorithm. Preferred, non-limiting examples of such mathematical algorithms are the algorithm of Myers and Miller, 1988; the local homology algorithm of Smith et al. 1981; the homology alignment algorithm of Needleman and Wunsch 1970; the search-for-similarity-method of Pearson and Lipman 1988; the algorithm of Karlin and Altschul, 1990, modified as in Karlin and Altschul, 1993.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the Wisconsin Genetics Software Package, Version 8 (available from Genetics Computer Group (GCG), 575 Science Drive, Madison, Wis., USA). Alignments using these programs can be performed using the default parameters. The CLUSTAL program is well described by Higgins et al. 1988; Higgins et al. 1989; Corpet et al. 1988; Huang et al. 1992; and Pearson et al. 1994. The ALIGN program is based on the algorithm of Myers and Miller, supra. The BLAST programs of Altschul et al., 1990, are based on the algorithm of Karlin and Altschul supra.

Software for performing BLAST analyses is publicly available through the website of the National Center for Biotechnology Information (NCBI). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached.

In addition to calculating percent sequence identity, the BLAST algorithm also performs a statistical analysis of the similarity between two sequences (see, e.g., Karlin & Altschul (1993). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleic acid sequence to the reference nucleic acid sequence is less than about 0.1, more preferably less than about 0.01, and most preferably less than about 0.001.

To obtain gapped alignments for comparison purposes, Gapped BLAST (in BLAST 2.0) can be utilized as described in Altschul et al. 1997. Alternatively, PSI-BLAST (in BLAST 2.0) can be used to perform an iterated search that detects distant relationships between molecules. See Altschul et al., supra. When utilizing BLAST, Gapped BLAST, PSI-BLAST, the default parameters of the respective programs (e.g. BLASTN for nucleotide sequences, BLASTX for proteins) can be used. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, 1989). See the website of the NCBI. Alignment may also be performed manually by inspection.

For purposes of the present invention, comparison of nucleotide sequences for determination of percent sequence identity to the promoter sequences disclosed herein is preferably made using the BlastN program (version 1.4.7 or later) with its default parameters or any equivalent program. By "equivalent program" is intended any sequence comparison program that, for any two sequences in question, generates an alignment having identical nucleotide or amino acid residue matches and an identical percent sequence identity when compared to the corresponding alignment generated by the preferred program.

(c) As used herein, "sequence identity" or "identity" in the context of two nucleic acid or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity." Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

(d) As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

(e)(i) The term "substantial identity" of polynucleotide sequences means that a polynucleotide comprises a sequence that has at least 70%, 71%, 72%, 73%, 74%, 75%, 76%, 77%, 78%, or 79%, preferably at least 80%, 81%, 82%, 83%, 84%, 85%, 86%, 87%, 88%, or 89%, more preferably at least 90%, 91%, 92%, 93%, or 94%, and most preferably at least 95%, 96%, 97%, 98%, or 99% sequence identity, compared to a reference sequence using one of the alignment programs described using standard parameters. One of skill in the art will recognize that these values can be appropriately adjusted to determine corresponding identity of proteins encoded by two nucleotide sequences by taking into account codon degeneracy, amino acid similarity, reading frame positioning, and the like. Substantial identity of amino acid sequences for these purposes normally means sequence identity of at least 70%, more preferably at least 80%, 90%, and most preferably at least 95%.

Another indication that nucleotide sequences are substantially identical is if two molecules hybridize to each other under stringent conditions (see below). Generally, stringent conditions are selected to be about 5° C. lower than the thermal melting point ($T_m$) for the specific sequence at a defined ionic strength and pH. However, stringent conditions encompass temperatures in the range of about 1° C. to about 20° C., depending upon the desired degree of stringency as otherwise qualified herein. Nucleic acids that do not hybridize to each other under stringent conditions are still substantially identical if the polypeptides they encode are substantially identical. This may occur, e.g., when a copy of a nucleic acid is created using the maximum codon degeneracy permitted by the genetic code. One indication that two nucleic acid sequences are substantially identical is when the polypeptide encoded by the first nucleic acid is immunologically cross reactive with the polypeptide encoded by the second nucleic acid.

(e)(ii) The term "substantial identity" in the context of a peptide indicates that a peptide comprises a sequence with at least 70%, 71%, 72%, 73%, 74%, 75%, 76%, 77%, 78%, or 79%, preferably 80%, 81%, 82%, 83%, 84%, 85%, 86%, 87%, 88%, or 89%, more preferably at least 90%, 91%, 92%, 93%, or 94%, or even more preferably, 95%, 96%, 97%, 98% or 99%, sequence identity to the reference sequence over a specified comparison window. Preferably, optimal alignment is conducted using the homology alignment algorithm of Needleman and Wunsch (1970). An indication that two peptide sequences are substantially identical is that one peptide is immunologically reactive with antibodies raised against the second peptide. Thus, a peptide is substantially identical to a second peptide, for example, where the two peptides differ only by a conservative substitution.

For sequence comparison, typically one sequence acts as a reference sequence to which test sequences are compared. When using a sequence comparison algorithm, test and reference sequences are input into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

As noted above, another indication that two nucleic acid sequences are substantially identical is that the two molecules hybridize to each other under stringent conditions. The phrase "hybridizing specifically to" refers to the binding, duplexing, or hybridizing of a molecule only to a particular nucleotide sequence under stringent conditions when that sequence is present in a complex mixture (e.g., total cellular) DNA or RNA. "Bind(s) substantially" refers to complementary hybridization between a probe nucleic acid and a target nucleic acid and embraces minor mismatches that can be accommodated by reducing the stringency of the hybridization media to achieve the desired detection of the target nucleic acid sequence.

"Stringent hybridization conditions" and "stringent hybridization wash conditions" in the context of nucleic acid hybridization experiments such as Southern and Northern hybridization are sequence dependent, and are different under different environmental parameters. The $T_m$ is the temperature (under defined ionic strength and pH) at which 50% of the target sequence hybridizes to a perfectly matched probe. Specificity is typically the function of post-hybridization washes, the critical factors being the ionic strength and temperature of the final wash solution. For DNA-DNA hybrids, the $T_m$ can be approximated from the equation of Meinkoth and Wahl, 1984; $T_m$ 81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. $T_m$ is reduced by about 1° C. for each 1% of mismatching; thus, $T_m$, hybridization, and/or wash conditions can be adjusted to hybridize to sequences of the desired identity. For example, if sequences with >90% identity are sought, the $T_m$ can be decreased 10° C. Generally, stringent conditions are selected to be about 5° C. lower than the thermal melting point 1 for the specific sequence and its complement at a defined ionic strength and pH. However, severely stringent conditions can utilize a hybridization and/or wash at 1, 2, 3, or 4° C. lower than the thermal melting point I; moderately stringent conditions can utilize a hybridization and/or wash at 6, 7, 8, 9, or 10° C. lower than the thermal melting point I; low stringency conditions can utilize a hybridization and/or wash at 11, 12, 13, 14, 15, or 20° C. lower than the thermal melting point I. Using the equation, hybridization and wash compositions, and desired T, those of ordinary skill will understand that variations in the stringency of hybridization and/or wash solutions are inherently described. If the desired degree of mismatching results in a T of less than 45° C. (aqueous solution) or 32° C. (formamide solution), it is preferred to increase the SSC concentration so that a higher temperature can be used. An extensive guide to the hybridization of nucleic acids is found in Tijssen, 1993. Generally, highly stringent hybridization and wash conditions are selected to be about 5° C. lower than the thermal melting point $T_m$ for the specific sequence at a defined ionic strength and pH.

An example of highly stringent wash conditions is 0.15 M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example medium stringency wash for a duplex of, e.g., more than 100 nucleotides, is 1×SSC at 45° C. for 15 minutes. An example low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.5 M, more preferably about 0.01 to 1.0 M, Na ion concentration (or other salts) at pH 7.0 to 8.3, and the temperature is typically at least about 30° C. and at least about 60° C. for long robes (e.g., >50 nucleotides). Stringent conditions may also be achieved with the addition of destabilizing agents such as formamide. In general, a signal to noise ratio of 2× (or higher) than that observed for an unrelated probe in the particular hybridization assay indicates detection of a specific hybridization. Nucleic acids that do not hybridize to each other under stringent conditions are still substantially identical if the proteins that they encode are substantially identical. This occurs, e.g., when a copy of a nucleic acid is created using the maximum codon degeneracy permitted by the genetic code.

Very stringent conditions are selected to be equal to the $T_m$ for a particular probe. An example of stringent conditions for hybridization of complementary nucleic acids which have more than 100 complementary residues on a filter in a Southern or Northern blot is 50% formamide, e.g., hybridization in 50% formamide, 1 M NaCl, 1% SDS at 37° C., and a wash in 0.1×SSC at 60 to 65° C. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C.

The following are examples of sets of hybridization/wash conditions that may be used to clone orthologous nucleotide sequences that are substantially identical to reference nucleotide sequences of the present invention: a reference nucleotide sequence preferably hybridizes to the reference nucleotide sequence in 7% sodium dodecyl sulfate (SDS), 0.5 M NaPO$_4$, 1 mM EDTA at 50° C. with washing in 2×SSC, 0.1% SDS at 50° C., more desirably in 7% sodium dodecyl sulfate (SDS), 0.5 M NaPO$_4$, 1 mM EDTA at 50° C. with washing in 1×SSC, 0.1% SDS at 50° C., more desirably still in 7% sodium dodecyl sulfate (SDS), 0.5 M NaPO$_4$, 1 mM EDTA at 50° C. with washing in 0.5×SSC, 0.1% SDS at 50° C., preferably in 7% sodium dodecyl sulfate (SDS), 0.5 M NaPO$_4$, 1 mM EDTA at 50° C. with washing in 0.1×SSC, 0.1% SDS at 50° C., more preferably in 7% sodium dodecyl sulfate (SDS), 0.5 M NaPO$_4$, 1 mM EDTA at 50° C. with washing in 0.1× SSC, 0.1% SDS at 65° C.

"DNA shuffling" is a method to introduce mutations or rearrangements, preferably randomly, in a DNA molecule or to generate exchanges of DNA sequences between two or more DNA molecules, preferably randomly. The DNA molecule resulting from DNA shuffling is a shuffled DNA molecule that is a non-naturally occurring DNA molecule derived from at least one template DNA molecule. The shuffled DNA preferably encodes a variant polypeptide modified with respect to the polypeptide encoded by the template DNA, and may have an altered biological activity with respect to the polypeptide encoded by the template DNA.

"Recombinant DNA molecule' is a combination of DNA sequences that are joined together using recombinant DNA technology and procedures used to join together DNA sequences as described, for example, in Sambrook et al., 1989.

The word "plant" refers to any plant, particularly to seed plant, and "plant cell" is a structural and physiological unit of the plant, which comprises a cell wall but may also refer to a protoplast. The plant cell may be in form of an isolated single cell or a cultured cell, or as a part of higher organized unit such as, for example, a plant tissue, or a plant organ.

"Significant increase" is an increase that is larger than the margin of error inherent in the measurement technique, preferably an increase by about 2-fold or greater.

"Significantly less" means that the decrease is larger than the margin of error inherent in the measurement technique, preferably a decrease by about 2-fold or greater.

II. NUCLEIC ACID MOLECULES OF THE INVENTION

The invention relates to an isolated plant, e.g., *Oryza*, nucleic acid molecule which directs the expression of linked nucleic acid segment in a plant, e.g., in a particular tissue or constitutively, as well as the corresponding open reading frame and encoded product. The nucleic acid molecule, e.g., one which comprises a promoter, can be used to overexpress a linked nucleic acid segment so as to express a product in a constitutive, tissue-specific or tissue-preferential manner, or to alter the expression of the product, e.g., via the use of antisense vectors or by "knocking out" the expression of at least one genomic copy of the gene.

The nucleic acid molecules of the invention can be obtained or isolated from any plant or non-plant source, or produced synthetically by purely chemical means. Preferred sources include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Cofea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea ultilane*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, duckweed (*Lemna*), barley, vegetables, ornamentals, and conifers.

Duckweed (*Lemna*, see WO 00/07210) includes members of the family Lemnaceae. There are known four genera and 34 species of duckweed as follows: genus *Lemna* (*L. aequinoctialis, L. disperma, L. ecuadoriensis, L. gibba, L. japonica, L. minor, L. miniscula, L. obscura, L. perpusilla, L. tenera, L. trisulca, L. turionifera, L. valdiviana*); genus *Spirodela* (*S. intermedia, S. polyrrhiza, S. punctata*); genus *Woffia* (*Wa. Angusta, Wa. Arrhiza, Wa. Australina, Wa. Borealis, Wa. Brasiliensis, Wa. Columbiana, Wa. Elongata, Wa. Globosa, Wa. Microscopica, Wa. Neglecta*) and genus *Wofiella* (*Wl. ultila, Wl. ultilane n, Wl. gladiata, Wl. ultila, Wl. lingulata, Wl. repunda, Wl. rotunda*, and *Wl. neotropica*). Any other genera or species of Lemnaceae, if they exist, are also aspects of the present invention. *Lemna gibba, Lemna minor*, and *Lemna miniscula* are preferred, with *Lemna minor* and *Lemna miniscula* being most preferred. *Lemna* species can be classified using the taxonomic scheme described by Landolt, Biosystematic Investigation on the Family of Duckweeds: The family of Lemnaceae—A Monograph Study. Geobatanischen Institute ETH, Stiftung Rubel, Zurich (1986)).

Vegetables from which to obtain or isolate the nucleic acid molecules of the invention include, but are not limited to, tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals from which to obtain or isolate the nucleic acid molecules of the invention include, but are not limited to, azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*), Douglas-fir (*Pseudotsuga menziesii*); Western hemlock (*Tsuga ultilane*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Leguminous plants from which the nucleic acid molecules of the invention can be isolated or obtained include, but are not limited to, beans and peas. Beans include guar, locust bean, fenugreek, soybean, garden beans, cowpea, mungbean, lima bean, fava bean, lentils, chickpea, and the like. Legumes include, but are not limited to, *Arachis*, e.g., peanuts, *Vicia*, e.g., crown vetch, hairy vetch, adzuki bean, mung bean, and chickpea, *Lupinus*, e.g., lupine, trifolium, *Phaseolus*, e.g., common bean and lima bean, *Pisum*, e.g., field bean, *Melilotus*, e.g., clover, *Medicago*, e.g., alfalfa, *Lotus*, e.g., trefoil, lens, e.g., lentil, and false indigo. Preferred forage and turf grass from which the nucleic acid molecules of the invention can be isolated or obtained for use in the methods of the invention include, but are not limited to, alfalfa, orchard grass, tall fescue, perennial ryegrass, creeping bent grass, and redtop.

Other preferred sources of the nucleic acid molecules of the invention include *Acacia*, aneth, artichoke, arugula, blackberry, canola, cilantro, clementines, escarole, eucalyptus, fennel, grapefruit, honey dew, jicama, kiwifruit, lemon, lime, mushroom, nut, okra, orange, parsley, persimmon, plantain, pomegranate, poplar, radiata pine, radicchio, Southern pine, sweetgum, tangerine, triticale, vine, yams, apple, pear, quince, cherry, apricot, melon, hemp, buckwheat, grape, raspberry, *chenopodium*, blueberry, nectarine, peach, plum, strawberry, watermelon, eggplant, pepper, cauliflower, *Brassica*, e.g., broccoli, cabbage, ultilan sprouts, onion, carrot, leek, beet, broad bean, celery, radish, pumpkin, endive, gourd, garlic, snapbean, spinach, squash, turnip, ultilane, and zucchini.

Yet other sources of nucleic acid molecules are ornamental plants including, but not limited to, impatiens, Begonia, Pelargonium, Viola, Cyclamen, Verbena, Vinca, Tagetes, Primula, Saint Paulia, Agertum, Amaranthus, Antihirrhinum, Aquilegia, Cineraria, Clover, Cosmo, Cowpea, Dahlia, Datura, Delphinium, Gerbera, Gladiolus, Gloxinia, Hippeastrum, Mesembryanthemum, Salpiglossos, and Zinnia, and plants such as those shown below.

| FAMILY | LATIN NAME | COMMON NAME | MAP REFERENCES RESOURCES |
|---|---|---|---|
| Cucurbitaceae | *Cucumis sativus* | Cucumber | |
| | *Cucumis melo* | Melon | |
| | *Citrullus lanatus* | Watermelon | |
| | *Cucurbita pepo* | Squash - summer | |
| | *Cucurbita maxima* | Squash - winter | |
| | *Cucurbita moschata* | Pumpkin/ butternut | |
| Solanaceae | *Lycopersicon esculentum* | Tomato | 15x BAC on variety Heinz 1706 order from Clemson Genome center 11.6x BAC of *L. cheesmanii* (originates from J. Giovannoni) available from Clemson genome center EST collection from TIGR EST collection from Clemsom Genome Center TAG 99: 254-271, 1999 (*esculentum* x *pennelli*) TAG 89: 1007-1013, 1994 (peruvianum) Plant Cell Reports 12: 293-297, 1993 (RAPDs) Genetics 132: 1141-1160, 1992 (potato x tomato) Genetics 120: 1095-1105, 1988 (RFLP potato and tomato) Genetics 115: 387-393, 1986 (*esculentum* x *pennelli* isozyme and cDNAs) |
| | *Capsicum annuum* | Pepper | |
| | *Capsicum frutescens* | Chile pepper | |
| | *Solanum melongena* | Eggplant | |
| | (*Nicotiana tabacum*) | (Tobacco) | |
| | (*Solanum tuberosum*) | (Potato) | |
| | (*Petunia* x *hybrida* hort. Ex E. Vilm.) | (Petunia) | 4x BAC of *Petunia hybrida* 7984 available from Clemson genome center |
| Brassicaceae | *Brassica oleracea* L. var. *italica* | Broccoli | |
| | *Brassica oleracea* L. var. *capitata* | Cabbage | |
| | *Brassica rapa* | Chinese Cabbage | |
| | *Brassica oleracea* L. var. *botrytis* | Cauliflower | |
| | *Raphanus sativus* var. *niger* | Daikon | |
| | (*Brassica napus*) | (Oilseed rape) | |
| | | Arabidopsis | 12x and 6x BACs on Columbia strain available from Clemson genome center |

-continued

| FAMILY | LATIN NAME | COMMON NAME | MAP REFERENCES RESOURCES |
|---|---|---|---|
| Umbelliferae | *Daucus carota* | Carrot | |
| Compositae | *Lactuca sativa* | Lettuce | |
| | *Helianthus annuus* | (Sunflower) | |
| Chenopodiaceae | *Spinacia oleracea* | Spinach | |
| | (*Beta vulgaris*) | (Sugar Beet) | |
| Leguminosae | *Phaseolus vulgaris* | Bean | 4.3x BAC available from Clemson genome center |
| | *Pisum sativum* | Pea | |
| | (*Glycine max*) | (Soybean) | 7.5x and 7.9x BACs available from Clemson genome center |
| Gramineae | *Zea mays* | Sweet Corn | Novartis BACs for Mo17 and B73 have been donated to Clemson Genome Center |
| | (*Zea mays*) | (Field Corn) | |
| Liliaceae | *Allium cepa* | Onion | |
| | | Leek | |
| | | (Garlic) | |
| | | (Asparagus) | |

Yet other preferred sources include, but are not limited to, crop plants and in particular cereals (for example, corn, alfalfa, sunflower, *Brassica*, canola, soybean, barley, soybean, sugarbeet, cotton, safflower, peanut, sorghum, wheat, millet, tobacco, and the like), and even more preferably corn, wheat and soybean.

According to one embodiment, the present invention is directed to a nucleic acid molecule comprising a nucleotide sequence isolated or obtained from any plant which encodes a polypeptide having at least 70% amino acid sequence identity to a polypeptide encoded by a gene comprising any one of SEQ ID NOs:1-2672, 5959, 5972, 5973, 5977-5990 and 6001. Based on the *Oryza* nucleic acid sequences of the present invention, orthologs may be identified or isolated from the genome of any desired organism, preferably from another plant, according to well known techniques based on their sequence similarity to the *Oryza* nucleic acid sequences, e.g., hybridization, PCR or computer generated sequence comparisons. For example, all or a portion of a particular *Oryza* nucleic acid sequence is used as a probe that selectively hybridizes to other gene sequences present in a population of cloned genomic DNA fragments or cDNA fragments (i.e., genomic or cDNA libraries) from a chosen source organism. Further, suitable genomic and cDNA libraries may be prepared from any cell or tissue of an organism. Such techniques include hybridization screening of plated DNA libraries (either plaques or colonies; see, e.g., Sambrook et al., 1989) and amplification by PCR using oligonucleotide primers preferably corresponding to sequence domains conserved among related polypeptide or subsequences of the nucleotide sequences provided herein (see, e.g., Innis et al., 1990). These methods are particularly well suited to the isolation of gene sequences from organisms closely related to the organism from which the probe sequence is derived. The application of these methods using the *Oryza* sequences as probes is well suited for the isolation of gene sequences from any source organism, preferably other plant species. In a PCR approach, oligonucleotide primers can be designed for use in PCR reactions to amplify corresponding DNA sequences from cDNA or genomic DNA extracted from any plant of interest. Methods for designing PCR primers and PCR cloning are generally known in the art.

In hybridization techniques, all or part of a known nucleotide sequence is used as a probe that selectively hybridizes to other corresponding nucleotide sequences present in a population of cloned genomic DNA fragments or cDNA fragments (i.e., genomic or cDNA libraries) from a chosen organism. The hybridization probes may be genomic DNA fragments, cDNA fragments, RNA fragments, or other oligonucleotides, and may be labeled with a detectable group such as $^{32}$P, or any other detectable marker. Thus, for example, probes for hybridization can be made by labeling synthetic oligonucleotides based on the sequence of the invention. Methods for preparation of probes for hybridization and for construction of cDNA and genomic libraries are generally known in the art and are disclosed in Sambrook et al. (1989). In general, sequences that hybridize to the sequences disclosed herein will have at least 40% to 50%, about 60% to 70% and even about 80% 85%, 90%, 95% to 98% or more identity with the disclosed sequences. That is, the sequence similarity of sequences may range, sharing at least about 40% to 50%, about 60% to 70%, and even about 80%, 85%, 90%, 95% to 98% sequence similarity.

The nucleic acid molecules of the invention can also be identified by, for example, a search of known databases for genes encoding polypeptides having a specified amino acid sequence identity or DNA having a specified nucleotide sequence identity. Methods of alignment of sequences for comparison are well known in the art and are described hereinabove.

Virtually any DNA composition may be used for delivery to recipient plant cells, e.g., monocotyledonous cells, to ultimately produce fertile transgenic plants in accordance with the present invention. For example, DNA segments or fragments in the form of vectors and plasmids, or linear DNA segments or fragments, in some instances containing only the DNA element to be expressed in the plant, and the like, may be employed. The construction of vectors which may be employed in conjunction with the present invention will be known to those of skill of the art in light of the present disclosure (see, e.g., Sambrook et al., 1989; Gelvin et al., 1990).

Vectors, plasmids, cosmids, YACs (yeast artificial chromosomes), BACs (bacterial artificial chromosomes) and DNA segments for use in transforming such cells will, of course, generally comprise the cDNA, gene or genes which one desires to introduce into the cells. These DNA constructs can further include structures such as promoters, enhancers, polylinkers, or even regulatory genes as desired. The DNA segment, fragment or gene chosen for cellular introduction will often encode a protein which will be expressed in the resultant recombinant cells, such as will result in a screenable or selectable trait and/or which will impart an improved phenotype to the regenerated plant. However, this may not always be the case, and the present invention also encompasses transgenic plants incorporating non-expressed transgenes.

In certain embodiments, it is contemplated that one may wish to employ replication-competent viral vectors in monocot transformation. Such vectors include, for example, wheat dwarf virus (WDV) "shuttle" vectors, such as pW1-11 and PW1-GUS (Ugaki et al., 1991). These vectors are capable of autonomous replication in maize cells as well as *E. coli*, and as such may provide increased sensitivity for detecting DNA delivered to transgenic cells. A replicating vector may also be useful for delivery of genes flanked by DNA sequences from transposable elements such as Ac, Ds, or Mu. It has been proposed (Laufs et al., 1990) that transposition of these elements within the maize genome requires DNA replication. It is also contemplated that transposable elements would be useful for introducing DNA segments or fragments lacking elements necessary for selection and maintenance of the plasmid vector in bacteria, e.g., antibiotic resistance genes and origins of DNA replication. It is also proposed that use of a transposable element such as Ac, Ds, or Mu would actively promote integration of the desired DNA and hence increase the frequency of stably transformed cells. The use of a transposable element such as Ac, Ds, or Mu may actively promote integration of the DNA of interest and hence increase the frequency of stably transformed cells. Transposable elements may be useful to allow separation of genes of interest from elements necessary for selection and maintenance of a plasmid vector in bacteria or selection of a transformant. By use of a transposable element, desirable and undesirable DNA sequences may be transposed apart from each other in the genome, such that through genetic segregation in progeny, one may identify plants with either the desirable undesirable DNA sequences.

It is one of the objects of the present invention to provide recombinant DNA molecules comprising a nucleotide sequence which directs transcription according to the invention operably linked to a nucleic acid segment or sequence of interest. The nucleic acid segment of interest can, for example, code for a ribosomal RNA, an antisense RNA or any other type of RNA that is not translated into protein. In another preferred embodiment of the invention, the nucleic acid segment of interest is translated into a protein product. The nucleotide sequence which directs transcription and/or the nucleic acid segment may be of homologous or heterologous origin with respect to the plant to be transformed. A recombinant DNA molecule useful for introduction into plant cells includes that which has been derived or isolated from any source, that may be subsequently characterized as to structure, size and/or function, chemically altered, and later introduced into plants. An example of a nucleotide sequence or segment of interest "derived" from a source, would be a nucleotide sequence or segment that is identified as a useful fragment within a given organism, and which is then chemically synthesized in essentially pure form. An example of such a nucleotide sequence or segment of interest "isolated" from a source, would be nucleotide sequence or segment that is excised or removed from said source by chemical means, e.g., by the use of restriction endonucleases, so that it can be further manipulated, e.g., amplified, for use in the invention, by the methodology of genetic engineering. Such a nucleotide sequence or segment is commonly referred to as "recombinant."

Therefore a useful nucleotide sequence, segment or fragment of interest includes completely synthetic DNA, semi-synthetic DNA, DNA isolated from biological sources, and DNA derived from introduced RNA. Generally, the introduced DNA is not originally resident in the plant genotype which is the recipient of the DNA, but it is within the scope of the invention to isolate a gene from a given plant genotype, and to subsequently introduce multiple copies of the gene into the same genotype, e.g., to enhance production of a given gene product such as a storage protein or a protein that confers tolerance or resistance to water deficit.

The introduced recombinant DNA molecule includes but is not limited to, DNA from plant genes, and non-plant genes such as those from bacteria, yeasts, animals or viruses. The introduced DNA can include modified genes, portions of genes, or chimeric genes, including genes from the same or different genotype. The term "chimeric gene" or "chimeric DNA" is defined as a gene or DNA sequence or segment comprising at least two DNA sequences or segments from species which do not combine DNA under natural conditions, or which DNA sequences or segments are positioned or linked in a manner which does not normally occur in the native genome of untransformed plant.

The introduced recombinant DNA molecule used for transformation herein may be circular or linear, double-stranded or single-stranded. Generally, the DNA is in the form of chimeric DNA, such as plasmid DNA, that can also contain coding regions flanked by regulatory sequences which promote the expression of the recombinant DNA present in the resultant plant.

Generally, the introduced recombinant DNA molecule will be relatively small, i.e., less than about 30 kb to minimize any susceptibility to physical, chemical, or enzymatic degradation which is known to increase as the size of the nucleotide molecule increases. As noted above, the number of proteins, RNA transcripts or mixtures thereof which is introduced into the plant genome is preferably preselected and defined, e.g., from one to about 5-10 such products of the introduced DNA may be formed.

Two principal methods for the control of expression are known, viz.: overexpression and underexpression. Overexpression can be achieved by insertion of one or more than one extra copy of the selected gene. It is, however, not unknown for plants or their progeny, originally transformed with one or more than one extra copy of a nucleotide sequence, to exhibit the effects of underexpression as well as overexpression. For underexpression there are two principle methods which are commonly referred to in the art as "antisense downregulation" and "sense downregulation" (sense downregulation is also referred to as "cosuppression"). Generically these processes are referred to as "gene silencing". Both of these methods lead to an inhibition of expression of the target gene.

Obtaining sufficient levels of transgene expression in the appropriate plant tissues is an important aspect in the production of genetically engineered crops. Expression of heterologous DNA sequences in a plant host is dependent upon the presence of an operably linked promoter that is functional within the plant host. Choice of the promoter sequence will determine when and where within the organism the heterologous DNA sequence is expressed.

It is specifically contemplated by the inventors that one could mutagenize a promoter to potentially improve the utility of the elements for the expression of transgenes in plants. The mutagenesis of these elements can be carried out at random and the mutagenized promoter sequences screened for activity in a trial-by-error procedure.

Alternatively, particular sequences which provide the promoter with desirable expression characteristics, or the promoter with expression enhancement activity, could be identified and these or similar sequences introduced into the sequences via mutation. It is further contemplated that one could mutagenize these sequences in order to enhance their expression of transgenes in a particular species.

The means for mutagenizing a DNA segment encoding a promoter sequence of the current invention are well-known to those of skill in the art. As indicated, modifications to promoter or other regulatory element may be made by random, or site-specific mutagenesis procedures. The promoter and other regulatory element may be modified by altering their structure through the addition or deletion of one or more nucleotides from the sequence which encodes the corresponding un-modified sequences.

Mutagenesis may be performed in accordance with any of the techniques known in the art, such as, and not limited to, synthesizing an oligonucleotide having one or more mutations within the sequence of a particular regulatory region. In particular, site-specific mutagenesis is a technique useful in the preparation of promoter mutants, through specific mutagenesis of the underlying DNA. The technique further provides a ready ability to prepare and test sequence variants, for example, incorporating one or more of the foregoing considerations, by introducing one or more nucleotide sequence changes into the DNA. Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Typically, a primer of about 17 to about 75 nucleotides or more in length is preferred, with about 10 to about 25 or more residues on both sides of the junction of the sequence being altered.

In general, the technique of site-specific mutagenesis is well known in the art, as exemplified by various publications. As will be appreciated, the technique typically employs a phage vector which exists in both a single stranded and double stranded form. Typical vectors useful in site-directed mutagenesis include vectors such as the M13 phage. These phage are readily commercially available and their use is generally well known to those skilled in the art.

Double stranded plasmids also are routinely employed in site directed mutagenesis which eliminates the step of transferring the gene of interest from a plasmid to a phage.

In general, site-directed mutagenesis in accordance herewith is performed by first obtaining a single-stranded vector or melting apart of two strands of a double stranded vector which includes within its sequence a DNA sequence which encodes the promoter. An oligonucleotide primer bearing the desired mutated sequence is prepared, generally synthetically. This primer is then annealed with the single-stranded vector, and subjected to DNA polymerizing enzymes such as *E. coli* polymerase I Klenow fragment, in order to complete the synthesis of the mutation-bearing strand. Thus, a heteroduplex is formed wherein one strand encodes the original non-mutated sequence and the second strand bears the desired mutation.

This heteroduplex vector is then used to transform or transfect appropriate cells, such as *E. coli* cells, and cells are selected which include recombinant vectors bearing the mutated sequence arrangement. Vector DNA can then be isolated from these cells and used for plant transformation. A genetic selection scheme was devised by Kunkel et al. (1987) to enrich for clones incorporating mutagenic oligonucleotides. Alternatively, the use of PCR with commercially available thermostable enzymes such as Taq polymerase may be used to incorporate a mutagenic oligonucleotide primer into an amplified DNA fragment that can then be cloned into an appropriate cloning or expression vector. The PCR-mediated mutagenesis procedures of Tomic et al. (1990) and Upender et al. (1995) provide two examples of such protocols. A PCR employing a thermostable ligase in addition to a thermostable polymerase also may be used to incorporate a phosphorylated mutagenic oligonucleotide into an amplified DNA fragment that may then be cloned into an appropriate cloning or expression vector. The mutagenesis procedure described by Michael (1994) provides an example of one such protocol.

The preparation of sequence variants of the selected promoter-encoding DNA segments using site-directed mutagenesis is provided as a means of producing potentially useful species and is not meant to be limiting as there are other ways in which sequence variants of DNA sequences may be obtained. For example, recombinant vectors encoding the desired promoter sequence may be treated with mutagenic agents, such as hydroxylamine, to obtain sequence variants.

As used herein, the term "oligonucleotide directed mutagenesis procedure" refers to template-dependent processes and vector-mediated propagation which result in an increase in the concentration of a specific nucleic acid molecule relative to its initial concentration, or in an increase in the concentration of a detectable signal, such as amplification. As used herein, the term "oligonucleotide directed mutagenesis procedure" also is intended to refer to a process that involves the template-dependent extension of a primer molecule. The term template-dependent process refers to nucleic acid synthesis of an RNA or a DNA molecule wherein the sequence of the newly synthesized strand of nucleic acid is dictated by the well-known rules of complementary base pairing (see, for example, Watson and Rarnstad, 1987). Typically, vector mediated methodologies involve the introduction of the nucleic acid fragment into a DNA or RNA vector, the clonal amplification of the vector, and the recovery of the amplified nucleic acid fragment. Examples of such methodologies are provided by U.S. Pat. No. 4,237,224. A number of template dependent processes are available to amplify the target sequences of interest present in a sample, such methods being well known in the art and specifically disclosed herein below.

Where a clone comprising a promoter has been isolated in accordance with the instant invention, one may wish to delimit the essential promoter regions within the clone. One efficient, targeted means for preparing mutagenizing promoters relies upon the identification of putative regulatory elements within the promoter sequence. This can be initiated by comparison with promoter sequences known to be expressed in similar tissue-specific or developmentally unique manner. Sequences which are shared among promoters with similar expression patterns are likely candidates for the binding of transcription factors and are thus likely elements which confer expression patterns. Confirmation of these putative regulatory elements can be achieved by deletion analysis of each putative regulatory region followed by functional analysis of each deletion construct by assay of a reporter gene which is functionally attached to each construct. As such, once a starting promoter sequence is provided, any of a number of different deletion mutants of the starting promoter could be readily prepared.

As indicated above, deletion mutants, deletion mutants of the promoter of the invention also could be randomly prepared and then assayed. With this strategy, a series of constructs are prepared, each containing a different portion of the clone (a subclone), and these constructs are then screened for activity. A suitable means for screening for activity is to attach a deleted promoter or intron construct which contains a deleted segment to a selectable or screenable marker, and to isolate only those cells expressing the marker gene. In this way, a number of different, deleted promoter constructs are identified which still retain the desired, or even enhanced, activity. The smallest segment which is required for activity is thereby identified through comparison of the selected constructs. This segment may then be used for the construction of vectors for the expression of exogenous genes.

Furthermore, it is contemplated that promoters combining elements from more than one promoter may be useful. For example, U.S. Pat. No. 5,491,288 discloses combining a Cauliflower Mosaic Virus promoter with a histone promoter. Thus, the elements from the promoters disclosed herein may be combined with elements from other promoters.

Promoters which are useful for plant transgene expression include those that are inducible, viral, synthetic, constitutive (Odell et al., 1985), temporally regulated, spatially regulated, tissue-specific, and spatio-temporally regulated.

Where expression in specific tissues or organs is desired, tissue-specific promoters may be used. In contrast, where gene expression in response to a stimulus is desired, inducible promoters are the regulatory elements of choice. Where continuous expression is desired throughout the cells of a plant, constitutive promoters are utilized. Additional regulatory sequences upstream and/or downstream from the core promoter sequence may be included in expression constructs of transformation vectors to bring about varying levels of expression of heterologous nucleotide sequences in a transgenic plant.

A variety of 5N and 3N transcriptional regulatory sequences are available for use in the present invention. Transcriptional terminators are responsible for the termination of transcription and correct mRNA polyadenylation. The 3N nontranslated regulatory DNA sequence preferably includes from about 50 to about 1,000, more preferably about 100 to about 1,000, nucleotide base pairs and contains plant transcriptional and translational termination sequences. Appropriate transcriptional terminators and those which are known to function in plants include the CaMV 35S terminator, the tml terminator, the nopaline synthase terminator, the pea rbcS E9 terminator, the terminator for the T7 transcript from the octopine synthase gene of *Agrobacterium tumefaciens*, and the 3N end of the protease inhibitor I or II genes from potato or tomato, although other 3N elements known to those of skill in the art can also be employed. Alternatively, one also could use a gamma coixin, oleosin 3 or other terminator from the genus *Coix*.

Preferred 3N elements include those from the nopaline synthase gene of *Agrobacterium tumefaciens* (Bevan et al., 1983), the terminator for the T7 transcript from the octopine synthase gene of *Agrobacterium tumefaciens*, and the 3' end of the protease inhibitor I or II genes from potato or tomato.

As the DNA sequence between the transcription initiation site and the start of the coding sequence, i.e., the untranslated leader sequence, can influence gene expression, one may also wish to employ a particular leader sequence. Preferred leader sequences are contemplated to include those which include sequences predicted to direct optimum expression of the attached gene, i.e., to include a preferred consensus leader sequence which may increase or maintain mRNA stability and prevent inappropriate initiation of translation. The choice of such sequences will be known to those of skill in the art in light of the present disclosure. Sequences that are derived from genes that are highly expressed in plants will be most preferred.

Other sequences that have been found to enhance gene expression in transgenic plants include intron sequences (e.g., from Adh1, bronze1, actin1, actin 2 (WO 00/760067), or the sucrose synthase intron) and viral leader sequences (e.g., from TMV, MCMV and AMV). For example, a number of non-translated leader sequences derived from viruses are known to enhance expression. Specifically, leader sequences from Tobacco Mosaic Virus (TMV), Maize Chlorotic Mottle Virus (MCMV), and Alfalfa Mosaic Virus (AMV) have been shown to be effective in enhancing expression (e.g., Gallie et al., 1987; Skuzeski et al., 1990). Other leaders known in the art include but are not limited to: Picornavirus leaders, for example, EMCV leader (Encephalomyocarditis 5 noncoding region) (Elroy-Stein et al., 1989); Potyvirus leaders, for example, TEV leader (Tobacco Etch Virus); MDMV leader (Maize Dwarf Mosaic Virus); Human immunoglobulin heavy-chain binding protein (BiP) leader, (Macejak et al., 1991); Untranslated leader from the coat protein mRNA of alfalfa mosaic virus (AMV RNA 4), (Jobling et al., 1987; Tobacco mosaic virus leader (TMV), (Gallie et al., 1989; and Maize Chlorotic Mottle Virus leader (MCMV) (Lommel et al., 1991. See also, Della-Cioppa et al., 1987.

Regulatory elements such as Adh intron 1 (Callis et al., 1987), sucrose synthase intron (Vasil et al., 1989) or TMV omega element (Gallie, et al., 1989), may further be included where desired.

Examples of enhancers include elements from the CaMV 35S promoter, octopine synthase genes (Ellis et al., 1987), the rice actin I gene, the maize alcohol dehydrogenase gene (Callis et al., 1987), the maize shrunken I gene (Vasil et al., 1989), TMV Omega element (Gallie et al., 1989) and promoters from non-plant eukaryotes (e.g. yeast; Ma et al., 1988).

Vectors for use in accordance with the present invention may be constructed to include the ocs enhancer element. This element was first identified as a 16 bp palindromic enhancer from the octopine synthase (ocs) gene of ultilane (Ellis et al., 1987), and is present in at least 10 other promoters (Bouchez et al., 1989). The use of an enhancer element, such as the ocs element and particularly multiple copies of the element, will act to increase the level of transcription from adjacent promoters when applied in the context of monocot transformation.

Ultimately, the most desirable DNA segments for introduction into, for example, a monocot genome, may be homologous genes or gene families which encode a desired trait (e.g., increased yield per acre) and which are introduced under the control of novel promoters or enhancers, etc., or perhaps even homologous or tissue specific (e.g., root-, collar/sheath-, whorl-, stalk-, earshank-, kernel- or leaf-specific) promoters or control elements. Indeed, it is envisioned that a particular use of the present invention will be the expression of a gene in a constitutive or a seed-specific manner.

Vectors for use in tissue-specific targeting of genes in transgenic plants will typically include tissue-specific promoters and may also include other tissue-specific control elements such as enhancer sequences. Promoters which direct specific or enhanced expression in certain plant tissues will be known to those of skill in the art in light of the present disclosure. These include, for example, the rbcS promoter, specific for green tissue; the ocs, nos and mas promoters which have higher activity in roots or wounded leaf tissue; a truncated (−90 to +8) 35S promoter which directs enhanced expression in roots, an alpha-tubulin gene that directs expression in roots and promoters derived from zein storage protein genes which direct expression in endosperm. It is particularly contemplated that one may advantageously use the 16 bp ocs enhancer element from the octopine synthase (ocs) gene (Ellis et al., 1987; Bouchez et al., 1989), especially when present in multiple copies, to achieve enhanced expression in roots.

Tissue specific expression may be functionally accomplished by introducing a constitutively expressed gene (all tissues) in combination with an antisense gene that is expressed only in those tissues where the gene product is not desired. For example, a gene coding for the crystal toxin protein from *B. thuringiensis* (Bt) may be introduced such that it is expressed in all tissues using the 35S promoter from Cauliflower Mosaic Virus. Expression of an antisense transcript of the Bt gene in a maize kernel, using for example a zein promoter, would prevent accumulation of the Bt protein in seed. Hence the protein encoded by the introduced gene would be present in all tissues except the kernel.

Expression of some genes in transgenic plants will be desired only under specified conditions. For example, it is proposed that expression of certain genes that confer resistance to environmental stress factors such as drought will be desired only under actual stress conditions. It is contemplated that expression of such genes throughout a plants development may have detrimental effects. It is known that a large number of genes exist that respond to the environment. For example, expression of some genes such as rbcS, encoding the small subunit of ribulose bisphosphate carboxylase, is regulated by light as mediated through phytochrome. Other genes are induced by secondary stimuli. For example, synthesis of abscisic acid (ABA) is induced by certain environmental factors, including but not limited to water stress. A number of genes have been shown to be induced by ABA (Skriver and Mundy, 1990). It is also anticipated that expression of genes conferring resistance to insect predation would be desired only under conditions of actual insect infestation. Therefore, for some desired traits inducible expression of genes in transgenic plants will be desired.

Expression of a gene in a transgenic plant will be desired only in a certain time period during the development of the plant. Developmental timing is frequently correlated with tissue specific gene expression. For example, expression of zein storage proteins is initiated in the endosperm about 15 days after pollination.

Additionally, vectors may be constructed and employed in the intracellular targeting of a specific gene product within the cells of a transgenic plant or in directing a protein to the extracellular environment. This will generally be achieved by joining a DNA sequence encoding a transit or signal peptide sequence to the coding sequence of a particular gene. The resultant transit, or signal, peptide will transport the protein to a particular intracellular, or extracellular destination, respectively, and will then be post-translationally removed. Transit or signal peptides act by facilitating the transport of proteins through intracellular membranes, e.g., vacuole, vesicle, plastid and mitochondrial membranes, whereas signal peptides direct proteins through the extracellular membrane.

A particular example of such a use concerns the direction of a herbicide resistance gene, such as the EPSPS gene, to a particular organelle such as the chloroplast rather than to the cytoplasm. This is exemplified by the use of the rbcs transit peptide which confers plastid-specific targeting of proteins. In addition, it is proposed that it may be desirable to target certain genes responsible for male sterility to the mitochondria, or to target certain genes for resistance to phytopathogenic organisms to the extracellular spaces, or to target proteins to the vacuole.

By facilitating the transport of the protein into compartments inside and outside the cell, these sequences may increase the accumulation of gene product protecting them from proteolytic degradation. These sequences also allow for additional mRNA sequences from highly expressed genes to be attached to the coding sequence of the genes. Since mRNA being translated by ribosomes is more stable than naked mRNA, the presence of translatable mRNA in front of the gene may increase the overall stability of the mRNA transcript from the gene and thereby increase synthesis of the gene product. Since transit and signal sequences are usually post-translationally removed from the initial translation product, the use of these sequences allows for the addition of extra translated sequences that may not appear on the final polypeptide. Targeting of certain proteins may be desirable in order to enhance the stability of the protein (U.S. Pat. No. 5,545,818).

It may be useful to target DNA itself within a cell. For example, it may be useful to target introduced DNA to the nucleus as this may increase the frequency of transformation. Within the nucleus itself it would be useful to target a gene in order to achieve site specific integration. For example, it would be useful to have an gene introduced through transformation replace an existing gene in the cell.

Other elements include those that can be regulated by endogenous or exogenous agents, e.g., by zinc finger proteins, including naturally occurring zinc finger proteins or chimeric zinc finger proteins (see, e.g., U.S. Pat. No. 5,789, 538, WO 99/48909; WO 99/45132; WO 98/53060; WO 98/53057; WO 98/53058; WO 00/23464; WO 95/19431; and WO 98/54311) or myb-like transcription factors. For example, a chimeric zinc finger protein may include amino acid sequences which bind to a specific DNA sequence (the zinc finger) and amino acid sequences that activate (e.g., GAL 4 sequences) or repress the transcription of the sequences linked to the specific DNA sequence.

It is one of the objects of the present invention to provide recombinant DNA molecules comprising a nucleotide sequence according to the invention operably linked to a nucleotide segment of interest.

A nucleotide segment of interest is reflective of the commercial markets and interests of those involved in the development of the crop. Crops and markets of interest changes, and as developing nations open up world markets, new crops and technologies will also emerge. In addition, as the understanding of agronomic traits and characteristics such as yield and heterosis increase, the choice of genes for transformation will change accordingly. General categories of nucleotides of interest include, for example, genes involved in information, such as zinc fingers, those involved in communication, such as kinases, and those involved in housekeeping, such as heat shock proteins. More specific categories of transgenes, for example, include genes encoding important traits for agronomics, insect resistance, disease resistance, herbicide resistance, sterility, grain characteristics, and commercial products. Genes of interest include, generally, those involved in starch, oil, carbohydrate, or nutrient metabolism, as well as those affecting kernel size, sucrose loading, zinc finger proteins, see, e.g., U.S. Pat. No. 5,789,538, WO 99/48909; WO 99/45132; WO 98/53060; WO 98/53057; WO 98/53058; WO 00/23464; WO 95/19431; and WO 98/54311, and the like.

One skilled in the art recognizes that the expression level and regulation of a transgene in a plant can vary significantly from line to line. Thus, one has to test several lines to find one with the desired expression level and regulation. Once a line is identified with the desired regulation specificity of a chimeric Cre transgene, it can be crossed with lines carrying different inactive replicons or inactive transgene for activation.

Other sequences which may be linked to the gene of interest which encodes a polypeptide are those which can target to a specific organelle, e.g., to the mitochondria, nucleus, or plastid, within the plant cell. Targeting can be achieved by providing the polypeptide with an appropriate targeting peptide sequence, such as a secretory signal peptide (for secretion or cell wall or membrane targeting, a plastid transit peptide, a chloroplast transit peptide, e.g., the chlorophyll a/b binding protein, a mitochondrial target peptide, a vacuole targeting peptide, or a nuclear targeting peptide, and the like. For example, the small subunit of ribulose bisphosphate carboxylase transit peptide, the EPSPS transit peptide or the dihydrodipicolinic acid synthase transit peptide may be used. For examples of plastid organelle targeting sequences (see WO 00/12732). Plastids are a class of plant organelles derived from proplastids and include chloroplasts, leucoplasts, aravloplasts, and chromoplasts. The plastids are major sites of biosynthesis in plants. In addition to photosynthesis in the chloroplast, plastids are also sites of lipid biosynthesis, nitrate reduction to ammonium, and starch storage. And while plastids contain their own circular genome, most of the proteins localized to the plastids are encoded by the nuclear genome and are imported into the organelle from the cytoplasm.

Transgenes used with the present invention will often be genes that direct the expression of a particular protein or polypeptide product, but they may also be non-expressible DNA segments, e.g., transposons such as Ds that do no direct their own transposition. As used herein, an "expressible gene" is any gene that is capable of being transcribed into RNA (e.g., mRNA, antisense RNA, etc.) or translated into a protein, expressed as a trait of interest, or the like, etc., and is not limited to selectable, screenable or non-selectable marker genes. The invention also contemplates that, where both an expressible gene that is not necessarily a marker gene is employed in combination with a marker gene, one may employ the separate genes on either the same or different DNA segments for transformation. In the latter case, the different vectors are delivered concurrently to recipient cells to maximize cotransformation.

The choice of the particular DNA segments to be delivered to the recipient cells will often depend on the purpose of the transformation. One of the major purposes of transformation of crop plants is to add some commercially desirable, agronomically important traits to the plant. Such traits include, but are not limited to, herbicide resistance or tolerance; insect resistance or tolerance; disease resistance or tolerance (viral, bacterial, fungal, nematode); stress tolerance and/or resistance, as exemplified by resistance or tolerance to drought, heat, chilling, freezing, excessive moisture, salt stress; oxidative stress; increased yields; food content and makeup; physical appearance; male sterility; drydown; standability; prolificacy; starch properties; oil quantity and quality; and the like. One may desire to incorporate one or more genes conferring any such desirable trait or traits, such as, for example, a gene or genes encoding pathogen resistance.

In certain embodiments, the present invention contemplates the transformation of a recipient cell with more than one advantageous transgene. Two or more transgenes can be supplied in a single transformation event using either distinct transgene-encoding vectors, or using a single vector incorporating two or more gene coding sequences. For example, plasmids bearing the bar and aroA expression units in either convergent, divergent, or collinear orientation, are considered to be particularly useful. Further preferred combinations are those of an insect resistance gene, such as a Bt gene, along with a protease inhibitor gene such as pinII, or the use of bar in combination with either of the above genes. Of course, any two or more transgenes of any description, such as those conferring herbicide, insect, disease (viral, bacterial, fungal, nematode) or drought resistance, male sterility, drydown, standability, prolificacy, starch properties, oil quantity and quality, or those increasing yield or nutritional quality may be employed as desired.

A. Exemplary Transgenes

1. Herbicide Resistance

The genes encoding phosphinothricin acetyltransferase (bar and pat), glyphosate tolerant EPSP synthase genes, the glyphosate degradative enzyme gene gox encoding glyphosate oxidoreductase, deh (encoding a dehalogenase enzyme that inactivates dalapon), herbicide resistant (e.g., sulfonylurea and imidazolinone) acetolactate synthase, and bxn genes (encoding a nitrilase enzyme that degrades bromoxynil) are good examples of herbicide resistant genes for use in transformation. The bar and pat genes code for an enzyme, phosphinothricin acetyltransferase (PAT), which inactivates the herbicide phosphinothricin and prevents this compound from inhibiting glutamine synthetase enzymes. The enzyme 5-enolpyruvylshikimate 3-phosphate synthase (EPSP Synthase), is normally inhibited by the herbicide N-(phosphonomethyl)glycine (glyphosate). However, genes are known that encode glyphosate-resistant EPSP Synthase enzymes.

These genes are particularly contemplated for use in monocot transformation. The deh gene encodes the enzyme dalapon dehalogenase and confers resistance to the herbicide dalapon. The bxn gene codes for a specific nitrilase enzyme that converts bromoxynil to a non-herbicidal degradation product.

2. Insect Resistance

An important aspect of the present invention concerns the introduction of insect resistance-conferring genes into plants. Potential insect resistance genes which can be introduced include *Bacillus thuringiensis* crystal toxin genes or Bt genes (Watrud et al., 1985). Bt genes may provide resistance to lepidopteran or coleopteran pests such as European Corn Borer (ECB) and corn rootworm (CRW). Preferred Bt toxin genes for use in such embodiments include the CryIA(b) and CryIA(c) genes. Endotoxin genes from other species of *B. thuringiensis* which affect insect growth or development may also be employed in this regard.

The poor expression of Bt toxin genes in plants is a well-documented phenomenon, and the use of different promoters, fusion proteins, and leader sequences has not led to significant increases in Bt protein expression (Vaeck et al., 1989; Barton et al., 1987). It is therefore contemplated that the most advantageous Bt genes for use in the transformation protocols disclosed herein will be those in which the coding sequence has been modified to effect increased expression in plants, and more particularly, those in which maize preferred codons have been used. Examples of such modified Bt toxin genes include the variant Bt CryIA(b) gene termed Iab6 (Perlak et al., 1991) and the synthetic CryIA(c) genes termed 1800a and 1800b.

Protease inhibitors may also provide insect resistance (Johnson et al., 1989), and will thus have utility in plant transformation. The use of a protease inhibitor II gene, pinII, from tomato or potato is envisioned to be particularly useful. Even more advantageous is the use of a pinII gene in combination with a Bt toxin gene, the combined effect of which has been discovered by the present inventors to produce synergistic insecticidal activity. Other genes which encode inhibitors of the insects' digestive system, or those that encode enzymes or co-factors that facilitate the production of inhibitors, may also be useful. This group may be exemplified by oryzacystatin and amylase inhibitors, such as those from wheat and barley.

Also, genes encoding lectins may confer additional or alternative insecticide properties. Lectins (originally termed phytohemagglutinins) are multivalent carbohydrate-binding proteins which have the ability to agglutinate red blood cells from a range of species. Lectins have been identified recently as insecticidal agents with activity against weevils, ECB and rootworm (Murdock et al., 1990; Czapla and Lang, 1990). Lectin genes contemplated to be useful include, for example, barley and wheat germ agglutinin (WGA) and rice lectins (Gatehouse et al., 1984), with WGA being preferred.

Genes controlling the production of large or small polypeptides active against insects when introduced into the insect pests, such as, e.g., lytic peptides, peptide hormones and toxins and venoms, form another aspect of the invention. For example, it is contemplated that the expression of juvenile hormone esterase, directed towards specific insect pests, may also result in insecticidal activity, or perhaps cause cessation of metamorphosis (Hammock et al., 1990).

Transgenic plants expressing genes which encode enzymes that affect the integrity of the insect cuticle form yet another aspect of the invention. Such genes include those encoding, e.g., chitinase, proteases, lipases and also genes for the production of nikkomycin, a compound that inhibits chitin synthesis, the introduction of any of which is contemplated to produce insect resistant maize plants. Genes that code for activities that affect insect molting, such those affecting the production of ecdysteroid UDP-glucosyl transferase, also fall within the scope of the useful transgenes of the present invention.

Genes that code for enzymes that facilitate the production of compounds that reduce the nutritional quality of the host plant to insect pests are also encompassed by the present invention. It may be possible, for instance, to confer insecticidal activity on a plant by altering its sterol composition. Sterols are obtained by insects from their diet and are used for hormone synthesis and membrane stability. Therefore alterations in plant sterol composition by expression of novel genes, e.g., those that directly promote the production of undesirable sterols or those that convert desirable sterols into undesirable forms, could have a negative effect on insect growth and/or development and hence endow the plant with insecticidal activity. Lipoxygenases are naturally occurring plant enzymes that have been shown to exhibit anti-nutritional effects on insects and to reduce the nutritional quality of their diet. Therefore, further embodiments of the invention concern transgenic plants with enhanced lipoxygenase activity which may be resistant to insect feeding.

The present invention also provides methods and compositions by which to achieve qualitative or quantitative changes in plant secondary metabolites. One example concerns transforming plants to produce DIMBOA which, it is contemplated, will confer resistance to European corn borer, rootworm and several other maize insect pests. Candidate genes that are particularly considered for use in this regard include those genes at the bx locus known to be involved in the synthetic DIMBOA pathway (Dunn et al., 1981). The introduction of genes that can regulate the production of maysin, and genes involved in the production of dhurrin in sorghum, is also contemplated to be of use in facilitating resistance to earworm and rootworm, respectively.

*Tripsacum dactyloides* is a species of grass that is resistant to certain insects, including corn root worm. It is anticipated that genes encoding proteins that are toxic to insects or are involved in the biosynthesis of compounds toxic to insects will be isolated from *Tripsacum* and that these novel genes will be useful in conferring resistance to insects. It is known that the basis of insect resistance in *Tripsacum* is genetic, because said resistance has been transferred to *Zea mays* via sexual crosses (Branson and Guss, 1972).

Further genes encoding proteins characterized as having potential insecticidal activity may also be used as transgenes in accordance herewith. Such genes include, for example, the cowpea trypsin inhibitor (CpTI; Hilder et al., 1987) which may be used as a rootworm deterrent; genes encoding avermectin (Campbell, 1989; Ikeda et al., 1987) which may prove particularly useful as a corn rootworm deterrent; ribosome inactivating protein genes; and even genes that regulate plant structures. Transgenic maize including anti-insect antibody genes and genes that code for enzymes that can covert a non-toxic insecticide (pro-insecticide) applied to the outside of the plant into an insecticide inside the plant are also contemplated.

3. Environment or Stress Resistance

Improvement of a plant's ability to tolerate various environmental stresses such as, but not limited to, drought, excess moisture, chilling, freezing, high temperature, salt, and oxidative stress, can also be effected through expression of heterologous, or overexpression of homologous genes. Benefits may be realized in terms of increased resistance to freezing temperatures through the introduction of an "antifreeze" protein such as that of the Winter Flounder (Cutler et al., 1989) or synthetic gene derivatives thereof. Improved chilling tolerance may also be conferred through increased expression of glycerol-3-phosphate acetyltransferase in chloroplasts (Murata et al., 1992; Wolter et al., 1992). Resistance to oxidative stress (often exacerbated by conditions such as chilling temperatures in combination with high light intensities) can be conferred by expression of superoxide dismutase (Gupta et al., 1993), and may be improved by glutathione reductase (Bowler et al., 1992). Such strategies may allow for tolerance to freezing in newly emerged fields as well as extending later maturity higher yielding varieties to earlier relative maturity zones.

Expression of novel genes that favorably effect plant water content, total water potential, osmotic potential, and turgor can enhance the ability of the plant to tolerate drought. As used herein, the terms "drought resistance" and "drought tolerance" are used to refer to a plants increased resistance or tolerance to stress induced by a reduction in water availability, as compared to normal circumstances, and the ability of the plant to function and survive in lower-water environments, and perform in a relatively superior manner. In this aspect of the invention it is proposed, for example, that the expression of a gene encoding the biosynthesis of osmotically-active solutes can impart protection against drought. Within this class of genes are DNAs encoding mannitol dehydrogenase (Lee and Saier, 1982) and trehalose-6-phosphate synthase (Kaasen et al., 1992). Through the subsequent action of native phosphatases in the cell or by the introduction and coexpression of a specific phosphatase, these introduced genes will result in the accumulation of either mannitol or trehalose, respectively, both of which have been well documented as protective compounds able to mitigate the effects of stress. Mannitol accumulation in transgenic tobacco has been verified and preliminary results indicate that plants expressing high levels of this metabolite are able to tolerate an applied osmotic stress (Tarczynski et al., 1992).

Similarly, the efficacy of other metabolites in protecting either enzyme function (e.g. alanopine or propionic acid) or membrane integrity (e.g., alanopine) has been documented (Loomis et al., 1989), and therefore expression of gene encoding the biosynthesis of these compounds can confer drought resistance in a manner similar to or complimentary to mannitol. Other examples of naturally occurring metabolites that are osmotically active and/or provide some direct protective effect during drought and/or desiccation include sugars and sugar derivatives such as fructose, erythritol (Coxson et al., 1992), sorbitol, dulcitol (Karsten et al., 1992), glucosylglycerol (Reed et al., 1984; Erdmann et al., 1992), sucrose, stachyose (Koster and Leopold, 1988; Blackman et al., 1992), ononitol and pinitol (Vernon and Bohnert, 1992), and raffinose (Bernal-Lugo and Leopold, 1992). Other osmotically active solutes which are not sugars include, but are not limited to, proline and glycine-betaine (Wyn-Jones and Storey, 1981). Continued canopy growth and increased reproductive fitness during times of stress can be augmented by introduction and expression of genes such as those controlling the osmotically active compounds discussed above and other such compounds, as represented in one exemplary embodiment by the enzyme myoinositol 0-methyltransferase.

It is contemplated that the expression of specific proteins may also increase drought tolerance. Three classes of Late Embryogenic Proteins have been assigned based on structural similarities (see Dure et al., 1989). All three classes of these proteins have been demonstrated in maturing (i.e., desiccating) seeds. Within these 3 types of proteins, the Type-II (dehydrin-type) have generally been implicated in drought and/or desiccation tolerance in vegetative plant parts (i.e. Mundy and Chua, 1988; Piatkowski et al., 1990; Yamaguchi-Shinozaki et al., 1992). Recently, expression of a Type-III LEA (HVA-1) in tobacco was found to influence plant height, maturity and drought tolerance (Fitzpatrick, 1993). Expression of structural genes from all three groups may therefore confer drought tolerance. Other types of proteins induced during water stress include thiol proteases, aldolases and transmembrane transporters (Guerrero et al., 1990), which may confer various protective and/or repair-type functions during drought stress. The expression of a gene that effects lipid biosynthesis and hence membrane composition can also be useful in conferring drought resistance on the plant.

Many genes that improve drought resistance have complementary modes of action. Thus, combinations of these genes might have additive and/or synergistic effects in improving drought resistance in maize. Many of these genes also improve freezing tolerance (or resistance); the physical stresses incurred during freezing and drought are similar in nature and may be mitigated in similar fashion. Benefit may be conferred via constitutive expression of these genes, but the preferred means of expressing these novel genes may be through the use of a turgor-induced promoter (such as the promoters for the turgor-induced genes described in Guerrero et al. 1990 and Shagan et al., 1993). Spatial and temporal expression patterns of these genes may enable maize to better withstand stress.

Expression of genes that are involved with specific morphological traits that allow for increased water extractions from drying soil would be of benefit. For example, introduction and expression of genes that alter root characteristics may enhance water uptake. Expression of genes that enhance reproductive fitness during times of stress would be of significant value. For example, expression of DNAs that improve the synchrony of pollen shed and receptiveness of the female flower parts, i.e., silks, would be of benefit. In addition, expression of genes that minimize kernel abortion during times of stress would increase the amount of grain to be harvested and hence be of value. Regulation of cytokinin levels in monocots, such as maize, by introduction and expression of an isopentenyl transferase gene with appropriate regulatory sequences can improve monocot stress resistance and yield (Gan et al., *Science,* 270:1986 (1995)).

Given the overall role of water in determining yield, it is contemplated that enabling plants to utilize water more efficiently, through the introduction and expression of novel genes, will improve overall performance even when soil water availability is not limiting. By introducing genes that improve the ability of plants to maximize water usage across a full range of stresses relating to water availability, yield stability or consistency of yield performance may be realized.

4. Disease Resistance

It is proposed that increased resistance to diseases may be realized through introduction of genes into plants period. It is possible to produce resistance to diseases caused by viruses, bacteria, fungi, root pathogens, insects and nematodes. It is also contemplated that control of mycotoxin producing organisms may be realized through expression of introduced genes.

Resistance to viruses may be produced through expression of novel genes. For example, it has been demonstrated that expression of a viral coat protein in a transgenic plant can impart resistance to infection of the plant by that virus and perhaps other closely related viruses (Cuozzo et al., 1988, Hemenway et al., 1988, Abel et al., 1986). It is contemplated that expression of antisense genes targeted at essential viral functions may impart resistance to said virus. For example, an antisense gene targeted at the gene responsible for replication of viral nucleic acid may inhibit said replication and lead to resistance to the virus. It is believed that interference with other viral functions through the use of antisense genes may also increase resistance to viruses. Further it is proposed that it may be possible to achieve resistance to viruses through other approaches, including, but not limited to the use of satellite viruses.

It is proposed that increased resistance to diseases caused by bacteria and fungi may be realized through introduction of novel genes. It is contemplated that genes encoding so-called "peptide antibiotics," pathogenesis related (PR) proteins, toxin resistance, and proteins affecting host-pathogen interactions such as morphological characteristics will be useful. Peptide antibiotics are polypeptide sequences which are inhibitory to growth of bacteria and other microorganisms. For example, the classes of peptides referred to as cecropins and magainins inhibit growth of many species of bacteria and fungi. It is proposed that expression of PR proteins in plants may be useful in conferring resistance to bacterial disease. These genes are induced following pathogen attack on a host plant and have been divided into at least five classes of proteins (Bol et al., 1990). Included amongst the PR proteins are beta-1,3-glucanases, chitinases, and osmotin and other proteins that are believed to function in plant resistance to disease organisms. Other genes have been identified that have antifungal properties, e.g., UDA (stinging nettle lectin) and hevein (Broakgert et al., 1989; Barkai-Golan et al., 1978). It is known that certain plant diseases are caused by the production of phytotoxins. Resistance to these diseases could be achieved through expression of a novel gene that encodes an enzyme capable of degrading or otherwise inactivating the phytotoxin. Expression novel genes that alter the interactions between the host plant and pathogen may be useful in reducing the ability the disease organism to invade the tissues of the host plant, e.g., an increase in the waxiness of the leaf cuticle or other morphological characteristics.

Plant parasitic nematodes are a cause of disease in many plants. It is proposed that it would be possible to make the plant resistant to these organisms through the expression of novel genes. It is anticipated that control of nematode infestations would be accomplished by altering the ability of the nematode to recognize or attach to a host plant and/or enabling the plant to produce nematicidal compounds, including but not limited to proteins.

5. Mycotoxin Reduction/Elimination

Production of mycotoxins, including aflatoxin and fumonisin, by fungi associated with plants is a significant factor in rendering the grain not useful. These fungal organisms do not cause disease symptoms and/or interfere with the growth of the plant, but they produce chemicals (mycotoxins) that are toxic to animals. Inhibition of the growth of these fungi would reduce the synthesis of these toxic substances and, therefore, reduce grain losses due to mycotoxin contamination. Novel genes may be introduced into plants that would inhibit synthesis of the mycotoxin without interfering with fungal growth. Expression of a novel gene which encodes an enzyme capable of rendering the mycotoxin nontoxic would be useful in order to achieve reduced mycotoxin contamination of grain. The result of any of the above mechanisms would be a reduced presence of mycotoxins on grain.

6. Grain Composition or Quality

Genes may be introduced into plants, particularly commercially important cereals such as maize, wheat or rice, to improve the grain for which the cereal is primarily grown. A wide range of novel transgenic plants produced in this manner may be envisioned depending on the particular end use of the grain.

For example, the largest use of maize grain is for feed or food. Introduction of genes that alter the composition of the grain may greatly enhance the feed or food value. The primary components of maize grain are starch, protein, and oil. Each of these primary components of maize grain may be improved by altering its level or composition. Several examples may be mentioned for illustrative purposes but in no way provide an exhaustive list of possibilities.

The protein of many cereal grains is suboptimal for feed and food purposes especially when fed to pigs, poultry, and humans. The protein is deficient in several amino acids that are essential in the diet of these species, requiring the addition of supplements to the grain. Limiting essential amino acids may include lysine, methionine, tryptophan, threonine, valine, arginine, and histidine. Some amino acids become limiting only after the grain is supplemented with other inputs for feed formulations. For example, when the grain is supplemented with soybean meal to meet lysine requirements, methionine becomes limiting. The levels of these essential amino acids in seeds and grain may be elevated by mechanisms which include, but are not limited to, the introduction of genes to increase the biosynthesis of the amino acids, decrease the degradation of the amino acids, increase the storage of the amino acids in proteins, or increase transport of the amino acids to the seeds or grain.

One mechanism for increasing the biosynthesis of the amino acids is to introduce genes that deregulate the amino acid biosynthetic pathways such that the plant can no longer adequately control the levels that are produced. This may be done by deregulating or bypassing steps in the amino acid biosynthetic pathway which are normally regulated by levels of the amino acid end product of the pathway. Examples include the introduction of genes that encode deregulated versions of the enzymes aspartokinase or dihydrodipicolinic acid (DHDP)-synthase for increasing lysine and threonine production, and anthranilate synthase for increasing tryptophan production. Reduction of the catabolism of the amino acids may be accomplished by introduction of DNA sequences that reduce or eliminate the expression of genes encoding enzymes that catalyse steps in the catabolic pathways such as the enzyme lysine-ketoglutarate reductase.

The protein composition of the grain may be altered to improve the balance of amino acids in a variety of ways including elevating expression of native proteins, decreasing expression of those with poor composition, changing the composition of native proteins, or introducing genes encoding entirely new proteins possessing superior composition. DNA may be introduced that decreases the expression of members of the zein family of storage proteins. This DNA may encode ribozymes or antisense sequences directed to impairing expression of zein proteins or expression of regulators of zein expression such as the opaque-2 gene product. The protein composition of the grain may be modified through the phenomenon of cosuppression, i.e., inhibition of expression of an endogenous gene through the expression of an identical structural gene or gene fragment introduced through transformation (Goring et al., 1991). Additionally, the introduced DNA may encode enzymes which degrade seines. The decreases in zein expression that are achieved may be accompanied by increases in proteins with more desirable amino acid composition or increases in other major seed constituents such as starch. Alternatively, a chimeric gene may be introduced that comprises a coding sequence for a native protein of adequate amino acid composition such as for one of the globulin proteins or 10 kD zein of maize and a promoter or other regulatory sequence designed to elevate expression of said protein. The coding sequence of said gene may include additional or replacement codons for essential amino acids. Further, a coding sequence obtained from another species, or, a partially or completely synthetic sequence encoding a completely unique peptide sequence designed to enhance the amino acid composition of the seed may be employed.

The introduction of genes that alter the oil content of the grain may be of value. Increases in oil content may result in increases in metabolizable energy content and density of the seeds for uses in feed and food. The introduced genes may encode enzymes that remove or reduce rate-limitations or regulated steps in fatty acid or lipid-biosynthesis. Such genes may include, but are not limited to, those that encode acetyl-CoA carboxylase, ACP-acyltransferase, beta-ketoacyl-ACP synthase, plus other well known fatty acid biosynthetic activities. Other possibilities are genes that encode proteins that do not possess enzymatic activity such as acyl carrier protein. Additional examples include 2-acetyltransferase, oleosin pyruvate dehydrogenase complex, acetyl CoA synthetase, ATP citrate lyase, ADP-glucose pyrophosphorylase and genes of the carnitine-CoA-acetyl-CoA shuttles. It is anticipated that expression of genes related to oil biosynthesis will be targeted to the plastid, using a plastid transit peptide sequence and preferably expressed in the seed embryo. Genes may be introduced that alter the balance of fatty acids present in the oil providing a more healthful or nutritive feedstuff. The introduced DNA may also encode sequences that block expression of enzymes involved in fatty acid biosynthesis, altering the proportions of fatty acids present in the grain such as described below.

Genes may be introduced that enhance the nutritive value of the starch component of the grain, for example by increasing the degree of branching, resulting in improved utilization of the starch in cows by delaying its metabolism.

Besides affecting the major constituents of the grain, genes may be introduced that affect a variety of other nutritive, processing, or other quality aspects of the grain as used for feed or food. For example, pigmentation of the grain may be increased or decreased. Enhancement and stability of yellow pigmentation is desirable in some animal feeds and may be achieved by introduction of genes that result in enhanced production of xanthophylls and carotenes by eliminating rate-limiting steps in their production. Such genes may encode altered forms of the enzymes phytoene synthase, phytoene desaturase, or lycopene synthase. Alternatively, unpigmented white corn is desirable for production of many food products and may be produced by the introduction of DNA which blocks or eliminates steps in pigment production pathways.

Feed or food comprising some cereal grains possesses insufficient quantities of vitamins and must be supplemented to provide adequate nutritive value. Introduction of genes that enhance vitamin biosynthesis in seeds may be envisioned including, for example, vitamins A, E, $B_{12}$, choline, and the like. For example, maize grain also does not possess sufficient mineral content for optimal nutritive value. Genes that affect the accumulation or availability of compounds containing phosphorus, sulfur, calcium, manganese, zinc, and iron among others would be valuable. An example may be the introduction of a gene that reduced phytic acid production or encoded the enzyme phytase which enhances phytic acid breakdown. These genes would increase levels of available phosphate in the diet, reducing the need for supplementation with mineral phosphate.

Numerous other examples of improvement of cereals for feed and food purposes might be described. The improvements may not even necessarily involve the grain, but may, for example, improve the value of the grain for silage. Introduction of DNA to accomplish this might include sequences that alter lignin production such as those that result in the "brown midrib" phenotype associated with superior feed value for cattle.

In addition to direct improvements in feed or food value, genes may also be introduced which improve the processing of grain and improve the value of the products resulting from the processing. The primary method of processing certain grains such as maize is via wetmilling. Maize may be improved though the expression of novel genes that increase the efficiency and reduce the cost of processing such as by decreasing steeping time.

Improving the value of wetmilling products may include altering the quantity or quality of starch, oil, corn gluten meal, or the components of corn gluten feed. Elevation of starch may be achieved through the identification and elimination of rate limiting steps in starch biosynthesis or by decreasing levels of the other components of the grain resulting in proportional increases in starch. An example of the former may be the introduction of genes encoding ADP-glucose pyrophosphorylase enzymes with altered regulatory activity or which are expressed at higher level. Examples of the latter may include selective inhibitors of, for example, protein or oil biosynthesis expressed during later stages of kernel development.

The properties of starch may be beneficially altered by changing the ratio of amylose to amylopectin, the size of the starch molecules, or their branching pattern. Through these changes a broad range of properties may be modified which include, but are not limited to, changes in gelatinization temperature, heat of gelatinization, clarity of films and pastes, Theological properties, and the like. To accomplish these changes in properties, genes that encode granule-bound or soluble starch synthase activity or branching enzyme activity may be introduced alone or combination. DNA such as antisense constructs may also be used to decrease levels of endogenous activity of these enzymes. The introduced genes or constructs may possess regulatory sequences that time their expression to specific intervals in starch biosynthesis and starch granule development. Furthermore, it may be advisable to introduce and express genes that result in the in vivo derivatization, or other modification, of the glucose moieties of the starch molecule. The covalent attachment of any molecule may be envisioned, limited only by the existence of enzymes that catalyze the derivatizations and the accessibility of appropriate substrates in the starch granule. Examples of important derivations may include the addition of functional groups such as amines, carboxyls, or phosphate groups which provide sites for subsequent in vitro derivatizations or affect starch properties through the introduction of ionic charges. Examples of other modifications may include direct changes of the glucose units such as loss of hydroxyl groups or their oxidation to aldehyde or carboxyl groups.

Oil is another product of wetmilling of corn and other grains, the value of which may be improved by introduction and expression of genes. The quantity of oil that can be extracted by wetmilling may be elevated by approaches as described for feed and food above. Oil properties may also be altered to improve its performance in the production and use of cooking oil, shortenings, lubricants or other oil-derived products or improvement of its health attributes when used in the food-related applications. Novel fatty acids may also be synthesized which upon extraction can serve as starting materials for chemical syntheses. The changes in oil properties may be achieved by altering the type, level, or lipid arrangement of the fatty acids present in the oil. This in turn may be accomplished by the addition of genes that encode enzymes that catalyze the synthesis of novel fatty acids and the lipids possessing them or by increasing levels of native fatty acids while possibly reducing levels of precursors. Alternatively DNA sequences may be introduced which slow or block steps in fatty acid biosynthesis resulting in the increase in precursor fatty acid intermediates. Genes that might be added include desaturases, epoxidases, hydratases, dehydratases, and other enzymes that catalyze reactions involving fatty acid intermediates. Representative examples of catalytic steps that might be blocked include the desaturations from stearic to oleic acid and oleic to linolenic acid resulting in the respective accumulations of stearic and oleic acids.

Improvements in the other major cereal wetmilling products, gluten meal and gluten feed, may also be achieved by the introduction of genes to obtain novel plants. Representative possibilities include but are not limited to those described above for improvement of food and feed value.

In addition it may further be considered that the plant be used for the production or manufacturing of useful biological compounds that were either not produced at all, or not produced at the same level, in the plant previously. The novel plants producing these compounds are made possible by the introduction and expression of genes by transformation methods. The possibilities include, but are not limited to, any biological compound which is presently produced by any organism such as proteins, nucleic acids, primary and intermediary metabolites, carbohydrate polymers, etc. The compounds may be produced by the plant, extracted upon harvest and/or processing, and used for any presently recognized useful purpose such as pharmaceuticals, fragrances, industrial enzymes to name a few.

Further possibilities to exemplify the range of grain traits or properties potentially encoded by introduced genes in transgenic plants include grain with less breakage susceptibility for export purposes or larger grit size when processed by dry milling through introduction of genes that enhance gamma-zein synthesis, popcorn with improved popping quality and expansion volume through genes that increase pericarp thickness, corn with whiter grain for food uses though introduction of genes that effectively block expression of enzymes involved in pigment production pathways, and improved quality of alcoholic beverages or sweet corn through introduction of genes which affect flavor such as the shrunken gene (encoding sucrose synthase) for sweet corn.

7. Plant Agronomic Characteristics

Two of the factors determining where plants can be grown are the average daily temperature during the growing season and the length of time between frosts. Within the areas where it is possible to grow a particular plant, there are varying limitations on the maximal time it is allowed to grow to maturity and be harvested. The plant to be grown in a particular area is selected for its ability to mature and dry down to harvestable moisture content within the required period of time with maximum possible yield. Therefore, plant of varying maturities are developed for different growing locations. Apart from the need to dry down sufficiently to permit harvest is the desirability of having maximal drying take place in the field to minimize the amount of energy required for additional drying post-harvest. Also the more readily the grain can dry down, the more time there is available for growth and kernel fill. Genes that influence maturity and/or dry down can be identified and introduced into plant lines using transformation techniques to create new varieties adapted to different growing locations or the same growing location but having improved yield to moisture ratio at harvest. Expression of genes that are involved in regulation of plant development may be especially useful, e.g., the liguleless and rough sheath genes that have been identified in plants.

Genes may be introduced into plants that would improve standability and other plant growth characteristics. For example, expression of novel genes which confer stronger stalks, improved root systems, or prevent or reduce ear droppage would be of great value to the corn farmer. Introduction and expression of genes that increase the total amount of photoassimilate available by, for example, increasing light distribution and/or interception would be advantageous. In addition the expression of genes that increase the efficiency of photosynthesis and/or the leaf canopy would further increase gains in productivity. Such approaches would allow for increased plant populations in the field.

Delay of late season vegetative senescence would increase the flow of assimilate into the grain and thus increase yield. Overexpression of genes within plants that are associated with "stay green" or the expression of any gene that delays senescence would achieve be advantageous. For example, a non-yellowing mutant has been identified in *Festuca pratensis* (Davies et al., 1990). Expression of this gene as well as others may prevent premature breakdown of chlorophyll and thus maintain canopy function.

8. Nutrient Utilization

The ability to utilize available nutrients and minerals may be a limiting factor in growth of many plants. It is proposed that it would be possible to alter nutrient uptake, tolerate pH extremes, mobilization through the plant, storage pools, and availability for metabolic activities by the introduction of novel genes. These modifications would allow a plant to more efficiently utilize available nutrients. It is contemplated that an increase in the activity of, for example, an enzyme that is normally present in the plant and involved in nutrient utilization would increase the availability of a nutrient. An example of such an enzyme would be phytase. It is also contemplated that expression of a novel gene may make a nutrient source available that was previously not accessible, e.g., an enzyme that releases a component of nutrient value from a more complex molecule, perhaps a macromolecule.

9. Male Sterility

Male sterility is useful in the production of hybrid seed. It is proposed that male sterility may be produced through expression of novel genes. For example, it has been shown that expression of genes that encode proteins that interfere with development of the male inflorescence and/or gametophyte result in male sterility. Chimeric ribonuclease genes that express in the anthers of transgenic tobacco and oilseed rape have been demonstrated to lead to male sterility (Mariani et al, 1990).

For example, a number of mutations were discovered in maize that confer cytoplasmic male sterility. One mutation in particular, referred to as T cytoplasm, also correlates with sensitivity to Southern corn leaf blight. A DNA sequence, designated TURF-13 (Levings, 1990), was identified that correlates with T cytoplasm. It would be possible through the introduction of TURF-13 via transformation to separate male sterility from disease sensitivity. As it is necessary to be able to restore male fertility for breeding purposes and for grain production, it is proposed that genes encoding restoration of male fertility may also be introduced.

10. Negative Selectable Markers

Introduction of genes encoding traits that can be selected against may be useful for eliminating undesirable linked genes. When two or more genes are introduced together by cotransformation, the genes will be linked together on the host chromosome. For example, a gene encoding a Bt gene that confers insect resistance on the plant may be introduced into a plant together with a bar gene that is useful as a selectable marker and confers resistance to the herbicide IGNITE® on the plant. However, it may not be desirable to have an insect resistant plant that is also resistant to the herbicide IGNITE®. It is proposed that one could also introduce an antisense bar gene that is expressed in those tissues where one does not want expression of the bar gene, e.g., in whole plant parts. Hence, although the bar gene is expressed and is useful as a selectable marker, it is not useful to confer herbicide resistance on the whole plant. The bar antisense gene is a negative selectable marker.

Negative selection is necessary in order to screen a population of transformants for rare homologous recombinants generated through gene targeting. For example, a homologous recombinant may be identified through the inactivation of a gene that was previously expressed in that cell. The antisense gene to neomycin phosphotransferase II (nptII) has been investigated as a negative selectable marker in tobacco (*Nicotiana tabacum*) and *Arabidopsis thaliana* (Xiang and Guerra, 1993). In this example both sense and antisense nptII genes are introduced into a plant through transformation and the resultant plants are sensitive to the antibiotic kanamycin. An introduced gene that integrates into the host cell chromosome at the site of the antisense nptII gene, and inactivates the antisense gene, will make the plant resistant to kanamycin and other aminoglycoside antibiotics. Therefore, rare site specific recombinants may be identified by screening for antibiotic resistance. Similarly, any gene, native to the plant or introduced through transformation, that when inactivated confers resistance to a compound, may be useful as a negative selectable marker.

It is contemplated that negative selectable markers may also be useful in other ways. One application is to construct transgenic lines in which one could select for transposition to unlinked sites. In the process of tagging it is most common for the transposable element to move to a genetically linked site on the same chromosome. A selectable marker for recovery of rare plants in which transposition has occurred to an unlinked locus would be useful. For example, the enzyme cytosine deaminase may be useful for this purpose (Stouggard, 1993). In the presence of this enzyme the compound 5-fluorocytosine is converted to 5-fluoruracil which is toxic to plant and animal cells. If a transposable element is linked to the gene for the enzyme cytosine deaminase, one may select for transposition to unlinked sites by selecting for transposition events in which the resultant plant is now resistant to 5-fluorocytosine. The parental plants and plants containing transpositions to linked sites will remain sensitive to 5-fluorocytosine. Resistance to 5-fluorocytosine is due to loss of the cytosine deaminase gene through genetic segregation of the transposable element and the cytosine deaminase gene. Other genes that encode proteins that render the plant sensitive to a certain compound will also be useful in this context. For example, T-DNA gene 2 from *Agrobacterium tumefaciens* encodes a protein that catalyzes the conversion of alpha-naphthalene acetamide (NAM) to alpha-napthalene acetic acid (NAA) renders plant cells sensitive to high concentrations of NAM (Depicker et al., 1988).

It is also contemplated that negative selectable markers may be useful in the construction of transposon tagging lines. For example, by marking an autonomous transposable element such as Ac, Master Mu, or En/Spn with a negative selectable marker, one could select for transformants in which the autonomous element is not stably integrated into the genome. This would be desirable, for example, when transient expression of the autonomous element is desired to activate in trans the transposition of a defective transposable element, such as Ds, but stable integration of the autonomous element is not desired. The presence of the autonomous element may not be desired in order to stabilize the defective element, i.e., prevent it from further transposing. However, it is proposed that if stable integration of an autonomous transposable element is desired in a plant the presence of a negative selectable marker may make it possible to eliminate the autonomous element during the breeding process.

11. Non-Protein-Expressing Sequences a. RNA-Expressing

DNA may be introduced into plants for the purpose of expressing RNA transcripts that function to affect plant phenotype yet are not translated into protein. Two examples are antisense RNA and RNA with ribozyme activity. Both may serve possible functions in reducing or eliminating expression of native or introduced plant genes.

Genes may be constructed or isolated, which when transcribed, produce antisense RNA that is complementary to all or part(s) of a targeted messenger RNA(s). The antisense RNA reduces production of the polypeptide product of the messenger RNA. The polypeptide product may be any protein encoded by the plant genome. The aforementioned genes will be referred to as antisense genes. An antisense gene may thus be introduced into a plant by transformation methods to produce a novel transgenic plant with reduced expression of a selected protein of interest. For example, the protein may be an enzyme that catalyzes a reaction in the plant. Reduction of the enzyme activity may reduce or eliminate products of the reaction which include any enzymatically synthesized compound in the plant such as fatty acids, amino acids, carbohydrates, nucleic acids and the like. Alternatively, the protein may be a storage protein, such as a zein, or a structural protein, the decreased expression of which may lead to changes in seed amino acid composition or plant morphological changes respectively. The possibilities cited above are provided only by way of example and do not represent the full range of applications.

Genes may also be constructed or isolated, which when transcribed produce RNA enzymes, or ribozymes, which can act as endoribonucleases and catalyze the cleavage of RNA molecules with selected sequences. The cleavage of selected messenger RNA's can result in the reduced production of their encoded polypeptide products. These genes may be used to prepare novel transgenic plants which possess them. The transgenic plants may possess reduced levels of polypeptides including but not limited to the polypeptides cited above that may be affected by antisense RNA.

It is also possible that genes may be introduced to produce novel transgenic plants which have reduced expression of a native gene product by a mechanism of cosuppression. It has been demonstrated in tobacco, tomato, and petunia (Goring et al, 1991; Smith et al., 1990; Napoli et al., 1990; van der Krol et al., 1990) that expression of the sense transcript of a native gene will reduce or eliminate expression of the native gene in a manner similar to that observed for antisense genes. The introduced gene may encode all or part of the targeted native protein but its translation may not be required for reduction of levels of that native protein.

b. Non-RNA-Expressing

For example, DNA elements including those of transposable elements such as Ds, Ac, or Mu, may be inserted into a gene and cause mutations. These DNA elements may be inserted in order to inactivate (or activate) a gene and thereby "tag" a particular trait. In this instance the transposable element does not cause instability of the tagged mutation, because the utility of the element does not depend on its ability to move in the genome. Once a desired trait is tagged, the introduced DNA sequence may be used to clone the corresponding gene, e.g., using the introduced DNA sequence as a PCR primer together with PCR gene cloning techniques (Shapiro, 1983; Dellaporta et al., 1988). Once identified, the entire gene(s) for the particular trait, including control or regulatory regions where desired may be isolated, cloned and manipulated as desired. The utility of DNA elements introduced into an organism for purposed of gene tagging is independent of the DNA sequence and does not depend on any biological activity of the DNA sequence, i.e., transcription into RNA or translation into protein. The sole function of the DNA element is to disrupt the DNA sequence of a gene.

It is contemplated that unexpressed DNA sequences, including novel synthetic sequences could be introduced into cells as proprietary "labels" of those cells and plants and seeds thereof. It would not be necessary for a label DNA element to disrupt the function of a gene endogenous to the host organism, as the sole function of this DNA would be to identify the origin of the organism. For example, one could introduce a unique DNA sequence into a plant and this DNA element would identify all cells, plants, and progeny of these cells as having arisen from that labeled source. It is proposed that inclusion of label DNAs would enable one to distinguish proprietary germplasm or germplasm derived from such, from unlabelled germplasm.

Another possible element which may be introduced is a matrix attachment region element (MAR), such as the chicken lysozyme A element (Stief et al., 1989), which can be positioned around an expressible gene of interest to effect an increase in overall expression of the gene and diminish position dependant effects upon incorporation into the plant genome (Stief et al., 1989; Phi-Van et al., 1990).

Further nucleotide sequences of interest that may be contemplated for use within the scope of the present invention in operable linkage with the promoter sequences according to the invention are isolated nucleic acid molecules, e.g., DNA or RNA, comprising a plant nucleotide sequence according to the invention comprising an open reading frame that is preferentially expressed in a specific tissue, i.e., seed-, root, green tissue (leaf and stem), panicle-, or pollen, or is expressed constitutively.

B. Marker Genes

In order to improve the ability to identify transformants, one may desire to employ a selectable or screenable marker gene as, or in addition to, the expressible gene of interest. "Marker genes" are genes that impart a distinct phenotype to cells expressing the marker gene and thus allow such transformed cells to be distinguished from cells that do not have the marker. Such genes may encode either a selectable or screenable marker, depending on whether the marker confers a trait which one can 'select' for by chemical means, i.e., through the use of a selective agent (e.g., a herbicide, antibiotic, or the like), or whether it is simply a trait that one can identify through observation or testing, i.e., by 'screening' (e.g., the R-locus trait, the green fluorescent protein (GFP)). Of course, many examples of suitable marker genes are known to the art and can be employed in the practice of the invention.

Included within the terms selectable or screenable marker genes are also genes which encode a "secretable marker" whose secretion can be detected as a means of identifying or selecting for transformed cells. Examples include markers which encode a secretable antigen that can be identified by antibody interaction, or even secretable enzymes which can be detected by their catalytic activity. Secretable proteins fall into a number of classes, including small, diffusible proteins detectable, e.g., by ELISA; small active enzymes detectable in extracellular solution (e.g., alpha-amylase, beta-lactamase, phosphinothricin acetyltransferase); and proteins that are inserted or trapped in the cell wall (e.g., proteins that include a leader sequence such as that found in the expression unit of extensin or tobacco PR-S).

With regard to selectable secretable markers, the use of a gene that encodes a protein that becomes sequestered in the cell wall, and which protein includes a unique epitope is considered to be particularly advantageous. Such a secreted antigen marker would ideally employ an epitope sequence that would provide low background in plant tissue, a promoter-leader sequence that would impart efficient expression and targeting across the plasma membrane, and would produce protein that is bound in the cell wall and yet accessible to antibodies. A normally secreted wall protein modified to include a unique epitope would satisfy all such requirements.

One example of a protein suitable for modification in this manner is extensin, or hydroxyproline rich glycoprotein (HPRG). For example, the maize HPRG (Steifel et al., 1990) molecule is well characterized in terms of molecular biology, expression and protein structure. However, any one of a variety of ultilane and/or glycine-rich wall proteins (Keller et al., 1989) could be modified by the addition of an antigenic site to create a screenable marker.

One exemplary embodiment of a secretable screenable marker concerns the use of a maize sequence encoding the wall protein HPRG, modified to include a 15 residue epitope from the pro-region of murine interleukin, however, virtually any detectable epitope may be employed in such embodiments, as selected from the extremely wide variety of antigen-antibody combinations known to those of skill in the art. The unique extracellular epitope can then be straightforwardly detected using antibody labeling in conjunction with chromogenic or fluorescent adjuncts.

Elements of the present disclosure may be exemplified in detail through the use of the bar and/or GUS genes, and also through the use of various other markers. Of course, in light of this disclosure, numerous other possible selectable and/or screenable marker genes will be apparent to those of skill in the art in addition to the one set forth hereinbelow. Therefore, it will be understood that the following discussion is exemplary rather than exhaustive. In light of the techniques disclosed herein and the general recombinant techniques which are known in the art, the present invention renders possible the introduction of any gene, including marker genes, into a recipient cell to generate a transformed plant.

1. Selectable Markers

Possible selectable markers for use in connection with the present invention include, but are not limited to, a neo gene (Potrykus et al., 1985) which codes for kanamycin resistance and can be selected for using kanamycin, G418, paromomycin, and the like; a bar gene which codes for bialaphos or phosphinothricin resistance; a gene which encodes an altered EPSP synthase protein (Hinchee et al., 1988) thus conferring glyphosate resistance; a nitrilase gene such as bxn from *Klebsiella ozaenae* which confers resistance to bromoxynil (Stalker et al., 1988); a mutant acetolactate synthase gene (ALS) which confers resistance to imidazolinone, sulfonylurea or other ALS-inhibiting chemicals (European Patent Application 154,204, 1985); a methotrexate-resistant DHFR gene (Thillet et al., 1988); a dalapon dehalogenase gene that confers resistance to the herbicide dalapon; a mutated anthranilate synthase gene that confers resistance to 5-methyl tryptophan. Preferred selectable marker genes encode phosphinothricin acetyltransferase; glyphosate resistant EPSPS, aminoglycoside phosphotransferase; hygromycin phosphotransferase, or neomycin phosphotransferase. Where a mutant EPSP synthase gene is employed, additional benefit may be realized through the incorporation of a suitable chloroplast transit peptide, CTP (European Patent Application 0,218,571, 1987).

An illustrative embodiment of a selectable marker gene capable of being used in systems to select transformants is the genes that encode the enzyme phosphinothricin acetyltransferase, such as the bar gene from *Streptomyces hygroscopicus* or the pat gene from *Streptomyces viridochromogenes*. The enzyme phosphinothricin acetyl transferase (PAT) inactivates the active ingredient in the herbicide bialaphos, phosphinothricin (PPT). PPT inhibits glutamine synthetase, (Murakami et al., 1986; Twell et al., 1989) causing rapid accumulation of ammonia and cell death. The success in using this selective system in conjunction with monocots was particularly surprising because of the major difficulties which have been reported in transformation of cereals (Potrykus, 1989).

Where one desires to employ a bialaphos resistance gene in the practice of the invention, a particularly useful gene for this purpose is the bar or pat genes obtainable from species of *Streptomyces* (e.g., ATCC No. 21,705). The cloning of the bar gene has been described (Murakami et al., 1986; Thompson et al., 1987) as has the use of the bar gene in the context of plants other than monocots (De Block et al., 1987; De Block et al., 1989).

2. Screenable Markers

Screenable markers that may be employed include, but are not limited to, a beta-glucuronidase (GUS) or uidA gene which encodes an enzyme for which various chromogenic substrates are known; an R-locus gene, which encodes a product that regulates the production of anthocyanin pigments (red color) in plant tissues (Dellaporta et al., 1988); a beta-lactamase gene (Sutcliffe, 1978), which encodes an enzyme for which various chromogenic substrates are known (e.g., PADAC, a chromogenic cephalosporin); a xylE gene (Zukowsky et al., 1983) which encodes a catechol dioxygenase that can convert chromogenic catechols; an ∀-amylase gene (Ikuta et al., 1990); a tyrosinase gene (Katz et al., 1983) which encodes an enzyme capable of oxidizing tyrosine to DOPA and dopaquinone which in turn condenses to form the easily detectable compound melanin; a ∃-galactosidase gene, which encodes an enzyme for which there are chromogenic substrates; a luciferase (lux) gene (Ow et al., 1986), which allows for bioluminescence detection; or even an aequorin gene (Prasher et al., 1985), which may be employed in calcium-sensitive bioluminescence detection, or a green fluorescent protein gene (Niedz et al., 1995).

Genes from the maize R gene complex are contemplated to be particularly useful as screenable markers. The R gene complex in maize encodes a protein that acts to regulate the production of anthocyanin pigments in most seed and plant tissue. A gene from the R gene complex was applied to maize transformation, because the expression of this gene in transformed cells does not harm the cells. Thus, an R gene introduced into such cells will cause the expression of a red pigment and, if stably incorporated, can be visually scored as a red sector. If a maize line is carries dominant □ultila for genes encoding the enzymatic intermediates in the anthocyanin biosynthetic pathway (C2, A1, A2, Bz1 and Bz2), but carries a recessive allele at the R locus, transformation of any cell from that line with R will result in red pigment formation. Exemplary lines include Wisconsin 22 which contains the rg-Stadler allele and TR112, a K55 derivative which is r-g, b, P1. Alternatively any genotype of maize can be utilized if the C1 and R alleles are introduced together.

It is further proposed that R gene regulatory regions may be employed in chimeric constructs in order to provide mechanisms for controlling the expression of chimeric genes. More diversity of phenotypic expression is known at the R locus than at any other locus (Coe et al., 1988). It is contemplated that regulatory regions obtained from regions 5' to the structural R gene would be valuable in directing the expression of genes, e.g., insect resistance, drought resistance, herbicide tolerance or other protein coding regions. For the purposes of the present invention, it is believed that any of the various R gene family members may be successfully employed (e.g., P, S, Lc, etc.). However, the most preferred will generally be Sn (particularly Sn:bol3). Sn is a dominant member of the R gene complex and is functionally similar to the R and B loci in that Sn controls the tissue specific deposition of anthocyanin pigments in certain seedling and plant cells, therefore, its phenotype is similar to R.

A further screenable marker contemplated for use in the present invention is firefly luciferase, encoded by the lux gene. The presence of the lux gene in transformed cells may be detected using, for example, X-ray film, scintillation counting, fluorescent spectrophotometry, low-light video cameras, photon counting cameras or multiwell luminometry. It is also envisioned that this system may be developed for populational screening for bioluminescence, such as on tissue culture plates, or even for whole plant screening. Where use of a screenable marker gene such as lux or GFP is desired, benefit may be realized by creating a gene fusion between the screenable marker gene and a selectable marker gene, for example, a GFP-NPTII gene fusion. This could allow, for example, selection of transformed cells followed by screening of transgenic plants or seeds.

C. Exemplary DNA Molecules

The invention provides an isolated nucleic acid molecule, e.g., DNA or RNA, comprising a plant nucleotide sequence comprising an open reading frame that is preferentially expressed in a specific plant tissue, i.e., in seeds, roots, green tissue (leaf and stem), panicles or pollen, or is expressed constitutively, or a promoter thereof.

In one specific embodiment the invention provides an isolated nucleic acid molecule, e.g., DNA or RNA, comprising a plant nucleotide sequence comprising an open reading frame that is preferentially expressed in a specific plant tissue, i.e., in seeds, roots, green tissue (leaf and stem), panicles or pollen and which is substantially similar, and preferably has at least 70%, e.g., 71%, 72%, 73%, 74%, 75%, 76%, 77%, 78%, 79%, 80%, 81%, 82%, 83%, 84%, 85%, 86%, 87%, 88%, 89%, and even 90% or more, e.g., 91%, 92%, 93%, 94%, 95%, 96%, 97%, 98%, and 99%, nucleic acid sequence identity, to an open reading frame expressed in (i) a seed-specific manner, e.g., one of SEQ ID NOs:1020-1597, 5927, 5940, 5941, 5945-5958;

(ii) a root-specific manner, e.g., one of SEQ ID NOs:801-1019;

(iii) a green tissue (leaf and stem)-specific manner, e.g., one of SEQ ID NOs:399-464;

(iv) a panicle-specific manner, e.g., one of SEQ ID NOs: 465-720; or (v) a pollen-specific manner, e.g., one of SEQ ID NOs:721-800;

or the complement thereof.

In another embodiment the invention provides an isolated nucleic acid molecule, e.g., DNA or RNA, comprising a plant nucleotide sequence comprising an open reading frame that is constitutively expressed and which is substantially similar, and preferably has at least 70%, e.g., 71%, 72%, 73%, 74%, 75%, 76%, 77%, 78%, 79%, 80%, 81%, 82%, 83%, 84%, 85%, 86%, 87%, 88%, 89%, and even 90% or more, e.g., 91%, 92%, 93%, 94%, 95%, 96%, 97%, 98%, and 99%, nucleic acid sequence identity, to a constitutively expressed open reading frame, which comprises one of SEQ ID NOs: 1-398 and 5928-5939 or the complement thereof.

In another embodiment, the invention provides an isolated nucleic acid molecule comprising a promoter which is preferentially expressed in a specific plant tissue, i.e., in seeds, roots, green tissue (leaf and stem), panicles or pollen and which is substantially similar, and preferably has at least 70%, e.g., 71%, 72%, 73%, 74%, 75%, 76%, 77%, 78%, 79%, 80%, 81%, 82%, 83%, 84%, 85%, 86%, 87%, 88%, 89%, and even 90% or more, e.g., 91%, 92%, 93%, 94%, 95%, 96%, 97%, 98%, and 99%, nucleic acid sequence identity, to a gene comprising a promoter listed in (i) SEQ ID NOs:2275-2672, 5959, 5972, 5973, 5977-5990 and 6001 (e.g., including a promoter obtained or obtainable from any one of SEQ ID NOs:2275-2672, 5959, 5972, 5973, 5977-5990 and 6001) which directs seed-specific transcription of a linked nucleic acid segment;

(ii) SEQ ID NOs:2144-2274 (e.g., including a promoter obtained or obtainable from any one of SEQ ID NOs: 2144-2274) which directs root-specific transcription of a linked nucleic acid segment;

(iii) SEQ ID NOs:1886-1918 (e.g., including a promoter obtained or obtainable from any one of SEQ ID NOs:

1886-1918) which directs green tissue (leaf and stem)-specific transcription of a linked nucleic acid segment;

(iv) SEQ ID NOs:1919-2085 (e.g., including a promoter obtained or obtainable from any one of SEQ ID NOs: 1919-2085) which directs panicle-specific transcription of a linked nucleic acid segment;

(v) SEQ ID NOs:2086-2143 (e.g., including a promoter obtained or obtainable from any one of SEQ ID NOs: 2086-2143) which directs pollen-specific transcription of a linked nucleic acid segment.

In yet another embodiment, the invention provides an isolated nucleic acid molecule comprising a promoter constitutively expressed and which is substantially similar, and preferably has at least 70%, e.g., 71%, 72%, 73%, 74%, 75%, 76%, 77%, 78%, 79%, 80%, 81%, 82%, 83%, 84%, 85%, 86%, 87%, 88%, 89%, and even 90% or more, e.g., 91%, 92%, 93%, 94%, 95%, 96%, 97%, 98%, and 99%, nucleic acid sequence identity, to a gene comprising a promoter listed in (vi) SEQ ID NOs:1598-1885 and 5960-5971 (e.g., including a promoter obtained or obtainable from any one of SEQ ID NOs:1598-1885 and 5960-5971, respectively) which directs constitutive transcription of a linked nucleic acid segment.

The present invention further provides a composition, an expression cassette or a recombinant vector containing the nucleic acid molecule of the invention, and host cells comprising the expression cassette or vector, e.g., comprising a plasmid. In particular, the present invention provides an expression cassette or a recombinant vector comprising a promoter linked to a nucleic acid segment comprising an open reading frame according to the invention which, when present in a plant, plant cell or plant tissue, results in transcription of the linked nucleic acid segment. Further, the invention provides isolated polypeptides encoded by any one of the open reading frames comprising SEQ ID NOs:1-1597, 5927, 5940, 5941, 5945-5958, or the orthologs thereof, e.g., an open reading frame comprising one of SEQ ID NOs:2673-5926.

The choice of promoter directing expression of a nucleic acid segment comprising an open reading frame according to the invention will vary depending on the temporal and spatial requirements for expression, and also depending on the target species. In some cases, expression in multiple tissues is desirable. While in others, tissue-specific, e.g., seed-specific, expression is desirable. Although many promoters from dicotyledons have been shown to be operational in monocotyledons and vice versa, ideally dicotyledonous promoters are selected for expression in dicotyledons, and monocotyledonous promoters for expression in monocotyledons. However, there is no restriction to the provenance of selected promoters; it is sufficient that they are operational in driving the expression of the nucleotide sequences in the desired cell.

These promoters include, but are not limited to, constitutive, inducible, temporally regulated, developmentally regulated, spatially-regulated, chemically regulated, stress-responsive, tissue-specific, viral and synthetic promoters. Promoter sequences are known to be strong or weak. A strong promoter provides for a high level of gene expression, whereas a weak promoter provides for a very low level of gene expression. An inducible promoter is a promoter that provides for the turning on and off of gene expression in response to an exogenously added agent, or to an environmental or developmental stimulus. A bacterial promoter such as the $P_{tac}$ promoter can be induced to varying levels of gene expression depending on the level of isothiopropylgalactoside added to the transformed bacterial cells. An isolated promoter sequence that is a strong promoter for heterologous nucleic acid is advantageous because it provides for a sufficient level of gene expression to allow for easy detection and selection of transformed cells and provides for a high level of gene expression when desired.

Within a plant promoter region there are several domains that are necessary for full function of the promoter. The first of these domains lies immediately upstream of the structural gene and forms the "core promoter region" containing consensus sequences, normally 70 base pairs immediately upstream of the gene. The core promoter region contains the characteristic CAAT and TATA boxes plus surrounding sequences, and represents a transcription initiation sequence that defines the transcription start point for the structural gene.

The presence of the core promoter region defines a sequence as being a promoter: if the region is absent, the promoter is non-functional. Furthermore, the core promoter region is insufficient to provide full promoter activity. A series of regulatory sequences upstream of the core constitute the remainder of the promoter. The regulatory sequences determine expression level, the spatial and temporal pattern of expression and, for an important subset of promoters, expression under inductive conditions (regulation by external factors such as light, temperature, chemicals, hormones).

A range of naturally-occurring promoters are known to be operative in plants and have been used to drive the expression of heterologous (both foreign and endogenous) genes in plants: for example, the constitutive 35S cauliflower mosaic virus (CaMV) promoter, the ripening-enhanced tomato polygalacturonase promoter (Bird et al., 1988), the E8 promoter (Diekman & Fischer, 1988) and the fruit specific 2A1 promoter (Pear et al., 1989) and many others, e.g., U2 and U5 snRNA promoters from maize, the promoter from alcohol dehydrogenase, the Z4 promoter from a gene encoding the Z4 22 kD zein protein, the Z10 promoter from a gene encoding a 10 kD zein protein, a Z27 promoter from a gene encoding a 27 kD zein protein, the A20 promoter from the gene encoding a 19 kD-zein protein, inducible promoters, such as the light inducible promoter derived from the pea rbcS gene and the actin promoter from rice, e.g., the actin 2 promoter (WO 00/70067); seed specific promoters, such as the phaseolin promoter from beans, may also be used. The nucleotide sequences of this invention can also be expressed under the regulation of promoters that are chemically regulated. This enables the nucleic acid sequence or encoded polypeptide to be synthesized only when the crop plants are treated with the inducing chemicals. Chemical induction of gene expression is detailed in EP 0 332 104 (to Ciba-Geigy) and U.S. Pat. No. 5,614,395. A preferred promoter for chemical induction is the tobacco PR-1a promoter.

Examples of some constitutive promoters which have been described include the rice actin 1 (Wang et al., 1992; U.S. Pat. No. 5,641,876), CaMV 35S (Odell et al., 1985), CaMV 19S (Lawton et al., 1987), nos, Adh, sucrose synthase; and the ubiquitin promoters.

Examples of tissue specific promoters which have been described include the lectin (Vodkin, 1983; Lindstrom et al., 1990) corn alcohol dehydrogenase 1 (Vogel et al., 1989; Dennis et al., 1984), corn light harvesting complex (Simpson, 1986; Bansal et al., 1992), corn heat shock protein (Odell et al., 1985), pea small subunit RuBP carboxylase (Poulsen et al., 1986), Ti plasmid mannopine synthase (Langridge et al., 1989), Ti plasmid nopaline synthase (Langridge et al., 1989), petunia chalcone isomerase (vanTunen et al., 1988), bean glycine rich protein 1 (Keller et al., 1989), truncated CaMV 35s (Odell et al., 1985), potato patatin (Wenzler et al., 1989), root cell (Yamamoto et al., 1990), maize zein (Reina et al., 1990; Kriz et al., 1987; Wandelt et al., 1989; Langridge et al., 1983; Reina et al., 1990), globulin-1 (Belanger et al., 1991), α-tubulin, cab (Sullivan et al., 1989), PEPCase (Hudspeth & Grula, 1989), R gene complex-associated promoters (Chandler et al., 1989), histone, and chalcone synthase promoters (Franken et al., 1991). Tissue specific enhancers are described in Fromm et al. (1989).

Inducible promoters that have been described include the ABA- and turgor-inducible promoters, the promoter of the auxin-binding protein gene (Schwob et al., 1993), the UDP glucose flavonoid glycosyl-transferase gene promoter (Ralston et al., 1988), the MPI proteinase inhibitor promoter (Cordero et al., 1994), and the glyceraldehyde-3-phosphate dehydrogenase gene promoter (Kohler et al., 1995; Quigley et al., 1989; Martinez et al., 1989).

Several other tissue-specific regulated genes and/or promoters have been reported in plants. These include genes encoding the seed storage proteins (such as napin, cruciferin, beta-conglycinin, and phaseolin) zein or oil body proteins (such as oleosin), or genes involved in fatty acid biosynthesis (including acyl carrier protein, stearoyl-ACP desaturase. And fatty acid desaturases (fad 2-1)), and other genes expressed during embryo development (such as Bce4, see, for example, EP 255378 and Kridl et al., 1991). Particularly useful for seed-specific expression is the pea vicilin promoter (Czako et al., 1992). (See also U.S. Pat. No. 5,625,136, herein incorporated by reference.) Other useful promoters for expression in mature leaves are those that are switched on at the onset of senescence, such as the SAG promoter from *Arabidopsis* (Gan et al., 1995).

A class of fruit-specific promoters expressed at or during antithesis through fruit development, at least until the beginning of ripening, is discussed in U.S. Pat. No. 4,943,674. cDNA clones that are preferentially expressed in cotton fiber have been isolated (John et al., 1992). cDNA clones from tomato displaying differential expression during fruit development have been isolated and characterized (Mansson et al., 1985, Slater et al., 1985). The promoter for polygalacturonase gene is active in fruit ripening. The polygalacturonase gene is described in U.S. Pat. No. 4,535,060, U.S. Pat. No. 4,769,061, U.S. Pat. No. 4,801,590, and U.S. Pat. No. 5,107,065, which disclosures are incorporated herein by reference.

Other examples of tissue-specific promoters include those that direct expression in leaf cells following damage to the leaf (for example, from chewing insects), in tubers (for example, patatin gene promoter), and in fiber cells (an example of a developmentally-regulated fiber cell protein is E6 (John et al., 1992). The E6 gene is most active in fiber, although low levels of transcripts are found in leaf, ovule and flower.

The tissue-specificity of some "tissue-specific" promoters may not be absolute and may be tested by one skilled in the art using the diphtheria toxin sequence. One can also achieve tissue-specific expression with "leaky" expression by a combination of different tissue-specific promoters (Beals et al., 1997). Other tissue-specific promoters can be isolated by one skilled in the art (see U.S. Pat. No. 5,589,379). Several inducible promoters ("gene switches") have been reported. Many are described in the review by Gatz (1996) and Gatz (1997). These include tetracycline repressor system, Lac repressor system, copper-inducible systems, salicylate-inducible systems (such as the PR1a system), glucocorticoid-(Aoyama et al., 1997) and ecdysome-inducible systems. Also included are the benzene sulphonamide-(U.S. Pat. No. 5,364,780) and alcohol-(WO 97/06269 and WO 97/06268) inducible systems and glutathione S-transferase promoters. Other studies have focused on genes inducibly regulated in response to environmental stress or stimuli such as increased salinity. Drought, pathogen and wounding. (Graham et al., 1985; Graham et al., 1985, Smith et al., 1986). Accumulation of metal-locarboxypeptidase-inhibitor protein has been reported in leaves of wounded potato plants (Graham et al., 1981). Other plant genes have been reported to be induced methyl jasmonate, elicitors, heat-shock, anaerobic stress, or herbicide safeners.

Regulated expression of the chimeric transacting viral replication protein can be further regulated by other genetic strategies. For example, Cre-mediated gene activation as described by Odell et al. 1990. Thus, a DNA fragment containing 3' regulatory sequence bound by lox sites between the promoter and the replication protein coding sequence that blocks the expression of a chimeric replication gene from the promoter can be removed by Cre-mediated excision and result in the expression of the trans-acting replication gene. In this case, the chimeric Cre gene, the chimeric trans-acting replication gene, or both can be under the control of tissue- and developmental-specific or inducible promoters. An alternate genetic strategy is the use of tRNA suppressor gene. For example, the regulated expression of a tRNA suppressor gene can conditionally control expression of a trans-acting replication protein coding sequence containing an appropriate termination codon as described by Ulmasov et al. 1997. Again, either the chimeric tRNA suppressor gene, the chimeric transacting replication gene, or both can be under the control of tissue- and developmental-specific or inducible promoters.

Frequently it is desirable to have continuous or inducible expression of a DNA sequence throughout the cells of an organism in a tissue-independent manner. For example, increased resistance of a plant to infection by soil- and air-borne-pathogens might be accomplished by genetic manipulation of the plant's genome to comprise a continuous promoter operably linked to a heterologous pathogen-resistance gene such that pathogen-resistance proteins are continuously expressed throughout the plant's tissues.

Alternatively, it might be desirable to inhibit expression of a native DNA sequence within a plant's tissues to achieve a desired phenotype. In this case, such inhibition might be accomplished with transformation of the plant to comprise a constitutive, tissue-independent promoter operably linked to an antisense nucleotide sequence, such that constitutive expression of the antisense sequence produces an RNA transcript that interferes with translation of the mRNA of the native DNA sequence.

To define a minimal promoter region, a DNA segment representing the promoter region is removed from the 5' region of the gene of interest and operably linked to the coding sequence of a marker (reporter) gene by recombinant DNA techniques well known to the art. The reporter gene is operably linked downstream of the promoter, so that transcripts initiating at the promoter proceed through the reporter gene. Reporter genes generally encode proteins which are easily measured, including, but not limited to, chloramphenicol acetyl transferase (CAT), beta-glucuronidase (GUS), green fluorescent protein (GFP), beta-galactosidase (beta-GAL), and luciferase.

The construct containing the reporter gene under the control of the promoter is then introduced into an appropriate cell type by transfection techniques well known to the art. To assay for the reporter protein, cell lysates are prepared and appropriate assays, which are well known in the art, for the reporter protein are performed. For example, if CAT were the reporter gene of choice, the lysates from cells transfected with constructs containing CAT under the control of a promoter under study are mixed with isotopically labeled chloramphenicol and acetyl-coenzyme A (acetyl-CoA). The CAT enzyme transfers the acetyl group from acetyl-CoA to the 2- or 3-position of chloramphenicol. The reaction is monitored by thin-layer chromatography, which separates acetylated chloramphenicol from unreacted material. The reaction products are then visualized by autoradiography.

The level of enzyme activity corresponds to the amount of enzyme that was made, which in turn reveals the level of expression from the promoter of interest. This level of expression can be compared to other promoters to determine the relative strength of the promoter under study. In order to be sure that the level of expression is determined by the promoter, rather than by the stability of the mRNA, the level of the reporter mRNA can be measured directly, such as by Northern blot analysis.

Once activity is detected, mutational and/or deletional analyses may be employed to determine the minimal region and/or sequences required to initiate transcription. Thus, sequences can be deleted at the 5' end of the promoter region and/or at the 3' end of the promoter region, and nucleotide substitutions introduced. These constructs are then introduced to cells and their activity determined.

In one embodiment, the promoter may be a gamma zein promoter, an oleosin ole16 promoter, a globulinI promoter, an actin I promoter, an actin c1 promoter, a sucrose synthetase promoter, an INOPS promoter, an EXM5 promoter, a globulin2 promoter, a b-32, ADPG-pyrophosphorylase promoter, an Ltp1 promoter, an Ltp2 promoter, an oleosin ole17 promoter, an oleosin ole18 promoter, an actin 2 promoter, a pollen-specific protein promoter, a pollen-specific pectate lyase promoter, an anther-specific protein promoter, an anther-specific gene RTS2 promoter, a pollen-specific gene promoter, a tapeturn-specific gene promoter, tapeturn-specific gene RAB24 promoter, a anthranilate synthase alpha subunit promoter, an alpha zein promoter, an anthranilate synthase beta subunit promoter, a dihydrodipicolinate synthase promoter, a Thil promoter, an alcohol dehydrogenase promoter, a cab binding protein promoter, an H3C4 promoter, a RUBISCO SS starch branching enzyme promoter, an ACCase promoter, an actin3 promoter, an actin7 promoter, a regulatory protein GF14-12 promoter, a ribosomal protein L9 promoter, a cellulose biosynthetic enzyme promoter, an S-adenosyl-L-homocysteine hydrolase promoter, a superoxide dismutase promoter, a C-kinase receptor promoter, a phosphoglycerate mutase promoter, a root-specific RCc3 mRNA promoter, a glucose-6 phosphate isomerase promoter, a pyrophosphate-fructose 6-phosphatelphosphotransferase promoter, an ubiquitin promoter, a beta-ketoacyl-ACP synthase promoter, a 33 kDa photosystem 11 promoter, an oxygen evolving protein promoter, a 69 kDa vacuolar ATPase subunit promoter, a metallothionein-like protein promoter, a glyceraldehyde-3-phosphate dehydrogenase promoter, an ABA- and ripening-inducible-like protein promoter, a phenylalanine ammonia lyase promoter, an adenosine triphosphatase S-adenosyl-L-homocysteine hydrolase promoter, an a-tubulin promoter, a cab promoter, a PEPCase promoter, an R gene promoter, a lectin promoter, a light harvesting complex promoter, a heat shock protein promoter, a chalcone synthase promoter, a zein promoter, a globulin-1 promoter, an ABA promoter, an auxin-binding protein promoter, a UDP glucose flavonoid glycosyl-transferase gene promoter, an NTI promoter, an actin promoter, an opaque 2 promoter, a b70 promoter, an oleosin promoter, a CaMV 35S promoter, a CaMV 19S promoter, a histone promoter, a turgor-inducible promoter, a pea small subunit RuBP carboxylase promoter, a Ti plasmid mannopine synthase promoter, Ti plasmid nopaline synthase promoter, a petunia chalcone isomerase promoter, a bean glycine rich protein I promoter, a CaMV 35S transcript promoter, a potato patatin promoter, or a S-E9 small subunit RuBP carboxylase promoter.

III. TRANSFORMED (TRANSGENIC) PLANTS OF THE INVENTION AND METHODS OF PREPARATION

Plant species may be transformed with the DNA construct of the present invention by the DNA-mediated transformation of plant cell protoplasts and subsequent regeneration of the plant from the transformed protoplasts in accordance with procedures well known in the art.

Any plant tissue capable of subsequent clonal propagation, whether by organogenesis or embryogenesis, may be transformed with a vector of the present invention. The term "organogenesis," as used herein, means a process by which shoots and roots are developed sequentially from meristematic centers; the term "embryogenesis," as used herein, means a process by which shoots and roots develop together in a concerted fashion (not sequentially), whether from somatic cells or gametes. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristems, axillary buds, and root meristems), and induced meristem tissue (e.g., cotyledon meristem and ultilane meristem).

Plants of the present invention may take a variety of forms. The plants may be chimeras of transformed cells and non-transformed cells; the plants may be clonal transformants (e.g., all cells transformed to contain the expression cassette); the plants may comprise grafts of transformed and untransformed tissues (e.g., a transformed root stock grafted to an untransformed scion in citrus species). The transformed plants may be propagated by a variety of means, such as by clonal propagation or classical breeding techniques. For example, first generation (or T1) transformed plants may be selfed to give homozygous second generation (or T2) transformed plants, and the T2 plants further propagated through classical breeding techniques. A dominant selectable marker (such as npt II) can be associated with the expression cassette to assist in breeding.

Thus, the present invention provides a transformed (transgenic) plant cell, in planta or ex planta, including a transformed plastid or other organelle, e.g., nucleus, mitochondria or chloroplast. The present invention may be used for transformation of any plant species, including, but not limited to, cells from corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassaya (*Manihot esculenta*), coffee (*Cofea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea ultilane*), fig (*Ficus casica*), guava (*Psidium guajava*), mango (*Mangifera*

*indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, duckweed (*Lemna*), barley, vegetables, ornamentals, and conifers.

Duckweed (*Lemna*, see WO 00/07210) includes members of the family Lemnaceae. There are known four genera and 34 species of duckweed as follows: genus *Lemna* (*L. aequinoctialis*, *L. disperma*, *L. ecuadoriensis*, *L. gibba*, *L. japonica*, *L. minor*, *L. miniscula*, *L. obscura*, *L. perpusilla*, *L. tenera*, *L. trisulca*, *L. turionifera*, *L. valdiviana*); genus *Spirodela* (*S. intermedia*, *S. polyrrhiza*, *S. punctata*); genus *Woffia* (*Wa. Angusta*, *Wa. Arrhiza*, *Wa. Australina*, *Wa. Borealis*, *Wa. Brasiliensis*, *Wa. Columbiana*, *Wa. Elongata*, *Wa. Globosa*, *Wa. Microscopica*, *Wa. Neglecta*) and genus *Wofiella* (*Wl. ultila*, *Wl. ultilanen*, *Wl. gladiata*, *Wl. ultila*, *Wl. lingulata*, *Wl. repunda*, *Wl. rotunda*, and *Wl. neotropica*). Any other genera or species of Lemnaceae, if they exist, are also aspects of the present invention. *Lemna gibba*, *Lemna minor*, and *Lemna miniscula* are preferred, with *Lemna minor* and *Lemna miniscula* being most preferred. *Lemna* species can be classified using the taxonomic scheme described by Landolt, Biosystematic Investigation on the Family of Duckweeds: The family of Lemnaceae—A Monograph Study. Geobatanischen Institute ETH, Stiftung Rubel, Zurich (1986)).

Vegetables within the scope of the invention include tomatoes (*Lycopersicon esculentum*), lettuce (e.g., *Lactuca sativa*), green beans (*Phaseolus vulgaris*), lima beans (*Phaseolus limenis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*), Douglas-fir (*Pseudotsuga menziesii*); Western hemlock (*Tsuga ultilane*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Leguminous plants include beans and peas. Beans include guar, locust bean, fenugreek, soybean, garden beans, cowpea, mungbean, lima bean, fava bean, lentils, chickpea, etc. Legumes include, but are not limited to, *Arachis*, e.g., peanuts, *Vicia*, e.g., crown vetch, hairy vetch, adzuki bean, mung bean, and chickpea, Lupinus, e.g., lupine, trifolium, *Phaseolus*, e.g., common bean and lima bean, *Pisum*, e.g., field bean, *Melilotus*, e.g., clover, *Medicago*, e.g., alfalfa, *Lotus*, e.g., trefoil, lens, e.g., lentil, and false indigo. Preferred forage and turf grass for use in the methods of the invention include alfalfa, orchard grass, tall fescue, perennial ryegrass, creeping bent grass, and redtop.

Other plants within the scope of the invention include *Acacia*, aneth, artichoke, arugula, blackberry, canola, cilantro, clementines, escarole, eucalyptus, fennel, grapefruit, honey dew, jicama, kiwifruit, lemon, lime, mushroom, nut, okra, orange, parsley, persimmon, plantain, pomegranate, poplar, radiata pine, radicchio, Southern pine, sweetgum, tangerine, triticale, vine, yams, apple, pear, quince, cherry, apricot, melon, hemp, buckwheat, grape, raspberry, *chenopodium*, blueberry, nectarine, peach, plum, strawberry, watermelon, eggplant, pepper, cauliflower, *Brassica*, e.g., broccoli, cabbage, ultilan sprouts, onion, carrot, leek, beet, broad bean, celery, radish, pumpkin, endive, gourd, garlic, snapbean, spinach, squash, turnip, ultilane, and zucchini.

Ornamental plants within the scope of the invention include impatiens, Begonia, Pelargonium, Viola, Cyclamen, Verbena, Vinca, Tagetes, Primula, Saint Paulia, Agertum, *Amaranthus*, Antihirrhinum, Aquilegia, Cineraria, Clover, Cosmo, Cowpea, Dahlia, *Datura*, Delphinium, Gerbera, Gladiolus, Gloxinia, Hippeastrum, *Mesembryanthemum*, Salpiglossos, and Zinnia. Other plants within the scope of the invention are shown in the Table hereinabove.

Preferably, transgenic plants of the present invention are crop plants and in particular cereals (for example, corn, alfalfa, sunflower, rice, *Brassica*, canola, soybean, barley, soybean, sugarbeet, cotton, safflower, peanut, sorghum, wheat, millet, tobacco, etc.), and even more preferably corn, rice and soybean.

Transformation of plants can be undertaken with a single DNA molecule or multiple DNA molecules (i.e., co-transformation), and both these techniques are suitable for use with the expression cassettes of the present invention. Numerous transformation vectors are available for plant transformation, and the expression cassettes of this invention can be used in conjunction with any such vectors. The selection of vector will depend upon the preferred transformation technique and the target species for transformation.

A variety of techniques are available and known to those skilled in the art for introduction of constructs into a plant cell host. These techniques generally include transformation with DNA employing *A. tumefaciens* or *A. rhizogenes* as the transforming agent, liposomes, PEG precipitation, electroporation, DNA injection, direct DNA uptake, microprojectile bombardment, particle acceleration, and the like (See, for example, EP 295959 and EP 138341) (see below). However, cells other than plant cells may be transformed with the expression cassettes of the invention. The general descriptions of plant expression vectors and reporter genes, and *Agrobacterium* and *Agrobacterium*-mediated gene transfer, can be found in Gruber et al. (1993).

Expression vectors containing genomic or synthetic fragments can be introduced into protoplasts or into intact tissues or isolated cells. Preferably expression vectors are introduced into intact tissue. General methods of culturing plant tissues are provided for example by Maki et al., (1993); and by Phillips et al. (1988). Preferably, expression vectors are introduced into maize or other plant tissues using a direct gene transfer method such as microprojectile-mediated delivery, DNA injection, electroporation and the like. More preferably expression vectors are introduced into plant tissues using the microprojectile media delivery with the biolistic device. See, for example, Tomes et al. (1995). The vectors of the invention can not only be used for expression of structural genes but may also be used in exon-trap cloning, or promoter trap procedures to detect differential gene expression in varieties of tissues, (Lindsey et al., 1993; Auch & Reth et al.).

It is particularly preferred to use the binary type vectors of Ti and Ri plasmids of *Agrobacterium* spp. Ti-derived vectors transform a wide variety of higher plants, including monocotyledonous and dicotyledonous plants, such as soybean, cotton, rape, tobacco, and rice (Pacciotti et al., 1985; Byrne et al., 1987; Sukhapinda et al., 1987; Lorz et al., 1985; Potrykus, 1985; Park et al., 1985; Hiei et al., 1994). The use of T-DNA to transform plant cells has received extensive study and is amply described (EP 120516; Hoekema, 1985; Knauf, et al., 1983; and An et al., 1985). For introduction into plants, the chimeric genes of the invention can be inserted into binary vectors as described in the examples.

Other transformation methods are available to those skilled in the art, such as direct uptake of foreign DNA constructs (see EP 295959), techniques of electroporation (Fromm et al., 1986) or high velocity ballistic bombardment with metal particles coated with the nucleic acid constructs (Kline et al., 1987, and U.S. Pat. No. 4,945,050). Once transformed, the cells can be regenerated by those skilled in the art. Of particular relevance are the recently described methods to transform foreign genes into commercially important crops, such as rapeseed (De Block et al., 1989), sunflower (Everett et al., 1987), soybean (McCabe et al., 1988; Hinchee et al., 1988; Chee et al., 1989; Christou et al., 1989; EP 301749), rice (Hiei et al., 1994), and corn (Gordon Kamm et al., 1990; Fromm et al., 1990).

Those skilled in the art will appreciate that the choice of method might depend on the type of plant, i.e., monocotyledonous or dicotyledonous, targeted for transformation. Suitable methods of transforming plant cells include, but are not limited to, microinjection (Crossway et al., 1986), electroporation (Riggs et al., 1986), *Agrobacterium*-mediated transformation (Hinchee et al., 1988), direct gene transfer (Paszkowski et al., 1984), and ballistic particle acceleration using devices available from Agracetus, Inc., Madison, Wis. And BioRad, Hercules, Calif. (see, for example, Sanford et al., U.S. Pat. No. 4,945,050; and McCabe et al., 1988). Also see, Weissinger et al., 1988; Sanford et al., 1987 (onion); Christou et al., 1988 (soybean); McCabe et al., 1988 (soybean); Datta et al., 1990 (rice); Klein et al., 1988 (maize); Klein et al., 1988 (maize); Klein et al., 1988 (maize); Fromm et al., 1990 (maize); and Gordon-Kamm et al., 1990 (maize); Svab et al., 1990 (tobacco chloroplast); Koziel et al., 1993 (maize); Shimamoto et al., 1989 (rice); Christou et al., 1991 (rice); European Patent Application EP 0 332 581 (orchardgrass and other Pooideae); Vasil et al., 1993 (wheat); Weeks et al., 1993 (wheat). In one embodiment, the protoplast transformation method for maize is employed (European Patent Application EP 0 292 435, U.S. Pat. No. 5,350,689).

In another embodiment, a nucleotide sequence of the present invention is directly transformed into the plastid genome. Plastid transformation technology is extensively described in U.S. Pat. Nos. 5,451,513, 5,545,817, and 5,545,818, in PCT application no. WO 95/16783, and in McBride et al., 1994. The basic technique for chloroplast transformation involves introducing regions of cloned plastid DNA flanking a selectable marker together with the gene of interest into a suitable target tissue, e.g., using biolistics or protoplast transformation (e.g., calcium chloride or PEG mediated transformation). The 1 to 1.5 kb flanking regions, termed targeting sequences, facilitate orthologous recombination with the plastid genome and thus allow the replacement or modification of specific regions of the plastome. Initially, point mutations in the chloroplast 16S rRNA and rps12 genes conferring resistance to spectinomycin and/or streptomycin are utilized as selectable markers for transformation (Svab et al., 1990; Staub et al., 1992). This resulted in stable homoplasmic transformants at a frequency of approximately one per 100 bombardments of target leaves. The presence of cloning sites between these markers allowed creation of a plastid targeting vector for introduction of foreign genes (Staub et al., 1993). Substantial increases in transformation frequency are obtained by replacement of the recessive rRNA or r-protein antibiotic resistance genes with a dominant selectable marker, the bacterial aadA gene encoding the spectinomycin-detoxifying enzyme aminoglycoside-3N-adenyltransferase (Svab et al., 1993). Other selectable markers useful for plastid transformation are known in the art and encompassed within the scope of the invention. Typically, approximately 15-20 cell division cycles following transformation are required to reach a homoplastidic state. Plastid expression, in which genes are inserted by orthologous recombination into all of the several thousand copies of the circular plastid genome present in each plant cell, takes advantage of the enormous copy number advantage over nuclear-expressed genes to permit expression levels that can readily exceed 10% of the total soluble plant protein. In a preferred embodiment, a nucleotide sequence of the present invention is inserted into a plastid targeting vector and transformed into the plastid genome of a desired plant host. Plants homoplastic for plastid genomes containing a nucleotide sequence of the present invention are obtained, and are preferentially capable of high expression of the nucleotide sequence.

*Agrobacterium tumefaciens* cells containing a vector comprising an expression cassette of the present invention, wherein the vector comprises a Ti plasmid, are useful in methods of making transformed plants. Plant cells are infected with an *Agrobacterium tumefaciens* as described above to produce a transformed plant cell, and then a plant is regenerated from the transformed plant cell. Numerous *Agrobacterium* vector systems useful in carrying out the present invention are known.

For example, vectors are available for transformation using *Agrobacterium tumefaciens*. These typically carry at least one T-DNA border sequence and include vectors such as pBIN19 (Bevan, 1984). In one preferred embodiment, the expression cassettes of the present invention may be inserted into either of the binary vectors pCIB200 and pCIB2001 for use with *Agrobacterium*. These vector cassettes for *Agrobacterium*-mediated transformation wear constructed in the following manner. PTJS75kan was created by NarI digestion of pTJS75 (Schmidhauser & Helinski, 1985) allowing excision of the tetracycline-resistance gene, followed by insertion of an AccI fragment from pUC4K carrying an NPTII (Messing & Vierra, 1982; Bevan et al., 1983; McBride et al., 1990). XhoI linkers were ligated to the EcoRV fragment of pCIB7 which contains the left and right T-DNA borders, a plant selectable nos/nptII chimeric gene and the pUC polylinker (Rothstein et al., 1987), and the XhoI-digested fragment was cloned into SalI-digested pTJS75kan to create pCIB200 (see also EP 0 332 104, example 19). PCIB200 contains the following unique polylinker restriction sites: EcoRI, SstI, KpnI, BglII, XbaI, and SalI. The plasmid pCIB2001 is a derivative of pCIB200 which was created by the insertion into the polylinker of additional restriction sites. Unique restriction sites in the polylinker of pCIB2001 are EcoRI, SstI, KpnI, BglII, XbaI, SalI, MluI, BclI, AvrII, ApaI, HpaI, and StuI. PCIB2001, in addition to containing these unique restriction sites also has plant and bacterial kanamycin selection, left and right T-DNA borders for *Agrobacterium*-mediated transformation, the RK2-derived trfA function for mobilization between *E. coli* and other hosts, and the OriT and OriV functions also from RK2. The pCIB2001 polylinker is suitable for the cloning of plant expression cassettes containing their own regulatory signals.

An additional vector useful for *Agrobacterium*-mediated transformation is the binary vector pCIB 10, which contains a gene encoding kanamycin resistance for selection in plants, T-DNA right and left border sequences and incorporates sequences from the wide host-range plasmid pRK252 allowing it to replicate in both *E. coli* and *Agrobacterium*. Its construction is described by Rothstein et al., 1987. Various derivatives of pCIB10 have been constructed which incorporate the gene for hygromycin B phosphotransferase described by Gritz et al., 1983. These derivatives enable selection of transgenic plant cells on hygromycin only (pCIB743), or hygromycin and kanamycin (pCIB715, pCIB717).

Methods using either a form of direct gene transfer or Agrobacterium-mediated transfer usually, but not necessarily, are undertaken with a selectable marker which may provide resistance to an antibiotic (e.g., kanamycin, hygromycin or methotrexate) or a herbicide (e.g., phosphinothricin). The choice of selectable marker for plant transformation is not, however, critical to the invention.

For certain plant species, different antibiotic or herbicide selection markers may be preferred. Selection markers used routinely in transformation include the nptII gene which confers resistance to kanamycin and related antibiotics (Messing & Vierra, 1982; Bevan et al., 1983), the bar gene which confers resistance to the herbicide phosphinothricin (White et al., 1990, Spencer et al., 1990), the hph gene which confers resistance to the antibiotic hygromycin (Blochinger & Diggelmann), and the dhfr gene, which confers resistance to methotrexate (Bourouis et al., 1983).

One such vector useful for direct gene transfer techniques in combination with selection by the herbicide Basta (or phosphinothricin) is pCIB3064. This vector is based on the plasmid pCIB246, which comprises the CaMV 35S promoter in operational fusion to the E. coli GUS gene and the CaMV 35S transcriptional terminator and is described in the PCT published application WO 93/07278, herein incorporated by reference. One gene useful for conferring resistance to phosphinothricin is the bar gene from Streptomyces viridochromogenes (Thompson et al., 1987). This vector is suitable for the cloning of plant expression cassettes containing their own regulatory signals.

An additional transformation vector is pSOG35 which utilizes the E. coli gene dihydrofolate reductase (DHFR) as a selectable marker conferring resistance to methotrexate. PCR was used to amplify the 35S promoter (about 800 bp), intron 6 from the maize Adh1 gene (about 550 bp) and 18 bp of the GUS untranslated leader sequence from pSOG10. A 250 bp fragment encoding the E. coli dihydrofolate reductase type II gene was also amplified by PCR and these two PCR fragments were assembled with a SacI-PstI fragment from pBI221 (Clontech) which comprised the pUC19 vector backbone and the nopaline synthase terminator. Assembly of these fragments generated pSOG19 which contains the 35S promoter in fusion with the intron 6 sequence, the GUS leader, the DHFR gene and the nopaline synthase terminator. Replacement of the GUS leader in pSOG19 with the leader sequence from Maize Chlorotic Mottle Virus check (MCMV) generated the vector pSOG35. pSOG19 and pSOG35 carry the pUC-derived gene for ampicillin resistance and have HindIII, SphII, PstI and EcoRI sites available for the cloning of foreign sequences.

IV. PRODUCTION AND CHARACTERIZATION OF STABLY TRANSFORMED PLANTS

Transgenic plant cells are then placed in an appropriate selective medium for selection of transgenic cells which are then grown to callus. Shoots are grown from callus and plantlets generated from the shoot by growing in rooting medium. The various constructs normally will be joined to a marker for selection in plant cells. Conveniently, the marker may be resistance to a biocide (particularly an antibiotic, such as kanamycin, G418, bleomycin, hygromycin, chloramphenicol, herbicide, or the like). The particular marker used will allow for selection of transformed cells as compared to cells lacking the DNA which has been introduced. Components of DNA constructs including transcription cassettes of this invention may be prepared from sequences which are native (endogenous) or foreign (exogenous) to the host. By "foreign" it is meant that the sequence is not found in the wild-type host into which the construct is introduced. Heterologous constructs will contain at least one region which is not native to the gene from which the transcription-initiation-region is derived.

To confirm the presence of the transgenes in transgenic cells and plants, a variety of assays may be performed. Such assays include, for example, "molecular biological" assays well known to those of skill in the art, such as Southern and Northern blotting, in situ hybridization and nucleic acid-based amplification methods such as PCR or RT-PCR; "biochemical" assays, such as detecting the presence of a protein product, e.g., by immunological means (ELISAs and Western blots) or by enzymatic function; plant part assays, such as seed assays; and also, by analyzing the phenotype of the whole regenerated plant, e.g., for disease or pest resistance.

DNA may be isolated from cell lines or any plant parts to determine the presence of the preselected nucleic acid segment through the use of techniques well known to those skilled in the art. Note that intact sequences will not always be present, presumably due to rearrangement or deletion of sequences in the cell.

The presence of nucleic acid elements introduced through the methods of this invention may be determined by polymerase chain reaction (PCR). Using this technique discreet fragments of nucleic acid are amplified and detected by gel electrophoresis. This type of analysis permits one to determine whether a preselected nucleic acid segment is present in a stable transformant, but does not prove integration of the introduced preselected nucleic acid segment into the host cell genome. In addition, it is not possible using PCR techniques to determine whether transformants have exogenous genes introduced into different sites in the genome, i.e., whether transformants are of independent origin. It is contemplated that using PCR techniques it would be possible to clone fragments of the host genomic DNA adjacent to an introduced preselected DNA segment.

Positive proof of DNA integration into the host genome and the independent identities of transformants may be determined using the technique of Southern hybridization. Using this technique specific DNA sequences that were introduced into the host genome and flanking host DNA sequences can be identified. Hence the Southern hybridization pattern of a given transformant serves as an identifying characteristic of that transformant. In addition it is possible through Southern hybridization to demonstrate the presence of introduced preselected DNA segments in high molecular weight DNA, i.e., confirm that the introduced preselected DNA segment has been integrated into the host cell genome. The technique of Southern hybridization provides information that is obtained using PCR, e.g., the presence of a preselected DNA segment, but also demonstrates integration into the genome and characterizes each individual transformant.

It is contemplated that using the techniques of dot or slot blot hybridization which are modifications of Southern hybridization techniques one could obtain the same information that is derived from PCR, e.g., the presence of a preselected DNA segment.

Both PCR and Southern hybridization techniques can be used to demonstrate transmission of a preselected DNA segment to progeny. In most instances the characteristic Southern hybridization pattern for a given transformant will segregate in progeny as one or more Mendelian genes (Spencer et al., 1992); Laursen et al., 1994) indicating stable inheritance of the gene. The nonchimeric nature of the callus and the parental transformants ($R_0$) was suggested by germline transmission and the identical Southern blot hybridization patterns and intensities of the transforming DNA in callus, $R_0$ plants and $R_1$ progeny that segregated for the transformed gene.

Whereas DNA analysis techniques may be conducted using DNA isolated from any part of a plant, RNA may only be expressed in particular cells or tissue types and hence it will be necessary to prepare RNA for analysis from these tissues. PCR techniques may also be used for detection and quantitation of RNA produced from introduced preselected DNA segments. In this application of PCR it is first necessary to reverse transcribe RNA into DNA, using enzymes such as reverse transcriptase, and then through the use of conventional PCR techniques amplify the DNA. In most instances PCR techniques, while useful, will not demonstrate integrity of the RNA product. Further information about the nature of the RNA product may be obtained by Northern blotting. This technique will demonstrate the presence of an RNA species and give information about the integrity of that RNA. The presence or absence of an RNA species can also be determined using dot or slot blot Northern hybridizations. These techniques are modifications of Northern blotting and will only demonstrate the presence or absence of an RNA species.

While Southern blotting and PCR may be used to detect the preselected DNA segment in question, they do not provide information as to whether the preselected DNA segment is being expressed. Expression may be evaluated by specifically identifying the protein products of the introduced preselected DNA segments or evaluating the phenotypic changes brought about by their expression.

Assays for the production and identification of specific proteins may make use of physical-chemical, structural, functional, or other properties of the proteins. Unique physical-chemical or structural properties allow the proteins to be separated and identified by electrophoretic procedures, such as native or denaturing gel electrophoresis or isoelectric focusing, or by chromatographic techniques such as ion exchange or gel exclusion chromatography. The unique structures of individual proteins offer opportunities for use of specific antibodies to detect their presence in formats such as an ELISA assay. Combinations of approaches may be employed with even greater specificity such as Western blotting in which antibodies are used to locate individual gene products that have been separated by electrophoretic techniques. Additional techniques may be employed to absolutely confirm the identity of the product of interest such as evaluation by amino acid sequencing following purification. Although these are among the most commonly employed, other procedures may be additionally used.

Assay procedures may also be used to identify the expression of proteins by their functionality, especially the ability of enzymes to catalyze specific chemical reactions involving specific substrates and products. These reactions may be followed by providing and quantifying the loss of substrates or the generation of products of the reactions by physical or chemical procedures. Examples are as varied as the enzyme to be analyzed.

Very frequently the expression of a gene product is determined by evaluating the phenotypic results of its expression. These assays also may take many forms including but not limited to analyzing changes in the chemical composition, morphology, or physiological properties of the plant. Morphological changes may include greater stature or thicker stalks. Most often changes in response of plants or plant parts to imposed treatments are evaluated under carefully controlled conditions termed bioassays.

V. USES OF TRANSGENIC PLANTS

Once an expression cassette of the invention has been transformed into a particular plant species, it may be propagated in that species or moved into other varieties of the same species, particularly including commercial varieties, using traditional breeding techniques. Particularly preferred plants of the invention include the agronomically important crops listed above. The genetic properties engineered into the transgenic seeds and plants described above are passed on by sexual reproduction and can thus be maintained and propagated in progeny plants. The present invention also relates to a transgenic plant cell, tissue, organ, seed or plant part obtained from the transgenic plant. Also included within the invention are transgenic descendants of the plant as well as transgenic plant cells, tissues, organs, seeds and plant parts obtained from the descendants.

Preferably, the expression cassette in the transgenic plant is sexually transmitted. In one preferred embodiment, the coding sequence is sexually transmitted through a complete normal sexual cycle of the R0 plant to the R1 generation. Additionally preferred, the expression cassette is expressed in the cells, tissues, seeds or plant of a transgenic plant in an amount that is different than the amount in the cells, tissues, seeds or plant of a plant which only differs in that the expression cassette is absent.

The transgenic plants produced herein are thus expected to be useful for a variety of commercial and research purposes. Transgenic plants can be created for use in traditional agriculture to possess traits beneficial to the grower (e.g., agronomic traits such as resistance to water deficit, pest resistance, herbicide resistance or increased yield), beneficial to the consumer of the grain harvested from the plant (e.g., improved nutritive content in human food or animal feed; increased vitamin, amino acid, and antioxidant content; the production of antibodies (passive immunization) and nutriceuticals), or beneficial to the food processor (e.g., improved processing traits). In such uses, the plants are generally grown for the use of their grain in human or animal foods. Additionally, the use of root-specific promoters in transgenic plants can provide beneficial traits that are localized in the consumable (by animals and humans) roots of plants such as carrots, parsnips, and beets. However, other parts of the plants, including stalks, husks, vegetative parts, and the like, may also have utility, including use as part of animal silage or for ornamental purposes. Often, chemical constituents (e.g., oils or starches) of maize and other crops are extracted for foods or industrial use and transgenic plants may be created which have enhanced or modified levels of such components.

Transgenic plants may also find use in the commercial manufacture of proteins or other molecules, where the molecule of interest is extracted or purified from plant parts, seeds, and the like. Cells or tissue from the plants may also be cultured, grown in vitro, or fermented to manufacture such molecules.

The transgenic plants may also be used in commercial breeding programs, or may be crossed or bred to plants of related crop species. Improvements encoded by the expression cassette may be transferred, e.g., from maize cells to cells of other species, e.g., by protoplast fusion.

The transgenic plants may have many uses in research or breeding, including creation of new mutant plants through insertional mutagenesis, in order to identify beneficial mutants that might later be created by traditional mutation and selection. An example would be the introduction of a recombinant DNA sequence encoding a transposable element that may be used for generating genetic variation. The methods of the invention may also be used to create plants having unique "signature sequences" or other marker sequences which can be used to identify proprietary lines or varieties.

Thus, the transgenic plants and seeds according to the invention can be used in plant breeding which aims at the development of plants with improved properties conferred by the expression cassette, such as tolerance of drought, disease, or other stresses. The various breeding steps are characterized by well-defined human intervention such as selecting the lines to be crossed, directing pollination of the parental lines, or selecting appropriate descendant plants. Depending on the desired properties different breeding measures are taken. The relevant techniques are well known in the art and include but are not limited to hybridization, inbreeding, backcross breeding, ultilane breeding, variety blend, interspecific hybridization, aneuploid techniques, etc. Hybridization techniques also include the sterilization of plants to yield male or female sterile plants by mechanical, chemical or biochemical means. Cross pollination of a male sterile plant with pollen of a different line assures that the genome of the male sterile but female fertile plant will uniformly obtain properties of both parental lines. Thus, the transgenic seeds and plants according to the invention can be used for the breeding of improved plant lines which for example increase the effectiveness of conventional methods such as herbicide or pesticide treatment or allow to dispense with said methods due to their modified genetic properties. Alternatively new crops with improved stress tolerance can be obtained which, due to their optimized genetic "equipment", yield harvested product of better quality than products which were not able to tolerate comparable adverse developmental conditions.

Polynucleotides derived from nucleotide sequences of the present invention having any of the nucleotide sequences of SEQ ID NOs: 1 to SEQ ID NO: 1597, 5927, 5940, 5941, 5945-5958 are useful to detect the presence in a test sample of at least one copy of a nucleotide sequence containing the same or substantially the same sequence, or a fragment, complement, or variant thereof. The sequence of the probes and/or primers of the instant invention need not be identical to those provided in the Sequence Listing or the complements thereof. Some variation in probe or primer sequence and/or length can allow additional family members to be detected, as well as orthologous genes and more taxonomically distant related sequences. Similarly probes and/or primers of the invention can include additional nucleotides that serve as a label for detecting duplexes, for isolation of duplexed polynucleotides, or for cloning purposes.

Preferred probes and primers of the invention include isolated, purified, or recombinant polynucleotides containing a contiguous span of between at least 12 to at least 1000 nucleotides of any nucleotide sequence which is substantially similar, and preferably has at least between 70% and 99% sequence identity to any one of SEQ ID NOs: 1 to 1597, 5927, 5940, 5941, 5945-5958 and further of any nucleotide sequence which is substantially similar, and preferably has at least between 70% and 99% sequence identity to any one of SEQ ID NO: 1598 to 2672, 5959, 5972, 5973, 5977-5990 and 6001 representing promoter sequences, or the complements thereof, with each individual number of nucleotides within this range also being part of the invention. Preferred are isolated, purified, or recombinant polynucleotides containing a contiguous span of at least 12, 15, 18, 20, 25, 30, 35, 40, 50, 60, 70, 80, 90, 100, 150, 200, 300, 400, 500, 750, or 1000 nucleotides of any nucleotide sequence which is substantially similar, and preferably has at least between 70% and 99% sequence identity to any one of SEQ ID NOs: 1 to 1597, 5927, 5940, 5941, 5945-5958 and further of any nucleotide sequence which is substantially similar, and preferably has at least between 70% and 99% sequence identity to any one of SEQ ID NO: 1598 to 2672, 5959, 5972, 5973, 5977-5990 and 6001 representing promoter sequences, or the complements thereof. The appropriate length for primers and probes will vary depending on the application. For use as PCR primers, probes are 12-40 nucleotides, preferably 18-30 nucleotides long. For use in mapping, probes are 50 to 500 nucleotides, preferably 100-250 nucleotides long. For use in Southern hybridizations, probes as long as several kilobases can be used. The appropriate length for primers and probes under a particular set of assay conditions may be empirically determined by one of skill in the art.

The primers and probes can be prepared by any suitable method, including, for example, cloning and restriction of appropriate sequences and direct chemical synthesis by a method such as the phosphodiester method of Narang et al. (*Meth Enzymol* 68: 90 (1979)), the diethylphosphoramidite method, the triester method of Matteucci et al. (*J Am Chem Soc* 103: 3185 (1981)), or according to Urdea et al. (*Proc Natl Acad* 80: 7461 (1981)), the solid support method described in EP 0 707 592, or using commercially available automated oligonucleotide synthesizers.

Detection probes are generally nucleotide sequences or uncharged nucleotide analogs such as, for example peptide nucleotides which are disclosed in International Patent Application WO 92/20702, morpholino analogs which are described in U.S. Pat. Nos. 5,185,444, 5,034,506 and 5,142,047. The probe may have to be rendered "non-extendable" such that additional dNTPs cannot be added to the probe. Analogs are usually non-extendable, and nucleotide probes can be rendered non-extendable by modifying the 3' end of the probe such that the hydroxyl group is no longer capable of participating in elongation. For example, the 3' end of the probe can be functionalized with the capture or detection label to thereby consume or otherwise block the hydroxyl group. Alternatively, the 3' hydroxyl group simply can be cleaved, replaced or modified so as to render the probe non-extendable.

Any of the polynucleotides of the present invention can be labeled, if desired, by incorporating a label detectable by spectroscopic, photochemical, biochemical, immunochemical, or chemical means. For example, useful labels include radioactive substances ($^{32}$P, $^{35}$S, $^{3}$H, $^{125}$I), fluorescent dyes (5-bromodeoxyuridine, fluorescein, acetylaminofluorene, digoxigenin) or biotin. Preferably, polynucleotides are labeled at their 3' and 5' ends. Examples of non-radioactive labeling of nucleotide fragments are described in the French patent No. FR-7810975 and by Urdea et al. (*Nuc Acids Res* 16:4937 (1988)). In addition, the probes according to the present invention may have structural characteristics such that they allow the signal amplification, such structural characteristics being, for example, branched DNA probes as described in EP 0 225 807.

A label can also be used to capture the primer so as to facilitate the immobilization of either the primer or a primer extension product, such as amplified DNA, on a solid support. A capture label is attached to the primers or probes and can be a specific binding member that forms a binding pair with the solid's phase reagent's specific binding member, for example biotin and streptavidin. Therefore depending upon the type of label carried by a polynucleotide or a probe, it may be employed to capture or to detect the target DNA. Further, it will be understood that the polynucleotides, primers or probes provided herein, may, themselves, serve as the capture label. For example, in the case where a solid phase reagent's binding member is a nucleotide sequence, it may be selected such that it binds a complementary portion of a primer or probe to thereby immobilize the primer or probe to the solid phase. In cases where a polynucleotide probe itself serves as the binding member, those skilled in the art will recognize that the probe will contain a sequence or "tail" that is not complementary to the target. In the case where a polynucleotide primer itself serves as the capture label, at least a portion of the primer will be free to hybridize with a nucleotide on a solid phase. DNA labeling techniques are well known in the art.

Any of the polynucleotides, primers and probes of the present invention can be conveniently immobilized on a solid support. Solid supports are known to those skilled in the art and include the walls of wells of a reaction tray, test tubes, polystyrene beads, magnetic beads, nitrocellulose strips, membranes, microparticles such as latex particles, sheep (or other animal) red blood cells, duracytes and others. The solid support is not critical and can be selected by one skilled in the art. Thus, latex particles, microparticles, magnetic or non-magnetic beads, membranes, plastic tubes, walls of microtiter wells, glass or silicon chips, sheep (or other suitable animal's) red blood cells and duracytes are all suitable examples. Suitable methods for immobilizing nucleotides on solid phases include ionic, hydrophobic, covalent interactions and the like. A solid support, as used herein, refers to any material that is insoluble, or can be made insoluble by a subsequent reaction. The solid support can be chosen for its intrinsic ability to attract and immobilize the capture reagent. Alternatively, the solid phase can retain an additional receptor that has the ability to attract and immobilize the capture reagent. The additional receptor can include a charged substance that is oppositely charged with respect to the capture reagent itself or to a charged substance conjugated to the capture reagent. As yet another alternative, the receptor molecule can be any specific binding member which is immobilized upon (attached to) the solid support and which has the ability to immobilize the capture reagent through a specific binding reaction. The receptor molecule enables the indirect binding of the capture reagent to a solid support material before the performance of the assay or during the performance of the assay. The solid phase thus can be a plastic, derivatized plastic, magnetic or non-magnetic metal, glass or silicon surface of a test tube, microtiter well, sheet, bead, microparticle, chip, sheep (or other suitable animal's) red blood cells, duracytes and other configurations known to those of ordinary skill in the art. The polynucleotides of the invention can be attached to or immobilized on a solid support individually or in groups of at least 2, 5, 8, 10, 12, 15, 20, or 25 distinct polynucleotides of the invention to a single solid support. In addition, polynucleotides other than those of the invention may be attached to the same solid support as one or more polynucleotides of the invention.

The polynucleotides of the invention that are expressed or repressed in response to environmental stimuli such as, for example, stress or treatment with chemicals or pathogens or at different developmental stages can be identified by employing an array of nucleic acid samples, e.g., each sample having a plurality of oligonucleotides, and each plurality corresponding to a different plant gene, on a solid substrate, e.g., a DNA chip, and probes corresponding to nucleic acid expressed in, for example, one or more plant tissues and/or at one or more developmental stages, e.g., probes corresponding to nucleic acid expressed in seed of a plant relative to control nucleic acid from sources other than seed. Thus, genes that are upregulated or downregulated in the majority of tissues at a majority of developmental stages, or upregulated or downregulated in one tissue such as in seed, can be systematically identified. The probes may also correspond to nucleic acid expressed in response to a defined treatment such as, for example, a treatment with a variety of plant hormones or the exposure to specific environmental conditions involving, for example, an abiotic stress or exposure to light.

Specifically, labeled rice cRNA probes were hybridized to the rice DNA array, expression levels were determined by laser scanning and then rice genes were identified that had a particular expression pattern. The rice oligonucleotide probe array consists of probes from over 18,000 unique rice genes, which covers approximately 40-50% of the genome. This genome array permits a broader, more complete and less biased analysis of gene expression.

Consequently, the invention also deals with a method for detecting the presence of a polynucleotide including a nucleotide sequence which is substantially similar to a nucleotide sequence given in SEQ ID NOs: 1 to SEQ ID NO: 6001, or a fragment or a variant thereof, or a complementary sequence thereto, in a sample, the method including the following steps of:
  (a) bringing into contact a nucleotide probe or a plurality of nucleotide probes which can hybridize with a polynucleotide having a nucleotide sequence which is substantially similar to a nucleotide sequence given in SEQ ID NOs: 1 to SEQ ID NO: 6001, a fragment or a variant thereof, or a complementary sequence thereto and the sample to be assayed.
  (b) detecting the hybrid complex formed between the probe and a nucleotide in the sample.

The invention further concerns a kit for detecting the presence of a polynucleotide including a nucleotide sequence which is substantially similar to a nucleotide sequence given in SEQ ID NOs: 1 to SEQ ID NO: 6001, a fragment or a variant thereof, or a complementary sequence thereto, in a sample, the kit including a nucleotide probe or a plurality of nucleotide probes which can hybridize with a nucleotide sequence included in a polynucleotide, which nucleotide sequence is substantially similar to a nucleotide sequence given in of SEQ ID NOs: 1 to SEQ ID NO: 6001, a fragment or a variant thereof, or a complementary sequence thereto and, optionally, the reagents necessary for performing the hybridization reaction.

In a first preferred embodiment of this detection method and kit, the nucleotide probe or the plurality of nucleotide probes are labeled with a detectable molecule. In a second preferred embodiment of the method and kit, the nucleotide probe or the plurality of nucleotide probes has been immobilized on a substrate.

The isolated polynucleotides of the invention can be used to create various types of genetic and physical maps of the genome of rice or other plants. Such maps are used to devise positional cloning strategies for isolating novel genes from the mapped crop species. The sequences of the present invention are also useful for chromosome mapping, chromosome identification, tagging of genes which are tissue-specifically expressed.

The isolated polynucleotides of the invention can further be used as probes for identifying polymorphisms associated with phenotypes of interest. Briefly, total DNA is isolated from an individual or isogenic line, cleaved with one or more restriction enzymes, separated according to mass, transferred to a solid support, and hybridized with a probe molecule according to the invention. The pattern of fragments hybridizing to a probe molecule is compared for DNA from different individuals or lines, where differences in fragment size signals a polymorphism associated with a particular nucleotide sequence according to the present invention. After identification of polymorphic sequences, linkage studies can be conducted. After identification of many polymorphisms using a nucleotide sequence according to the invention, linkage studies can be conducted by using the individuals showing polymorphisms as parents in crossing programs. Recombinants, $F_2$ progeny recombinants or recombinant inbreds, can then be analyzed using the same restriction enzyme/hybridization procedure. The order of DNA polymorphisms along the chromosomes can be inferred based on the frequency with which they are inherited together versus inherited independently. The closer together two polymorphisms occur in a chromosome, the higher the probability that they are inherited together. Integration of the relative positions of polymorphisms and associated marker sequences produces a genetic map of the species, where the distances between markers reflect the recombination frequencies in that chromosome segment. Preferably, the polymorphisms and marker sequences are sufficiently numerous to produce a genetic map of sufficiently high resolution to locate one or more loci of interest.

The use of recombinant inbred lines for such genetic mapping is described for rice (Oh et al., *Mol Cells* 8:175 (1998); Nandi et al., *Mol Gen Genet* 255:1 (1997); Wang et al., *Genetics* 136:1421 (1994)), sorghum (Subudhi et al., *Genome* 43:240 (2000)), maize (Burr et al., *Genetics* 118:519 (1998); Gardiner et al., *Genetics* 134:917 (1993)), and *Arabidopsis* (*Methods in Molecular Biology*, Martinez-Zapater and Salinas, eds., 82:137-146, (1998)). However, this procedure is not limited to plants and can be used for other organisms such as yeast or other fungi, or for oomycetes or other protistans.

The nucleotide sequences of the present invention can also be used for simple sequence repeat identification, also known as single sequence repeat, (SSR) mapping. SSR mapping in rice has been described by Miyao et al. (*DNA Res* 3:233 (1996)) and Yang et al. (*Mol Gen Genet* 245:187 (1994)), and in maize by Ahn et al. (*Mol Gen Genet* 241:483 (1993)). SSR mapping can be achieved using various methods. In one instance, polymorphisms are identified when sequence specific probes flanking an SSR contained within an sequence of the invention are made and used in polymerase chain reaction (PCR) assays with template DNA from two or more individuals or, in plants, near isogenic lines. A change in the number of tandem repeats between the SSR-flanking sequence produces differently sized fragments (U.S. Pat. No. 5,766,847). Alternatively, polymorphisms can be identified by using the PCR fragment produced from the SSR-flanking sequence specific primer reaction as a probe against Southern blots representing different individuals (Refseth et al., *Electrophoresis* 18:1519 (1997)). Rice SSRs were used to map a molecular marker closely linked to a nuclear restorer gene for fertility in rice as described by Akagi et al. (*Genome* 39:205 (1996)).

The nucleotide sequences of the present invention can be used to identify and develop a variety of microsatellite markers, including the SSRs described above, as genetic markers for comparative analysis and mapping of genomes. The nucleotide sequences of the present invention can be used in a variation of the SSR technique known as inter-SSR (ISSR), which uses microsatellite oligonucleotides as primers to amplify genomic segments different from the repeat region itself (Zietkiewicz et al., *Genomics* 20:176 (1994)). ISSR employs oligonucleotides based on a simple sequence repeat anchored or not at their 5'- or 3'-end by two to four arbitrarily chosen nucleotides, which triggers site-specific annealing and initiates PCR amplification of genomic segments which are flanked by inversely orientated and closely spaced repeat sequences. In one embodiment of the present invention, microsatellite markers derived from the nucleotide sequences disclosed in the Sequence Listing, or substantially similar sequences or allelic variants thereof, may be used to detect the appearance or disappearance of markers indicating genomic instability as described by Leroy et al. (*Electron. J Biotechnol*, 3(2), (2000), available at the website of the Electronic Journal of Biotechnology), where alteration of a fingerprinting pattern indicated loss of a marker corresponding to a part of a gene involved in the regulation of cell proliferation. Microsatellite markers derived from nucleotide sequences as provided in the Sequence Listing will be useful for detecting genomic alterations such as the change observed by Leroy et al. (*Electron. J Biotechnol*, 3(2), supra (2000)) which appeared to be the consequence of microsatellite instability at the primer binding site or modification of the region between the microsatellites, and illustrated somaclonal variation leading to genomic instability. Consequently, the nucleotide sequences of the present invention are useful for detecting genomic alterations involved in somaclonal variation, which is an important source of new phenotypes.

In addition, because the genomes of closely related species are largely syntenic (that is, they display the same ordering of genes within the genome), these maps can be used to isolate novel alleles from wild relatives of crop species by positional cloning strategies. This shared synteny is very powerful for using genetic maps from one species to map genes in another. For example, a gene mapped in rice provides information for the gene location in maize and wheat.

The various types of maps discussed above can be used with the nucleotide sequences of the invention to identify Quantitative Trait Loci (QTLs) for a variety of uses, including marker-assisted breeding. Many important crop traits are quantitative traits and result from the combined interactions of several genes. These genes reside at different loci in the genome, often on different chromosomes, and generally exhibit multiple alleles at each locus. Developing markers, tools, and methods to identify and isolate the QTLs enables marker-assisted breeding to enhance traits of interest or suppress undesirable traits that interfere with a desired effect. The nucleotide sequences as provided in the Sequence Listing can be used to generate markers, including single-sequence repeats (SSRs) and microsatellite markers for QTLs of interest to assist marker-assisted breeding. The nucleotide sequences of the invention can be used to identify QTLs and isolate alleles as described by Li et al. in a study of QTLs involved in resistance to a pathogen of rice. (Li et al., *Mol Gen Genet* 261:58 (1999)). In addition to isolating QTL alleles in rice, other cereals, and other monocot and dicot crop species, the nucleotide sequences of the invention can also be used to isolate alleles from the corresponding QTL(s) of wild relatives. Transgenic plants having various combinations of QTL alleles can then be created and the effects of the combinations measured. Once an ideal allele combination has been identified, crop improvement can be accomplished either through biotechnological means or by directed conventional breeding programs. (Flowers et al., *J Exp Bot* 51:99 (2000); Tanksley and McCouch, *Science* 277:1063 (1997)).

In another embodiment the nucleotide sequences of the invention can be used to help create physical maps of the genome of maize, *Arabidopsis* and related species. Where the nucleotide sequences of the invention have been ordered on a genetic map, as described above, then the nucleotide sequences of the invention can be used as probes to discover which clones in large libraries of plant DNA fragments in YACs, PACs, etc. contain the same nucleotide sequences of the invention or similar sequences, thereby facilitating the assignment of the large DNA fragments to chromosomal positions. Subsequently, the large BACs, YACs, etc. can be ordered unambiguously by more detailed studies of their sequence composition and by using their end or other sequence to find the identical sequences in other cloned DNA fragments (Mozo et al., *Nat Genet* 22:271 (1999)). Overlapping DNA sequences in this way allows assembly of large sequence contigs that, when sufficiently extended, provide a complete physical map of a chromosome. The nucleotide sequences of the invention themselves may provide the means of joining cloned sequences into a contig, and are useful for constructing physical maps.

In another embodiment, the nucleotide sequences of the present invention may be useful in mapping and characterizing the genomes of other cereals. Rice has been proposed as a model for cereal genome analysis (Havukkala, *Curr Opin Genet Devel* 6:711 (1996)), based largely on its smaller genome size and higher gene density, combined with the considerable conserved gene order among cereal genomes (Ahn et al., *Mol Gen Genet* 241:483 (1993)). The cereals demonstrate both general conservation of gene order (synteny) and considerable sequence homology among various cereal gene families. This suggests that studies on the functions of genes or proteins from rice that are tissue-specifically expressed could lead to the identification of orthologous genes or proteins in other cereals, including maize, wheat, secale, sorghum, barley, millet, teff, milo, triticale, flax, gramma grass, *Tripsacum* sp., and teosinte. The nucleotide sequences according to the invention can also be used to physically characterize homologous chromosomes in other cereals, as described by Sarma et al. (*Genome* 43:191 (2000)), and their use can be extended to non-cereal monocots such as sugarcane, grasses, and lilies.

Given the synteny between rice and other cereal genomes, the nucleotide sequences of the present invention can be used to obtain molecular markers for mapping and, potentially, for positional cloning. Kilian et al. described the use of probes from the rice genomic region of interest to isolate a saturating number of polymorphic markers in barley, which were shown to map to syntenic regions in rice and barley, suggesting that the nucleotide sequences of the invention derived from the rice genome would be useful in positional cloning of syntenic genes of interest from other cereal species. (Kilian, et al., *Nucl Acids Res* 23:2729 (1995); Kilian, et al., *Plant Mol Biol* 35:187 (1997)). Synteny between rice and barley has recently been reported in the area of the carrying malting quality QTLs (Han, et al., *Genome* 41:373 (1998)), and use of synteny between cereals for positional cloning efforts is likely to add considerable value to rice genome analysis. Likewise, mapping of the ligules region of sorghum was facilitated using molecular markers from a syntenic region of the rice genome. (Zwick, et al., *Genetics* 148:1983 (1998)).

Rice marker technology utilizing the nucleotide sequences of the present invention can also be used to identify QTL alleles for a trait of interest from a wild relative of cultivated rice, for example as described by Xiao, et al. (*Genetics* 150: 899 (1998)). Wild relatives of domesticated plants represent untapped pools of genetic resources for abiotic and biotic stress resistance, apomixis and other breeding strategies, plant architecture, determinants of yield, secondary metabolites, and other valuable traits. In rice, Xiao et al. (supra) used molecular markers to introduce an average of approximately 5% of the genome of a wild relative, and the resulting plants were scored for phenotypes such as plant height, panicle length and 1000-grain weight. Trait-improving alleles were found for all phenotypes except plant height, where any change is considered negative. Of the 35 trait-improving alleles, Xiao et al. found that 19 had no effect on other phenotypes whereas 16 had deleterious effects on other traits. The nucleotide sequences of the invention such as those provided in the Sequence Listing can be employed as molecular markers to identify QTL alleles for trait of interest from a wild relative, by which these valuable traits can be introgressed from wild relatives using methods including, but not limited to, that described by Xiao et al. ((1998) supra). Accordingly, the nucleotide sequences of the invention can be employed in a variety of molecular marker technologies for yield improvement.

Following the procedures described above to identify polymorphisms, and using a plurality of the nucleotide sequences of the invention, any individual (or line) can be genotyped. Genotyping a large number of DNA polymorphisms such as single nucleotide polymorphisms (SNPs), in breeding lines makes it possible to find associations between certain polymorphisms or groups of polymorphisms, and certain phenotypes. In addition to sequence polymorphisms, length polymorphisms such as triplet repeats are studied to find associations between polymorphism and phenotype. Genotypes can be used for the identification of particular cultivars, varieties, lines, ecotypes, and genetically modified plants or can serve as tools for subsequent genetic studies of complex traits involving multiple phenotypes.

The patent publication WO95/35505 and U.S. Pat. Nos. 5,445,943 and 5,410,270 describe scanning multiple alleles of a plurality of loci using hybridization to arrays of oligonucleotides. The nucleotide sequences of the invention are suitable for use in genotyping techniques useful for each of the types of mapping discussed above.

In a preferred embodiment, the nucleotide sequences of the invention are useful for identifying and isolating a least one unique stretch of protein-encoding nucleotide sequence. The nucleotide sequences of the invention are compared with other coding sequences having sequence similarity with the sequences provided in the Sequence Listing, using a program such as BLAST. Comparison of the nucleotide sequences of the invention with other similar coding sequences permits the identification of one or more unique stretches of coding sequences encoding proteins that are tissue-specifically expressed and that are not identical to the corresponding coding sequence being screened. Preferably, a unique stretch of coding sequence of about 25 base pairs (bp) long is identified, more preferably 25 bp, or even more preferably 22 bp, or 20 bp, or yet even more preferably 18 bp or 16 bp or 14 bp. In one embodiment, a plurality of nucleotide sequences is screened to identify unique coding sequences according to the invention. In one embodiment, one or more unique coding sequences according to the invention can be applied to a chip as part of an array, or used in a non-chip array system. In a further embodiment, a plurality of unique coding sequences according to the invention is used in a screening array. In another embodiment, one or more unique coding sequences according to the invention can be used as immobilized or as probes in solution. In yet another embodiment, one or more unique coding sequences according to the invention can be used as primers for PCR. In a further embodiment, one or more unique coding sequences according to the invention can be used as organism-specific primers for PCR in a solution containing DNA from a plurality of sources.

In another embodiment unique stretches of nucleotide sequences according to the invention are identified that are preferably about 30 bp, more preferably 50 bp or 75 bp, yet more preferably 100 bp, 150 bp, 200 bp, 250, 500 bp, 750 bp, or 1000 bp. The length of an unique coding sequence may be chosen by one of skill in the art depending on its intended use and on the characteristics of the nucleotide sequence being used. In one embodiment, unique coding sequences according to the invention may be used as probes to screen libraries to find homologs, orthologs, or paralogs. In another embodiment, unique coding sequences according to the invention may be used as probes to screen genomic DNA or cDNA to find homologs, orthologs, or paralogs. In yet another embodiment, unique coding sequences according to the invention may be used to study gene evolution and genome evolution.

The invention also provides a computer readable medium having stored thereon a data structure containing nucleic acid sequences having at least 70% sequence identity to a nucleic acid sequence selected from those listed in SEQ ID Nos: 1-6001, as well as complementary, ortholog, and variant sequences thereof. Storage and use of nucleic acid sequences on a computer readable medium is well known in the art. See for example U.S. Pat. Nos. 6,023,659; 5,867,402; 5,795,716. Examples of such medium include, but are not limited to, magnetic tape, optical disk, CD-ROM, random access memory, volatile memory, non-volatile memory and bubble memory. Accordingly, the nucleic acid sequences contained on the computer readable medium may be compared through use of a module that receives the sequence information and compares it to other sequence information. Examples of other sequences to which the nucleic acid sequences of the invention may be compared include those maintained by the National Center for Biotechnology Information (NCBI), accessible through the World Wide Web, and the Swiss Protein Data Bank. A computer is an example of such a module that can read and compare nucleic acid sequence information. Accordingly, the invention also provides the method of comparing a nucleic acid sequence of the invention to another sequence. For example, a sequence of the invention may be submitted to the NCBI for a Blast search as described herein where the sequence is compared to sequence information contained within the NCBI database and a comparison is returned. The invention also provides nucleic acid sequence information in a computer readable medium that allows the encoded polypeptide to be optimized for a desired property. Examples of such properties include, but are not limited to, increased or decreased: thermal stability, chemical stability, hydrophylicity, hydrophobicity, and the like. Methods for the use of computers to model polypeptides and polynucleotides having altered activities are well known in the art and have been reviewed. (Lesyng et al., 1993; Surles et al., 1994; Koehl et al., 1996; Rossi et al., 2001).

Example 1

GENECHIP® Standard Protocol 1.1 Quantitation of Total RNA
Total RNA from plant tissue is extracted and quantified.
30 Quantify total RNA using GeneQuant
$1OD_{260}$=40 mg RNA/ml; $A_{260}/A_{280}$=1.9 to about 2.1
2. Run gel to check the integrity and purity of the extracted RNA 1.2 Synthesis of Double-Stranded cDNA
Gibco/BRL SuperScript Choice System for cDNA Synthesis (Cat#1B090-019) was employed to prepare cDNAs. T7-$(dT)_{24}$ oligonucleotides were prepared and purified by HPLC.

(5'-GGCCAGTGAATTGTAATACGACTCACTATAGGGAGGCGG- $(dT)_{24}$-3'; SEQ ID NO:4709).

1.2.1 Step 1. Primer Hybridization:
Incubate at 70° C. for 10 minutes
Quick spin and put on ice briefly 1.2.2 Step 2. Temperature Adjustment:
Incubate at 42° C. for 2 minutes
1.2.3 Step 3. First Strand Synthesis:
DEPC-water-1:1
RNA (10:g final)-10:1
T7=$(dT)_{24}$ Primer (100 pmol final)-1:1 pmol
5×$1^{st}$ strand cDNA buffer-4:1
0.1M DTT (10 mM final)-2:1
10 mM dNTP mix (500:M final)-1:1
Superscript II RT 200 U/:1-1:1
Total of 20:1
Mix well
Incubate at 42° C. for 1 hour
1.2.4 Step 4. Second Strand Synthesis:
Place reactions on ice, quick spin
DEPC-water-91:1
5×$2^{nd}$ strand cDNA buffer-30:1
10 mM dNTP mix (250 mM final)-3:1
E. coli DNA ligase (10 U/:1)-1:1
E. coli DNA polymerase 1-10 U/:1-4:1
RnaseH 2U/:1-1:1
T4 DNA polymerase 5 U/:1-2:1
0.5 M EDTA (0.5 M final)-10:1
Total 162:1
Mix/spin down/incubate 16° C. for 2 hours
1.2.5 Step 5. Completing the reaction:
Incubate at 16° C. for 5 minutes 1.3 Purification of Double Stranded cDNA
1. Centrifuge PLG (Phase Lock Gel, EPPENDORF® 5 Prime Inc., pI-188233) at 14,000×, transfer 162:1 of cDNA to PLG
2. Add 162:1 of Phenol:Chloroform:Isoamyl alcohol (pH 8.0), centrifuge 2 minutes
3. Transfer the supernatant to a fresh 1.5 ml tube, add

| | |
|---|---|
| Glycogen (5 mg/ml) | 2 µl |
| 0.5 M NH$_4$OAC (0.75 × Vol) | 120 µl |
| ETOH (2.5 × Vol, −20° C.) | 400 µl |

4. Mix well and centrifuge at 14,000× for 20 minutes
5. Remove supernatant, add 0.5 ml 80% EtOH (−20° C.)
6. Centrifuge for 5 minutes, air dry or by speed vac for 5-10 minutes
7. Add 44:1 DEPC H$_2$O Analyze of quantity and size distribution of cDNA Run a gel using 1:1 of the double-stranded synthesis product 1.4 Synthesis of Biotinylated cRNA
(use Enzo BioArray High Yield RNA Transcript Labeling Kit Cat#900182)

| | |
|---|---|
| Purified cDNA | 22:1 |
| 10X Hy buffer | 4:1 |
| 10X biotin ribonucleotides | 4:1 |
| 10X DTT | 4:1 |
| 10X Rnase inhibitor mix | 4:1 |
| 20X T7 RNA polymerase | 2:1 |
| Total | 40:1 |

Centrifuge 5 seconds, and incubate for 4 hours at 37° C. Gently mix every 30-45 minutes 1.5 Purification and Quantification of cRNA (use Qiagen RNEASY® Mini kit Cat# 74103)

| cRNA | 40:1 | |
|---|---|---|
| DEPC H$_2$O | 60:1 | |
| RLT buffer | 350:1 | mix by vortexing |
| EtOH | 250:1 | mix by pipetting |
| Total | 700:1 | |

Wait 1 minute or more for the RNA to stick

Centrifuge at 2000 rpm for 5 minutes

| RPE buffer | 500:1 |
|---|---|

Centrifuge at 10,000 rpm for 1 minute

| RPE buffer | 500:1 |
|---|---|

Centrifuge at 10,000 rpm for 1 minute

Centrifuge at 10,000 rpm for 1 minute to dry the column

| DEPC H$_2$O | 30:1 |
|---|---|

Wait for 1 minute, then elute cRNA from by centrifugation, 10K 1 minute

| DEPC H$_2$O | 30:1 |
|---|---|

Repeat previous step

Determine concentration and dilute to 1:g/:1 concentration 1.6 Fragmentation of cRNA

| cRNA (1:g/:1) | 15:1 |
|---|---|
| 5X Fragmentation Buffer* | 6:1 |
| DEPC H$_2$O | 9:1 |
| | 30:1 |

*5x Fragmentation Buffer

| 1M Tris (pH8.1) | 4.0 ml |
|---|---|
| MgOAc | 0.64 g |
| KOAC | 0.98 g |
| DEPC H$_2$O | |
| Total | 20 ml |

Filter Sterilize 1.7 Array Wash and Staining

Stringent Wash Buffer**

Non-Stringent Wash Buffer***

SAPE Stain****

Antibody Stain*****

**Stringent Buffer: 12×MES 83.3 ml, 5 M NaCl 5.2 ml, 10% Tween 1.0 ml, H$_2$O 910 ml, Filter Sterilize
***Non-Stringent Buffer: 20×SSPE 300 ml, 10% Tween 1.0 ml, H$_2$O 698 ml, Filter Sterilize, Antifoam 1.0.
****SAPE stain: 2× Stain Buffer 600:1, BSA 48:1, SAPE 12:1, H$_2$O 540:1.
*****Antibody Stain: 2× Stain Buffer 300:1, H$_2$O 266.4:1, BSA 24:1, Goat IgG 6:1, Biotinylated Ab 3.6:1

Wash on fluidics station using the appropriate antibody amplification protocol

Example 2

Characterization of Gene Expression Profiles During *Oryza* Plant Development

A rice gene array (proprietary to Affymetrix) and probes derived from rice RNA extracted from different tissues and developmental stages were used to identify the expression profile of genes on the chip. The rice array contains over 23,000 genes (approximately 18,000 unique genes) or roughly 50% of the rice genome and is similar to the *Arabidopsis* GENECHIP® (Affymetrix) with the exception that the 16 oligonucleotide probe sets do not contain mismatch probe sets. The level of expression is therefore determined by internal software that analyzes the intensity level of the 16 probe sets for each gene. The highest and lowest probes are removed if they do not fit into a set of predefined statistical criteria and the remaining sets are averaged to give an expression value. The final expression values are normalized by software, as described below. The advantages of a gene chip in such an analysis include a global gene expression analysis, quantitative results, a highly reproducible system, and a higher sensitivity than Northern blot analyses.

Total RNA was isolated from 29 samples at different developmental stages (see below).

germinating seed root
germinating seed leaf
3-4 leaf arial
root tillering
leaf tillering
arial tillering
panicle 1-3
panicle 4-7
panicle 8-14
panicle 15-20
Panicle panicle emergence
leaf booting
arial booting
root booting
root panicle emergence
stem panicle emergence
Inflorescence
stem mature
root mature
leaf mature
stem senescence
leaf senescence
Embryo
Endosperm
seed coat -continued Aleurone
seed milk
seed soft
seed hard

Example 2.1

Preparation of RNA

Total RNA is prepared from the frozen samples using Qiagen RNEASY® columns (Valencia, Calif.) and precipitated overnight at −20° C. after the addition of 0.25 volumes of 10M LiCl$_2$. Pellets are washed with 70% EtOH, air dried and resuspended in RNase-free water.

Alternatively, total RNA is prepared using the "Pine Tree method" (Chang et al., 1993) where 1 gram of the ground frozen sample is added to 5 ml of extraction buffer (2% hexadectitrimethylamminium bromide, 2% polyvilylpyrrolidone K 30, 100 mM Tris-HCl (pH 8.0), 25 mM EDTA, 2.0 M NaCl, 0.5 g/L spermidine and 2% beta-mercaptoethanol, previously warmed to 65° C.) and mixed by inversion and vortexing. The solution is extracted two times with an equal volume of chloroform:isoamyl alcohol and precipitated overnight at −20° C. after the addition of 0.25 volumes of 10M LiCl$_2$. Pellets are washed with 70% EtOH, air dried and resuspended in RNase-free water.

Example 2.2

Preparation of cDNA

Total RNA (5 μg) from each sample is reverse transcribed. First strand cDNA synthesis is accomplished at 42° C. for one hour using 5 μg of total RNA from *Arabidopsis* tissue, 100 pmol of an oligo dT$_{(24)}$ primer containing a 5' T7 RNA polymerase promoter sequence [5'-GGCCAGTGAATTG-TAATACGACTCACTATAGGGAGGCGG-(dT)$_{24}$-3'; SEQ ID NO:4710] synthesized by Genosys, and SUPER-SCRIPT™ II reverse transcriptase (RT) (Gibco/BRL).

First strand cDNA synthesis reactions performed with SUPERSCRIPT™ II RT are carried out according to the manufacturer's recommendations using 50 mM Tris-HCl (pH 8.3), 75 mM KCl, 3 mM MgCl$_2$, 10 mM dithiothreitol (DTT), 0.5 mM dNTPs, and 200 units of RT enzyme.

The second cDNA strand is synthesized using 40 units of *E. coli* DNA polymerase I, 10 units of *E. coli* DNA ligase, and 2 units of RNase H in a reaction containing 25 mM Tris-HCl (pH 7.5), 100 mM KCl, 5 mM MgCl$_2$, 10 mM (NH$_4$)SO$_4$, 0.15 mM β-NAD$^+$, 1 mM dNTPs, and 1.2 mM DTT. The reaction proceeded at 16° C. for 2 hours and is terminated using EDTA. Double-stranded cDNA products are purified by phenol/chloroform extraction and ethanol precipitation.

Example 2.3

Preparation of Biotinylated cRNA Probes

Synthesized cDNAs (approximately 0.1 μg) are used as templates to produce biotinylated cRNA probes by in vitro transcription using T7 RNA Polymerase (ENZO BioArray High Yield RNA Transcript Labeling Kit). Labeled cRNAs are purified using affinity resin (Qiagen RNEASY® Spin Columns) and randomly fragmented to produce molecules of approximately 35 to 200 bases. Fragmentation is achieved by incubation at 94° C. for 35 minutes in a buffer containing 40 mM Tris-acetate, pH 8.1, 100 mM potassium acetate, and 30 mM magnesium acetate.

Example 2.4

Array Hybridization

The labeled samples are mixed with 0.1 mg/mL sonicated herring sperm DNA in a hybridization buffer containing 100 mM 2-N-Morpholino-ethane-sulfonic acid (MES), 1 M NaCl, 20 mM EDTA, 0.01% Tween 20, denatured at 99° C. for 5 min, and equilibrated at 45° C. for 5 min before hybridization. The hybridization mix is then transferred to the *Arabidopsis* GeneChip genome array (Affymetrix) cartridge and hybridized at 45° C. for 16 h on a rotisserie at 60 rpm.

The hybridized arrays are then rinsed and stained in a fluidics station (Affymetrix). They are first rinsed with wash buffer A (6×SSPE (0.9 M NaCl, 0.06 M NaH$_2$PO$_4$, 0.006 M EDTA), 0.01% Tween 20, 0.005% Antifoam) at 25° C. for 10 min and incubated with wash buffer B (100 mM MES, 0.1 M NaCl, 0.01% Tween 20) at 50° C. for 20 min, then stained with Streptavidin Phycoerythrin (SAPE) (100 mM MES, 1 M NaCl, 0.05% Tween 20, 0.005% Antifoam, 10 mg/mL SAPE 2 mg/mL BSA) at 25° C. for 10 min, washed with wash buffer A at 25° C. for 20 min and stained with biotinylated anti-streptavidin antibody at 25° C. for 10 min. After staining, arrays are stained with SAPE at 25° C. for 10 min and washed with wash buffer A at 30° C. for 30 min. The probe arrays are scanned twice and the intensities are averaged with a Hewlett-Packard GeneArray Scanner.

GeneSpring software was used to analyze relative expression levels and compare tissue-specificity of gene expression.

Example 2.5

Data Analysis

GENECHIP® Suite 3.2 (Affymetrix) is used for data normalization. The overall intensity of all probe sets of each array is scaled to 100 so hybridization intensity of all arrays is equivalent. False positives are defined based on experiments in which samples are split, hybridized to GENECHIP® expression arrays and the results compared. A false positive is indicated if a probe set is scored qualitatively as an "Increase" or "Decrease" and quantitatively as changing by at least two fold and average difference is greater than 25. A significant change is defined as 2-fold change or above with an expression baseline of 25, which is determined as the threshold level according to the scaling.

The expression data of selected genes are then normalized. Briefly, the median of the expression level within each chip is calculated, and the difference between the average difference and median average difference is used as new value to measure the gene expression level. The expression data are also adjusted across different chip experiments according to the calculated medium. Normalized data (genes and arrays) are analysed by the self organization map (SOM) method (Tamayo et al., *P.N.A.S.*, 96:2907 (1999), and then subject to heirachy cluster analysis (Eisen et al., *P.N.A.S.*, 95:14863 (1998). By the cluster analysis, genes and chip experiments are clustered according to the expression levels.

2.5.1. Promoter Analysis

Generally, a database with rice contigs and Perl scripts were employed to determine which rice contig contained sequences from the identified genes. Five gene prediction programs were analyzed on these contigs and the rice sequence was blasted to these predictions. The prediction that contained the entire rice sequence within an exon was used to find the promoter that was adjacent to the first exon.

For *Oryza* genes that were constitutively expressed, a cut off value of 250 in all samples was used to screen for genes that were expressed in all tissues (range of 250-8638). The background level (gene not expressed) was 50. This analysis resulted in the identification of 618 genes that were constitutively expressed (Table 1A). The ORFs for 398 of those genes are listed in SEQ ID NOs:1-398 and the promoters for some of those genes in SEQ ID NOs:1598-1885 and 5960-5971, respectively. Based on expression analysis, 150 genes were selected (Table 1B) and 120 genes of those considered for further analysis (Table 1C). Primers were prepared to isolate 38 promoters from the 120 genes (Table 12). Preferred constitutively expressed genes include but are not limited to those having SEQ ID NOs:7, 10, 12, 14, 22, 53, 54, 63, 84, 102, 103, 123, 128, and 136, and orthologs thereof, e.g., promoters having SEQ ID NOs:1647, 1634, 1606, 1684, 1631, 1662, 1691, 1630, 1603, 1663, 1604, or an ortholog thereof. Further preferred constitutively expressed genes include but are not limited to those having SEQ ID NOs: 5928, 5929, 5930, 5931, 5932, 5933, 5934, 5935, 5936, 5937, 5938, and 5939, and orthologs thereof, e.g., promoters having SEQ ID NOs: 5960, 5961, 5962, 5963, 5964, 5965, 5966, 5967, 5968, 5969, 5970, and 5971, or an ortholog thereof.

For *Oryza* genes expressed primarily in seed tissue, all genes that were expressed at 50 or above in at least one of the 29 tissues (about 13,450 genes) were filtered to be expressed less than 50 in all non-seed related samples, not including aleurone, seed coat, embryo, endosperm and seed milk, soft dough and hard dough. These analyses resulted in the identification of 812 genes that were preferentially expressed in seed tissue (Table 2A). The ORFs for 578 of those genes are listed in SEQ ID NOs:1020-1567 and the promoters for some of those in SEQ ID NOs:2275-2672. Preferred seed-specific promoters are those from genes having SEQ ID NOs:1021-1023, 1028, 1044, 1033, 1068, 1403, 1081, 1048, 1046, 1097, 1309, 1147, 1038, 1107,1161,1162, 1505, and 1026 and the orthologs thereof, e.g., promoters having SEQ ID NOs:2275-2277, 2279, 2289, 2283, 2317, 2293, 2291, 2464, 2364, 2286, 2325, 2376, 2377, and 2586, and an ortholog thereof. Further preferred are those from genes having SEQ ID NOs: 5927, 5940, 5941, and 5945-5958 and the orthologs thereof, e.g., promoters having SEQ ID NOs: 5959, 5972, 5973, 5977-5990 and 6001, and an ortholog thereof.

For seed-specific genes that were expressed only in a particular part of a seed, e.g., embryo, endosperm, aleurone, genes that were expressed at 50 or above in the particular sample but less than 50 in all other samples absent that particular tissue sample were selected. Thus, embryo-specific, endosperm-specific and aleurone-specific genes were identified (Tables 3-5). Preferred aleurone-specific promoters are those from genes having SEQ ID NOs:1045, 1165, 1324, 1150, 1547, 1373, and 5927 and the orthologs thereof, e.g., promoters having SEQ ID NOs:2290, 2380, 2366, 2627 and 5959, or an ortholog thereof. Preferred embryo-specific promoters are from genes having SEQ ID NOs:1294, 1346, 1325, 1412, 1079 and the orthologs thereof, e.g., a promoter having SEQ ID NO:2315 or an ortholog thereof. Further preferred embryo-specific promoters are from genes having SEQ ID NOs: 5940 and 5941 and the orthologs thereof, e.g., a promoter having SEQ ID NO: 5972 and 5973, or an ortholog thereof. Preferred endosperm-specific promoters are from genes having SEQ ID NOs:1043 and 1215 and the orthologs thereof, e.g., a promoter having SEQ ID NO:2411 or an ortholog thereof.

A cut off value of less than 50 in all non-root samples was used to screen for *Oryza* genes that were expressed in a root-specific manner. The background level (gene not expressed) was 50. Genes that were expressed at greater than 50 in one or more of all root samples were selected. This analysis resulted in the identification of 265 genes that were expressed primarily in root tissue (Table 8A). The ORFs for 219 of these genes is shown in SEQ ID NOs:801-1019 and some of the promoters in SEQ ID NOs:2144-2274.

For *Oryza* genes expressed primarily in *Oryza* panicle tissue (flower and pollen), all genes that were expressed at 50 or above on at least one of the rice panicle chips (about 10,597 genes) were filtered to be expressed less than 50 in (i) leaf samples at germinating seed, tillering, mature and senescence stages; (ii) root samples at germinating seed, tillering, booting, mature and panicle emergence stages; (iii) stem samples at panicle emergence and senescence stages; and (iv) seed hard dough and aleurone samples. These analyses resulted in the identification of 335 genes that were preferentially expressed in panicle tissue (Table 7A). The ORFs for 256 of those genes is listed in SEQ ID NOs:465-720 and some of the promoters in SEQ ID NOs:1919-2085 (for panicle). Preferred panicle-specific promoters are those from genes having SEQ ID NOs:689, 511, 482, 467 and 468, and the orthologs thereof, e.g., promoters having SEQ ID NOs:1920-1921, 2054, or an ortholog thereof.

Eighty pollen-specific *Oryza* genes were identified (Table 9A and SEQ ID NOs:721-800) as well some pollen-specific promoters (SEQ ID NOs:2086-2143 Preferred pollen-specific promoter are those from genes having SEQ ID NOs:723-726 and 728 and the orthologs thereof, e.g., promoters having SEQ ID NOs:2088-2090, or an ortholog thereof.

For *Oryza* genes expressed primarily in leaf and stem, i.e., green tissue, all genes that were expressed at 50 or above in at least three of the tissues (about 12,563 genes) were filtered to be expressed more than 50 in arial 3-4 leaf stage samples; less than 50 in all seed samples (day 0-19); and less than 50 in aleurone, embryo, endosperm and pollen samples. Analysis revealed 90 genes expressed in arial tissue at tillering stages that were expressed 2 fold greater than in root tissue at tillering stage (Table 6A). The ORFs for 66 of those genes are shown in SEQ ID NOs:399-464 and some of the promoters for those genes in SEQ ID NOs:1886-1918. Preferred green tissue-specific promoters are those from genes having SEQ ID NOs:401, 405, 408, 410, 416, 417, 419, 433, 438, 447 and 454 and orthologs thereof, e.g., promoters having SEQ ID NOs:1903, 1910, 1897, 1890, 1891, or an ortholog thereof. Leaf-specific but not fruit-specific genes were determined by filtering the genes as follows: relative expression of less than 50 in all of the seed samples, and greater than 50 in the leaf at tillering stage sample. This analysis resulted in the identification of five rice sequences: 5942/5991 (RF1; OS009452.1), OS012592.1, OS019946, OS001669.1, and OS002989.1. The promoter for one such gene is shown in SEQ ID NOs: 5974 and 5996, respectively.

Example 3

Promoter Analysis

The gene chip experiment described above are designed to uncover genes that are constitutively or tissue specifically (tissue-preferentially) expressed. Candidate promoters are identified based upon the expression profiles of the associated transcripts representatives of which are provided in SEQ ID NOs: 1598-1885 and SEQ ID NOs: 1886-2672, respectively and further in SEQ ID Nos: 5960-5971, 5972-5990, and 5996-6001.

Candidate promoters are obtained by PCR and fused to a GUS reporter gene containing an intron. Both histochemical and fluorometric GUS assays are carried out on stably transformed rice and maize plants and GUS activity is detected in the transformants.

Further, transient assays with the promoter::GUS constructs are carried out in rice embryogenic callus and GUS activity is detected by histochemical staining according the protocol described below (see Example 12).

Example 3.1

Construction of Binary Promoter::Reporter Plasmids

To construct a binary promoter::reporter plasmid for rice transformation a vector containing a candidate promoter of interest (i.e., the DNA sequence 5' of the initiation codon for the gene of interest) is used, which results from recombination in a BP reaction between a PCR product using the promoter of interest as a template and pDONR201™, producing an entry vector. The regulatory/promoter sequence is fused to the GUS reporter gene (Jefferson et al, 1987) by recombination using GATEWAY® Technology according to manufacturers protocol as described in the Instruction Manual (GATEWAY® Cloning Technology, GIBCO BRL, Rockville, Md., USA).

Briefly, the GATEWAY® Gus-intron-Gus (GIG)/NOS expression cassette is ligated into pNOV2117 binary vector in 5' to 3' orientation. The 4.1 kB expression cassette is ligated into the Kpn-I site of pNOV2117, then clones are screened for orientation to obtain pNOV2346, a GATEWAY® adapted binary destination vector.

The promoter fragment in the entry vector is recombined via the LR reaction with the binary destination vector containing the GUS coding region with an intron that has an attR site 5' to the GUS reporter, producing a binary vector with a promoter fused to the GUS reporter (pNOVCANDProm). The orientation of the inserted fragment is maintained by the att sequences and the final construct is verified by sequencing. The construct is then transformed into *Agrobacterium tumefaciens* strains by electroporation as described herein below.

Example 3.2

Transient Expression Analysis of Candidate Promoters in Rice Embryogenic Callus 3.2.1 Materials:
Embryogenic rice callus (Kaybonett cultivar)
LBA 4404 *Agrobacterium* strains
KCMS liquid media for re-suspending bacterial pellet
200 mM stock (40 mg/ml) Acetosyringone
Sterile filter paper discs (8.5 mm in diameter)
LB spec liquid culture
MS-CIM media plates
MS-AS plates (co-cultivation plates)
MS-Tim plates (recovery plates)
Gus staining solution 3.2.2 Methods:

3.2.2.1 Induction of Embryogenic Callus:
1. Sterilize mature Kaybonett rice seeds in 40% ultra Clorox, 1 drop Tween 20, for 40 min.
2. Rinse with sterile water and plate on MS-CIM media (12 seeds/plate)
3. Grow in dark for four weeks.
4. Isolate embryogenic calli from scutellum to MS-CIM
5. Let grow in dark 8 days before use for transformation 3.2.2.2 *Agrobacterium* Preparation and Induction:
1. Start 6 mL shaking cultures of LBA4404 *Agrobacterium* strains harboring rice promoter binary plasmids.
2. Grow the cultures at room temperature for 48 hrs in the rotary shaker.
3. Spin down the cultures at 8'000 rpm at 4° C. and re-suspend bacterial pellets in 10 ml of KCMS media supplemented with 100 µM Acetosyringone.
4. Place in the shaker at room temp for 1 hr for induction of *Agrobacterium* virulence genes.
5. In a sterile hood dilute *Agrobacterium* cultures 1:3 in KSMS media and transfer diluted cultures into deep petri dishes.

3.2.2.3 Inoculation of Plant Material and Staining:
6. In a sterile hood transfer embryogenic callus into diluted *Agrobacterium* solution and incubate for 30 minutes.
7. In a sterile hood blot callus tissue on sterile filter paper and transfer on MS-AS plates.
8. Co-culture plates in 22° C. growth chamber in the dark for two days.
9. In a sterile hood transfer callus tissue to MS-Tim plates for the tissue recovery (the presence of Timentin will prevent *Agrobacterium* growth).
10. Incubate tissue on MS-Tim media for two days at 22° C. in the dark.
11. Remove callus tissue from the plates and stain for 48 hrs. in GUS staining solution.
12. De-stain tissue in 70% EtOH for 24 hours.

3.2.2.4 Recipes:
KCMS Media (Liquid), pH to 5.5
100 ml/l MS Major Salts, 10 ml/l MS Minor Salts, 5 ml/l MS iron stock, 0.5M $K_2HPO_4$, 0.1 mg/ml Myo-Inositol, 1.3 µg/ml Thiamine, 0.2 g/ml 2,4-D (1 mg/ml), 0.1 g/ml Kinetin, 3% Sucrose, 100 µM Acetosyringone MS-CIM Media, pH 5.8
MS Basal salt (4.3 g/L), B5 Vitamins (200×) (5 m/L), 2% Sucrose (20 g/L), Proline (500 mg/L), Glutamine (500 mg/L), Casein Hydrolysate (300 mg/L), 2 µg/ml 2,4-D, Phytagel (3 g/L)

MS-As Medium pH 5.8
MS Basal salt (4.3 g/L), B5 Vitamins (200×) (5 m/L), 2% Sucrose (20 g/L), Proline (500 mg/L), Glutamine (500 mg/L), Casein Hydrolysate (300 mg/L), 2 µg/ml 2,4-D, Phytagel (3 g/L), 200 µM Acetosyringone MS-Tim media, pH 5.8
MS Basal salt (4.3 g/L), B5 Vitamins (200×) (5 m/L), 2% Sucrose (20 g/L), Proline (500 mg/L), Glutamine (500 mg/L), Casein Hydrolysate (300 mg/L), 2 µg/ml 2,4-D, Phytagel (3 g/L), 400 mg/l Timentin Gus staining solution, pH 7
0.3M Mannitol; 0.02M EDTA, pH=7.0; 0.04 $NaH_2PO_4$; 1 mM x-gluc The binary Promoter::Reporter Plasmids described in Example 3 above can also be used for stable transformation of rice and maize plants according to the protocols provided in Examples 10.1 and 10.2, respectively.

| Promoter Name | SEQ ID | Binary Vector | leafy leaf | leaf-2 o leaf | root | root-2 root | flower husk | seed kernel | anther silk | pollen pollen | comments | Rice Maize |
|---|---|---|---|---|---|---|---|---|---|---|---|---|
| RC11 |  | pNOV6043 | − |  |  | + | − | − |  |  |  | Rice |
| RC11 |  | pNOV6043 | − | − |  | + | − | + baz, e, s | − | − |  | Maize |
| RC2 | 5963 | pNOV6030 | −/+ | + | + | + | + | + |  |  |  | Rice |
| RC2 | 5963 | pNOV6030 | − | − |  | −/+ | − | + baz | − | −!' |  | Maize |
| RC26 | 5966 | pNOV6046 | − | + | − | + | − | − |  |  |  | Rice |
| RC26 | 5966 | pNOV6046 | − |  |  | ++ | − | +baz | − | −! |  | Maize |
| RC33 | 5968 | pNOV6044 | − | + | −/+ | + | − | − |  |  |  | Rice |
| RC33 | 5968 | pNOV6044 | − |  |  | + | − | +baz, s, p | − | −! |  | Maize |
| RF1 | 5974 | pNOV6045 | − | + | − | + | − | − |  |  |  | Rice |
| RF1 | 5974 | pNOV6045 | − |  |  | + | − | + baz | − | − |  | Maize |
| RS10 | 5977 | pNOV6034 | − |  | −/+ | −/+ | − | ++ |  |  |  | Rice |
| RS10 | 5977 | pNOV6034 | − |  |  | + | − | ++ e | − | −! | Seed specific, root background | Maize |
| RS18 | 6001 | pNOV6035 | −/+ | −/+ | −/+ | −/+ | −/+ | +/− |  |  |  | Rice |
| RS18 | 6001 | pNOV6035 | − |  |  | −/+ |  |  |  |  |  | Maize |
| RS3 | 2275 | pNOV6031 | − | −/+ | − | + | ++ | ++ |  |  |  | Rice |
| RS3 | 2275 | pNOV6031 | − |  |  | + | − | + baz | − | "−!" | Seed specific | Maize |
| RS4 | 2276 | pNOV6032 | − | −/+ | −/+ | − | −/+ | +++ |  |  |  | Rice |
| RS4 | 2276 | pNOV6032 | − |  |  | − | − | +++ ec | − | −! | Seed specific | Maize |
| RS8 | 2283 | pNOV6033 | +/− | −/+ | − | −/+ | −/+ | +++ | ++ | − |  | Rice |
| RS8 | 2283 | pNOV6033 | − |  |  | −/+ | − | ++ e, p | − | − | Seed specific | Maize |
| ZmUBIintron |  | pNOV6048 | ++ |  | +++ | ++ | ++ |  |  |  | Positive Control | Rice |
| ZmUBIintron |  | pNOV6048 | ++ |  | +++ | +++ | +++ | +++ | ++ | +++ | Positive Control | Maize |

GUS staining scores:
+ = staining observed
++ = strong staining
+++ = very strong staining
− = no staining
"−!" = some pollen grains stained, probably contamination
+/− = some lines showed staining, but not all
−/+ = staining faint or seen in only 1 or 2 lines
blank = not analyzed yet
Key:
baz—black abscission zone
s—scutellum
p—pedicel
e—endosperm or embryo
sc—seed coat
Note:
many RS seem to stain in kernel and root

Example 4

Rice Orthologs of *Arabidopsis* Tissue-Specifically Expressed Genes Identified by Reverse Genetics Understanding the function of every gene is the major challenge in the age of completely sequenced eukaryotic genomes. Sequence homology can be helpful in identifying possible functions of many genes. However, reverse genetics, the process of identifying the function of a gene by obtaining and studying the phenotype of an individual containing a mutation in that gene, is another approach to identify the function of a gene.

Reverse genetics in *Arabidopsis* has been aided by the establishment of large publicly available collections of insertion mutants (Krysan et al., (1999) Plant Cell 11, 2283-2290; Tisser et al., (1999) Plant Cell 11, 1841-1852; Speulman et al., (1999). Plant Cell 11, 1853-1866; Parinov et al., (1999). Plant Cell 11, 2263-2270; Parinov and Sundaresan, 2000; Biotechnology 11, 157-161). Mutations in genes of interest are identified by screening the population by PCR amplification using primers derived from sequences near the insert border and the gene of interest to screen through large pools of individuals. Pools producing PCR products are confirmed by Southern hybridization and further deconvoluted into sub-pools until the individual is identified (Sussman et al., (2000) Plant Physiology 124, 1465-1467).

Recently, some groups have begun the process of sequencing insertion site flanking regions from individual plants in large insertion mutant populations, in effect prescreening a subset of lines for genomic insertion sites (Parinov et al., (1999). Plant Cell 11, 2263-2270; Tisser et al., (1999). Plant Cell 11, 1841-1852). The advantage to this approach is that the laborious and time-consuming process of PCR-based screening and deconvolution of pools is avoided.

A large database of insertion site flanking sequences from approximately 100,000 T-DNA mutagenized *Arabidopsis* plants of the Columbia ecotype (GARLIC lines) is prepared. T-DNA left border sequences from individual plants are amplified using a modified thermal asymmetric interlaced-polymerase chain reaction (TAIL-PCR) protocol (Liu et al., (1995). Plant J. 8, 457-463). Left border TAIL-PCR products are sequenced and assembled into a database that associates sequence tags with each of the approximately 100,000 plants in the mutant collection. Screening the collection for insertions in genes of interest involves a simple gene name or sequence BLAST query of the insertion site flanking sequence database, and search results point to individual lines. Insertions are confirmed using PCR.

Analysis of the GARLIC insert lines suggests that there are 76,856 insertions that localize to a subset of the genome representing coding regions and promoters of 22,880 genes. Of these, 49,231 insertions lie in the promoters of over 18,572 genes, and an additional 27,625 insertions are located within the coding regions of 13,612 genes. Approximately 25,000 T-DNA left border mTAIL-PCR products (25% of the total 102,765) do not have significant matches to the subset of the genome representing promoters and coding regions, and are therefore presumed to lie in noncoding and/or repetitive regions of the genome.

The *Arabidopsis* T-DNA GARLIC insertion collection is used to investigate the roles of certain genes, which are expressed in specific plant tissues. Target genes are chosen using a variety of criteria, including public reports of mutant phenotypes, RNA profiling experiments, and sequence similarity to tissue-specific genes. Plant lines with insertions in genes of interest are then identified. Each T-DNA insertion line is represented by a seed lot collected from a plant that is hemizygous for a particular T-DNA insertion. Plants homozygous for insertions of interest are identified using a PCR assay. The seed produced by these plants is homozygous for the T-DNA insertion mutation of interest.

Homozygous mutant plants are tested for altered grain composition. The genes interrupted in these mutants contribute to the observed phenotype.

Rice orthologs of the *Arabidopsis* genes are identified by similarity searching of a rice database using the Double-Affine Smith-Waterman algorithm (BLASP with e values better than$^{-10}$).

Example 5

Cloning and Sequencing of Nucleic Acid Molecules from Rice 5.1 Genomic DNA: Plant genomic DNA samples are isolated from a collection of tissues which are listed in Table 1. Individual tissues are collected from a minimum of five plants and pooled. DNA can be isolated according to one of the three procedures, e.g., standard procedures described by Ausubel et al. (1995), a quick leaf prep described by Klimyuk et al. (1993), or using FTA paper (Life Technologies).

For the latter procedure, a piece of plant tissue such as, for example, leaf tissue is excised from the plant, placed on top of the FTA paper and covered with a small piece of parafilm that serves as a barrier material to prevent contamination of the crushing device. In order to drive the sap and cells from the plant tissue into the FTA paper matrix for effective cell lysis and nucleic acid entrapment, a crushing device is used to mash the tissue into the FTA paper. The FTA paper is air dried for an hour. For analysis of DNA, the samples can be archived on the paper until analysis. Two mm punches are removed from the specimen area on the FTA paper using a 2 mm Harris MICRO-PUNCH™ and placed into PCR tubes. Two hundred (200) microliters of FTA purification reagent is added to the tube containing the punch and vortexed at low speed for 2 seconds. The tube is then incubated at room temperature for 5 minutes. The solution is removed with a pipette so as to repeat the wash one more time. Two hundred (200) microliters of TE (10 mM Tris, 0.1 mM EDTA, pH 8.0) is added and the wash is repeated two more times. The PCR mix is added directly to the punch for subsequent PCR reactions.

5.2 Cloning of Candidate cDNA: A candidate cDNA is amplified from total RNA isolated from rice tissue after reverse transcription using primers designed against the computationally predicted cDNA. Primers designed based on the genomic sequence can be used to PCR amplify the full-length cDNA (start to stop codon) from first strand cDNA prepared from rice cultivar Nipponbare tissue.

The Qiagen RNEASY® kit (Qiagen, Hilden, Germany) is used for extraction of total RNA. The SUPERSCRIPT™ II kit (Invitrogen, Carlsbad, Calif., USA) is used for the reverse transcription reaction. PCR amplification of the candidate cDNA is carried out using the reverse primer sequence located at the translation start of the candidate gene in 5'-3' direction. This is performed with high-fidelity Taq polymerase (Invitrogen, Carlsbad, Calif., USA).

The PCR fragment is then cloned into PCR®2.1-TOPO® (Invitrogen) or the PGEM®-T easy vector (Promega Corporation, Madison, Wis., USA) per the manufacturer's instructions, and several individual clones are subjected to sequencing analysis.

5.3 DNA sequencing: DNA preps for 2-4 independent clones are miniprepped following the manufacturer's instructions (Qiagen). DNA is subjected to sequencing analysis using the BIGDYE™ Terminator Kit according to manufacturer's instructions (ABI). Sequencing makes use of primers designed to both strands of the predicted gene of interest. DNA sequencing is performed using standard dye-terminator sequencing procedures and automated sequencers (models 373 and 377; Applied Biosystems, Foster City, Calif.). All sequencing data are analyzed and assembled using the Phred/Phrap/Consed software package (University of Washington) to an error ratio equal to or less than $10^{-4}$ at the consensus sequence level.

The consensus sequence from the sequencing analysis is then to be validated as being intact and the correct gene in several ways. The coding region is checked for being full length (predicted start and stop codons present) and uninterrupted (no internal stop codons). Alignment with the gene prediction and BLAST analysis is used to ascertain that this is in fact the right gene.

The clones are sequenced to verify their correct amplification.

Example 6

Functional Analysis in Plants

A plant complementation assay can be used for the functional characterization of the tissue-specifically expressed genes according to the invention.

Rice and *Arabidopsis* putative orthologue pairs are identified using BLAST comparisons, TFASTXY comparisons, and Double-Affine Smith-Waterman similarity searches. Constructs containing a rice cDNA or genomic clone inserted between the promoter and terminator of the *Arabidopsis* orthologue are generated using overlap PCR (Gene 77, 61-68 (1989)) and GATEWAY® cloning (Life Technologies Invitrogen). For ease of cloning, rice cDNA clones are preferred to rice genomic clones. A three stage PCR strategy is used to make these constructs.

(1) In the first stage, primers are used to PCR amplify: (i) 2 Kb upstream of the translation start site of the *Arabidopsis* orthologue, (ii) the coding region or cDNA of the rice orthologue, and (iii) the 500 bp immediately downstream of the Arabidopsis orthogue's translation stop site. Primers are designed to incorporate onto their 5' ends at least 16 bases of the 3' end of the adjacent fragment, except in the case of the most distal primers which flank the gene construct (the forward primer of the promoter and the reverse primer of the terminator). The forward primer of the promoters contains on their 5' ends partial AttB1 sites, and the reverse primer of the terminators contains on their 5' ends partial AttB2 sites, for GATEWAY® cloning.

(2) In the second stage, overlap PCR is used to join either the promoter and the coding region, or the coding region and the terminator.

(3) In the third stage either the promoter-coding region product can be joined to the terminator or the coding region-terminator product can be joined to the promoter, using overlap PCR and amplification with full Att site-containing primers, to link all three fragments, and put full Att sites at the construct termini.

The fused three-fragment piece flanked by GATEWAY® cloning sites are introduced into the LTI donor vector pDONR201 using the BP clonase reaction, for confirmation by sequencing. Confirmed sequenced constructs are introduced into a binary vector containing GATEWAY® cloning sites, using the LR clonase reaction such as, for example, pAS200.

The pAS200 vector was created by inserting the GATEWAY® cloning cassette RfA into the Acc65I site of pNOV3510.

pNOV3510 was created by ligation of inverted pNOV2114 VSI binary into pNOV3507, a vector containing a PTX5' Arab Protox promoter driving the PPO gene with the Nos terminator.

pNOV2114 was created by insertion of virGN54D (Pazour et al. 1992, J. Bacteriol. 174:4169-4174) from pAD1289 (Hansen et al. 1994, PNAS 91:7603-7607) into pHiNK085.

pHiNK085 was created by deleting the 35S:PMI cassette and M13 ori in pVictorHiNK.

pPVictorHiNK was created by modifying the T-DNA of pVictor (described in WO 97/04112) to delete M13 derived sequences and to improve its cloning versatility by introducing the BIGLINK polylinker.

The sequence of the pVictor HiNK vector is disclosed in SEQ ID NO: 5 in WO 00/6837, which is incorporated herein by reference. The pVictor HiNK vector contains the following constituents that are of functional importance:

The origin of replication (ORI) functional in *Agrobacterium* is derived from the *Pseudomonas aeruginosa* plasmid pVS1 (Itoh et al. 1984. Plasmid 11: 206-220; Itoh and Haas, 1985. Gene 36: 27-36). The pVSI ORI is only functional in *Agrobacterium* and can be mobilised by the helper plasmid pRK2013 from *E. coli* into *A. tumefaciens* by means of a triparental mating procedure (Ditta et al., 1980. Proc. Natl. Acad. Sci USA 77: 7347-7351).

The ColE1 origin of replication functional in *E. coli* is derived from pUC19 (Yannisch-Perron et al., 1985. Gene 33: 103-119).

The bacterial resistance to spectinomycin and streptomycin encoded by a 0.93 kb fragment from transposon Tn7 (Fling et al., 1985. Nucl. Acids Res. 13: 7095) functions as selectable marker for maintenance of the vector in *E. coli* and *Agrobacterium* The gene is fused to the tac promoter for efficient bacterial expression (Amman et al., 1983. Gene 25: 167-178).

The right and left T-DNA border fragments of 1.9 kb and 0.9 kb that comprise the 24 bp border repeats, have been derived from the Ti-plasmid of the nopaline type *Agrobacterium tumefaciens* strains pTiT37 (Yadav et al., 1982. Proc. Natl. Acad. Sci. USA. 79: 6322-6326).

The plasmid is introduced into *Agrobacterium tumefaciens* GV3101 pMP90 by electroporation. The positive bacterial transformants are selected on LB medium containing 50 µg/µl kanamycin and 25 µg/µl gentamycin. Plants are transformed by standard methodology (e.g., by dipping flowers into a solution containing the *Agrobacterium*) except that 0.02% Silwet-77 (Lehle Seeds, Round Rock, Tex., USA) is added to the bacterial suspension and the vacuum step omitted. Five hundred (500) mg of seeds are planted per 2 ft$^2$ flat of soil and progeny seeds are selected for transformants using PPO selection.

Primary transformants are analyzed for complementation. Primary transformants are genotyped for the *Arabidopsis* mutation and presence of the transgene. When possible, >50 mutants harboring the transgene should be phenotyped to observe variation due to transgene copy number and expression.

Example 7

Vector Construction for Overexpression and Gene "Knockout" Experiments 7.1 Overexpression Vectors used for expression of full-length "candidate genes" of interest in plants (overexpression) are designed to overexpress the protein of interest and are of two general types, biolistic and binary, depending on the plant transformation method to be used.

For biolistic transformation (biolistic vectors), the requirements are as follows:

1. a backbone with a bacterial selectable marker (typically, an antibiotic resistance gene) and origin of replication functional in *Escherichia coli* (*E. coli*; eg. ColE1), and
2. a plant-specific portion consisting of:
   a. a gene expression cassette consisting of a promoter (eg. ZmUBIint MOD), the gene of interest (typically, a full-length cDNA) and a transcriptional terminator (eg. *Agrobacterium tumefaciens* nos terminator);
   b. a plant selectable marker cassette, consisting of a promoter (eg. rice Act1D-BV MOD), selectable marker gene (eg. phosphomannose isomerase, PMI) and transcriptional terminator (eg. CaMV terminator).

Vectors designed for transformation by *Agrobacterium tumefaciens* (*A. tumefaciens*; binary vectors) consist of:

1. a backbone with a bacterial selectable marker functional in both *E. coli* and *A. tumefaciens* (eg. spectinomycin resistance mediated by the aadA gene) and two origins of replication, functional in each of aforementioned bacterial hosts, plus the *A. tumefaciens* virG gene;
2. a plant-specific portion as described for biolistic vectors above, except in this instance this portion is flanked by *A. tumefaciens* right and left border sequences which mediate transfer of the DNA flanked by these two sequences to the plant.

7.2 Knockout Vectors

Vectors designed for reducing or abolishing expression of a single gene or of a family or related genes (knockout vectors) are also of two general types corresponding to the methodology used to downregulate gene expression: antisense or double-stranded RNA interference (dsRNAi).

(a) Anti-Sense

For antisense vectors, a full-length or partial gene fragment (typically, a portion of the cDNA) can be used in the same vectors described for full-length expression, as part of the gene expression cassette. For antisense-mediated down-regulation of gene expression, the coding region of the gene or gene fragment will be in the opposite orientation relative to the promoter; thus, mRNA will be made from the non-coding (antisense) strand in planta.

(b) dsRNAi

For dsRNAi vectors, a partial gene fragment (typically, 300 to 500 basepairs long) is used in the gene expression cassette, and is expressed in both the sense and antisense orientations, separated by a spacer region (typically, a plant intron, eg. the OsSH1 intron 1, or a selectable marker, eg. conferring kanamycin resistance). Vectors of this type are designed to form a double-stranded mRNA stem, resulting from the basepairing of the two complementary gene fragments in planta.

Biolistic or binary vectors designed for overexpression or knockout can vary in a number of different ways, including eg. the selectable markers used in plant and bacteria, the transcriptional terminators used in the gene expression and plant selectable marker cassettes, and the methodologies used for cloning in gene or gene fragments of interest (typically, conventional restriction enzyme-mediated or GATEWAY® recombinase-based cloning). An important variant is the nature of the gene expression cassette promoter driving expression of the gene or gene fragment of interest in most tissues of the plants (constitutive, eg. ZmUBIint MOD), in specific plant tissues (eg. maize ADP-gpp for endosperm-specific expression), or in an inducible fashion (eg. GAL4bsBz1 for estradiol-inducible expression in lines constitutively expressing the cognate transcriptional activator for this promoter).

Example 8

Insertion of a "Candidate Gene" into Expression Vector

A validated rice cDNA clone in PCR®2.1-TOPO® or the PGEM®-T easy vector is subcloned using conventional restriction enzyme-based cloning into a vector, downstream of the maize ubiquitin promoter and intron, and upstream of the *Agrobacterium tumefaciens* nos 3' end transcriptional terminator. The resultant gene expression cassette (promoter, "candidate gene" and terminator) is further subcloned, using conventional restriction enzyme-based cloning, into the pNOV2117 binary vector (Negrotto et al (2000) Plant Cell Reports 19, 798-803; plasmid pNOV117 disclosed in this article corresponds to pNOV2117 described herein), generating pNOVCAND.

The pNOVCAND binary vector is designed for transformation and over-expression of the "candidate gene" in monocots. It consists of a binary backbone containing the sequences necessary for selection and growth in *Escherichia coli* DH-5α (Invitrogen) and *Agrobacterium tumefaciens* LBA4404 (pAL4404; pSB1), including the bacterial spectinomycin antibiotic resistance aadA gene from *E. coli* transposon Tn7, origins of replication for *E. coli* (ColE1) and *A. tumefaciens* (VS1), and the *A. tumefaciens* virG gene. In addition to the binary backbone, which is identical to that of pNOV2114 described herein previously (see Example 5 above), pNOV2117 contains the T-DNA portion flanked by the right and left border sequences, and including the POSITECH™ (Syngenta) plant selectable marker (WO 94/20627) and the "candidate gene" gene expression cassette.

The POSITECH™ plant selectable marker confers resistance to mannose and in this instance consists of the maize ubiquitin promoter driving expression of the PMI (phosphomannose isomerase) gene, followed by the cauliflower mosaic virus transcriptional terminator.

Plasmid pNOV2117 is introduced into *Agrobacterium tumefaciens* LBA4404 (pAL4404; pSB1) by electroporation. Plasmid pAL4404 is a disarmed helper plasmid (Ooms et al (1982) Plasmid 7, 15-29). Plasmid pSB1 is a plasmid with a wide host range that contains a region of homology to pNOV2117 and a 15.2 kb KpnI fragment from the virulence region of pTiBo542 (Ishida et al (1996) Nat Biotechnol 14, 745-750). Introduction of plasmid pNOV2117 into *Agrobacterium* strain LBA4404 results in a co-integration of pNOV2117 and pSB1.

Alternatively, plasmid pCIB7613, which contains the hygromycin phosphotransferase (hpt) gene (Gritz and Davies, Gene 25, 179-188, 1983) as a selectable marker, may be employed for transformation.

Plasmid pCIB7613 (see WO 98/06860, incorporated herein by reference in its entirety) is selected for rice transformation. In pCIB7613, the transcription of the nucleic acid sequence coding hygromycin-phosphotransferase (HYG gene) is driven by the corn ubiquitin promoter (ZmUbi) and enhanced by corn ubiquitin intron 1. The 3'polyadenylation signal is provided by NOS 3' nontranslated region.

Other useful plasmids include pNADII002 (GAL4-ER-VP16) which contains the yeast GAL4 DNA Binding domain (Keegan et al., *Science,* 231:699 (1986)), the mammalian estrogen receptor ligand binding domain (Greene et al., *Science,* 231:1150 (1986)) and the transcriptional activation domain of the HSV VP16 protein (Triezenberg et al., 1988). Both hpt and GAL4-ER-VP16 are constitutively expressed using the maize Ubiquitin promoter, and pSGCDL1 (GAL4BS Bz1 Luciferase), which carries the firefly luciferase reporter gene under control of a minimal maize Bronze1 (Bz1) promoter with 10 upstream synthetic GAL4 binding sites. All constructs use termination signals from the nopaline synthase gene.

Example 9

Plant Transformation

Example 9.1

Rice Transformation pNOVCAND is transformed into a rice cultivar (Kaybonnet) using *Agrobacterium*-mediated transformation, and mannose-resistant calli are selected and regenerated.

*Agrobacterium* is grown on YPC solid plates for 2-3 days prior to experiment initiation. Agrobacterial colonies are suspended in liquid MS media to an OD of 0.2 at λ600 nm. Acetosyringone is added to the agrobacterial suspension to a concentration of 200 μM and agro is induced for 30 min.

Three-week-old calli which are induced from the scutellum of mature seeds in the N6 medium (Chu, C. C. et al., Sci, Sin., 18, 659-668(1975)) are incubated in the *agrobacterium* solution in a 100×25 petri plate for 30 minutes with occasional shaking. The solution is then removed with a pipet and the callus transferred to a MSAs medium which is overlayed with sterile filter paper.

Co-Cultivation is continued for 2 days in the dark at 22° C.

Calli are then placed on MS-Timetin plates for 1 week. After that they are transferred to PAA+ mannose selection media for 3 weeks.

Growing calli (putative events) are picked and transferred to PAA+ mannose media and cultivated for 2 weeks in light.

Colonies are transferred to MS20SorbKinTim regeneration media in plates for 2 weeks in light. Small plantlets are transferred to MS20SorbKinTim regeneration media in GA7 containers. When they reach the lid, they are transferred to soil in the greenhouse.

Expression of the "candidate gene" in transgenic $T_0$ plants is analyzed. Additional rice cultivars, such as but not limited to, Nipponbare, Taipei 309 and Fuzisaka 2 are also transformed and assayed for expression of the "candidate gene" product and enhanced protein expression.

Example 9.2

Maize Transformation

Transformation of immature maize embryos is performed essentially as described in Negrotto et al., (2000) Plant Cell Reports 19: 798-803. For this example, all media constituents are as described in Negrotto et al., supra. However, various media constituents described in the literature may be substituted.

9.2.1. Transformation Plasmids and Selectable Marker

The genes used for transformation are cloned into a vector suitable for maize transformation as described in Example 17. Vectors used contain the phosphomannose isomerase (PMI) gene (Negrotto et al. (2000) Plant Cell Reports 19: 798-803).

9.2.2. Preparation of *Agrobacterium tumefaciens*

*Agrobacterium* strain LBA4404 (pSB1) containing the plant transformation plasmid is grown on YEP (yeast extract (5 g/L), peptone (10 g/L), NaCl (5 g/L), 15 g/l agar, pH 6.8) solid medium for 2 to 4 days at 28° C. Approximately $0.8 \times 10^9$ *Agrobacteria* are suspended in LS-inf media supplemented with 100 μM acetosyringone (As) (Negrotto et al., (2000) Plant Cell Rep 19: 798-803). Bacteria are pre-induced in this medium for 30-60 minutes.

9.2.3. Inoculation

Immature embryos from A188 or other suitable maize genotypes are excised from 8-12 day old ears into liquid LS-inf+100 μM As. Embryos are rinsed once with fresh infection medium. *Agrobacterium* solution is then added and embryos are vortexed for 30 seconds and allowed to settle with the bacteria for 5 minutes. The embryos are then transferred scutellum side up to LSAs medium and cultured in the dark for two to three days. Subsequently, between 20 and 25 embryos per petri plate are transferred to LSDc medium supplemented with cefotaxime (250 mg/l) and silver nitrate (1.6 mg/l) and cultured in the dark for 28° C. for 10 days.

9.2.4. Selection of Transformed Cells and Regeneration of Transformed Plants

Immature embryos producing embryogenic callus are transferred to LSD1M0.5S medium. The cultures are selected on this medium for 6 weeks with a subculture step at 3 weeks. Surviving calli are transferred either to LSD1M0.5S medium to be bulked-up or to Reg1 medium. Following culturing in the light (16 hour light/8 hour dark regiment), green tissues are then transferred to Reg2 medium without growth regulators and incubated for 1-2 weeks. Plantlets are transferred to Magenta GA-7 boxes (Magenta Corp, Chicago, Ill., USA) containing Reg3 medium and grown in the light. Plants that are PCR positive for the promoter-reporter cassette are transferred to soil and grown in the greenhouse.

Example 10

Chromosomal Markers to Identify the Location of a Nucleic Acid Sequence

The sequences of the present invention can also be used for SSR mapping. SSR mapping in rice has been described by Miyao et al. (*DNA Res* 3:233 (1996)) and Yang et al. (*Mol Gen Genet* 245:187 (1994)), and in maize by Ahn et al. (*Mol Gen Genet* 241:483 (1993)). SSR mapping can be achieved using various methods. In one instance, polymorphisms are identified when sequence specific probes flanking an SSR contained within a sequence are made and used in polymerase chain reaction (PCR) assays with template DNA from two or more individuals or, in plants, near isogenic lines. A change in the number of tandem repeats between the SSR-flanking sequence produces differently sized fragments (U.S. Pat. No. 5,766,847). Alternatively, polymorphisms can be identified by using the PCR fragment produced from the SSR-flanking sequence specific primer reaction as a probe against Southern blots representing different individuals (Refseth et al., *Electrophoresis* 18:1519 (1997)). Rice SSRs can be used to map a molecular marker closely linked to functional gene, as described by Akagi et al. (*Genome* 39:205 (1996)).

The sequences of the present invention can be used to identify and develop a variety of microsatellite markers, including the SSRs described above, as genetic markers for comparative analysis and mapping of genomes.

Many of the polynucleotides listed in Tables 2 to 11 contain at least 3 consecutive di-, tri- or tetranucleotide repeat units in their coding region that can potentially be developed into SSR markers. Trinucleotide motifs that can be commonly found in the coding regions of said polynucleotides and easily identified by screening the polynucleotides sequences for said motifs are, for example: CGG; GCC, CGC, GGC, etc. Once such a repeat unit has been found, primers can be designed which are complementary to the region flanking the repeat unit and used in any of the methods described below.

Sequences of the present invention can also be used in a variation of the SSR technique known as inter-SSR (ISSR), which uses microsatellite oligonucleotides as primers to amplify genomic segments different from the repeat region itself (Zietkiewicz et al., *Genomics* 20:176 (1994)). ISSR employs oligonucleotides based on a simple sequence repeat anchored or not at their 5'- or 3'-end by two to four arbitrarily chosen nucleotides, which triggers site-specific annealing and initiates PCR amplification of genomic segments which are flanked by inversely orientated and closely spaced repeat sequences. In one embodiment of the present invention, microsatellite markers as disclosed herein, or substantially similar sequences or allelic variants thereof, may be used to detect the appearance or disappearance of markers indicating genomic instability as described by Leroy et al. (*Electron. J Biotechnol*, 3(2), (2000), available at the website of the Electronic Journal of Biotechnology), where alteration of a fingerprinting pattern indicated loss of a marker corresponding to a part of a gene involved in the regulation of cell proliferation. Microsatellite markers are useful for detecting genomic alterations such as the change observed by Leroy et al. (*Electron. J Biotechnol*, 3(2), supra (2000)) which appeared to be the consequence of microsatellite instability at the primer binding site or modification of the region between the microsatellites, and illustrated somaclonal variation leading to genomic instability. Consequently, sequences of the present invention are useful for detecting genomic alterations involved in somaclonal variation, which is an important source of new phenotypes.

In addition, because the genomes of closely related species are largely syntenic (that is, they display the same ordering of genes within the genome), these maps can be used to isolate novel alleles from wild relatives of crop species by positional cloning strategies. This shared synteny is very powerful for using genetic maps from one species to map genes in another. For example, a gene mapped in rice provides information for the gene location in maize and wheat.

Example 11

Quantitative Trait Linked Breeding

Various types of maps can be used with the sequences of the invention to identify Quantitative Trait Loci (QTLs) for a variety of uses, including marker-assisted breeding. Many important crop traits are quantitative traits and result from the combined interactions of several genes. These genes reside at different loci in the genome, often on different chromosomes, and generally exhibit multiple alleles at each locus. Developing markers, tools, and methods to identify and isolate the QTLs involved in a trait, enables marker-assisted breeding to enhance desirable traits or suppress undesirable traits. The sequences disclosed herein can be used as markers for QTLs to assist marker-assisted breeding. The sequences of the invention can be used to identify QTLs and isolate alleles as described by Li et al. in a study of QTLs involved in resistance to a pathogen of rice. (Li et al., *Mol Gen Genet* 261:58 (1999)). In addition to isolating QTL alleles in rice, other cereals, and other monocot and dicot crop species, the sequences of the invention can also be used to isolate alleles from the corresponding QTL(s) of wild relatives. Transgenic plants having various combinations of QTL alleles can then be created and the effects of the combinations measured. Once an ideal allele combination has been identified, crop improvement can be accomplished either through biotechnological means or by directed conventional breeding programs. (Flowers et al., *J Exp Bot* 51:99 (2000); Tanksley and McCouch, *Science* 277:1063 (1997)).

Example 12

Marker-Assisted Breeding

Markers or genes associated with specific desirable or undesirable traits are known and used in marker assisted breeding programs. It is particularly beneficial to be able to screen large numbers of markers and large numbers of candidate parental plants or progeny plants. The methods of the invention allow high volume, multiplex screening for numerous markers from numerous individuals simultaneously.

Markers or genes associated with specific desirable or undesirable traits are known and used in marker assisted breeding programs. It is particularly beneficial to be able to screen large numbers of markers and large numbers of candidate parental plants or progeny plants. The methods of the invention allow high volume, multiplex screening for numerous markers from numerous individuals simultaneously.

A multiplex assay is designed providing SSRs specific to each of the markers of interest. The SSRs are linked to different classes of beads. All of the relevant markers may be expressed genes, so RNA or cDNA techniques are appropriate. RNA is extracted from root tissue of 1000 different individual plants and hybridized in parallel reactions with the different classes of beads. Each class of beads is analyzed for each sample using a microfluidics analyzer. For the classes of beads corresponding to qualitative traits, qualitative measures of presence or absence of the target gene are recorded. For the classes of beads corresponding to quantitative traits, quantitative measures of gene activity are recorded. Individuals showing activity of all of the qualitative genes and highest expression levels of the quantitative traits are selected for further breeding steps. In procedures wherein no individuals have desirable results for all the measured genes, individuals having the most desirable, and fewest undesirable, results are selected for further breeding steps. In either case, progeny are screened to further select for homozygotes with high quantitative levels of expression of the quantitative traits.

Example 13

Method of Modifying the Gene Frequency

The invention further provides a method of modifying the frequency of a gene in a plant population, including the steps of: identifying an SSR within a coding region of a gene; screening a plurality of plants using the SSR as a marker to determine the presence or absence of the gene in an individual plant; selecting at least one individual plant for breeding based on the presence or absence of the gene; and breeding at least one plant thus selected to produce a population of plants having a modified frequency of the gene. The identification of the SSR within the coding region of a gene can be accomplished based on sequence similarity between the nucleic acid molecules of the invention and the region within the gene of interest flanking the SSR.

Example 14

Testing of Rice Promoters in Plants

The promoters of Table 13 were cloned from an entry vector using the GATEWAY® system into the pNOV2346 vector pNOV2346 had the promoter of interest controlling the GUS gene and ZmUBI controlling the PMI gene with a NOS terminator. All constructs were submitted to CC and then transformed into rice or maize. Most were only transformed in maize. 10 to 15 single copy events were chosen for T0 analysis. All tissue types were sampled for two assays. For rice; leaf, root, flower and seed. For maize; leaf, root, husk, silk, tassel, stem, pollen and kernel. The first assay was GUS histochemical staining. The tissues were put into a solution containing 1 mM X-Gluc overnight at 37° C. The tissues were scored based on staining results. Most often a GUS fluorometric assay was done on the tissues to quantify the GUS expression. After the assays were done, pictures were taken of all the tissues. The pictures and the GUS fluorometric assay results were uploaded to the promoters database.

In addition, T1 analysis was done on some constructs in maize. 10-15 homozygous plants were chosen and the same assays were performed according to the following protocols.

GUS Staining Protocol

1. Sample tissue into well of tissue culture plate.
2. Add 50 µL of Silwett L-77 to 500 mL of GUS stain (pH 7.5 for Arab, pH 8.0 for rice and maize).
3. Add GUS stain to the wells until the tissue is covered.
4. Incubate at 37 degrees Celsius for 48 hours, 1.5 hr for rice and maize seed.
5. Destain in 70% EtOH, change everyday if needed.

GUS Fluorometric Assay Protocol

Solution preparations:
1. Prepare Extraction Buffer—EB (Recipe 1) in advance in large volumes and store at +4° C.

2. Prepare Assay Buffer (Recipe 2) in EB in large volumes and store at −80° C. up to 6 months in the dark (wrap tubes in foil or tape).
   Important! Do not thaw and refreeze repeatedly as this will lead to loss of activity.
3. Prepare Stop (2% Na$_2$CO$_3$) Solution (Recipe 3) in large volume and store at room temperature
4. Prepare 1 mM 4-MU Storage Stock and 10 μM 4-MU Working Stock (Recipe 4)
5. Prepare 24× standards of BSA in Extraction buffer (Recipe 6) and keep at +4° C.

Tissue harvest:
Organ and tissue harvest may vary with each organ, tissue type.
1. Harvest appropriate amount of tissue into 96 well block with metal beads
2. Following harvest tissue may be processed immediately or deep freezed on dry ice or in liquid N$_2$ and stored at −80° C. until processing.

Extraction:
1. Grind tissue in bead beater, Kleco or SawsAll for 2 min
2. Freeze block on dry ice or liquid nitrogen o/n
3. That block and repeat grinding as in step 1
4. Add 250 μl of chilled GUS EB
   You will need a minimum of 200 μl for each sample, but will usually use 0.3-1.0 ml/sample. Adjust volume according to amount of tissue being ground. Try to use the least amount of buffer that is possible to prevent diluting activity below limits of detection.
5. Following tissue grinding, clear extracts by centrifuging blocks for 10 min at +4° C. at 4000 RPM (EPPENDORF® 5810 R).
6. Remove supernatant into a fresh 96 well block, keep supernatant (plant extract) on ice at all times
7. Following extraction samples can be either:
   for long term storage: frozen in liquid nitrogen and stored at −80° C. up to 6 months
   or for a short term storage: can be stored at +4° C. up to 1 week prior to carrying out assays
   Warning! Do no keep your extracts frozen at −20° C. as this will kill enzymatic activity in your extracts MUG Assay
1. Thaw appropriate number of tubes with Assay buffer (see Recipe 2). One tube is usually enough for one 96 well plate.
2. Prepare assay plates by adding 250 μl of Assay Buffer in the same # of wells as samples and pre-warm the assay plates at +37° C. for at least 30 min
3. Prepare Stop 96 well black, clear flat bottom Plates (greiner bio-one stock 655096) by adding 270 μl Stop Solution (2% Na$_2$CO$_3$) leaving the last 12th column empty for the 4-MU standard (added later)
   Important! It is recommended that separate Stop Plates should be used for each individual time point (required for easier transfer of data from the plate reader to the MUG and BCA Macro)
4. Add 50 μl of extracts to pre-warmed assay plates (this is the incubation mix)

For high expressing promoters:
5. Immediately after adding extracts to the Assay block remove 30 μl of the Incubation mix and add to the Stop plate (this is your 0 min time point)
6. Begin timing incubation as soon as extract is added to the assay buffer and remove 30 μl of samples to stop plates at 15 min, 30 min and 60 min time points For low and medium expressing promoters:
7. As soon as extracts were added to Assay Blocks start pre-Incubation period for 30 min at +37° C.
8. Following 30 min pre-incubation time remove 30 μl of incubation mix to stop buffer at 0 min, 30 min and 60 min time points Measure Fluorescence on Plate Reader
9 Make 4-MU standards 0, 50, 100, 250, 500, 1000, 1500, 2000 pmol MU diluted in 2% Na$_2$CO$_3$ (Recipe 5) and place standards in the last 12th column in each assay plate
10. Measure activity on Tecan Spectrafluor Plus with 360 nm excitation and 465 nm emission (readings done with 3 flashes and gain optimized to give measurable readings for all samples—typically 40-60)
    Activity can be read immediately (preferred) or hold samples overnight at room temperature and measure activity the following day.
11. Transfer readings into MUG1 etc sheets of MUG and BCA Macro for Gus Activity calculations BCA Assays:
12. Prepare 1 to 2 dilution plates for roots:
    Alternatively, 25 μl of undiluted extract can be used for the BCA
    Add 50 μl of extract in new 96 well plate and mix with 50 μl of water
    Add 50 μl of 2×BSA Standards in the last 12th column of the same plate and add 50 μl of water
13. Prepare 1 to 12 dilution plates for all other tissues:
    Remove 40 μl of 1:2 dilutions of extracts and BSA Standards and add 200 μl of water
14. Prepare BCA-Assay plates;
    Add 25 μl of appropriate dilutions into 96 well clear flat bottom plates (greiner bio-one stock 655101), last column is filled with appropriate dilutions of BSA standards with the final concentrations of 0, 25, 50. 75, 100, 150, 200, 250 μg/ml
    Add 100 μl of BCA reagent (Recipe 7)
15. Incubate BCA-Assay plates at +37° C. for 30 min
16. Cool down BCA-Assay plates at room temperature for 10 min
17. Read samples immediately on Tecan Spectrafluor Plus with 560 nm Absorbance filter
18. Transfer readings into BCA1 sheet of MUG and BCA Macro for Gus Activity calculations Recipe 1: GUS Extraction Buffer-EB 50 mM NaPO4 pH 7.0; 1 mMDDT; 10 mM EDTA; 0.1% Sarcosyl; 0.1% Triton

| Stock: | For 100 ml | For 500 ml | For 1000 ml |
| --- | --- | --- | --- |
| 1M NaPO4 pH 7.0 | 5.0 ml | 25.0 ml | 50 ml |
| 1M DTT in H2O | 0.1 ml | 0.5 ml | 1 ml |
| 0.5M Na2ESTA | 2 ml | 10 ml | 20 ml |
| 20% Sarcosyl | 0.5 ml | 2.5 ml | 5 ml |
| 10% Triton | 1.0 ml | 5.0 ml | 10 ml |
| Dd H2O | 91.4 ml | 457 ml | 914 ml |

Recipe 2: Assay Buffer

Prepare Assay buffer by dissolving appropriate amount of 4-Methylumbelliferyl β-D-Glucuronide (Sigma M-9130) in appropriate amount of EB. Generally, make large volume of assay buffer. Aliquot 25 ml, 15 ml or smaller volume in new 15, 30 or 50 ml or any other tube, wrap them in foil or tape and freeze immediately. If kept frozen at −80° C. and not thawed and re-freezed the substrate is stable for several months (up to 6 months). Typically the left over unused assay buffer from one tube is discarded.

| Compound | For 50 ml EB | For 100 ml EB | For 200 ml EB | For 300 ml EB | For 500 ml EB |
|---|---|---|---|---|---|
| 4-Methylumbelliferyl β-D-Glucuronide | 17.62 mg | 35.23 mg | 70.46 mg | 105.69 mg | 176.15 mg |

| Assay Buffer Aliquot | Number of samples |
|---|---|
| 1.5 ml | 6 |
| 5 ml | 20 |
| 10 ml | 40 |
| 15 ml | 60 |
| 25 ml | 84 (1 block) |
| 50 ml | 168 (2 blocks) |

Recipe 3: Stop Solution-2% $Na_2CO_3$

Dissolve appropriate amount of $Na_2CO_3$ in water

| Compound | For 100 ml | For 1 L | For 2 L | For 5 L |
|---|---|---|---|---|
| $Na_2CO_3$ | 2 g | 20 g | 40 g | 100 g |

Recipe 4: Storage 1 mM 4-MU Stock and Working 10 μM 4-MU Stock

Dissolve appropriate amount of 4-Methylumbelliferone (□) (Fluka 69580) in water. This Storage Stock solution can be stored at +4° C. in the dark (wrap container in foil) up to 3 months

| Compound | For 10 ml | For 50 ml | For 100 ml |
|---|---|---|---|
| 4-Methylumbelliferone (□) | 1.94 mg | 9.7 mg | 19.4 mg |

To make a Working 10 μM 4-MU Stock (10000 nmol/ml or 1000 pmoles/100 μl) dilute the appropriate amount of 1 mM 4-MU stock in 2% $Na_2CO_3$. This solution can be stored at +4° C. in the dark (wrap container in foil) no longer than 1 month.

| Solution | For 10 ml | For 15 ml | For 30 ml |
|---|---|---|---|
| 4-Methylumbellifeone (□) | 100 μl | 150 μl | 300 μl |

Recipe 5: 4-MU Standard Curve Preparation
1. Make samples for standard curve by mixing appropriate amount of 10 μM 4-MU Working Stock with the appropriate amount of Stop buffer. Total volume for each dilution should be 300 μl

| pmol 4-MU | Volume of 10 μM 4-MU working stock | Volume of 2% $Na_2CO_3$ |
|---|---|---|
| 0 | 0 μl | 300 μl |
| 50 | 5 μl | 295 μl |
| 100 | 10 μl | 290 μl |
| 250 | 25 μl | 275 μl |
| 500 | 50 μl | 250 μl |
| 1000 | 100 μl | 200 μl |
| 1500 | 150 μl | 150 μl |
| 2000 | 200 μl | 100 μl |

Recipe 6: 24×BSA Solutions in Extraction Buffer

Dissolve an appropriate amount of BSA (Pierce or Sigma) in appropriate volume of extraction buffer. The stocks can be stored at +4° C.

| 24X Stock Concentration μg/ml | Amount of BSA for 10 ml | Amount of BSA for 15 ml | Amount of BSA for 30 ml |
|---|---|---|---|
| 0 | 0 mg | 0 mg | 0 mg |
| 600 | 6 mg | 9 mg | 18 mg |
| 1200 | 12 mg | 18 mg | 36 mg |
| 1800 | 18 mg | 27 mg | 54 mg |
| 2400 | 24 mg | 36 mg | 72 mg |
| 3600 | 36 mg | 54 mg | 108 mg |
| 4800 | 48 mg | 72 mg | 144 mg |
| 6000 | 60 mg | 90 mg | 180 mg |

Recipe 7: BOA Reagent

Add 1 ml of BSA Protein Assay Reagent B (Pierce #23224) into 50 ml of BCA Protein Assay reagent A (Pierce #23221), mix well Result showed that RA1 was a low-expressing promoter, as was RC17. RC22 was pollen and kernel preferred with low expression in roots. RC9 was a low constitutive expresser. REM13-1573 showed embryo-preferred expression, as did REM7. REN5 showed endosperm-specific expression, and RGT1 showed green tissue-preferred expression. RR1 proved to be a root-preferred expresser, as did RR2. RS13 showed seed-preferred expression, as did RS15. RS25, RS26, and RS3 were very low expressing promoters. RS4 was found to be a strong endosperm-preferred promoter with some residual activity in root stem and husk. RS5 was seed-preferred, and RS6 showed strong expression in roots. RS8 showed endosperm-preferred expression, with some residual activity in root and tassels/flowers. RT16 and RT27 are transcription factors.

Lengthy table referenced here

US07550578-20090623-T00001

Please refer to the end of the specification for access instructions.

Lengthy table referenced here

US07550578-20090623-T00002

Please refer to the end of the specification for access instructions.

Lengthy table referenced here

US07550578-20090623-T00003

Please refer to the end of the specification for access instructions.

Lengthy table referenced here

US07550578-20090623-T00004

Please refer to the end of the specification for access instructions.

Lengthy table referenced here

US07550578-20090623-T00005

Please refer to the end of the specification for access instructions.

Lengthy table referenced here

US07550578-20090623-T00006

Please refer to the end of the specification for access instructions.

Lengthy table referenced here

US07550578-20090623-T00007

Please refer to the end of the specification for access instructions.

Lengthy table referenced here

US07550578-20090623-T00008

Please refer to the end of the specification for access instructions.

Lengthy table referenced here

US07550578-20090623-T00009

Please refer to the end of the specification for access instructions.

Lengthy table referenced here

US07550578-20090623-T00010

Please refer to the end of the specification for access instructions.

Table 11: Swiss-Prot Data

Seq ID: 1; Accession: P27322; Swissprot_id: HS72_LYCES; Gi_number: 123620; Description: HEAT SHOCK COGNATE 70 KD PROTEIN 2;

Seq ID: 2; Accession: P28968; Swissprot_id: VGLX_HS-VEB; Gi_number: 138350; Description: GLYCOPROTEIN X PRECURSOR;

Seq ID: 3; Accession: Q9ZRR5; Swissprot_id: TBA3_HORVU; Gi_number: 8928432; Description: Tubulin alpha-3 chain;

Seq ID: 4; Accession: P03993; Swissprot_id: UBIQ_SOYBN; Gi_number: 136673; Description: UBIQUITIN;

Seq ID: 5; Accession: O64937; Swissprot_id: EF1A_ORYSA; Gi_number: 6015059; Description: ELONGATION FACTOR 1-ALPHA (EF-1-ALPHA);

Seq ID: 6; Accession: P13983; Swissprot_id: EXTN_TOBAC; Gi_number: 119714; Description: Extensin precursor (Cell wall hydroxyproline-rich glycoprotein);

Seq ID: 7; Accession: O00555; Swissprot_id: CCAA_HUMAN; Gi_number: 6166047; Description: VOLTAGE-DEPENDENT P/Q-TYPE CALCIUM CHANNEL ALPHA-1A SUBUNIT (CALCIUM CHANNEL, L TYPE, ALPHA-1 POLYPEPTIDE ISOFORM 4) (BRAIN CALCIUM CHANNEL I) (BI);

Seq ID: 8; Accession: Q99583; Swissprot_id: MNT_HUMAN; Gi_number: 3914034; Description: MAX binding protein MNT (ROX protein) (MYC antagonist MNT);

Seq ID: 9; Accession: P35681; Swissprot_id: TCTP_ORYSA; Gi_number: 549063; Description: TRANSLATIONALLY CONTROLLED TUMOR PROTEIN HOMOLOG (TCTP);

Seq ID: 10; Accession: P49311; Swissprot_id: GRP2_SINAL; Gi_number: 1346181; Description: Glycine-rich RNA-binding protein GRP2A;

Seq ID: 11; Accession: P54258; Swissprot_id: DRPL_RAT; Gi_number: 1706520; Description: ATROPHIN-1 (DENTATORUBRAL-PALLIDOLUYSLKN ATROPHY PROTEIN);

Seq ID: 13; Accession: P02308; Swissprot_id: H4_WHEAT; Gi_number: 122106; Description: HISTONE H4;

Seq ID: 14; Accession: P57078; Swissprot_id: ANR3_HUMAN; Gi_number: 10719883; Description: Serine/threonine-protein kinase ANKRD3 (Ankyrin repeat domain protein 3) (PKC-delta-interacting protein kinase);

Seq ID: 15; Accession: P04050; Swissprot_id: RPB1_YEAST; Gi_number: 2507347; Description: DNA-DIRECTED RNA POLYMERASE II LARGEST SUBUNIT (B220);

Seq ID: 16; Accession: Q06666; Swissprot_id: T2_MOUSE; Gi_number: 730888; Description: OCTAPEPTIDE-REPEAT PROTEIN T2;

Seq ID: 17; Accession: Q9QX66; Swissprot_id: REQN_MOUSE; Gi_number: 13431818; Description: ZINC-FINGER PROTEIN NEURO-D4;

Seq ID: 18; Accession: Q02817; Swissprot_id: MUC2_HUMAN; Gi_number: 2506877; Description: MUCIN 2 PRECURSOR (INTESTINAL MUCIN 2);

Seq ID: 19; Accession: P12978; Swissprot_id: EBN2_EBV; Gi_number: 119111; Description: EBNA-2 NUCLEAR PROTEIN;

Seq ID: 20; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 21; Accession: P21997; Swissprot_id: SSG-P_VOLCA; Gi_number: 134920; Description: SULFATED SURFACE GLYCOPROTEIN 185 (SSG 185);

Seq ID: 22; Accession: Q9NZM4; Swissprot_id: GSR1_HUMAN; Gi_number: 18203330; Description: Glioma tumor suppressor candidate region gene 1 protein;

Seq ID: 23; Accession: P48608; Swissprot_id: DIA_DROME; Gi_number: 13124711; Description: DIAPHANOUS PROTEIN;

Seq ID: 24; Accession: P27484; Swissprot_id: GRP2_NICSY; Gi_number: 121631; Description: Glycine-rich protein 2;

Seq ID: 25; Accession: P31924; Swissprot_id: SUS2_ORYSA; Gi_number: 401140; Description: Sucrose synthase 2 (Sucrose-UDP glucosyltransferase 2);

Seq ID: 26; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 27; Accession: P54774; Swissprot_id: CC48_SOYBN; Gi_number: 1705678; Description: CELL DIVISION CYCLE PROTEIN 48 HOMOLOG (VALOSIN CONTAINING PROTEIN HOMOLOG) (VCP);

Seq ID: 28; Accession: P33126; Swissprot_id: HS82_ORYSA; Gi_number: 417154; Description: HEAT SHOCK PROTEIN 82;

Seq ID: 29; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 30; Accession: P28968; Swissprot_id: VGLX_HSVEB; Gi_number: 138350; Description: GLYCOPROTEIN X PRECURSOR;

Seq ID: 31; Accession: P14641; Swissprot_id: TBA2_MAIZE; Gi_number: 135411; Description: Tubulin alpha-2 chain (Alpha-2 tubulin);

Seq ID: 32; Accession: P51968; Swissprot_id: RO31_XENLA; Gi_number: 1710625; Description: Heterogeneous nuclear ribonucleoprotein A3 homolog 1 (hnRNP A3(A));

Seq ID: 33; Accession: P25439; Swissprot_id: BRM_DROME; Gi_number: 115132; Description: HOMEOTIC GENE REGULATOR (BRAHMA PROTEIN);

Seq ID: 34; Accession: P14328; Swissprot_id: SP96_DICDI; Gi_number: 134780; Description: SPORE COAT PROTEIN SP96;

Seq ID: 35; Accession: Q02817; Swissprot_id: MUC2_HUMAN; Gi_number: 2506877; Description: MUCIN 2 PRECURSOR (INTESTINAL MUCIN 2);

Seq ID: 36; Accession: P03211; Swissprot_id: EBN1_EBV; Gi_number: 119110; Description: EBNA-I NUCLEAR PROTEIN;

Seq ID: 37; Accession: O23755; Swissprot_id: EF2_BETVU; Gi_number: 6015065; Description: ELONGATION FACTOR 2 (EF-2);

Seq ID: 38; Accession: P25862; Swissprot_id: TBB1_AVESA; Gi_number: 135444; Description: TUBULIN BETA-1 CHAIN;

Seq ID: 39; Accession: P06876; Swissprot_id: MYB_MOUSE; Gi_number: 127594; Description: MYB PROTO-ONCOGENE PROTEIN (C-MYB);

Seq ID: 40; Accession: Q06666; Swissprot_id: T2_MOUSE; Gi_number: 730888; Description: OCTAPEPTIDE-REPEAT PROTEIN T2;

Seq ID: 41; Accession: P03211; Swissprot_id: EBN1_EBV; Gi_number: 119110; Description: EBNA-1 NUCLEAR PROTEIN;

Seq ID: 42; Accession: Q43247; Swissprot_id: G3PE_MAIZE; Gi_number: 6166167; Description: Glyceraldehyde 3-phosphate dehydrogenase, cytosolic 3;

Seq ID: 43; Accession: Q40649; Swissprot_id: R103_ORYSA; Gi_number: 2500353; Description: 60S RIBOSOMAL PROTEIN L10-3 (QM/R22);

Seq ID: 44; Accession: Q9LQZ7; Swissprot_id: COL6_ARATH; Gi_number: 17433066; Description: Zinc finger protein constants-like 6;

Seq ID: 45; Accession: P39858; Swissprot_id: CAP1_STAAU; Gi_number: 729026; Description: CAPI PROTEIN;

Seq ID: 46; Accession: P80299; Swissprot_id: HYES_RAT; Gi_number: 462371; Description: SOLUBLE EPOXIDE HYDROLASE (SEH) (EPOXIDE HYDRATASE) (CYTOSOLIC EPOXIDE HYDROLASE) (CEH);

Seq ID: 47; Accession: O13759; Swissprot_id: CSX1_SCHPO; Gi_number: 3121946; Description: RNA-BINDING POST-TRANSCRIPTIONAL REGULATOR CSX1;

Seq ID: 48; Accession: O43516; Swissprot_id: WAIP_HUMAN; Gi_number: 13124642; Description: WISKOTT-ALDRICH SYNDROME PROTEIN INTERACTING PROTEIN (WASP INTERACTING PROTEIN) (PRPL-2 PROTEIN);

Seq ID: 49; Accession: P25096; Swissprot_id: P21_SOYBN; Gi_number: 129320; Description: P21 PROTEIN;

Seq ID: 50; Accession: P49688; Swissprot_id: RS2_ARATH; Gi_number: 3915847; Description: 40S RIBOSOMAL PROTEIN S2;

Seq ID: 51; Accession: P33278; Swissprot_id: SUI1_ORYSA; Gi_number: 462195; Description: PROTEIN TRANSLATION FACTOR SUI1 HOMOLOG (GOS2 PROTEIN);

Seq ID: 52; Accession: Q99583; Swissprot_id: MNT_HUMAN; Gi_number: 3914034; Description: MAX binding protein MNT (ROX protein) (MYC antagonist MNT);

Seq ID: 53; Accession: P46602; Swissprot_id: HAT3_ARATH; Gi_number: 12644275; Description: Homeobox-leucine zipper protein HAT3 (HD-ZIP protein 3);

Seq ID: 54; Accession: P21997; Swissprot_id: SSG-P_VOLCA; Gi_number: 134920; Description: SULFATED SURFACE GLYCOPROTEIN 185 (SSG 185);

Seq ID: 55; Accession: P13983; Swissprot_id: EXTN_TOBAC; Gi_number: 119714; Description: Extensin precursor (Cell wall hydroxyproline-rich glycoprotein);

Seq ID: 56; Accession: Q9SW70; Swissprot_id: SRP_VITRI; Gi_number: 15214303; Description: Stress-related protein;

Seq ID: 57; Accession: P53039; Swissprot_id: YIPA_YEAST; Gi_number: 1724030; Description: YIP1 PROTEIN;

Seq ID: 58; Accession: O22540; Swissprot_id: RL11_ORYSA; Gi_number: 6093997; Description: 60S RIBOSOMAL PROTEIN L11;

Seq ID: 59; Accession: Q03211; Swissprot_id: EXLP_TOBAC; Gi_number: 544262; Description: PISTL-SPECIFIC EXTENSIN-LIKE PROTEIN PRECURSOR (PELP);

Seq ID: 60; Accession: P05203; Swissprot_id: H3_MAIZE; Gi_number: 122085; Description: HISTONE H3;

Seq ID: 61; Accession: P29314; Swissprot_id: RS9_RAT; Gi_number: 1173286; Description: 40S RIBOSOMAL PROTEIN S9;

Seq ID: 62; Accession: P06599; Swissprot_id: EXTN_DAUCA; Gi_number: 119711; Description: EXTENSIN PRECURSOR;

Seq ID: 63; Accession: P37705; Swissprot_id: GRP3_DAUCA; Gi_number: 585217; Description: GLYCINE RICH PROTEIN A3;

Seq ID: 64; Accession: Q99091; Swissprot_id: CPR3_PETCR; Gi_number: 1169084; Description: LIGHT-INDUCIBLE PROTEIN CPRF-3;

Seq ID: 65; Accession: P13983; Swissprot_id: EXTN_TOBAC; Gi_number: 119714; Description: Extensin precursor (Cell wall hydroxyproline-rich glycoprotein);

Seq ID: 66; Accession: P18566; Swissprot_id: RBS2_ORYSA; Gi_number: 132096; Description: Ribulose bisphosphate carboxylase small chain A, chloroplast precursor (RuBisCO small subunit A);

Seq ID: 67; Accession: P03211; Swissprot_id: EBN1_EBV; Gi_number: 119110; Description: EBNA-1 NUCLEAR PROTEIN;

Seq ID: 69; Accession: P23246; Swissprot_id: SFPQ_HUMAN; Gi_number: 1709851; Description: SPLICING FACTOR, PROLINE-AND GLUTAMINE-RICH (POLYPYRIMIDINE TRACT-BINDING PROTEIN-ASSOCIATED SPLICING FACTOR) (PTB-ASSOCIATED SPLICING FACTOR) (PSF) (DNA-BINDING P52/P100 COMPLEX, 100 KDA SUBUNIT);

Seq ID: 71; Accession: P22277; Swissprot_id: R27A_HORVU; Gi_number: 133898; Description: 40S RIBOSOMAL PROTEIN S27A;

Seq ID: 72; Accession: Q9SS17; Swissprot_id: RS24_ARATH; Gi_number: 11134742; Description: 40S ribosomal protein S24;

Seq ID: 73; Accession: P03993; Swissprot_id: UBIQ_SOYBN; Gi_number: 136673; Description: UBIQUITIN;

Seq ID: 74; Accession: P24068; Swissprot_id: OCS1_MAIZE; Gi_number: 1352613; Description: OCS-ELEMENT BINDING FACTOR 1 (OCSBF-1);

Seq ID: 75; Accession: P05203; Swissprot_id: H3_MAIZE; Gi_number: 122085; Description: HISTONE H3;

Seq ID: 76; Accession: P49637; Swissprot_id: RL2A_ARATH; Gi_number: 1710530; Description: 60S ribosomal protein L27A;

Seq ID: 77; Accession: P46297; Swissprot_id: RS23_FRAAN; Gi_number: 1173187; Description: 40S RIBOSOMAL PROTEIN S23 (S12);

Seq ID: 78; Accession: P46297; Swissprot_id: RS23_FRAAN; Gi_number: 1173187; Description: 40S RIBOSOMAL PROTEIN S23 (S12);

Seq ID: 79; Accession: P93329; Swissprot_id: NO20_MEDTR; Gi_number: 3914142; Description: EARLY NODULIN 20 PRECURSOR (N-20);

Seq ID: 80; Accession: P49216; Swissprot_id: RS26_ORYSA; Gi_number: 1350969; Description: 40S RIBOSOMAL PROTEIN S26 (S31);

Seq ID: 81; Accession: P03211; Swissprot_id: EBN1_EBV; Gi_number: 119110; Description: EBNA-1 NUCLEAR PROTEIN;

Seq ID: 82; Accession: O48557; Swissprot_id: RL17_MAIZE; Gi_number: 3914685; Description: 60S RIBOSOMAL PROTEIN L17;

Seq ID: 83; Accession: Q24523; Swissprot_id: BUN2_DROME; Gi_number: 17366491; Description: Bunched protein, class 2/class 3 isoforms (Shortsighted protein);

Seq ID: 84; Accession: P00303; Swissprot_id: BABL_CUCSA; Gi_number: 114806; Description: BASIC BLUE PROTEIN (CUSACYANIN) (PLANTACYANIN) (CBP);

Seq ID: 85; Accession: P17078; Swissprot_id: RL35_RAT; Gi_number: 132917; Description: 60S RIBOSOMAL PROTEIN L35;

Seq ID: 86; Accession: O08816; Swissprot_id: WASL_RAT; Gi_number: 13431956; Description: Neural Wiskott-Aldrich syndrome protein (N-WASP);

Seq ID: 87; Accession: Q9M352; Swissprot_id: R36B_ARATH; Gi_number: 17865567; Description: 60S ribosomal protein L36-2;

Seq ID: 88; Accession: P35687; Swissprot_id: RS21_ORYSA; Gi_number: 548852; Description: 40S RIBOSOMAL PROTEIN S21;

Seq ID: 89; Accession: P14328; Swissprot_id: SP96_DICDI; Gi_number: 134780; Description: SPORE COAT PROTEIN SP96;

Seq ID: 90; Accession: P13983; Swissprot_id: EXTN_TOBAC; Gi_number: 119714; Description: Extensin precursor (Cell wall hydroxyproline-rich glycoprotein);

Seq ID: 91; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 92; Accession: P27483; Swissprot_id: GRP_ARATH; Gi_number: 121640; Description: GLYCINE-RICH CELL WALL STRUCTURAL PROTEIN PRECURSOR;

Seq ID: 93; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 95; Accession: P40602; Swissprot_id: APG_ARATH; Gi_number: 728867; Description: ANTER-SPECIFIC PROLINE-RICH PROTEIN APG PRECURSOR;

Seq ID: 96; Accession: P33485; Swissprot_id: VNUA_PRVKA; Gi_number: 465445; Description: PROBABLE NUCLEAR ANTIGEN;

Seq ID: 97; Accession: P70315; Swissprot_id: WASP_MOUSE; Gi_number: 2499130; Description: Wiskott-Aldrich syndrome protein homolog (WASP);

Seq ID: 98; Accession: P10220; Swissprot_id: TEGU_HSV11; Gi_number: 135576; Description: LARGE TEGUMENT PROTEIN (VIRION PROTEIN UL36);

Seq ID: 99; Accession: P11675; Swissprot_id: IE18_PRVIF; Gi_number: 124178; Description: IMMEDIATE-EARLY PROTEIN IE180;

Seq ID: 100; Accession: P13983; Swissprot_id: EXTN_TOBAC; Gi_number: 119714; Description: Extensin precursor (Cell wall hydroxyproline-rich glycoprotein);

Seq ID: 101; Accession: Q62376; Swissprot_id: RU17_MOUSE; Gi_number: 13633918; Description: U1 small nuclear ribonucleoprotein 70 kDa (U1 SNRNP 70 kDa) (snRNP70);

Seq ID: 102; Accession: P03211; Swissprot_id: EBN1_EBV; Gi_number: 119110; Description: EBNA-1 NUCLEAR PROTEIN;

Seq ID: 103; Accession: P33485; Swissprot_id: VNUA_PRVKA; Gi_number: 465445; Description: PROBABLE NUCLEAR ANTIGEN;

Seq ID: 104; Accession: P21997; Swissprot_id: SSGP_VOLCA; Gi_number: 134920; Description: SULFATED SURFACE GLYCOPROTEIN 185 (SSG 185);

Seq ID: 105; Accession: Q63003; Swissprot_id: 5E5_RAT; Gi_number: 2498095; Description: 5E5 ANTIGEN;

Seq ID: 106; Accession: Q02817; Swissprot_id: MUC2_HUMAN; Gi_number: 2506877; Description: MUCIN 2 PRECURSOR (INTESTINAL MUCIN 2);

Seq ID: 107; Accession: P13983; Swissprot_id: EXTN_TOBAC; Gi_number: 119714; Description: Extensin precursor (Cell wall hydroxyproline-rich glycoprotein);

Seq ID: 109; Accession: P18615; Swissprot_id: RDP_HUMAN; Gi_number: 1350554; Description: RD protein;

Seq ID: 110; Accession: P21997; Swissprot_id: SSGP_VOLCA; Gi_number: 134920; Description: SULFATED SURFACE GLYCOPROTEIN 185 (SSG 185);

Seq ID: 111; Accession: Q00451; Swissprot_id: PRF1_LYCES; Gi_number: 1709767; Description: 36.4 KD PROLINE-RICH PROTEIN;

Seq ID: 112; Accession: Q02817; Swissprot_id: MUC2_HUMAN; Gi_number: 2506877; Description: MUCIN 2 PRECURSOR (INTESTINAL MUCIN 2);

Seq ID: 113; Accession: P21997; Swissprot_id: SSGP_VOLCA; Gi_number: 134920; Description: SULFATED SURFACE GLYCOPROTEIN 185 (SSG 185);

Seq ID: 116; Accession: Q02817; Swissprot_id: MUC2_HUMAN; Gi_number: 2506877; Description: MUCIN 2 PRECURSOR (INTESTINAL MUCIN 2);

Seq ID: 117; Accession: P70315; Swissprot_id: WASP_MOUSE; Gi_number: 2499130; Description: Wiskott-Aldrich syndrome protein homolog (WASP);

Seq ID: 121; Accession: O22446; Swissprot_id: HDAC_ARATH; Gi_number: 3023945; Description: Histone deacetylase (HD);

Seq ID: 122; Accession: P03211; Swissprot_id: EBN1_EBV; Gi_number: 119110; Description: EBNA-1 NUCLEAR PROTEIN;

Seq ID: 124; Accession: P08393; Swissprot_id: ICP0_HSV11; Gi_number: 124134; Description: Trans-acting transcriptional protein ICP0 (Immediate-early protein IE110) (VMW110) (Alpha-0 protein);

Seq ID: 125; Accession: P49625; Swissprot_id: RL5_ORYSA; Gi_number: 3915826; Description: 60S RIBOSOMAL PROTEIN L5;

Seq ID: 126; Accession: P33485; Swissprot_id: VNUA_PRVKA; Gi_number: 465445; Description: PROBABLE NUCLEAR ANTIGEN;

Seq ID: 127; Accession: P14918; Swissprot_id: EXTN_MAIZE; Gi_number: 119712; Description: EXTENSIN PRECURSOR (PROLINE-RICH GLYCOPROTEIN);

Seq ID: 128; Accession: P42736; Swissprot_id: CDI3_ARATH; Gi_number: 1168862; Description: CADMIUM-INDUCED PROTEIN AS30;

Seq ID: 129; Accession: P33479; Swissprot_id: E18_PRVKA; Gi_number: 462387; Description: IMMEDIATE-EARLY PROTEIN E180;

Seq ID: 130; Accession: Q95107; Swissprot_id: WASL_BOVIN; Gi_number: 13431968; Description: Neural Wiskott-Aldrich syndrome protein (N-WASP);

Seq ID: 132; Accession: P33485; Swissprot_id: VNUA_PRVKA; Gi_number: 465445; Description: PROBABLE NUCLEAR ANTIGEN;

Seq ID: 133; Accession: Q02817; Swissprot_id: MUC2_HUMAN; Gi_number: 2506877; Description: MUCIN 2 PRECURSOR (INTESTINAL MUCIN 2);

Seq ID: 134; Accession: Q9SYQ8; Swissprot_id: CLV1_ARATH; Gi_number: 12643323; Description: RECEPTOR PROTEIN KINASE CLAVATA1 PRECURSOR;

Seq ID: 135; Accession: O80340; Swissprot_id: ERF4_ARATH; Gi_number: 7531110; Description: Ethylene responsive element binding factor 4 (AtERF4);

Seq ID: 136; Accession: P08392; Swissprot_id: ICP4_HSV11; Gi_number: 124141; Description: TRANS-ACTING TRANSCRIPTIONAL PROTEIN ICP4 (TRANSCRIPTIONAL ACTIVATOR IE175) (ALPHA-4 PROTEIN);

Seq ID: 137; Accession: Q03211; Swissprot_id: EXLP_TOBAC; Gi_number: 544262; Description: PISTIL-SPECIFIC EXTENSIN-LIKE PROTEIN PRECURSOR (PELP);

Seq ID: 138; Accession: P18165; Swissprot_id: LORI_MOUSE; Gi_number: 126390; Description: LORICRIN;

Seq ID: 139; Accession: O00268; Swissprot_id: T2D3_HUMAN; Gi_number: 3024681; Description: TRANSCRIPTION INITIATION FACTOR TFIID 135 KDA SUBUNIT (TAFII-135) (TAFII135) (TAFII-130) (TAFII130);

Seq ID: 140; Accession: P42768; Swissprot_id: WASP_HUMAN; Gi_number: 1722836; Description: WISKOTT-ALDRICH SYNDROME PROTEIN (WASP);

Seq ID: 141; Accession: P78621; Swissprot_id: SEPA_EMENI; Gi_number: 15214279; Description: CYTOKINESIS PROTEIN SEPA (FH1/2 PROTEIN) (FORCED EXPRESSION INHIBITION OF GROWTH A);

Seq ID: 142; Accession: P46301; Swissprot_id: RS25_LYCES; Gi_number: 1173234; Description: 40S RIBOSOMAL PROTEIN S25;

Seq ID: 143; Accession: Q00519; Swissprot_id: XDH_MOUSE; Gi_number: 1722858; Description: XANTHINE DEHYDROGENASE/OXIDASE [INCLUDES: XANTHINE DEHYDROGENASE (XD); XANTHINE OXIDASE (XO) (XANTHINE OXIDOREDUCTASE)];

Seq ID: 144; Accession: Q43043; Swissprot_id: PME_PETIN; Gi_number: 6093743; Description: PECTINESTERASE PRECURSOR (PECTIN METHYLESTERASE) (PE);

Seq ID: 145; Accession: O76082; Swissprot_id: OCN2_HUMAN; Gi_number: 8928257; Description: Organic cation/carnitine transporter 2 (Solute carrier family 22, member 5) (High-affinity sodium-dependent carnitine cotransporter);

Seq ID: 146; Accession: P07730; Swissprot_id: GLU2_ORYSA; Gi_number: 121475; Description: GLUTELIN TYPE II PRECURSOR;

Seq ID: 147; Accession: Q43772; Swissprot_id: UDPG_HORVU; Gi_number: 6136111; Description: UTP-GLUCOSE-1-PHOSPHATE URIDYLYLTRANSFERASE (UDP-GLUCOSE PYROPHOSPHORYLASE) (UDPGP) (UGPASE);

Seq ID: 148; Accession: P24465; Swissprot_id: CP71_PERAE; Gi_number: 117188; Description: CYTOCHROME P450 71A1 (CYPLXXIA1) (ARP-2);

Seq ID: 149; Accession: P32323; Swissprot_id: AGA1_YEAST; Gi_number: 416592; Description: A-AGGLUTININ ATTACHMENT SUBUNIT PRECURSOR;

Seq ID: 150; Accession: P09195; Swissprot_id: F16P_WHEAT; Gi_number: 119745; Description: FRUCTOSE-1,6-BISPHOSPHATASE, CHLOROPLAST PRECURSOR (D-FRUCTOSE-1,6-BISPHOSPHATE 1-PHOSPHOHYDROLASE) (FBPASE);

Seq ID: 151; Accession: Q9BYV1; Swissprot_id: AGT2_HUMAN; Gi_number: 17432913; Description: Alanine-glyoxylate aminotransferase 2, mitochondrial precursor (AGT 2) (Beta-alanine-pyruvate aminotransferase) (Beta-ALAAT II);

Seq ID: 152; Accession: P18583; Swissprot_id: SON_HUMAN; Gi_number: 586013; Description: SON PROTEIN (SON3);

Seq ID: 153; Accession: P76072; Swissprot_id: STFR_ECOLI; Gi_number: 12643676; Description: SIDE TAIL FIBER PROTEIN HOMOLOG FROM LAMBDOID PROPHAGE RAC;

Seq ID: 154; Accession: P17814; Swissprot_id: 4CL1_ORYSA; Gi_number: 112802; Description: 4-coumarate-CoA ligase 1 (4CL 1) (4-coumaroyl-CoA synthase 1);

Seq ID: 155; Accession: P03211; Swissprot_id: EBN1_EBV; Gi_number: 119110; Description: EBNA-1 NUCLEAR PROTEIN;

Seq ID: 156; Accession: P39656; Swissprot_id: OST4_HUMAN; Gi_number: 730241; Description: DOLICHYL-DIPHOSPHOOLIGOSACCHARIDE-PROTEIN GLYCOSYLTRANSFERASE 48 KDA SUBUNIT PRECURSOR (OLIGOSACCHARYL TRANSFERASE 48 KDA SUBUNIT) (DDOST 48 KDA SUBUNIT);

Seq ID: 157; Accession: O82256; Swissprot_id: COLA_ARATH; Gi_number: 17432989; Description: Zinc finger protein constants-like 10;

Seq ID: 158; Accession: P21997; Swissprot_id: SSGP_VOLCA; Gi_number: 134920; Description: SULFATED SURFACE GLYCOPROTEIN 185 (SSG 185);

Seq ID: 159; Accession: Q02910; Swissprot_id: CPN_DROME; Gi_number: 416833; Description: CALPHOTIN;

Seq ID: 160; Accession: P15792; Swissprot_id: KPK1_PHAVU; Gi_number: 125568; Description: Protein kinase PVPK-1;

Seq ID: 161; Accession: P40602; Swissprot_id: APG_ARATH; Gi_number: 728867; Description: ANTER-SPECIFIC PROLINE-RICH PROTEIN APG PRECURSOR;

Seq ID: 162; Accession: P41152; Swissprot_id: HSF3_LYCPE; Gi_number: 729774; Description: HEAT SHOCK FACTOR PROTEIN HSF30 (HEAT SHOCK TRANSCRIPTION FACTOR 30) (HSTF 30) (HEAT STRESS TRANSCRIPTION FACTOR);

Seq ID: 163; Accession: P05143; Swissprot_id: PRP3_MOUSE; Gi_number: 131002; Description: PROLINE-RICH PROTEIN MP-3;

Seq ID: 164; Accession: O43516; Swissprot_id: WAIP_HUMAN; Gi_number: 13124642; Description: WISKOTT-ALDRICH SYNDROME PROTEIN INTERACTING PROTEIN (WASP INTERACTING PROTEIN) (PRPL-2 PROTEIN);

Seq ID: 165; Accession: P17784; Swissprot_id: ALF_ORYSA; Gi_number: 113622; Description: FRUCTOSE-BISPHOSPHATE ALDOLASE, CYTOPLASMIC ISOZYME;

Seq ID: 166; Accession: P21997; Swissprot_id: SSGP_VOLCA; Gi_number: 134920; Description: SULFATED SURFACE GLYCOPROTEIN 185 (SSG 185);

Seq ID: 167; Accession: P30364; Swissprot_id: ASPG_LUPAN; Gi_number: 231573; Description: L-ASPARAGINASE (L-ASPARAGINE AMIDOHYDROLASE);

Seq ID: 168; Accession: Q9UBQ6; Swissprot_id: EXL2_HUMAN; Gi_number: 9296986; Description: Exostosin-like 2 (EXT-related protein 2);

Seq ID: 169; Accession: Q02817; Swissprot_id: MUC2_HUMAN; Gi_number: 2506877; Description: MUCIN 2 PRECURSOR (INTESTINAL MUCIN 2);

Seq ID: 170; Accession: O54939; Swissprot_id: DHB3_RAT; Gi_number: 3913460; Description: Estradiol 17 beta-dehydrogenase 3 (17-beta-HSD 3) (Testicular 17-beta-hydroxysteroid dehydrogenase);

Seq ID: 171; Accession: Q63003; Swissprot_id: 5E5_RAT; Gi_number: 2498095; Description: 5E5 ANTIGEN;

Seq ID: 172; Accession: P14009; Swissprot_id: 14 KD_DAUCA; Gi_number: 112697; Description: 14 KD PROLINE-RICH PROTEIN DC2.15 PRECURSOR;

Seq ID: 173; Accession: P50172; Swissprot_id: DHI1_MOUSE; Gi_number: 1706408; Description: Corticosteroid 11-beta-dehydrogenase, isozyme 1 (11-DH) (11-beta-hydroxysteroid dehydrogenase 1) (11-beta-HSD1) (11 beta-HSD1A);

Seq ID: 174; Accession: P25866; Swissprot_id: UBC2_WHEAT; Gi_number: 136640; Description: UBIQUITIN-CONJUGATING ENZYME E2-17 KD (UBIQUITIN-PROTEIN LIGASE) (UBIQUITIN CARRIER PROTEIN);

Seq ID: 175; Accession: P51614; Swissprot_id: CHIA_VITVI; Gi_number: 1705812; Description: ACIDIC ENDOCHITINASE PRECURSOR;

Seq ID: 177; Accession: P48038; Swissprot_id: ACRO_RABIT; Gi_number: 1351865; Description: Acrosin precursor;

Seq ID: 179; Accession: P42736; Swissprot_id: CDI3_ARATH; Gi_number: 1168862; Description: CADMIUM-INDUCED PROTEIN AS30;

Seq ID: 180; Accession: Q42443; Swissprot_id: THIH_ORYSA; Gi_number: 3915131; Description: THIOREDOXIN H-TYPE (TRX-H) (PHLOEM SAP 13 KDA PROTEIN-1);

Seq ID: 181; Accession: Q04629; Swissprot_id: PSLA_YEAST; Gi_number: 18202481; Description: PSL10 protein;

Seq ID: 182; Accession: P27884; Swissprot_id: CCAA_RABIT; Gi_number: 399201; Description: VOLTAGE-DEPENDENT P/Q-TYPE CALCIUM CHANNEL ALPHA-1A SUBUNIT (CALCIUM CHANNEL, L TYPE, ALPHA-1 POLYPEPTIDE ISOFORM 4) (BRAIN CALCIUM CHANNEL I) (BI);

Seq ID: 183; Accession: P02350; Swissprot_id: RS3A_XENLA; Gi_number: 133940; Description: 40S RIBOSOMAL PROTEIN S3A (S1A);

Seq ID: 184; Accession: Q9S8P4; Swissprot_id: RHRE_PEA; Gi_number: 18203442; Description: Rhicadhesin receptor precursor (Germin-like protein);

Seq ID: 185; Accession: Q07760; Swissprot_id: RL23_TOBAC; Gi_number: 730536; Description: 60S RIBOSOMAL PROTEIN L23;

Seq ID: 186; Accession: P13983; Swissprot_id: EXTN_TOBAC; Gi_number: 119714; Description: Extensin precursor (Cell wall hydroxyproline-rich glycoprotein);

Seq ID: 187; Accession: Q9SP35; Swissprot_id: IM17_ARATH; Gi_number: 12643851; Description: MITOCHONDRIAL IMPORT INNER MEMBRANE TRANSLOCASE SUBUNIT TIM17;

Seq ID: 188; Accession: Q05466; Swissprot_id: HAT4_ARATH; Gi_number: 462281; Description: Homeobox-leucine zipper protein HAT4 (HD-ZIP protein 4) (HD-ZIP protein ATHB-2);

Seq ID: 189; Accession: P50160; Swissprot_id: TS2_MAZE; Gi_number: 1717794; Description: SEX DETERMINATION PROTEIN TASSELSEED 2;

Seq ID: 190; Accession: O54939; Swissprot_id: DHB3_RAT; Gi_number: 3913460; Description: Estradiol 17 beta-dehydrogenase 3 (17-beta-HSD 3) (Testicular 17-beta-hydroxysteroid dehydrogenase);

Seq ID: 191; Accession: Q9WTV7; Swissprot_id: RNFB_MOUSE; Gi_number: 13124535; Description: RING FINGER PROTEIN 12 (LIM DOMAIN INTERACTING RING FINGER PROTEIN) (RING FINGER LIM DOMAIN-BINDING PROTEIN) (R-LIM);

Seq ID: 192; Accession: Q06666; Swissprot_id: T2_MOUSE; Gi_number: 730888; Description: OCTAPEPTIDE-REPEAT PROTEIN T2;

Seq ID: 193; Accession: Q02817; Swissprot_id: MUC2_HUMAN; Gi_number: 2506877; Description: MUCIN 2 PRECURSOR (INTESTINAL MUCIN 2);

Seq ID: 194; Accession: Q9Y252; Swissprot_id: RNF6_HUMAN; Gi_number: 13124536; Description: RING FINGER PROTEIN 6;

Seq ID: 195; Accession: Q06652; Swissprot_id: GSHZ_CITSI; Gi_number: 544437; Description: GLUTATHIONE PEROXIDASE HOMOLOG (SALT-ASSOCIATED PROTEIN);

Seq ID: 197; Accession: O00268; Swissprot_id: T2D3_HUMAN; Gi_number: 3024681; Description: TRANSCRIPTION INITIATION FACTOR TFIID 135 KDA SUBUNIT (TAFII-135) (TAFII135) (TAFII-130) (TAFII130);

Seq ID: 198; Accession: P37705; Swissprot_id: GRP3_DAUCA; Gi_number: 585217; Description: GLYCINE RICH PROTEIN A3;

Seq ID: 199; Accession: Q40635; Swissprot_id: VATL_ORYSA; Gi_number: 22493147; Description: VACUOLAR ATP SYNTHASE 16 KD PROTEOLIPID SUBUNIT;

Seq ID: 201; Accession: O04003; Swissprot_id: LG1_MAIZE; Gi_number: 6016502; Description: LIGULELESS1 PROTEIN;

Seq ID: 202; Accession: P80639; Swissprot_id: IF5A_MAIZE; Gi_number: 12643437; Description: INITIATION FACTOR 5A (EIF-5A) (EIF4D);

Seq ID: 203; Accession: P31673; Swissprot_id: HS12_ORYSA; Gi_number: 399937; Description: 17.4 KD CLASS I HEAT SHOCK PROTEIN;

Seq ID: 204; Accession: P27483; Swissprot_id: GRP_ARATH; Gi_number: 121640; Description: GLYCINE-RICH CELL WALL STRUCTURAL PROTEIN PRECURSOR;

Seq ID: 205; Accession: P03211; Swissprot_id: EBN1_EBV; Gi_number: 119110; Description: EBNA-1 NUCLEAR PROTEIN;

Seq ID: 206; Accession: Q43261; Swissprot_id: H$_2$B3_MAIZE; Gi_number: 3913804; Description: HISTONE 142B.3;

Seq ID: 207; Accession: Q07760; Swissprot_id: RL23_TOBAC; Gi_number: 730536; Description: 60S RIBOSOMAL PROTEIN L23;

Seq ID: 208; Accession: Q41001; Swissprot_id: BCP_PEA; Gi_number: 2493318; Description: Blue copper protein precursor;

Seq ID: 209; Accession: P21997; Swissprot_id: SSGP_VOLCA; Gi_number: 134920; Description: SULFATED SURFACE GLYCOPROTEIN 185 (SSG 185);

Seq ID: 210; Accession: P14009; Swissprot_id: 14 KD_DAUCA; Gi_number: 112697; Description: 14 KD PROLINE-RICH PROTEIN DC2.15 PRECURSOR;

Seq ID: 211; Accession: Q9P7J6; Swissprot_id: R17B_SCHPO; Gi_number: 15214229; Description: 40S ribosomal protein S17-B;

Seq ID: 212; Accession: O74893; Swissprot_id: RS20_SCHPO; Gi_number: 6094168; Description: 40S RIBOSOMAL PROTEIN S20;

Seq ID: 213; Accession: P78621; Swissprot_id: SEPA_EMENI; Gi_number: 15214279; Description: CYTOKINESIS PROTEIN SEPA (FH1/2 PROTEIN) (FORCED EXPRESSION INHIBITION OF GROWTH A);

Seq ID: 214; Accession: Q96499; Swissprot_id: RL44_GOSHI; Gi_number: 2500380; Description: 60S RIBOSOMAL PROTEIN L44;

Seq ID: 215; Accession: P55852; Swissprot_id: SMT3_ARATH; Gi_number: 2501448; Description: UBIQUITIN-LIKE PROTEIN SMT3;

Seq ID: 216; Accession: P53665; Swissprot_id: ACPM_ARATH; Gi_number: 1703091; Description: Acyl carrier protein, mitochondrial precursor (ACP) (NADH-ubiquinone oxidoreductase 9.6 kDa subunit) (MtACP-1);

Seq ID: 217; Accession: O81277; Swissprot_id: PSK5_ORYSA; Gi_number: 18202216; Description: Phytosulfokines 5 precursor (Secretory protein SH27A) [Contains: Phytosulfokine-alpha (PSK-alpha) (Phytosulfokine-a); Phytosulfokine-beta (PSK-beta) (Phytosulfokine-b)];

Seq ID: 219; Accession: P11414; Swissprot_id: RPB1_CRIGR; Gi_number: 133323; Description: DNA-DIRECTED RNA POLYMERASE II LARGEST SUBUNIT (RPB1);

Seq ID: 220; Accession: P27603; Swissprot_id: PHEA_PSEST; Gi_number: 130055; Description: P-PROTEIN [INCLUDES: CHORISMATE MUTASE (CM); PREPHENATE DEHYDRATASE (PDT)];

Seq ID: 221; Accession: P49455; Swissprot_id: TPM4_DROME; Gi_number: 1351285; Description: TROPOMYOSIN 1, FUSION PROTEIN 33;

Seq ID: 223; Accession: P42145; Swissprot_id: HSP1_PSECU; Gi_number: 1170404; Description: Sperm protamine P1;

Seq ID: 224; Accession: P15941; Swissprot_id: MUC1_HUMAN; Gi_number: 547937; Description: MUCIN 1 PRECURSOR (POLYMORPHIC EPITHELIAL MUCIN) (PEM) (PEMT) (EPISIALIN) (TUMOR-ASSOCIATED MUCIN) (CARCINOMA-ASSOCIATED MUCIN) (TUMOR-ASSOCIATED EPITHELIAL MEMBRANE ANTIGEN) (EMA) (H23AG) (PEANUT-REACTIVE URINARY MUCIN) (PUM) (BREAST CARCINOMA-ASSOCIA>;

Seq ID: 225; Accession: P70315; Swissprot_id: WASP_MOUSE; Gi_number: 2499130; Description: Wiskott-Aldrich syndrome protein homolog (WASP);

Seq ID: 226; Accession: P36782; Swissprot_id: VE2_HPV12; Gi_number: 549237; Description: REGULATORY PROTEIN E2;

Seq ID: 227; Accession: P04052; Swissprot_id: RPB1_DROME; Gi_number: 14286163; Description: DNA-DIRECTED RNA POLYMERASE II LARGEST SUBUNIT;

Seq ID: 228; Accession: P10162; Swissprot_id: PRPL_HUMAN; Gi_number: 131011; Description: SALIVARY PROLINE-RICH PROTEIN PO (ALLELE K) [CONTAINS: PEPTIDE P-D];

Seq ID: 229; Accession: P13983; Swissprot_id: EXTN_TOBAC; Gi_number: 119714; Description: Extensin precursor (Cell wall hydroxyproline-rich glycoprotein);

Seq ID: 230; Accession: P13983; Swissprot_id: EXTN_TOBAC; Gi_number: 119714; Description: Extensin precursor (Cell wall hydroxyproline-rich glycoprotein);

Seq ID: 231; Accession: P05142; Swissprot_id: PRP2_MOUSE; Gi_number: 130999; Description: Proline-rich protein MP-2 precursor;

Seq ID: 232; Accession: P13983; Swissprot_id: EXTN_TOBAC; Gi_number: 119714; Description: Extensin precursor (Cell wall hydroxyproline-rich glycoprotein);

Seq ID: 233; Accession: P19706; Swissprot_id: MYSB_ACACA; Gi_number: 1171093; Description: Myosin heavy chain IB (Myosin heavy chain IL);

Seq ID: 234; Accession: P14918; Swissprot_id: EXTN_MAIZE; Gi_number: 119712; Description: EXTENSIN PRECURSOR (PROLINE-RICH GLYCOPROTEIN);

Seq ID: 239; Accession: P40603; Swissprot_id: APG_BRANA; Gi_number: 728868; Description: ANTER-SPECIFIC PROLINE-RICH PROTEIN APG (PROTEIN CEX);

Seq ID: 240; Accession: O60610; Swissprot_id: DIA1_HUMAN; Gi_number: 6225268; Description: DIAPHANOUS PROTEIN HOMOLOG 1 (DIAPHANOUS-RELATED FORMIN 1) (DRF1);

Seq ID: 243; Accession: P21997; Swissprot_id: SSGP_VOLCA; Gi_number: 134920; Description: SULFATED SURFACE GLYCOPROTEIN 185 (SSG 185);

Seq ID: 244; Accession: P18431; Swissprot_id: SGG_DROME; Gi_number: 13124808; Description: PROTEIN KINASE SHAGGY (PROTEIN ZESTE-WHITE 3);

Seq ID: 246; Accession: P24856; Swissprot_id: ANP_NOTCO; Gi_number: 8488962; Description: Antifreeze glycopeptide polyprotein precursor (AFGP polyprotein) [Contains: AFGP7 (AFGP 7); AFGP8 (AFGP 8)];

Seq ID: 248; Accession: P16356; Swissprot_id: RPB1_CAEEL; Gi_number: 133322; Description: DNA-DIRECTED RNA POLYMERASE II LARGEST SUBUNIT;

Seq ID: 250; Accession: P18165; Swissprot_id: LORI_MOUSE; Gi_number: 126390; Description: LORICRIN;

Seq ID: 252; Accession: P21997; Swissprot_id: SSGP_VOLCA; Gi_number: 134920; Description: SULFATED SURFACE GLYCOPROTEIN 185 (SSG 185);

Seq ID: 253; Accession: Q01538; Swissprot_id: MYT1_HUMAN; Gi_number: 13638422; Description: MYELIN TRANSCRIPTION FACTOR 1 (MYT1) (MYTI) (PROTEOLIPID PROTEIN BINDING PROTEIN) (PLPB1);

Seq ID: 254; Accession: Q02817; Swissprot_id: MUC2_HUMAN; Gi_number: 2506877; Description: MUCIN 2 PRECURSOR (INTESTINAL MUCIN 2);

Seq ID: 255; Accession: P17133; Swissprot_id: RU17_DROME; Gi_number: 13638469; Description: U1 SMALL NUCLEAR RIBONUCLEOPROTEIN 70 KDA (U1 SNRNP 70 KDA) (SNRNP70);

Seq ID: 256; Accession: P05527; Swissprot_id: HMIN_DROME; Gi_number: 123388; Description: HOMEOBOX PROTEIN INVECTED;

Seq ID: 257; Accession: O80340; Swissprot_id: ERF4_ARATH; Gi_number: 7531110; Description: Ethylene responsive element binding factor 4 (AtERF4);

Seq ID: 258; Accession: P40954; Swissprot_id: CHI3_CANAL; Gi_number: 1168933; Description: CHITINASE 3 PRECURSOR;

Seq ID: 259; Accession: Q02817; Swissprot_id: MUC2_HUMAN; Gi_number: 2506877; Description: MUCIN 2 PRECURSOR (INTESTINAL MUCIN 2);

Seq ID: 260; Accession: P11675; Swissprot_id: IE18_PRVIF; Gi_number: 124178; Description: IMMEDIATE-EARLY PROTEIN IE180;

Seq ID: 261; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 262; Accession: P05790; Swissprot_id: FBOH_BOMMO; Gi_number: 9087216; Description: FIBROIN HEAVY CHAIN PRECURSOR (FIB-H) (H-FIBROIN);

Seq ID: 263; Accession: Q02817; Swissprot_id: MUC2_HUMAN; Gi_number: 2506877; Description: MUCIN 2 PRECURSOR (INTESTINAL MUCIN 2);

Seq ID: 264; Accession: Q9NYV4; Swissprot_id: CRK7_HUMAN; Gi_number: 12643825; Description: CELL DIVISION CYCLE 2-RELATED PROTEIN KINASE 7 (CDC2-RELATED PROTEIN KINASE 7) (CRKRS);

Seq ID: 265; Accession: Q42569; Swissprot_id: C901_ARATH; Gi_number: 5915851; Description: Cytochrome P450 90A1;

Seq ID: 266; Accession: Q19200; Swissprot_id: STO1_CAEEL; Gi_number: 2493264; Description: STO-1 PROTEIN;

Seq ID: 267; Accession: P34579; Swissprot_id: UN47_CAEEL; Gi_number: 14917051; Description: Unc-47 protein;

Seq ID: 268; Accession: O04681; Swissprot_id: PTI5_LYCES; Gi_number: 7531180; Description: PATHOGENESIS-RELATED GENES TRANSCRIPTIONAL ACTIVATOR PTI5;

Seq ID: 269; Accession: P03211; Swissprot_id: EBN1_EBV; Gi_number: 119110; Description: EBNA-1 NUCLEAR PROTEIN;

Seq ID: 270; Accession: P27884; Swissprot_id: CCAA_RABIT; Gi_number: 399201; Description: VOLTAGE-DEPENDENT P/Q-TYPE CALCIUM CHANNEL ALPHA-1A SUBUNIT (CALCIUM CHANNEL, L TYPE, ALPHA-1 POLYPEPTIDE ISOFORM 4) (BRAIN CALCIUM CHANNEL I) (BI);

Seq ID: 271; Accession: Q02817; Swissprot_id: MUC2_HUMAN; Gi_number: 2506877; Description: MUCIN 2 PRECURSOR (INTESTINAL MUCIN 2);

Seq ID: 272; Accession: P28968; Swissprot_id: VGLX_HSVEB; Gi_number: 138350; Description: GLYCOPROTEIN X PRECURSOR;

Seq ID: 273; Accession: P13983; Swissprot_id: EXTN_TOBAC; Gi_number: 119714; Description: Extensin precursor (Cell wall hydroxyproline-rich glycoprotein);

Seq ID: 275; Accession: P36024; Swissprot_id: SIS2_YEAST; Gi_number: 548925; Description: SIS2 PROTEIN (HALOTOLERANCE PROTEIN HAL3);

Seq ID: 276; Accession: O80337; Swissprot_id: ERFI_ARATH; Gi_number: 7531107; Description: ETHYLENE RESPONSIVE ELEMENT BINDING FACTOR 1 (ATERF1);

Seq ID: 277; Accession: P33485; Swissprot_id: VNUA_PRVKA; Gi_number: 465445; Description: PROBABLE NUCLEAR ANTIGEN;

Seq ID: 278; Accession: Q9WTV7; Swissprot_id: RNFB_MOUSE; Gi_number: 13124535; Description: RING FINGER PROTEIN 12 (LIM DOMAIN INTERACTING RING FINGER PROTEIN) (RING FINGER LIM DOMAIN-BINDING PROTEIN) (R-LIM);

Seq ID: 279; Accession: P18583; Swissprot_id: SON_HUMAN; Gi_number: 586013; Description: SON PROTEIN (SON3);

Seq ID: 280; Accession: O43516; Swissprot_id: WAIP_HUMAN; Gi_number: 13124642; Description: WISKOTT-ALDRICH SYNDROME PROTEIN INTERACTING PROTEIN (WASP INTERACTING PROTEIN) (PRPL-2 PROTEIN);

Seq ID: 281; Accession: Q9W611; Swissprot_id: RBMS_CHICK; Gi_number: 13124483; Description: RNA-binding protein with multiple splicing homolog (RBP-MS) (HEart, RRM Expressed Sequence) (Hermes);

Seq ID: 282; Accession: Q03173; Swissprot_id: NDPP_MOUSE; Gi_number: 1709249; Description: NPC DERIVED PROLINE RICH PROTEIN 1 (NDPP-1);

Seq ID: 284; Accession: P06544; Swissprot_id: THI1_ANASO; Gi_number: 135761; Description: Thioredoxin 1 (TRX-1) (Thioredoxin M);

Seq ID: 285; Accession: Q9WTV7; Swissprot_id: RNFB_MOUSE; Gi_number: 13124535; Description: RING FINGER PROTEIN 12 (LIM DOMAIN INTERACTING RING FINGER PROTEIN) (RING FINGER LIM DOMAIN-BINDING PROTEIN) (R-LIM);

Seq ID: 286; Accession: Q40089; Swissprot_id: ATP4_IPOBA; Gi_number: 2493046; Description: ATP synthase delta' chain, mitochondrial precursor;

Seq ID: 287; Accession: P36787; Swissprot_id: VE2_HPV25; Gi_number: 549242; Description: REGULATORY PROTEIN E2;

Seq ID: 288; Accession: P70315; Swissprot_id: WASP_MOUSE; Gi_number: 2499130; Description: Wiskott-Aldrich syndrome protein homolog (WASP);

Seq ID: 289; Accession: P11675; Swissprot_id: IE18_PRVIF; Gi_number: 124178; Description: IMMEDIATE-EARLY PROTEIN E180;

Seq ID: 290; Accession: O08816; Swissprot_id: WASL_RAT; Gi_number: 13431956; Description: Neural Wiskott-Aldrich syndrome protein (N-WASP);

Seq ID: 291; Accession: P17483; Swissprot_id: HXB4_HUMAN; Gi_number: 547692; Description: HOMEOBOX PROTEIN HOX-B4 (HOX-2F) (HOX-2.6);

Seq ID: 292; Accession: Q53547; Swissprot_id: EST2_PSEFL; Gi_number: 3023719; Description: CARBOXYLESTERASE 2 (ESTERASE II);

Seq ID: 294; Accession: P13983; Swissprot_id: EXTN_TOBAC; Gi_number: 119714; Description: Extensin precursor (Cell wall hydroxyproline-rich glycoprotein);

Seq ID: 295; Accession: P47735; Swissprot_id: RLK5_ARATH; Gi_number: 1350783; Description: Receptor-like protein kinase 5 precursor;

Seq ID: 296; Accession: P03211; Swissprot_id: EBN1_EBV; Gi_number: 119110; Description: EBNA-1 NUCLEAR PROTEIN;

Seq ID: 297; Accession: P23074; Swissprot_id: POL_SFV1; Gi_number: 400825; Description: POL polyprotein [Contains: Protease; Reverse transcriptase; Endonuclease];

Seq ID: 298; Accession: P09189; Swissprot_id: HS7C_PETHY; Gi_number: 123650; Description: HEAT SHOCK COGNATE 70 KD PROTEIN;

Seq ID: 299; Accession: P43293; Swissprot_id: NAK_ARATH; Gi_number: 1171642; Description: Probable serine/threonine-protein kinase NAK;

Seq ID: 300; Accession: P08775; Swissprot_id: RPB1_MOUSE; Gi_number: 133327; Description: DNA-directed RNA polymerase II largest subunit (RPB1);

Seq ID: 301; Accession: P36787; Swissprot_id: VE2_HPV25; Gi_number: 549242; Description: REGULATORY PROTEIN E2;

Seq ID: 302; Accession: O60508; Swissprot_id: PR17_HUMAN; Gi_number: 17380181; Description: PremRNA splicing factor PRP17 (hPRP17) (EH-binding protein 3) (Ehb3);

Seq ID: 303; Accession: Q02817; Swissprot_id: MUC2_HUMAN; Gi_number: 2506877; Description: MUCIN 2 PRECURSOR (INTESTINAL MUCIN 2);

Seq ID: 304; Accession: Q39017; Swissprot_id: KDG1_ARATH; Gi_number: 2494034; Description: Diacylglycerol kinase 1 (Diglyceride kinase 1) (DGK 1) (DAG kinase 1);

Seq ID: 305; Accession: P51027; Swissprot_id: NRM1_CHICK; Gi_number: 1709350; Description: Natural resistance-associated macrophage protein 1 (NRAMP 1);

Seq ID: 306; Accession: Q96423; Swissprot_id: TCMO_GLYEC; Gi_number: 3915095; Description: TRANS-CINNAMATE 4-MONOOXYGENASE (CINNAMIC ACID 4-HYDROXYLASE) (CA4H) (C4H) (P450C4H) (CYTOCHROME P450 73);

Seq ID: 307; Accession: P02812; Swissprot_id: PRP2 HUMAN; Gi_number: 130998; Description: Salivary proline-rich protein precursor (Clone CP7) [Contains: Basic peptide P-F];

Seq ID: 308; Accession: P12783; Swissprot_id: PGKY_WHEAT; Gi_number: 129916; Description: PHOSPHOGLYCERATE KINASE, CYTOSOLIC;

Seq ID: 309; Accession: P17840; Swissprot_id: SLS3_BRAOL; Gi_number: 134532; Description: S-locus-specific glycoprotein S13 precursor (SLSG-13);

Seq ID: 310; Accession: Q9Z2A7; Swissprot_id: DGAT_MOUSE; Gi_number: 17374647; Description: Diacylglycerol O-acyltransferase (Diglyceride acyltransferase);

Seq ID: 311; Accession: P38564; Swissprot_id: MNB-A_MAIZE; Gi_number: 1346559; Description: DNA-BINDING PROTEIN MNB1A;

Seq ID: 312; Accession: P10496; Swissprot_id: GRP2_PHAVU; Gi_number: 121632; Description: GLYCINE-RICH CELL WALL STRUCTURAL PROTEIN 1.8 PRECURSOR (GRP 1.8);

Seq ID: 313; Accession: P40631; Swissprot_id: MLH_TETTH; Gi_number: 730030; Description: Micronuclear linker histone polyprotein (MIC LH) [Contains: Micronuclear linker histone-alpha; Micronuclear linker histone-beta; Micronuclear linker histone-delta; Micronuclear linker histone-gamma];

Seq ID: 315; Accession: O24215; Swissprot_id: DCAM_ORYSA; Gi_number: 6166113; Description: S-ADENOSYLMETHIONINE DECARBOXYLASE PROENZYME (ADOMETDC) (SAMDC);

Seq ID: 316; Accession: Q9LX45; Swissprot_id: PIR4_ARATH; Gi_number: 14195010; Description: Pirin-like protein At3g59260;

Seq ID: 317; Accession: P34913; Swissprot_id: HYES_HUMAN; Gi_number: 462369; Description: Soluble epoxide hydrolase (SEH) (Epoxide hydratase) (Cytosolic epoxide hydrolase) (CEH);

Seq ID: 318; Accession: P13983; Swissprot_id: EXTN_TOBAC; Gi_number: 119714; Description: Extensin precursor (Cell wall hydroxyproline-rich glycoprotein);

Seq ID: 320; Accession: Q9HTR0; Swissprot_id: NOM2_PSEAE; Gi_number: 14285606; Description: Probable multidrug resistance protein norM 2 (Na(+)/drug antiporter) (Multidrug-efflux transporter);

Seq ID: 321; Accession: O43516; Swissprot_id: WAIP_HUMAN; Gi_number: 13124642; Description: WISKOTT-ALDRICH SYNDROME PROTEIN INTERACTING PROTEIN (WASP INTERACTING PROTEIN) (PRPL-2 PROTEIN);

Seq ID: 322; Accession: O43516; Swissprot_id: WAIP_HUMAN; Gi_number: 13124642; Description: WISKOTT-ALDRICH SYNDROME PROTEIN INTERACTING PROTEIN (WASP INTERACTING PROTEIN) (PRPL-2 PROTEIN);

Seq ID: 323; Accession: Q12446; Swissprot_id: LA17_YEAST; Gi_number: 2498506; Description: PROLINE-RICH PROTEIN LAS17;

Seq ID: 324; Accession: Q00451; Swissprot_id: PRF1_LYCES; Gi_number: 1709767; Description: 36.4 KD PROLINE-RICH PROTEIN;

Seq ID: 326; Accession: P39881; Swissprot_id: CUT1_CANFA; Gi_number: 729093; Description: CCAAT displacement protein (Homeobox protein Clox) (Clox-1);

Seq ID: 327; Accession: P10162; Swissprot_id: PRPL_HUMAN; Gi_number: 131011; Description: SALIVARY PROLINE-RICH PROTEIN PO (ALLELE K) [CONTAINS: PEPTIDE P-D];

Seq ID: 329; Accession: P70315; Swissprot_id: WASP_MOUSE; Gi_number: 2499130; Description: Wiskott-Aldrich syndrome protein homolog (WASP);

Seq ID: 330; Accession: P52154; Swissprot_id: RHO_MICLU; Gi_number: 2507337; Description: Transcription termination factor rho;

Seq ID: 332; Accession: P14897; Swissprot_id: ELI9_HORVU; Gi_number: 119286; Description: Low molecular mass early light-inducible protein HV90, chloroplast precursor (ELIP);

Seq ID: 333; Accession: Q39411; Swissprot_id: RL26_BRARA; Gi_number: 3914740; Description: 60S RIBOSOMAL PROTEIN L26;

Seq ID: 335; Accession: P19837; Swissprot_id: SPD1_NEPCL; Gi_number: 1174414; Description: SPIDROIN 1 (DRAGLINE SILK FIBROIN 1);

Seq ID: 336; Accession: P46665; Swissprot_id: HT14_ARATH; Gi_number: 12230908; Description: Homeobox-leucine zipper protein HAT14 (HD-ZIP protein 14);

Seq ID: 337; Accession: P47815; Swissprot_id: IF1A_WHEAT; Gi_number: 1352427; Description: Eukaryotic translation initiation factor 1A (EIF-1A) (EIF-4C);

Seq ID: 338; Accession: Q02817; Swissprot_id: MUC2_HUMAN; Gi_number: 2506877; Description: MUCIN 2 PRECURSOR (INTESTINAL MUCIN 2);

Seq ID: 340; Accession: P08399; Swissprot_id: PHX5_MOUSE; Gi_number: 2507093; Description: PERHEXAMER REPEAT PROTEIN 5;

Seq ID: 341; Accession: Q61189; Swissprot_id: ICLN_MOUSE; Gi_number: 13431571; Description: Chloride conductance regulatory protein ICln I(Cln) (Chloride channel, nucleotide sensitive 1A) (Chloride ion current inducer protein) (ClCI);

Seq ID: 342; Accession: Q02817; Swissprot_id: MUC2_HUMAN; Gi_number: 2506877; Description: MUCIN 2 PRECURSOR (INTESTINAL MUCIN 2);

Seq ID: 343; Accession: Q05193; Swissprot_id: DYN1_HUMAN; Gi_number: 461976; Description: Dynamin-1;

Seq ID: 345; Accession: O60610; Swissprot_id: DIA1_HUMAN; Gi_number: 6225268; Description: DIAPHANOUS PROTEIN HOMOLOG 1 (DIAPHANOUS-RELATED FORMIN 1) (DRF1);

Seq ID: 346; Accession: P03211; Swissprot_id: EBN1_EBV; Gi_number: 119110; Description: EBNA-1 NUCLEAR PROTEIN;

Seq ID: 347; Accession: P05142; Swissprot_id: PRP2_MOUSE; Gi_number: 130999; Description: Proline-rich protein MP-2 precursor;

Seq ID: 348; Accession: P13983; Swissprot_id: EXTN_TOBAC; Gi_number: 119714; Description: Extensin precursor (Cell wall hydroxyproline-rich glycoprotein);

Seq ID: 350; Accession: P10323; Swissprot_id: ACRO_HUMAN; Gi_number: 113208; Description: ACROSIN PRECURSOR;

Seq ID: 351; Accession: Q06666; Swissprot_id: T2_MOUSE; Gi_number: 730888; Description: OCTAPEPTIDE-REPEAT PROTEIN T2;

Seq ID: 352; Accession: P48634; Swissprot_id: BAT2_HUMAN; Gi_number: 1352066; Description: LARGE PROLINE-RICH PROTEIN BAT2 (HLA-B-ASSOCIATED TRANSCRIPT 2);

Seq ID: 354; Accession: P10569; Swissprot_id: MYSC_ACACA; Gi_number: 127749; Description: Myosin IC heavy chain;

Seq ID: 355; Accession: P14918; Swissprot_id: EXTN_MAIZE; Gi_number: 119712; Description: EXTENSIN PRECURSOR (PROLINE-RICH GLYCOPROTEIN);

Seq ID: 356; Accession: Q63262; Swissprot_id: BRN1_RAT; Gi_number: 5915802; Description: BRAIN-SPECIFIC HOMEOBOX/POU DOMAIN PROTEIN 1 (BRN-1 PROTEIN);

Seq ID: 357; Accession: P37370; Swissprot_id: VRP1_YEAST; Gi_number: 2507155; Description: VERPROLIN;

Seq ID: 359; Accession: P40603; Swissprot_id: APG_BRANA; Gi_number: 728868; Description: ANTER-SPECIFIC PROLINE-RICH PROTEIN APG (PROTEIN CEX);

Seq ID: 361; Accession: Q95107; Swissprot_id: WASL_BOVIN; Gi_number: 13431968; Description: Neural Wiskott-Aldrich syndrome protein (N-WASP);

Seq ID: 362; Accession: P08001; Swissprot_id: ACRO_PIG; Gi_number: 113210; Description: ACROSIN PRECURSOR (53 KD FUCOSE-BINDING PROTEIN);

Seq ID: 363; Accession: Q01484; Swissprot_id: ANK2_HUMAN; Gi_number: 1703310; Description: ANKYRIN 2 (BRAIN ANKYRIN) (ANKYRIN B) (ANKYRIN, NONERYTHROID);

Seq ID: 364; Accession: P28968; Swissprot_id: VGLX_HSVEB; Gi_number: 138350; Description: GLYCOPROTEIN X PRECURSOR;

Seq ID: 365; Accession: Q9WTV7; Swissprot_id: RNFB_MOUSE; Gi_number: 13124535; Description: RING FINGER PROTEIN 12 (LIM DOMAIN INTERACTING RING FINGER PROTEIN) (RING FINGER LIM DOMAIN-BINDING PROTEIN) (R-LIM);

Seq ID: 366; Accession: Q9UMN6; Swissprot_id: TRX2_HUMAN; Gi_number: 12643900; Description: TRITHORAX HOMOLOG 2 (MIXED LINEAGE LEUKEMIA GENE HOMOLOG 2 PROTEIN);

Seq ID: 367; Accession: P33479; Swissprot_id: IE18_PRVKA; Gi_number: 462387; Description: IMMEDIATE-EARLY PROTEIN IE180;

Seq ID: 368; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 369; Accession: P13917; Swissprot_id: 7SBG_SOYBN; Gi_number: 14549156; Description: BASIC 7S GLOBULIN PRECURSOR (BG) (SBG7S);

Seq ID: 370; Accession: P25012; Swissprot_id: CG22_SOYBN; Gi_number: 116162; Description: G2/mitotic-specific cyclin S13-7 (B-like cyclin);

Seq ID: 371; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 373; Accession: P14328; Swissprot_id: SP96_DICDI; Gi_number: 134780; Description: SPORE COAT PROTEIN SP96;

Seq ID: 374; Accession: P33479; Swissprot_id: IE18_PRVKA; Gi_number: 462387; Description: IMMEDIATE-EARLY PROTEIN IE180;

Seq ID: 375; Accession: P13983; Swissprot_id: EXTN_TOBAC; Gi_number: 119714; Description: Extensin precursor (Cell wall hydroxyproline-rich glycoprotein);

Seq ID: 376; Accession: Q03211; Swissprot_id: EXLP_TOBAC; Gi_number: 544262; Description: PISTIL-SPECIFIC EXTENSIN-LIKE PROTEIN PRECURSOR (PELP);

Seq ID: 377; Accession: Q02817; Swissprot_id: MUC2_HUMAN; Gi_number: 2506877; Description: MUCIN 2 PRECURSOR (INTESTINAL MUCIN 2);

Seq ID: 379; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 380; Accession: P30962; Swissprot_id: CCMC_BRAJA; Gi_number: 399869; Description: HEME EXPORTER PROTEIN C (CYTOCHROME C-TYPE BIOGENESIS PROTEIN CYCZ);

Seq ID: 381; Accession: P52551; Swissprot_id: MYB-B_XENLA; Gi_number: 6226654; Description: Myb-related protein B (B-Myb) (Myb-related protein 1) (XMYB1);

Seq ID: 382; Accession: P10394; Swissprot_id: POL4_DROME; Gi_number: 130407; Description: Retrovirus-related Pol polyprotein from transposon 412 [Contains: Protease; Reverse transcriptase; Endonuclease];

Seq ID: 383; Accession: P17656; Swissprot_id: CC2_CAEEL; Gi_number: 115398; Description: CUTICLE COLLAGEN 2;

Seq ID: 384; Accession: P37370; Swissprot_id: VRP1_YEAST; Gi_number: 2507155; Description: VERPROLIN;

Seq ID: 385; Accession: P03211; Swissprot_id: EBN1_EBV; Gi_number: 119110; Description: EBNA-1 NUCLEAR PROTEIN;

Seq ID: 386; Accession: P24007; Swissprot_id: RBS_PYRPY; Gi_number: 132153; Description: Ribulose bisphosphate carboxylase small chain, chloroplast precursor (RuBisCO small subunit);

Seq ID: 388; Accession: Q01540; Swissprot_id: AG_BRANA; Gi_number: 399096; Description: Agamous protein;

Seq ID: 389; Accession: Q9WTV7; Swissprot_id: RNFB_MOUSE; Gi_number: 13124535; Description: RING FINGER PROTEIN 12 (LIM DOMAIN INTERACTING RING FINGER PROTEIN) (RING FINGER LIM DOMAIN-BINDING PROTEIN) (R-LIM);

Seq ID: 390; Accession: Q96502; Swissprot_id: COL2_ARATH; Gi_number: 17433030; Description: Zinc finger protein CONSTANS-LIKE 2;

Seq ID: 391; Accession: O60610; Swissprot_id: DIA1_HUMAN; Gi_number: 6225268; Description: DIAPHANOUS PROTEIN HOMOLOG 1 (DIAPHANOUS-RELATED FORMIN 1) (DRF1);

Seq ID: 392; Accession: P08723; Swissprot_id: SPBP_RAT; Gi_number: 134789; Description: Prostatic spermine-binding protein precursor (SBP);

Seq ID: 393; Accession: Q9LR17; Swissprot_id: OSR8_ORYSA; Gi_number: 15214171; Description: Hydrophobic protein OSR8;

Seq ID: 394; Accession: Q27294; Swissprot_id: CAZ_DROME; Gi_number: 8928004; Description: RNA-binding protein cabeza (Sarcoma-associated RNA-binding fly homolog) (P19);

Seq ID: 395; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 396; Accession: P21997; Swissprot_id: SSGP_VOLCA; Gi_number: 134920; Description: SULFATED SURFACE GLYCOPROTEIN 185 (SSG 185);

Seq ID: 397; Accession: P03211; Swissprot_id: EBN1_EBV; Gi_number: 119110; Description: EBNA-1 NUCLEAR PROTEIN;

Seq ID: 398; Accession: O00268; Swissprot_id: T2D3_HUMAN; Gi_number: 3024681; Description: TRANSCRIPTION INITIATION FACTOR TFIID 135 KDA SUBUNIT (TAFII-135) (TAFII135) (TAFII-130) (TAFII130);

Seq ID: 399; Accession: P23225; Swissprot_id: GLSF_MAIZE; Gi_number: 121446; Description: Ferredoxin-dependent glutamate synthase, chloroplast precursor (Fd-GOGAT);

Seq ID: 400; Accession: P34811; Swissprot_id: EFGC_SOYBN; Gi_number: 461999; Description: ELONGATION FACTOR G, CHLOROPLAST PRECURSOR (EF-G);

Seq ID: 401; Accession: Q02978; Swissprot_id: M2OM_HUMAN; Gi_number: 400210; Description: MITOCHONDRIAL 2-OXOGLUTARATE/MALATE CARRIER PROTEIN (OGCP);

Seq ID: 402; Accession: P28284; Swissprot_id: ICP0_HSV2H; Gi_number: 124135; Description: Trans-acting transcriptional protein ICP0 (VMW118 protein);

Seq ID: 403; Accession: Q9SK53; Swissprot_id: COL8_ARATH; Gi_number: 17433082; Description: Zinc finger protein constans-like 8;

Seq ID: 404; Accession: P93236; Swissprot_id: ABA2_LYCES; Gi_number: 5902706; Description: Zeaxanthin epoxidase, chloroplast precursor;

Seq ID: 405; Accession: Q9SSU8; Swissprot_id: PSY_DAUCA; Gi_number: 8928282; Description: Phytoene synthase, chloroplast precursor;

Seq ID: 406; Accession: P37821; Swissprot_id: 1A1C_MALDO; Gi_number: 3041658; Description: 1-AMINOCYCLOPROPANE-1-CARBOXYLATE SYNTHASE (ACC SYNTHASE) (S-ADENOSYL-L-METHIONINE METHYLTHIOADENOSINE-LYASE);

Seq ID: 408; Accession: P48125; Swissprot_id: RK1_CYAPA; Gi_number: 1350623; Description: Cyanelle 50S ribosomal protein L1;

Seq ID: 410; Accession: Q9WZV3; Swissprot_id: DNAJ_THEMA; Gi_number: 11132549; Description: Chaperone protein dnaJ;

Seq ID: 411; Accession: P29344; Swissprot_id: RR1_SPIOL; Gi_number: 133872; Description: 30S ribosomal protein S1, chloroplast precursor (CS1);

Seq ID: 414; Accession: Q42463; Swissprot_id: DCL_LYCES; Gi_number: 6014934; Description: DCL PROTEIN, CHLOROPLAST PRECURSOR (DEFECTIVE CHLOROPLASTS AND LEAVES PROTEIN);

Seq ID: 415; Accession: Q08298; Swissprot_id: RD22_ARATH; Gi_number: 1172874; Description: DEHYDRATION-RESPONSIVE PROTEIN RD22 PRECURSOR;

Seq ID: 416; Accession: P23326; Swissprot_id: RK35_SPIOL; Gi_number: 132918; Description: 50S RIBOSOMAL PROTEIN L35, CHLOROPLAST PRECURSOR (CL35);

Seq ID: 417; Accession: O59742; Swissprot_id: IF3X_SCHPO; Gi_number: 14916997; Description: Probable eukaryotic translation initiation factor 3 135 kDa subunit (eIF3 p135) (Translation initiation factor eIF3, p135 subunit);

Seq ID: 418; Accession: O54408; Swissprot_id: RELA_BACSU; Gi_number: 6647736; Description: GTP PYROPHOSPHOKINASE (ATP:GTP 3'-PYROPHOSPHOTRANSFERASE) (PPGPP SYNTHETASE I) ((P)PPGPP SYNTHETASE);

Seq ID: 419; Accession: Q9SHI1; Swissprot_id: IF2C_ARATH; Gi_number: 13627881; Description: Translation initiation factor IF-2, chloroplast precursor;

Seq ID: 420; Accession: Q9JIK5; Swissprot_id: DD21_MOUSE; Gi_number: 13959325; Description: NUCLEOLAR RNA HELICASE II (NUCLEOLAR RNA HELICASE GU) (RH II/GU) (DEAD BOX PROTEIN 21);

Seq ID: 421; Accession: P14328; Swissprot_id: SP96_DICDI; Gi_number: 134780; Description: SPORE COAT PROTEIN SP96;

Seq ID: 422; Accession: O81117; Swissprot_id: C941_VICSA; Gi_number: 17366212; Description: Cytochrome P450 94A1 (P450-dependent fatty acid omega-hydroxylase);

Seq ID: 423; Accession: P37107; Swissprot_id: SR5C_ARATH; Gi_number: 586038; Description: Signal recognition particle 54 kDa protein, chloroplast precursor (SRP54) (54 chloroplast protein) (54CP) (FFC);

Seq ID: 424; Accession: Q59914; Swissprot_id: HRDD_STRGR; Gi_number: 17366575; Description: RNA polymerase principal sigma factor hrdD;

Seq ID: 425; Accession: P42895; Swissprot_id: ENO2_MAIZE; Gi_number: 1169528; Description: ENOLASE 2 (2-PHOSPHOGLYCERATE DEHYDRATASE 2) (2-PHOSPHO-D-GLYCERATE HYDRO-LYASE 2);

Seq ID: 426; Accession: P38564; Swissprot_id: MNBA_MAIZE; Gi_number: 1346559; Description: DNA-BINDING PROTEIN MNB1A;

Seq ID: 427; Accession: O49939; Swissprot_id: TL40_SPIOL; Gi_number: 10720315; Description: Peptidyl-prolyl cis-trans isomerase, chloroplast precursor (40 kDa thylakoid lumen PPIase) (40 kDa thylakoid lumen rotamase);

Seq ID: 429; Accession: O67695; Swissprot_id: RF2_AQUAE; Gi_number: 6225943; Description: Peptide chain release factor 2 (RF-2);

Seq ID: 430; Accession: P32945; Swissprot_id: PPQ1_YEAST; Gi_number: 417746; Description: SERINE/THREONINE PROTEIN PHOSPHATASE PPQ;

Seq ID: 432; Accession: Q9MUU5; Swissprot_id: RK5_MESVI; Gi_number: 14548222; Description: Chloroplast 50S ribosomal protein L5;

Seq ID: 433; Accession: Q02817; Swissprot_id: MUC2_HUMAN Gi_number: 2506877; Description: MUCIN 2 PRECURSOR (INTESTINAL MUCIN 2);

Seq ID: 434; Accession: O94903; Swissprot_id: POSC_HUMAN; Gi_number: 12230426; Description: Proline synthetase co-transcribed bacterial homolog protein;

Seq ID: 435; Accession: P57708; Swissprot_id: ISPF_PSEAE; Gi_number: 12643672; Description: 2C-METHYL-D-ERYTHRITOL 2,4-CYCLODIPHOSPHATE SYNTHASE (MECPS);

Seq ID: 436; Accession: Q9SEC2; Swissprot_id: MSRA_LACSA; Gi_number: 12230349; Description: Peptide methionine sulfoxide reductase (Protein-methionine-S-oxide reductase) (Peptide Met(O) reductase);

Seq ID: 439; Accession: Q9WZV3; Swissprot_id: DNA-J_THEMA; Gi_number: 11132549; Description: Chaperone protein dnaJ;

Seq ID: 440; Accession: P30260; Swissprot_id: CC27_HUMAN; Gi_number: 12644198; Description: PROTEIN CDC27HS (CELL DIVISION CYCLE PROTEIN 27 HOMOLOG) (H-NUC);

Seq ID: 441; Accession: O46894; Swissprot_id: RK3_GUITH; Gi_number: 3914660; Description: CHLOROPLAST 50S RIBOSOMAL PROTEIN L3;

Seq ID: 442; Accession: P25864; Swissprot_id: RK9_ARATH; Gi_number: 133028; Description: 50S ribosomal protein L9, chloroplast precursor (CL9);

Seq ID: 443; Accession: Q03211; Swissprot_id: EXLP_TOBAC; Gi_number: 544262; Description: PISTIL-SPECIFIC EXTENSIN-LIKE PROTEIN PRECURSOR (PELP);

Seq ID: 446; Accession: O59742; Swissprot_id: IF3X_SCHPO; Gi_number: 14916997; Description: Probable eukaryotic translation initiation factor 3 135 kDa subunit (eIF3 p135) (Translation initiation factor eIF3, p135 subunit);

Seq ID: 447; Accession: P74070; Swissprot_id: EFTS_SYNY3; Gi_number: 2494280; Description: Elongation factor Ts (EF-Ts);

Seq ID: 448; Accession: Q42546; Swissprot_id: DPNP_ARATH; Gi_number: 3913518; Description: 3'(2'),5'-bisphosphate nucleotidase (3'(2'),5-bisphosphonucleoside 3'(2')-phosphohydrolase) (DPNPase);

Seq ID: 449; Accession: Q55806; Swissprot_id: SYT_SYNY3; Gi_number: 2501062; Description: Threonyl-tRNA synthetase (Threonine-tRNA ligase) (ThrRS);

Seq ID: 450; Accession: P21997; Swissprot_id: SSGP_VOLCA; Gi_number: 134920; Description: SULFATED SURFACE GLYCOPROTEIN 185 (SSG 185);

Seq ID: 451; Accession: P40477; Swissprot_id: N159_YEAST; Gi_number: 731862; Description: Nucleoporin NUP159 (Nuclear pore protein NUP159);

Seq ID: 453; Accession: P51106; Swissprot_id: DFRA_HORVU; Gi_number: 1706372; Description: DIHYDROFLAVONOL-4-REDUCTASE (DFR) (DIHYDROKAEMPFEROL 4-REDUCTASE);

Seq ID: 454; Accession: P11893; Swissprot_id: RK24_PEA; Gi_number: 132819; Description: 50S RIBOSOMAL PROTEIN L24, CHLOROPLAST PRECURSOR (CL24);

Seq ID: 455; Accession: P37370; Swissprot_id: VRP1_YEAST; Gi_number: 2507155; Description: VERPROLIN;

Seq ID: 456; Accession: P82244; Swissprot_id: RK34_SPIOL; Gi_number: 14285713; Description: 50S ribosomal protein L34, chloroplast precursor;

Seq ID: 457; Accession: Q13823; Swissprot_id: NGP1_HUMAN; Gi_number: 3334276; Description: Autoantigen NGP-1;

Seq ID: 458; Accession: Q12238; Swissprot_id: UV31_SCHPO; Gi_number: 3024789; Description: UV-INDUCED PROTEIN UVI31;

Seq ID: 459; Accession: Q42569; Swissprot_id: C901_ARATH; Gi_number: 5915851; Description: Cytochrome P450 90A1;

Seq ID: 461; Accession: P11892; Swissprot_id: RK25_PEA; Gi_number: 132825; Description: 50S RIBOSOMAL PROTEIN CL25, CHLOROPLAST PRECURSOR;

Seq ID: 462; Accession: P78426; Swissprot_id: HK61_HUMAN; Gi_number: 6016211; Description: HOMEOBOX PROTEIN NKX-6.1;

Seq ID: 463; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 464; Accession: P16301; Swissprot_id: LCAT_MOUSE; Gi_number: 125994; Description: PHOSPHATIDYLCHOLINE-STEROL ACYLTRANSFERASE PRECURSOR (LECITHIN-CHOLESTEROL ACYLTRANSFERASE) (PHOSPHOLIPID-CHOLESTEROL ACYLTRANSFERASE);

Seq ID: 465; Accession: P43293; Swissprot_id: NAK_ARATH; Gi_number: 1171642; Description: Probable serine/threonine-protein kinase NAK;

Seq ID: 466; Accession: O04226; Swissprot_id: P5CS_ORYSA; Gi_number: 6225820; Description: Delta 1-pyrroline-5-carboxylate synthetase (P5CS) [Includes: Glutamate 5-kinase (Gamma-glutamyl kinase) (GK); Gamma-glutamyl phosphate reductase (GPR) (Glutamate-5-semialdehyde dehydrogenase) (Glutamyl-gamma-semialdehyde dehydrogenase)];

Seq ID: 467; Accession: O81395; Swissprot_id: DRTS_MAIZE; Gi_number: 6685381; Description: BIFUNCTIONAL DIHYDROFOLATE REDUCTASE-THYMIDYLATE SYNTHASE (DHFR-TS) [INCLUDES: DIHYDROFOLATE REDUCTASE; THYMIDYLATE SYNTHASE];

Seq ID: 468; Accession: P42566; Swissprot_id: EP15_HUMAN; Gi_number: 1169540; Description: Epidermal growth factor receptor substrate 15 (Protein EPS15) (AF-1P protein);

Seq ID: 470; Accession: P52306; Swissprot_id: GDS1_HUMAN; Gi_number: 1707895; Description: RAP1 GTPASE-GDP DISSOCIATION STIMULATOR 1 (SMG P21 STIMULATORY GDP/GTP EXCHANGE PROTEIN) (SMG GDS PROTEIN);

Seq ID: 471; Accession: P38631; Swissprot_id: GLS1_YEAST; Gi_number: 1346146; Description: 1,3-BETA-GLUCAN SYNTHASE COMPONENT GLS1 (1,3-BETA-D-GLUCAN-UDP GLUCOSYLTRANSFERASE) (CND1 PROTEIN) (CWN53 PROTEIN) (FKS1 PROTEIN) (PAPULACANDIN B SENSITIVITY PROTEIN 1);

Seq ID: 472; Accession: Q42510; Swissprot_id: EM30_ARATH; Gi_number: 2498329; Description: PATTERN FORMATION PROTEIN EMB30;

Seq ID: 473; Accession: P47735; Swissprot_id: RLK5_ARATH; Gi_number: 1350783; Description: Receptor-like protein kinase 5 precursor;

Seq ID: 474; Accession: P20305; Swissprot_id: GELS_PIG; Gi_number: 121118; Description: Gelsolin precursor, plasma (Actin-depolymerizing factor) (ADF) (Brevin);

Seq ID: 475; Accession: P46607; Swissprot_id: HGL2_ARATH; Gi_number: 2506525; Description: Homeobox protein GLABRA2 (Homeobox-leucine zipper protein ATHB-10) (HD-ZIP protein ATHB-10);

Seq ID: 477; Accession: P40541; Swissprot_id: IRR1_YEAST; Gi_number: 731791; Description: IRR1PROTEIN;

Seq ID: 478; Accession: P18493; Swissprot_id: PPOL_BOVIN; Gi_number: 130779; Description: POLY [ADP-RIBOSE] POLYMERASE (PARP) (ADPRT) (NAD(+) ADP-RIBOSYLTRANSFERASE) (POLY[ADP-RIBOSE] SYNTHETASE);

Seq ID: 479; Accession: P15792; Swissprot_id: KPK1_PHAVU; Gi_number: 125568; Description: Protein kinase PVPK-1;

Seq ID: 480; Accession: P48980; Swissprot_id: BGAL_LYCES; Gi_number: 1352077; Description: Beta-galactosidase precursor (Lactase) (EXO-(1→4)-beta-D-galactanase);

Seq ID: 481; Accession: O60610; Swissprot_id: DIA1_HUMAN; Gi_number: 6225268; Description: DIAPHANOUS PROTEIN HOMOLOG 1 (DIAPHANOUS-RELATED FORMIN 1) (DRF1);

Seq ID: 482; Accession: P39014; Swissprot_id: MT30_YEAST; Gi_number: 730077; Description: MET30 protein;

Seq ID: 484; Accession: Q01577; Swissprot_id: PKPA_PHYBL; Gi_number: 3122617; Description: Serine/threonine protein kinase PKPA;

Seq ID: 485; Accession: P29141; Swissprot_id: SUBV_BACSU; Gi_number: 135023; Description: Minor extracellular protease VPR precursor;

Seq ID: 486; Accession: P47735; Swissprot_id: RLK5_ARATH; Gi_number: 1350783; Description: Receptor-like protein kinase 5 precursor;

Seq ID: 487; Accession: P51849; Swissprot_id: DCP3_ORYSA; Gi_number: 1706331; Description: PYRUVATE DECARBOXYLASE ISOZYME 3 (PDC);

Seq ID: 488; Accession: Q43207; Swissprot_id: FKB7_WHEAT; Gi_number: 3023751; Description: 70 kDa peptidylprolyl isomerase (Peptidylprolyl cis-trans isomerase) (Cyclophilin) (PPiase);

Seq ID: 489; Accession: P47997; Swissprot_id: G11A_ORYSA; Gi_number: 1346057; Description: Protein kinase G11A;

Seq ID: 490; Accession: O15523; Swissprot_id: DDXY_HUMAN; Gi_number: 6014945; Description: DEAD-box protein 3, Y-chromosomal;

Seq ID: 491; Accession: Q38997; Swissprot_id: KI10_ARATH; Gi_number: 6166239; Description: SNF1-related protein kinase KIN10 (AKIN10);

Seq ID: 492; Accession: P52707; Swissprot_id: MDL3_PRUSE; Gi_number: 1708972; Description: (R)-MANDELONITRILE LYASE ISOFORM 3 PRECURSOR (HYDROXYNITRILE LYASE 3) ((R)-OXYNITRILASE 3);

Seq ID: 493; Accession: Q02817; Swissprot_id: MUC2_HUMAN; Gi_number: 2506877; Description: MUCIN 2 PRECURSOR (INTESTINAL MUCIN 2);

Seq ID: 494; Accession: P38631; Swissprot_id: GLS1_YEAST; Gi_number: 1346146; Description: 1,3-BETA-GLUCAN SYNTHASE COMPONENT GLS1 (1,3-BETA-D-GLUCAN-UDP GLUCOSYLTRANSFERASE) (CND1 PROTEIN) (CWN53 PROTEIN) (FKS1 PROTEIN) (PAPULACANDIN B SENSITIVITY PROTEIN 1);

Seq ID: 495; Accession: P54278; Swissprot_id: PMS2_HUMAN; Gi_number: 1709685; Description: PMS1 protein homolog 2 (DNA mismatch repair protein PMS2);

Seq ID: 496; Accession: Q02637; Swissprot_id: CEB_DROME; Gi_number: 1345723; Description: CCAAT/ENHANCER BINDING PROTEIN (C/EBP) (SLOW BORDER CELL PROTEIN);

Seq ID: 497; Accession: Q40671; Swissprot_id: CG2B_ORYSA; Gi_number: 3913236; Description: G2/mitotic-specific cyclin 2 (B-like cyclin) (CYCOS2);

Seq ID: 498; Accession: Q02096; Swissprot_id: PGLR_PERAE; Gi_number: 400758; Description: Polygalacturonase precursor (PG) (Pectinase);

Seq ID: 499; Accession: Q07474; Swissprot_id: MAD2_PETHY; Gi_number: 729976; Description: Floral homeotic protein PMADS 2;

Seq ID: 500; Accession: P18583; Swissprot_id: SON_HUMAN; Gi_number: 586013; Description: SON PROTEIN (SON3);

Seq ID: 501; Accession: Q61548; Swissprot_id: A180_MOUSE; Gi_number: 2492687; Description: CLATHRIN COAT ASSEMBLY PROTEIN AP180 (CLATHRIN COAT ASSOCIATED PROTEIN AP180) (PHOSPHOPROTEIN F1-20) (91 KDA SYNAPTOSOMAL-ASSOCIATED PROTEIN);

Seq ID: 502; Accession: P50809; Swissprot_id: VE2_HPV36; Gi_number: 1718125; Description: REGULATORY PROTEIN E2;

Seq ID: 503; Accession: Q00624; Swissprot_id: ASO_BRANA; Gi_number: 114268; Description: L-ascorbate oxidase homolog precursor (Ascorbase);

Seq ID: 504; Accession: O22467; Swissprot_id: MSI1_ARATH; Gi_number: 3122387; Description: WD-40 repeat protein MSI1;

Seq ID: 505; Accession: Q13459; Swissprot_id: MY9B_HUMAN; Gi_number: 14548118; Description: MYOSIN IXB (UNCONVENTIONAL MYOSIN-9B);

Seq ID: 508; Accession: Q9HB07; Swissprot_id: MYG1_HUMAN; Gi_number: 14194963; Description: MYG1 protein;

Seq ID: 509; Accession: P05100; Swissprot_id: 3MG1_ECOLI; Gi_number: 112785; Description: DNA-3-methyladenine glycosylase I (3-methyladenine-DNA glycosylase I, constitutive) (TAG I) (DNA-3-methyladenine glycosidase I);

Seq ID: 511; Accession: O24356; Swissprot_id: MEN8_SILLA; Gi_number: 6016542; Description: MEN-8 protein precursor;

Seq ID: 512; Accession: P40013; Swissprot_id: BIM1_YEAST; Gi_number: 731441; Description: BIM1 PROTEIN;

Seq ID: 514; Accession: P30755; Swissprot_id: $H_2B1$_MAIZE; Gi_number: 399853; Description: HISTONE H2B.1;

Seq ID: 516; Accession: P08985; Swissprot_id: H2AV_DROME; Gi_number: 121989; Description: HISTONE H2A VARIANT;

Seq ID: 517; Accession: P28968; Swissprot_id: VGLX_HSVEB; Gi_number: 138350; Description: GLYCOPROTEIN X PRECURSOR;

Seq ID: 519; Accession: Q05654; Swissprot_id: RDPO_SCHPO; Gi_number: 1710054; Description: RETROTRANSPOSABLE ELEMENT TF2 155 KDA PROTEIN;

Seq ID: 525; Accession: P04323; Swissprot_id: POL3_DROME; Gi_number: 130405; Description: Retrovirus-related Pol polyprotein from transposon 17.6 [Contains: Protease; Reverse transcriptase; Endonuclease];

Seq ID: 526; Accession: P29375; Swissprot_id: RBB2_HUMAN; Gi_number: 1710032; Description: Retinoblastoma-binding protein 2 (RBBP-2);

Seq ID: 527; Accession: P14233; Swissprot_id: TGAB_TOBAC; Gi_number: 135670; Description: TGACG-SEQUENCE SPECIFIC DNA-BINDING PROTEIN TGA-1B (HSBF);

Seq ID: 529; Accession: P05423; Swissprot_id: BN51_HUMAN; Gi_number: 115081; Description: BN51 protein;

Seq ID: 530; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 532; Accession: P44389; Swissprot_id: RS15_HAEIN; Gi_number: 1173205; Description: 30S ribosomal protein S15;

Seq ID: 533; Accession: P40619; Swissprot_id: HMGL_PHANI; Gi_number: 729736; Description: HMG1/2-LIKE PROTEIN;

Seq ID: 535; Accession: P43214; Swissprot_id: MPP2_PHLPR; Gi_number: 1171009; Description: POLLEN ALLERGEN PHL P 2 PRECURSOR (PHL P II);

Seq ID: 536; Accession: Q9Y6D5; Swissprot_id: BIG2_HUMAN; Gi_number: 13123996; Description: BREFELDIN A-INHIBITED GUANINE NUCLEOTIDE-EXCHANGE PROTEIN 2 (BREFELDIN A-INHIBITED GEP 2);

Seq ID: 537; Accession: P12957; Swissprot_id: CALD_CHICK; Gi_number: 2506984; Description: CALDESMON (CDM);

Seq ID: 538; Accession: Q9FJR0; Swissprot_id: RNT1_ARATH; Gi_number: 18202906; Description: Regulator of nonsense transcripts 1 homolog;

Seq ID: 539; Accession: Q14562; Swissprot_id: DDX8_HUMAN; Gi_number: 3023637; Description: ATP-dependent helicase DDX8 (RNA helicase HRH1) (DEAH-box protein 8);

Seq ID: 540; Accession: Q9Y4I1; Swissprot_id: MY5A_HUMAN; Gi_number: 13431722; Description: MYOSIN VA (MYOSIN 5A) (DILUTE MYOSIN HEAVY CHAIN, NON-MUSCLE) (MYOSIN HEAVY CHAIN 12) (MYOXIN);

Seq ID: 541; Accession: Q9LRE6; Swissprot_id: DPOD_ORYSA; Gi_number: 13124219; Description: DNA polymerase delta catalytic subunit;

Seq ID: 542; Accession: Q15477; Swissprot_id: SKIW_HUMAN; Gi_number: 3123284; Description: HELICASE SK12W (HELICASE-LIKE PROTEIN) (HLP);

Seq ID: 543; Accession: P50533; Swissprot_id: XCPE_XENLA; Gi_number: 1722856; Description: CHROMOSOME ASSEMBLY PROTEIN XCAP-E;

Seq ID: 544; Accession: P47735; Swissprot_id: RLK5_ARATH; Gi_number: 1350783; Description: Receptor-like protein kinase 5 precursor;

Seq ID: 545; Accession: P78706; Swissprot_id: RCO1_NEUCR; Gi_number: 2494901; Description: TRANSCRIPTIONAL REPRESSOR RCO-1;

Seq ID: 546; Accession: P47735; Swissprot_id: RLK5_ARATH; Gi_number: 1350783; Description: Receptor-like protein kinase 5 precursor;

Seq ID: 547; Accession: P25822; Swissprot_id: PUM_DROME; Gi_number: 131605; Description: MATERNAL PUMILIO PROTEIN;

Seq ID: 548; Accession: P23394; Swissprot_id: PR28_YEAST; Gi_number: 1172596; Description: PRE-mRNA SPLICING FACTOR RNA HELICASE PRP28 (HELICASE CA8);

Seq ID: 549; Accession: P31948; Swissprot_id: IEFS_HUMAN; Gi_number: 400042; Description: Stress-induced-phosphoprotein 1 (STI1) (Hsp70/Hsp90-organizing protein) (Transformation-sensitive protein IEF SSP 3521);

Seq ID: 551; Accession: P07742; Swissprot_id: RIR1_MOUSE; Gi_number: 132609; Description: Ribonucleoside-diphosphate reductase M1 chain (Ribonucleotide reductase large chain);

Seq ID: 552; Accession: Q08759; Swissprot_id: MYB_XENLA; Gi_number: 730090; Description: Myb protein;

Seq ID: 553; Accession: P51798; Swissprot_id: CLC7_HUMAN; Gi_number: 12644301; Description: CHLORIDE CHANNEL PROTEIN 7 (CLC-7);

Seq ID: 554; Accession: Q9R0N7; Swissprot_id: SYT7_MOUSE; Gi_number: 18203408; Description: Synaptotagmin VII (SytVII);

Seq ID: 555; Accession: Q43704; Swissprot_id: MCM3_MAIZE; Gi_number: 2497820; Description: DNA replication licensing factor MCM3 homolog (Replication origin activator) (ROA protein);

Seq ID: 556; Accession: P93648; Swissprot_id: LON2_MAIZE; Gi_number: 3914006; Description: Lon protease homolog 2, mitochondrial precursor;

Seq ID: 557; Accession: P20724; Swissprot_id: ELYA_BACSP; Gi_number: 119309; Description: Alkaline elastase YaB precursor;

Seq ID: 558; Accession: O59933; Swissprot_id: ER25_CANAL; Gi_number: 6015108; Description: C-4 methyl sterol oxidase;

Seq ID: 559; Accession: Q9QUR6; Swissprot_id: PPCE_MOUSE; Gi_number: 13633250; Description: Prolyl endopeptidase (Post-proline cleaving enzyme) (PE);

Seq ID: 560; Accession: P40798; Swissprot_id: STC_DROME; Gi_number: 730843; Description: Shuttle craft protein;

Seq ID: 561; Accession: P38630; Swissprot_id: RFC1_YEAST; Gi_number: 584899; Description: Activator 1 95 kDa subunit (Replication factor C 95 kDa subunit) (Cell division control protein 44);

Seq ID: 562; Accession: Q9SYQ8; Swissprot_id: CLV1_ARATH; Gi_number: 12643323; Description: RECEPTOR PROTEIN KINASE CLAVATA1 PRECURSOR;

Seq ID: 564; Accession: P13983; Swissprot_id: EXTN_TOBAC; Gi_number: 119714; Description: Extensin precursor (Cell wall hydroxyproline-rich glycoprotein);

Seq ID: 565; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 566; Accession: P38605; Swissprot_id: CAS1_ARATH; Gi_number: 584882; Description: CYCLOARTENOL SYNTHASE (2,3-EPOXYSQUALENE-CYCLOARTENOL CYCLASE);

Seq ID: 567; Accession: Q9SA34; Swissprot_id: IMH2_ARATH; Gi_number: 14194878; Description: Probable inosine-5'-monophosphate dehydrogenase (IMP dehydrogenase) (IMPDH) (IMPD);

Seq ID: 568; Accession: P43293; Swissprot_id: NAK_ARATH; Gi_number: 1171642; Description: Probable serine/threonine-protein kinase NAK;

Seq ID: 569; Accession: P25386; Swissprot_id: USO1_YEAST; Gi_number: 137175; Description: Intracellular protein transport protein USO1;

Seq ID: 571; Accession: P10163; Swissprot_id: PRP4_HUMAN; Gi_number: 131005; Description: SALIVARY PROLINE-RICH PROTEIN PO PRECURSOR (ALLELE S);

Seq ID: 572; Accession: P38994; Swissprot_id: MSS4_YEAST; Gi_number: 1709144; Description: Probable phosphatidylinositol-4-phosphate 5-kinase MSS4 (1-phosphatidylinositol-4-phosphate kinase) (PIP5K) (PtdIns(4)P-5-kinase) (Diphosphoinositide kinase);

Seq ID: 573; Accession: P37898; Swissprot_id: AAP1_YEAST; Gi_number: 728771; Description: ALANINE/ARGININE AMINOPEPTIDASE;

Seq ID: 574; Accession: P53683; Swissprot_id: CDP2_ORYSA; Gi_number: 1705734; Description: Calcium-dependent protein kinase, isoform 2 (CDPK 2);

Seq ID: 576; Accession: P17814; Swissprot_id: 4CL1_ORYSA; Gi_number: 112802; Description: 4-coumarate-CoA ligase 1 (4CL 1) (4-coumaroyl-CoA synthase 1);

Seq ID: 577; Accession: P42704; Swissprot_id: L130_HUMAN; Gi_number: 1730078; Description: 130 kDa leucine-rich protein (LRP 130) (GP130);

Seq ID: 578; Accession: P78963; Swissprot_id: SKB1_SCHPO; Gi_number: 12644354; Description: SHK1 KINASE-BINDING PROTEIN 1;

Seq ID: 579; Accession: P80073; Swissprot_id: MYB2_PHYPA; Gi_number: 462669; Description: Myb-related protein Pp2;

Seq ID: 580; Accession: P29458; Swissprot_id: CC21_SCHPO; Gi_number: 6226565; Description: CDC21 PROTEIN;

Seq ID: 581; Accession: P52707; Swissprot_id: MDL3_PRUSE; Gi_number: 1708972; Description: (R)-MANDELONITRILE LYASE ISOFORM 3 PRECURSOR (HYDROXYNITRILE LYASE 3) ((R)-OXYNITRILASE 3);

Seq ID: 582; Accession: P25439; Swissprot_id: BRM_DROME; Gi_number: 115132; Description: HOMEOTIC GENE REGULATOR (BRAHMA PROTEIN);

Seq ID: 583; Accession: Q99614; Swissprot_id: TTC1_HUMAN; Gi_number: 12585378; Description: TETRATRICOPEPTIDE REPEAT PROTEIN 1 (TPR REPEAT PROTEIN 1);

Seq ID: 584; Accession: P45672; Swissprot_id: NIR3_AZOBR; Gi_number: 1171716; Description: NIFR3-LIKE PROTEIN;

Seq ID: 585; Accession: P07153; Swissprot_id: RIB1_RAT; Gi_number: 132560; Description: Dolichyl-diphosphooligosaccharide-protein glycosyltransferase 67 kDa subunit precursor (Ribophorin I) (RPN-I);

Seq ID: 586; Accession: Q38741; Swissprot_id: SBP1_ANTMA; Gi_number: 6094239; Description: SQUAMOSA-PROMOTER BINDING PROTEIN 1;

Seq ID: 587; Accession: P21447; Swissprot_id: MDR3_MOUSE; Gi_number: 266517; Description: Multidrug resistance protein 3 (P-glycoprotein 3) (MDR1A);

Seq ID: 588; Accession: P52706; Swissprot_id: MDL1_PRUSE; Gi_number: 1708971; Description: (R)-MANDELONITRILE LYASE ISOFORM 1 PRECURSOR (HYDROXYNITRILE LYASE 1) ((R)-OXYNITRILASE 1);

Seq ID: 589; Accession: P21997; Swissprot_id: SSG-P_VOLCA; Gi_number: 134920; Description: SULFATED SURFACE GLYCOPROTEIN 185 (SSG 185);

Seq ID: 591; Accession: P70362; Swissprot_id: UFD1_MOUSE; Gi_number: 2501439; Description: Ubiquitin fusion degradation protein 1 homolog (UB fusion protein 1);

Seq ID: 592; Accession: P05522; Swissprot_id: GUN1_PERAE; Gi_number: 121784; Description: ENDOGLUCANASE 1 PRECURSOR (ENDO-1,4-BETA-GLUCANASE) (ABSCISSION CELLULASE 1);

Seq ID: 593; Accession: Q40286; Swissprot_id: UFO4_MANES; Gi_number: 2501493; Description: Flavonol 3-O-glucosyltransferase 4 (UDP-glucose flavonoid 3-O-glucosyltransferase 4) (Fragment);

Seq ID: 594; Accession: P52409; Swissprot_id: E13B_WHEAT; Gi_number: 1706551; Description: GLUCAN ENDO-1,3-BETA-GLUCOSIDASE PRECURSOR ((1→3)-BETA-GLUCAN ENDOHYDROLASE) ((1→3)-BETA-GLUCANASE) (BETA-1,3-ENDOGLUCANASE);

Seq ID: 595; Accession: P19706; Swissprot_id: MYSB_ACACA; Gi_number: 1171093; Description: Myosin heavy chain IB (Myosin heavy chain IL);

Seq ID: 596; Accession: P13728; Swissprot_id: SGS3_DROYA; Gi_number: 134469; Description: Salivary glue protein SGS-3 precursor;

Seq ID: 597; Accession: P16258; Swissprot_id: OXYB_RABIT; Gi_number: 129309; Description: OXYSTEROL-BINDING PROTEIN;

Seq ID: 599; Accession: P52409; Swissprot_id: E13B_WHEAT; Gi_number: 1706551; Description: GLUCAN ENDO-1,3-BETA-GLUCOSIDASE PRECURSOR ((1→3)-BETA-GLUCAN ENDOHYDROLASE) ((1→3)-BETA-GLUCANASE) (BETA-1,3-ENDOGLUCANASE);

Seq ID: 600; Accession: P28968; Swissprot_id: VGLX_HSVEB; Gi_number: 138350; Description: GLYCOPROTEIN X PRECURSOR;

Seq ID: 601; Accession: P78371; Swissprot_id: TCPB_HUMAN; Gi_number: 6094436; Description: T-complex protein 1, beta subunit (TCP-1-beta) (CCT-beta);

Seq ID: 602; Accession: Q62520; Swissprot_id: ZIC2_MOUSE; Gi_number: 3183503; Description: Zinc finger protein ZIC2 (Zinc finger protein of the cerebellum 2);

Seq ID: 603; Accession: Q9NYH9; Swissprot_id: HC66_HUMAN; Gi_number: 18203325; Description: Hepatocellular carcinoma-associated antigen 66;

Seq ID: 604; Accession: Q61084; Swissprot_id: M3K3_MOUSE; Gi_number: 2499641; Description: MITOGEN-ACTIVATED PROTEIN KINASE KINASE KINASE 3 (MAPK/ERK KINASE KINASE 3) (MEK KINASE 3) (MEKK 3);

Seq ID: 606; Accession: Q59695; Swissprot_id: ACOC_PSEPU; Gi_number: 7531037; Description: DIHYDROLIPOAMIDE ACETYLTRANSFERASE COMPONENT OF ACETOIN CLEAVING SYSTEM (ACETOIN DEHYDROGENASE E2 COMPONENT);

Seq ID: 607; Accession: P49902; Swissprot_id: 5NTC_HUMAN; Gi_number: 1703012; Description: Cytosolic purine 5'-nucleotidase;

Seq ID: 608; Accession: P71684; Swissprot_id: GCH2_MYCTU; Gi_number: 3915713; Description: RIBOFLAVIN BIOSYNTHESIS PROTEIN RIBA [INCLUDES: GTP CYCLOHYDROLASE II; 3,4-DIHYDROXY-2-BUTANONE 4-PHOSPHATE SYNTHASE (DHBP SYNTHASE)];

Seq ID: 609; Accession: P35585; Swissprot_id: A1M1_MOUSE; Gi_number: 543817; Description: Adaptor-related protein complex 1, mu 1 subunit (Clathrin coat assembly protein AP47) (Clathrin coat associated protein AP47) (Golgi adaptor AP-1 47 kDa protein) (HA1 47 kDa subunit) (Clathrin assembly protein assembly protein complex 1 medium chain);

Seq ID: 610; Accession: P27644; Swissprot_id: PGLR_AGRTU; Gi_number: 129937; Description: POLYGALACTURONASE (PECTINASE) (PGL);

Seq ID: 611; Accession: P55180; Swissprot_id: GALE_BACSU; Gi_number: 1730193; Description: UDP-glucose 4-epimerase (Galactowaldenase) (UDP-galactose 4-epimerase);

Seq ID: 612; Accession: P47179; Swissprot_id: DAN4_YEAST; Gi_number: 1352944; Description: Cell wall protein DAN4 precursor;

Seq ID: 613; Accession: P40124; Swissprot_id: CAP1_MOUSE; Gi_number: 729032; Description: ADENYLYL CYCLASE-ASSOCIATED PROTEIN 1 (CAP 1);

Seq ID: 614; Accession: P26368; Swissprot_id: U2AF_HUMAN; Gi_number: 267188; Description: Splicing factor U2AF 65 kDa subunit (U2 auxiliary factor 65 kDa subunit) (U2 SNRNP auxiliary factor large subunit);

Seq ID: 615; Accession: P57604; Swissprot_id: AROB_BUCAI; Gi_number: 11131261; Description: 3-dehydroquinate synthase;

Seq ID: 616; Accession: O04111; Swissprot_id: CHSY_PERFR; Gi_number: 5921781; Description: CHALCONE SYNTHASE (NARINGENIN-CHALCONE SYNTHASE);

Seq ID: 618; Accession: P35336; Swissprot_id: PGLR_ACTCH; Gi_number: 548488; Description: Polygalacturonase precursor (PG) (Pectinase);

Seq ID: 620; Accession: P29599; Swissprot_id: SUBB_BACLE; Gi_number: 267046; Description: SUBTILISIN BL (ALKALINE PROTEASE);

Seq ID: 623; Accession: P43588; Swissprot_id: MPR1_YEAST; Gi_number: 1171012; Description: Proteasome regulatory subunit RPN11 (MPR1 protein);

Seq ID: 624; Accession: P34547; Swissprot_id: UBPX_CAEEL; Gi_number: 14917050; Description: Probable ubiquitin carboxyl-terminal hydrolase R10E11.3 (Ubiquitin thiolesterase) (Ubiquitin-specific processing protease) (Deubiquitinating enzyme);

Seq ID: 625; Accession: Q9LHA4; Swissprot_id: V0D2_ARATH; Gi_number: 12585471; Description: Probable vacuolar ATP synthase subunit d 2 (V-ATPase d subunit 2) (Vacuolar proton pump d subunit 2);

Seq ID: 627; Accession: Q9H$_2$C0; Swissprot_id: GAN_HUMAN; Gi_number: 13626745; Description: Gigaxonin;

Seq ID: 631; Accession: P32323; Swissprot_id: AGA1_YEAST; Gi_number: 416592; Description: A-AGGLUTININ ATTACHMENT SUBUNIT PRECURSOR;

Seq ID: 633; Accession: P23246; Swissprot_id: SFPQ_HUMAN; Gi_number: 1709851; Description: SPLICING FACTOR, PROLINE-AND GLUTAMINE-RICH (POLYPYRIMIDINE TRACT-BINDING PROTEIN-ASSOCIATED SPLICING FACTOR) (PTB-ASSOCIATED SPLICING FACTOR) (PSF) (DNA-BINDING P52/P100 COMPLEX, 100 KDA SUBUNIT);

Seq ID: 635; Accession: Q40687; Swissprot_id: GBB_ORYSA; Gi_number: 3023843; Description: GUANINE NUCLEOTIDE-BINDING PROTEIN BETA SUBUNIT;

Seq ID: 636; Accession: P23950; Swissprot_id: TISB_MOUSE; Gi_number: 135863; Description: Butyrate response factor 1 (TIS11B protein);

Seq ID: 637; Accession: O43502; Swissprot_id: R51C_HUMAN; Gi_number: 3914534; Description: DNA repair protein RAD51 homolog 3;

Seq ID: 638; Accession: P23902; Swissprot_id: FABB_HORVU; Gi_number: 119784; Description: 3-oxoacyl-[acyl-carrier-protein] synthase I, chloroplast precursor (Beta-ketoacyl-ACP synthase I) (KAS I);

Seq ID: 639; Accession: P24074; Swissprot_id: RECA_RHILV; Gi_number: 132236; Description: RecA protein (Recombinase A);

Seq ID: 640; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 641; Accession: Q09172; Swissprot_id: P2C2_SCHPO; Gi_number: 1171963; Description: PROTEIN PHOSPHATASE 2C HOMOLOG 2 (PP2C-2);

Seq ID: 642; Accession: P25010; Swissprot_id: CG2A_DAUCA; Gi_number: 116167; Description: G2/MITOTIC-SPECIFIC CYCLIN C13-1 (A-LIKE CYCLIN);

Seq ID: 643; Accession: Q9Y5K3; Swissprot_id: CTPU_HUMAN; Gi_number: 12643330; Description: CHOLINE-PHOSPHATE CYTIDYLYLTRANSFERASE B (PHOSPHORYLCHOLINE TRANSFERASE B) (CTP:PHOSPHOCHOLINE CYTIDYLYLTRANSFERASE B) (CT B) (CCT B) (CCT-BETA);

Seq ID: 644; Accession: Q92373; Swissprot_id: RFA2_SCHPO; Gi_number: 2498849; Description: Replication factor-A protein 2 (Single-stranded DNA-binding protein P30 subunit);

Seq ID: 645; Accession: P15705; Swissprot_id: STI1_YEAST; Gi_number: 134975; Description: HEAT SHOCK PROTEIN STI1;

Seq ID: 646; Accession: P50160; Swissprot_id: TS2_MAIZE; Gi_number: 1717794; Description: SEX DETERMINATION PROTEIN TASSELSEED 2;

Seq ID: 647; Accession: Q9Y2U8; Swissprot_id: MAN1_HUMAN; Gi_number: 13629600; Description: INNER NUCLEAR MEMBRANE PROTEIN MAN1;

Seq ID: 648; Accession: Q9ZCV3; Swissprot_id: RL25_RICPR; Gi_number: 6225985; Description: Probable 50S ribosomal protein L25;

Seq ID: 649; Accession: Q9GZU7; Swissprot_id: NIF3_HUMAN; Gi_number: 17865510; Description: Nuclear LIM interactor-interacting factor 3 (NLI-interacting factor 3) (NLI-IF);

Seq ID: 650; Accession: P46573; Swissprot_id: APKB_ARATH; Gi_number: 12644274; Description: PROTEIN KINASE APK1B;

Seq ID: 652; Accession: P29383; Swissprot_id: AGL3_ARATH; Gi_number: 3915599; Description: AGAMOUS-LIKE MADS BOX PROTEIN AGL3;

Seq ID: 653; Accession: P32679; Swissprot_id: NFI_ECOLI; Gi_number: 2506912; Description: Endonuclease V (Deoxyinosine 3'endonuclease);

Seq ID: 654; Accession: P29675; Swissprot_id: TSF3_HELAN; Gi_number: 267177; Description: POLLEN SPECIFIC PROTEIN SF3;

Seq ID: 656; Accession: P36520; Swissprot_id: RM10_YEAST; Gi_number: 1710599; Description: 60S RIBOSOMAL PROTEIN L10, MITOCHONDRIAL PRECURSOR (YML10);

Seq ID: 657; Accession: O48556; Swissprot_id: IPYR_MAIZE; Gi_number: 4033424; Description: Soluble inorganic pyrophosphatase (Pyrophosphate phosphohydrolase) (PPase);

Seq ID: 658; Accession: P52565; Swissprot_id: GDIR_HUMAN; Gi_number: 1707892; Description: Rho GDP-dissociation inhibitor 1 (Rho GDI 1) (Rho-GDI alpha);

Seq ID: 659; Accession: P29834; Swissprot_id: GRP2_ORYSA; Gi_number: 232183; Description: GLYCINE-RICH CELL WALL STRUCTURAL PROTEIN 2 PRECURSOR;

Seq ID: 660; Accession: O81263; Swissprot_id: KITH_ORYSA; Gi_number: 7674094; Description: Thymidine kinase;

Seq ID: 661; Accession: P03211; Swissprot_id: EBN1_EBV; Gi_number: 119110; Description: EBNA-1 NUCLEAR PROTEIN;

Seq ID: 662; Accession: P28968; Swissprot_id: VGLX_HSVEB; Gi_number: 138350; Description: GLYCOPROTEIN X PRECURSOR;

Seq ID: 663; Accession: P52298; Swissprot_id: CB20_HUMAN; Gi_number: 1705651; Description: 20 KDA NUCLEAR CAP BINDING PROTEIN (NCBP 20 KDA SUBUNIT) (CBP20);

Seq ID: 665; Accession: P33485; Swissprot_id: VNUA_PRVKA; Gi_number: 465445; Description: PROBABLE NUCLEAR ANTIGEN;

Seq ID: 667; Accession: P51109; Swissprot_id: DFRA_MEDSA; Gi_number: 1706375; Description: DIHYDROFLAVONOL-4-REDUCTASE (DFR) (DIHYDROKAEMPFEROL 4-REDUCTASE);

Seq ID: 668; Accession: P33050; Swissprot_id: C13_MAIZE; Gi_number: 416731; Description: Pollen specific protein C13 precursor;

Seq ID: 669; Accession: O04003; Swissprot_id: LG1_MAIZE; Gi_number: 6016502; Description: LIGULELESS1 PROTEIN;

Seq ID: 670; Accession: Q9LJ98; Swissprot_id: PFD2_ARATH; Gi_number: 12230458; Description: Probable prefoldin subunit 2;

Seq ID: 672; Accession: P23535; Swissprot_id: E13B_PHAVU; Gi_number: 119006; Description: GLUCAN ENDO-1,3-BETA-GLUCOSIDASE, BASIC ISOFORM ((1→3)-BETA-GLUCAN ENDOHYDROLASE) ((1→3)-BETA-GLUCANASE) (BETA-1,3-ENDOGLUCANASE);

Seq ID: 674; Accession: P08799; Swissprot_id: MYS2_DICDI; Gi_number: 127774; Description: Myosin II heavy chain, non muscle;

Seq ID: 675; Accession: Q9Y5K1; Swissprot_id: SP11_HUMAN; Gi_number: 7674367; Description: SPO11 protein homolog;

Seq ID: 676; Accession: Q63003; Swissprot_id: 5E5_RAT; Gi_number: 2498095; Description: 5E5 ANTIGEN;

Seq ID: 677; Accession: O42354; Swissprot_id: MDM2_BRARE; Gi_number: 8472496; Description: Ubiquitin-protein ligase E3 Mdm2 (P53-binding protein Mdm2) (Double minute 2 protein);

Seq ID: 678; Accession: O43516; Swissprot_id: WAIP_HUMAN; Gi_number: 13124642; Description: WISKOTT-ALDRICH SYNDROME PROTEIN INTERACTING PROTEIN (WASP INTERACTING PROTEIN) (PRPL-2 PROTEIN);

Seq ID: 680; Accession: P12978; Swissprot_id: EBN2_EBV; Gi_number: 119111; Description: EBNA-2 NUCLEAR PROTEIN;

Seq ID: 682; Accession: P09789; Swissprot_id: GRP1_PETHY; Gi_number: 121627; Description: GLYCINE-RICH CELL WALL STRUCTURAL PROTEIN 1 PRECURSOR;

Seq ID: 683; Accession: P82659; Swissprot_id: THGF_HELAN; Gi_number: 11387188; Description: Flower-specific gamma-thionin precursor (Defensin SD2);

Seq ID: 684; Accession: P48731; Swissprot_id: ATH1_ARATH; Gi_number: 1351999; Description: Homeobox protein ATH1;

Seq ID: 686; Accession: P52409; Swissprot_id: E13B_WHEAT; Gi_number: 1706551; Description: GLUCAN ENDO-1,3-BETA-GLUCOSIDASE PRECURSOR ((1→3)-BETA-GLUCAN ENDOHYDROLASE) ((1→3)-BETA-GLUCANASE) (BETA-1,3-ENDOGLUCANASE);

Seq ID: 688; Accession: Q02224; Swissprot_id: CENE_HUMAN; Gi_number: 399227; Description: CENTROMERIC PROTEIN E (CENP-E PROTEIN);

Seq ID: 690; Accession: P41892; Swissprot_id: CC7_SCHPO; Gi_number: 1168817; Description: Cell division control protein 7;

Seq ID: 691; Accession: Q9NYV4; Swissprot_id: CRK7_HUMAN; Gi_number: 12643825; Description:

CELL DIVISION CYCLE 2-RELATED PROTEIN KINASE 7 (CDC2-RELATED PROTEIN KINASE 7) (CRKRS);

Seq ID: 692; Accession: Q02224; Swissprot_id: CENE_HUMAN; Gi_number: 399227; Description: CENTROMERIC PROTEIN E (CENP-E PROTEIN);

Seq ID: 693; Accession: Q27991; Swissprot_id: MYHA_BOVIN; Gi_number: 13431706; Description: Myosin heavy chain, nonmuscle type B (Cellular myosin heavy chain, type B) (Nonmuscle myosin heavy chain-B) (NM-MHC-B);

Seq ID: 694; Accession: P04265; Swissprot_id: K2C2_XENLA; Gi_number: 125099; Description: Keratin, type II cytoskeletal I (Clone PUF164);

Seq ID: 695; Accession: P17180; Swissprot_id: PER3_ARMRU; Gi_number: 129812; Description: Peroxidase C3 precursor;

Seq ID: 696; Accession: Q02224; Swissprot_id: CENE_HUMAN; Gi_number: 399227; Description: CENTROMERIC PROTEIN E (CENP-E PROTEIN);

Seq ID: 697; Accession: P54274; Swissprot_id: TRF1_HUMAN; Gi_number: 2507149; Description: Telomeric repeat binding factor 1;

Seq ID: 698; Accession: O50044; Swissprot_id: KDSA_PEA; Gi_number: 6647535; Description: 2-DEHYDRO-3-DEOXYPHOSPHOOCTONATE ALDOLASE (PHOSPHO-2-DEHYDRO-3-DEOXYOCTONATE ALDOLASE) (3-DEOXY-D-MANNO-OCTULOSONIC ACID 8-PHOSPHATE SYNTHETASE) (KDO-8-PHOSPHATE SYNTHETASE) (KDO 8-P SYNTHASE);

Seq ID: 699; Accession: P04323; Swissprot_id: POL3_DROME; Gi_number: 130405; Description: Retrovirus-related Pol polyprotein from transposon 17.6 [Contains: Protease; Reverse transcriptase; Endonuclease];

Seq ID: 700; Accession: Q41853; Swissprot_id: RSH1_MAIZE; Gi_number: 3024577; Description: HOMEOBOX PROTEIN ROUGH SHEATH 1;

Seq ID: 701; Accession: P28968; Swissprot_id: VGLX_HSVEB; Gi_number: 138350; Description: GLYCOPROTEIN X PRECURSOR;

Seq ID: 703; Accession: P28968; Swissprot_id: VGLX_HSVEB; Gi_number: 138350; Description: GLYCOPROTEIN X PRECURSOR;

Seq ID: 704; Accession: P04634; Swissprot_id: LIPG_RAT; Gi_number: 126307; Description: TRIACYLGLYCEROL LIPASE, LINGUAL PRECURSOR (LINGUAL LIPASE);

Seq ID: 705; Accession: O24475; Swissprot_id: TSD1_ABIGR; Gi_number: 17367924; Description: Pinene synthase, chloroplast precursor (Beta-geraniolene synthase) ((−)-(1S,5S)-pinene synthase);

Seq ID: 706; Accession: P15233; Swissprot_id: PERC_ARMRU; Gi_number: 129816; Description: Peroxidase C1C precursor;

Seq ID: 707; Accession: Q02817; Swissprot_id: MUC2_HUMAN; Gi_number: 2506877; Description: MUCIN 2 PRECURSOR (INTESTINAL MUCIN 2);

Seq ID: 708; Accession: O57593; Swissprot_id: SUR1_FUGRU; Gi_number: 6094369; Description: SURFEIT LOCUS PROTEIN 1;

Seq ID: 710; Accession: Q9JK11; Swissprot_id: RTN4_RAT; Gi_number: 17367410; Description: Reticulon 4 (Neurite outgrowth inhibitor) (Nogo protein) (Foocen) (Glut4 vesicle 20 kDa protein);

Seq ID: 711; Accession: P14328; Swissprot_id: SP96_DICDI; Gi_number: 134780; Description: SPORE COAT PROTEIN SP96;

Seq ID: 713; Accession: O52535; Swissprot_id: CAH_KLEPN; Gi_number: 5915869; Description: Carbonic anhydrase precursor (Carbonate dehydratase);

Seq ID: 714; Accession: P35250; Swissprot_id: AC14_HUMAN; Gi_number: 2507300; Description: ACTIVATOR 1 40 KDA SUBUNIT (REPLICATION FACTOR C 40 KDA SUBUNIT) (A1 40 KDA SUBUNIT) (RF-C 40 KDA SUBUNIT) (RFC40);

Seq ID: 715; Accession: P57078; Swissprot_id: ANR3_HUMAN; Gi_number: 10719883; Description: Serine/threonine-protein kinase ANKRD3 (Ankyrin repeat domain protein 3) (PKC-delta-interacting protein kinase);

Seq ID: 716; Accession: P42768; Swissprot_id: WASP_HUMAN; Gi_number: 1722836; Description: WISKOTT-ALDRICH SYNDROME PROTEIN (WASP);

Seq ID: 717; Accession: Q94915; Swissprot_id: REG2_DROME; Gi_number: 6093951; Description: RHYTHMICALLY EXPRESSED GENE 2 PROTEIN (DREG-2);

Seq ID: 718; Accession: P03211; Swissprot_id: EBN1_EBV; Gi_number: 119110; Description: EBNA-1 NUCLEAR PROTEIN;

Seq ID: 719; Accession: P43214; Swissprot_id: MPP2_PHLPR; Gi_number: 1171009; Description: POLLEN ALLERGEN PHL P 2 PRECURSOR (PHL P II);

Seq ID: 720; Accession: P14947; Swissprot_id: MPL2_LOLPR; Gi_number: 126386; Description: Pollen allergen Lol p 2-A (Lol p II-A);

Seq ID: 721; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 722; Accession: Q9WVK4; Swissprot_id: EHD1_MOUSE; Gi_number: 18203578; Description: EH-domain containing protein 1 (mPAST1);

Seq ID: 723; Accession: P46573; Swissprot_id: APKB_ARATH; Gi_number: 12644274; Description: PROTEIN KINASE APK1B;

Seq ID: 724; Accession: P05790; Swissprot_id: FBOH_BOMMO; Gi_number: 9087216; Description: FIBROIN HEAVY CHAIN PRECURSOR (FIB-H) (H-FIBROIN);

Seq ID: 725; Accession: P41900; Swissprot_id: T2FB_DROME; Gi_number: 1729817; Description: TRANSCRIPTION INITIATION FACTOR IIF, BETA SUBUNIT (TFHIIF-BETA);

Seq ID: 726; Accession: Q9FUD1; Swissprot_id: PROA_ORYSA; Gi_number: 14423855; Description: Profilin A;

Seq ID: 727; Accession: P16265; Swissprot_id: NU3M_MAIZE; Gi_number: 1352562; Description: NADH-UBIQUINONE OXIDOREDUCTASE CHAIN 3;

Seq ID: 728; Accession: P10978; Swissprot_id: POLX_TOBAC; Gi_number: 130582; Description: Retrovirus-related Pol polyprotein from transposon TNT 1-94 [Contains: Protease; Reverse transcriptase; Endonuclease];

Seq ID: 729; Accession: P17840; Swissprot_id: SLS3_BRAOL; Gi_number: 134532; Description: S-locus-specific glycoprotein S13 precursor (SLSG-13);

Seq ID: 730; Accession: P29375; Swissprot_id: RBB2_HUMAN; Gi_number: 1710032; Description: Retinoblastoma-binding protein 2 (RBBP-2);

Seq ID: 731; Accession: P26792; Swissprot_id: INV1_DAUCA; Gi_number: 124712; Description: BETA-FRUCTOFURANOSIDASE, INSOLUBLE ISOENZYME 1

PRECURSOR (SUCROSE-6-PHOSPHATE HYDROLASE 1) (INVERTASE 1) (CELL WALL BETA-FRUCTOSIDASE 1);

Seq ID: 732; Accession: Q60809; Swissprot_id: CNO7_MOUSE; Gi_number: 3219782; Description: CCR4-NOT transcription complex, subunit 7 (CCR4-associated; factor 1) (CAF1);

Seq ID: 734; Accession: O35587; Swissprot_id: TM21_MESAU; Gi_number: 3915123; Description: Transmembrane protein Tmp21 precursor (21 kDa Transmembrane trafficking protein) (Integral membrane protein p23);

Seq ID: 735; Accession: P29675; Swissprot_id: TSF3_HELAN; Gi_number: 267177; Description: POLLEN SPECIFIC PROTEIN SF3;

Seq ID: 738; Accession: P21997; Swissprot_id: SSG-P_VOLCA; Gi_number: 134920; Description: SULFATED SURFACE GLYCOPROTEIN 185 (SSG 185);

Seq ID: 739; Accession: P03211; Swissprot_id: EBN1_EBV; Gi_number: 119110; Description: EBNA-1 NUCLEAR PROTEIN;

Seq ID: 740; Accession: Q9U7E0; Swissprot_id: ATRX_CAEEL; Gi_number: 17367114; Description: Transcriptional regulator ATRX homolog (X-linked nuclear protein-1);

Seq ID: 741; Accession: P00412; Swissprot_id: COX2_MAIZE; Gi_number: 1706052; Description: CYTOCHROME C OXIDASE POLYPEPTIDE II;

Seq ID: 742; Accession: P28284; Swissprot_id: ICP0_HSV2H; Gi_number: 124135; Description: Trans-acting transcriptional protein ICP0 (VMW118 protein);

Seq ID: 745; Accession: P52824; Swissprot_id: KDGT_HUMAN; Gi_number: 1708624; Description: Diacylglycerol kinase, theta (Diglyceride kinase) (DGK-theta) (DAG kinase theta);

Seq ID: 746; Accession: O59816; Swissprot_id: ODP2_SCHPO; Gi_number: 3914192; Description: DIHYDROLIPOAMIDE ACETYLTRANSFERASE COMPONENT OF PYRUVATE DEHYDROGENASE COMPLEX, MITOCHONDRIAL PRECURSOR (E2) (PDC-E2);

Seq ID: 747; Accession: Q9NY64; Swissprot_id: GTR8_HUMAN; Gi_number: 17367002; Description: Solute carrier family 2, facilitated glucose transporter, member 8 (Glucose transporter type 8) (Glucose transporter type X1);

Seq ID: 748; Accession: P54873; Swissprot_id: HMCS_ARATH; Gi_number: 1708236; Description: HYDROXYMETHYLGLUTARYL-COA SYNTHASE (HMG-COA SYNTHASE) (3-HYDROXY-3-METHYLGLUTARYL COENZYME A SYNTHASE);

Seq ID: 749; Accession: Q38997; Swissprot_id: KI10_ARATH; Gi_number: 6166239; Description: SNF1-related protein kinase KIN10 (AKIN10);

Seq ID: 750; Accession: P39958; Swissprot_id: GDI1_YEAST; Gi_number: 729566; Description: SECRETORY PATHWAY GDP DISSOCIATION INHIBITOR;

Seq ID: 751; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 753; Accession: Q00808; Swissprot_id: HET1_PODAN; Gi_number: 3023956; Description: Vegetatible incompatibility protein HET-E-1;

Seq ID: 754; Accession: P21997; Swissprot_id: SSG-P_VOLCA; Gi_number: 134920; Description: SULFATED SURFACE GLYCOPROTEIN 185 (SSG 185);

Seq ID: 755; Accession: P27484; Swissprot_id: GRP2_NICSY; Gi_number: 121631; Description: Glycine-rich protein 2;

Seq ID: 757; Accession: O64748; Swissprot_id: COPE_ARATH; Gi_number: 6647445; Description: Probable coatomer epsilon subunit (Epsilon-coat protein) (Epsilon-COP);

Seq ID: 758; Accession: P40989; Swissprot_id: GLS2_YEAST; Gi_number: 1707982; Description: 1,3-BETA-GLUCAN SYNTHASE COMPONENT GLS2 (1,3-BETA-D-GLUCAN-UDP GLUCOSYLTRANSFERASE);

Seq ID: 760; Accession: P54654; Swissprot_id: CAP_DICDI; Gi_number: 1705592; Description: ADENYLYL CYCLASE-ASSOCIATED PROTEIN (CAP);

Seq ID: 761; Accession: P54927; Swissprot_id: MYO2_LYCES; Gi_number: 1709204; Description: Myo-inositol-1(or 4)-monophosphatase 2 (IMPase 2) (IMP 2) (Inositol monophosphatase 2);

Seq ID: 762; Accession: P38994; Swissprot_id: MSS4_YEAST; Gi_number: 1709144; Description: Probable phosphatidylinositol-4-phosphate 5-kinase MSS4 (1-phosphatidylinositol-4-phosphate kinase) (PIP5K) (PtdIns(4)P-5-kinase) (Diphosphoinositide kinase);

Seq ID: 764; Accession: Q9SWE7; Swissprot_id: VATE_CITLI; Gi_number: 12585492; Description: Vacuolar ATP synthase subunit E (V-ATPase E subunit) (Vacuolar proton pump E subunit) (CLVE-1);

Seq ID: 765; Accession: P22227; Swissprot_id: ZF42_MOUSE; Gi_number: 132461; Description: Zinc finger protein 42 (Zfp-42) (REX-1 protein) (Reduced expression-1 protein);

Seq ID: 766; Accession: P91428; Swissprot_id: COQ4_CAEEL; Gi_number: 3121872; Description: UBIQUINONE BIOSYNTHESIS PROTEIN COQ4 HOMOLOG;

Seq ID: 767; Accession: P16924; Swissprot_id: P4HA_CHICK; Gi_number: 129365; Description: PROLYL 4-HYDROXYLASE ALPHA SUBUNIT;

Seq ID: 768; Accession: P40318; Swissprot_id: SSM4_YEAST; Gi_number: 730835; Description: SSM4 PROTEIN;

Seq ID: 769; Accession: P38546; Swissprot_id: RAN1_LYCES; Gi_number: 585777; Description: GTP-BINDING NUCLEAR PROTEIN RAN1;

Seq ID: 770; Accession: P33050; Swissprot_id: C13_MAIZE; Gi_number: 416731; Description: Pollen specific protein C13 precursor;

Seq ID: 771; Accession: P25071; Swissprot_id: TCH3_ARATH; Gi_number: 17380537; Description: Calmodulin-related protein 3, touch-induced;

Seq ID: 777; Accession: P28968; Swissprot_id: VGLX_HSVEB; Gi_number: 138350; Description: GLYCOPROTEIN X PRECURSOR;

Seq ID: 778; Accession: P10401; Swissprot_id: POLY_DROME; Gi_number: 130583; Description: RETROVIRUS-RELATED POL POLYPROTEIN FROM TRANSPOSON GYPSY [CONTAINS: REVERSE TRANSCRIPTASE; ENDONUCLEASE];

Seq ID: 779; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 781; Accession: P10978; Swissprot_id: POLX_TOBAC; Gi_number: 130582; Description: Retrovirus-related Pol polyprotein from transposon TNT 1-94 [Contains: Protease; Reverse transcriptase; Endonuclease];

Seq ID: 790; Accession: P53776; Swissprot_id: LHX4_MOUSE; Gi_number: 8247937; Description: LIM/HOMEOBOX PROTEIN LHX4;

Seq ID: 791; Accession: O35344; Swissprot_id: IMA3_MOUSE; Gi_number: 3122277; Description: Importin alpha-3 subunit (Karyopherin alpha-3 subunit) (Importin alpha Q2);

Seq ID: 792; Accession: Q01577; Swissprot_id: PKPA_HYBL; Gi_number: 3122617; Description: Serine/threonine protein kinase PKPA;

Seq ID: 793; Accession: P14328; Swissprot_id: SP96_DICDI; Gi_number: 134780; Description: SPORE COAT PROTEIN SP96;

Seq ID: 794; Accession: P53683; Swissprot_id: CDP2_ORYSA; Gi_number: 1705734; Description: Calcium-dependent protein kinase, isoform 2 (CDPK 2);

Seq ID: 795; Accession: P05492; Swissprot_id: ATP0_OENBI; Gi_number: 114408; Description: ATP synthase alpha chain, mitochondrial;

Seq ID: 796; Accession: P30175; Swissprot_id: ADF_LILLO; Gi_number: 231509; Description: Actin-depolymerizing factor (ADF);

Seq ID: 797; Accession: P04146; Swissprot_id: COPI_DROME; Gi_number: 13124684; Description: Copia protein [Contains: Copia VLP protein; Copia protease;];

Seq ID: 798; Accession: P08547; Swissprot_id: LIN1_HUMAN; Gi_number: 126295; Description: LINE-1 REVERSE TRANSCRIPTASE HOMOLOG;

Seq ID: 801; Accession: Q9T074; Swissprot_id: PPCK_ARATH; Gi_number: 12230482; Description: Phosphoenolpyruvate carboxykinase [ATP] (PEP carboxykinase) (Phosphoenolpyruvate carboxylase) (PEPCK);

Seq ID: 802; Accession: Q03663; Swissprot_id: GTX2_TOBAC; Gi_number: 416650; Description: Probable glutathione S-transferase (Auxin-induced protein PGNT35/PCNT111);

Seq ID: 803; Accession: P80884; Swissprot_id: ANAN_ANACO; Gi_number: 13432122; Description: ANANAIN PRECURSOR;

Seq ID: 804; Accession: Q06548; Swissprot_id: APKA_ARATH; Gi_number: 1168470; Description: Protein kinase APK1A;

Seq ID: 805; Accession: P35792; Swissprot_id: PR12_HORVU; Gi_number: 548588; Description: PATHOGENESIS-RELATED PROTEIN PRB1-2 PRECURSOR;

Seq ID: 806; Accession: P27349; Swissprot_id: GOS9_ORYSA; Gi_number: 121528; Description: GOS9 PROTEIN;

Seq ID: 807; Accession: O43374; Swissprot_id: RSG5_HUMAN; Gi_number: 13959542; Description: RAS-GAP-ACTIVATING-LIKE PROTEIN 2;

Seq ID: 809; Accession: P29834; Swissprot_id: GRP2_ORYSA; Gi_number: 232183; Description: GLYCINE-RICH CELL WALL STRUCTURAL PROTEIN 2 PRECURSOR;

Seq ID: 810; Accession: Q03460; Swissprot_id: GLSN_MEDSA; Gi_number: 417073; Description: Glutamate synthase [NADH], chloroplast precursor (NADH-GOGAT);

Seq ID: 811; Accession: O23731; Swissprot_id: CHS8_BROFI; Gi_number: 5921766; Description: CHALCONE SYNTHASE 8 (NARINGENIN-CHALCONE SYNTHASE 8);

Seq ID: 812; Accession: Q99758; Swissprot_id: ABC3_HUMAN; Gi_number: 7387524; Description: ATP-binding cassette, sub-family A, member 3 (ATP-binding cassette transporter 3) (ATP-binding cassette 3) (ABC-C transporter);

Seq ID: 813; Accession: P29250; Swissprot_id: LOX2_ORYSA; Gi_number: 126401; Description: LIPOXYGENASE L-2;

Seq ID: 815; Accession: P13650; Swissprot_id: DHGB_ACICA; Gi_number: 118560; Description: Glucose dehydrogenase-B [pyrroloquinoline-quinone] precursor;

Seq ID: 816; Accession: Q06915; Swissprot_id: EA6_ARATH; Gi_number: 1169451; Description: Probable glucan endo-1,3-beta-glucosidase A6 precursor ((1→3)-beta-glucan endohydrolase) ((1→3)-beta-glucanase) (Beta-1,3-endoglucanase) (Anther-specific protein A6);

Seq ID: 817; Accession: P52420; Swissprot_id: PUR2_ARATH; Gi_number: 12644306; Description: Phosphoribosylamine-glycine ligase, chloroplast precursor (GARS) (Glycinamide ribonucleotide synthetase) (Phosphoribosylglycinamide synthetase);

Seq ID: 818; Accession: Q07176; Swissprot_id: MMK1_MEDSA; Gi_number: 585519; Description: MITOGEN-ACTIVATED PROTEIN KINASE HOMOLOG MMK1 (MAP KINASE MSK7) (MAP KINASE ERK1);

Seq ID: 819; Accession: P11965; Swissprot_id: PERX_TOBAC; Gi_number: 129837; Description: Lignin forming anionic peroxidase precursor;

Seq ID: 820; Accession: P19135; Swissprot_id: PER2_CUCSA; Gi_number: 129810; Description: Peroxidase 2;

Seq ID: 821; Accession: P51614; Swissprot_id: CHIA_VITVI; Gi_number: 1705812; Description: ACIDIC ENDOCHITINASE PRECURSOR;

Seq ID: 822; Accession: Q9SYQ8; Swissprot_id: CLV1_ARATH; Gi_number: 12643323; Description: RECEPTOR PROTEIN KINASE CLAVATA1 PRECURSOR;

Seq ID: 823; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 824; Accession: P24021; Swissprot_id: NUS1_ASPOR; Gi_number: 128912; Description: NUCLEASE S1 (ENDONUCLEASE S1) (SINGLE-STRANDED-NUCLEATE ENDONUCLEASE) (DEOXYRIBONUCLEASE S1);

Seq ID: 825; Accession: Q01577; Swissprot_id: PKPA_PHYBL; Gi_number: 3122617; Description: Serine/threonine protein kinase PKPA;

Seq ID: 826; Accession: P80073; Swissprot_id: MYB2_PHYPA; Gi_number: 462669; Description: Myb-related protein Pp2;

Seq ID: 827; Accession: Q9ZT66; Swissprot_id: E134_MAIZE; Gi_number: 8928122; Description: Endo-1,3;1,4-beta-D-glucanase precursor;

Seq ID: 828; Accession: P77258; Swissprot_id: NEMA_ECOLI; Gi_number: 2499420; Description: N-ethylmaleimide reductase (N-ethylmaleimide reducing enzyme);

Seq ID: 829; Accession: P93329; Swissprot_id: NO20_MEDTR; Gi_number: 3914142; Description: EARLY NODULIN 20 PRECURSOR (N-20);

Seq ID: 830; Accession: P12653; Swissprot_id: GTH1_MAIZE; Gi_number: 121695; Description: GLUTATHIONE S-TRANSFERASE I (GST-I) (GST-29) (GST CLASS-PHI);

Seq ID: 831; Accession: P37835; Swissprot_id: PER2_ORYSA; Gi_number: 585662; Description: Peroxidase precursor;

Seq ID: 832; Accession: P08995; Swissprot_id: NO26_SOYBN; Gi_number: 1352509; Description: NODULIN-26 (N-26);

Seq ID: 833; Accession: O75880; Swissprot_id: SCO1_HUMAN; Gi_number: 8134663; Description: SCO1 protein homolog, mitochondrial precursor;

Seq ID: 834; Accession: Q05968; Swissprot_id: PR1_HORVU; Gi_number: 548592; Description: PATHOGENESIS-RELATED PROTEIN 1 PRECURSOR;

Seq ID: 835; Accession: P28814; Swissprot_id: BAR-W_HORVU; Gi_number: 114832; Description: Barwin;

Seq ID: 836; Accession: P07084; Swissprot_id: IBBR_ORYSA; Gi_number: 6166242; Description: BOWMAN-BIRK TYPE BRAN TRYPSIN INHIBITOR PRECURSOR (RBTI) (OSE727A);

Seq ID: 839; Accession: P29834; Swissprot_id: GRP2_ORYSA; Gi_number: 232183; Description: GLYCINE-RICH CELL WALL STRUCTURAL PROTEIN 2 PRECURSOR;

Seq ID: 841; Accession: O14727; Swissprot_id: APAF_HUMAN; Gi_number: 3023307; Description: Apoptotic protease activating factor 1 (Apaf-1);

Seq ID: 842; Accession: P35816; Swissprot_id: PDP1_BOVIN; Gi_number: 548465; Description: [Pyruvate dehydrogenase [Lipoamide]]-phosphatase 1, mitochondrial precursor (PDP 1) (Pyruvate dehydrogenase phosphatase, catalytic subunit 1) (PDPC 1);

Seq ID: 843; Accession: P32839; Swissprot_id: BCS1_YEAST; Gi_number: 2506091; Description: BCS1 PROTEIN;

Seq ID: 844; Accession: P46573; Swissprot_id: APKB_ARATH; Gi_number: 12644274; Description: PROTEIN KINASE APK1B;

Seq ID: 845; Accession: P10496; Swissprot_id: GRP2_PHAVU; Gi_number: 121632; Description: GLYCINE-RICH CELL WALL STRUCTURAL PROTEIN 1.8 PRECURSOR (GRP 1.8);

Seq ID: 846; Accession: P39881; Swissprot_id: CUT1_CANFA; Gi_number: 729093; Description: CCAAT displacement protein (Homeobox protein Clox) (Clox-1);

Seq ID: 847; Accession: O42690; Swissprot_id: CDR3_CANAL; Gi_number: 5921713; Description: OPAQUE-SPECIFIC ABC TRANSPORTER CDR3;

Seq ID: 848; Accession: P08183; Swissprot_id: MDR1_HUMAN; Gi_number: 2506118; Description: MULTIDRUG RESISTANCE PROTEIN 1 (P-GLYCOPROTEIN 1);

Seq ID: 849; Accession: P21997; Swissprot_id: SSG-P_VOLCA; Gi_number: 134920; Description: SULFATED SURFACE GLYCOPROTEIN 185 (SSG 185);

Seq ID: 850; Accession: O15254; Swissprot_id: CAO3_HUMAN; Gi_number: 17366151; Description: Acyl-coenzyme A oxidase 3, peroxisomal (Pristanoyl-CoA oxidase);

Seq ID: 851; Accession: P13983; Swissprot_id: EXTN_TOBAC; Gi_number: 119714; Description: Extensin precursor (Cell wall hydroxyproline-rich glycoprotein);

Seq ID: 852; Accession: Q9SYQ8; Swissprot_id: CLV1_ARATH; Gi_number: 12643323; Description: RECEPTOR PROTEIN KINASE CLAVATA1 PRECURSOR;

Seq ID: 853; Accession: P05522; Swissprot_id: GUN1_PERAE; Gi_number: 121784; Description: ENDOGLUCANASE 1 PRECURSOR (ENDO-1,4-BETA-GLUCANASE) (ABSCISSION CELLULASE 1);

Seq ID: 854; Accession: P43293; Swissprot_id: NAK_ARATH; Gi_number: 1171642; Description: Probable serine/threonine-protein kinase NAK;

Seq ID: 855; Accession: P54646; Swissprot_id: AAK2_HUMAN; Gi_number: 1703035; Description: 5'-AMP-activated protein kinase, catalytic alpha-2 chain (AMPK alpha-2 chain);

Seq ID: 856; Accession: P34106; Swissprot_id: ALA2_PANMI; Gi_number: 461498; Description: ALANINE AMINOTRANSFERASE 2 (GPT) (GLUTAMIC-PYRUVIC TRANSAMINASE 2) (GLUTAMIC-ALANINE TRANSAMINASE 2) (ALAAT-2);

Seq ID: 858; Accession: P10056; Swissprot_id: PAP3_CARPA; Gi_number: 1709574; Description: Caricain precursor (Papaya proteinase omega) (Papaya proteinase III) (PPIII) (Papaya peptidase A);

Seq ID: 859; Accession: P28968; Swissprot_id: VGLX_HSVEB; Gi_number: 138350; Description: GLYCOPROTEIN X PRECURSOR;

Seq ID: 860; Accession: O70579; Swissprot_id: PM34_MOUSE; Gi_number: 12585304; Description: Peroxisomal membrane protein PMP34 (34 kDa peroxisomal membrane protein) (Solute carrier family 25, member 17);

Seq ID: 861; Accession: Q95107; Swissprot_id: WASL_BOVIN; Gi_number: 13431968; Description: Neural Wiskott-Aldrich syndrome protein (N-WASP);

Seq ID: 862; Accession: P23923; Swissprot_id: HBPB_WHEAT; Gi_number: 122772; Description: TRANSCRIPTION FACTOR HBP-1B;

Seq ID: 865; Accession: P81214; Swissprot_id: CARP_SYNRA; Gi_number: 5915874; Description: SYNCEPHAPEPSIN PRECURSOR;

Seq ID: 866; Accession: O75317; Swissprot_id: UBP-C_HUMAN; Gi_number: 6707738; Description: Ubiquitin carboxyl-terminal hydrolase 12 (Ubiquitin thiolesterase 12) (Ubiquitin-specific processing protease 12) (Deubiquitinating enzyme 12) (Ubiquitin hydrolyzing enzyme 1);

Seq ID: 868; Accession: P16273; Swissprot_id: PRPX_HORVU; Gi_number: 1346809; Description: PATHOGEN-RELATED PROTEIN;

Seq ID: 869; Accession: Q43295; Swissprot_id: KAP1_ARATH; Gi_number: 7387811; Description: Adenylylsulfate kinase 1, chloroplast precursor (APS kinase) (Adenosine-5'phosphosulfate kinase) (ATP adenosine-5'-phosphosulfate 3'-phosphotransferase);

Seq ID: 870; Accession: P08393; Swissprot_id: ICP0_HSV11; Gi_number: 124134; Description: Trans-acting transcriptional protein ICP0 (Immediate-early protein IE110) (VMW110) (Alpha-0 protein);

Seq ID: 872; Accession: P40616; Swissprot_id: ARL1_HUMAN; Gi_number: 728888; Description: ADP-RIBOSYLATION FACTOR-LIKE PROTEIN 1;

Seq ID: 874; Accession: P35135; Swissprot_id: UBC4_LYCES; Gi_number: 464981; Description: UBIQUITIN-CONJUGATING ENZYME E2-17 KD (UBIQUITIN-PROTEIN LIGASE) (UBIQUITIN CARRIER PROTEIN);

Seq ID: 876; Accession: Q00765; Swissprot_id: DP1_HUMAN; Gi_number: 232007; Description: POLYPOSIS LOCUS PROTEIN 1 (TB2 PROTEIN);

Seq ID: 877; Accession: Q9NZW4; Swissprot_id: DSP-P_HUMAN; Gi_number: 17865470; Description: Dentin sialophosphoprotein precursor [Contains: Dentin phosphoprotein (Dentin phosphophoryn) (DPP); Dentin sialoprotein (DSP)];

Seq ID: 878; Accession: P21997; Swissprot_id: SSGP_VOLCA; Gi_number: 134920; Description: SULFATED SURFACE GLYCOPROTEIN 185 (SSG 185);

Seq ID: 881; Accession: P43293; Swissprot_id: NAK_ARATH; Gi_number: 1171642; Description: Probable serine/threonine-protein kinase NAK;

Seq ID: 882; Accession: P27164; Swissprot_id: CAL3_PETHY; Gi_number: 115492; Description: CALMODULIN-RELATED PROTEIN;

Seq ID: 883; Accession: P11675; Swissprot_id: IE18_PRVIF; Gi_number: 124178; Description: IMMEDIATE-EARLY PROTEIN IE180;

Seq ID: 884; Accession: O52535; Swissprot_id: CAH_KLEPN; Gi_number: 5915869; Description: Carbonic anhydrase precursor (Carbonate dehydratase);

Seq ID: 885; Accession: O64637; Swissprot_id: C7C2_ARATH; Gi_number: 5915832; Description: Cytochrome P450 76C2;

Seq ID: 886; Accession: P10978; Swissprot_id: POLX_TOBAC; Gi_number: 130582; Description: Retrovirus-related Pol polyprotein from transposon TNT 1-94 [Contains: Protease; Reverse transcriptase; Endonuclease];

Seq ID: 887; Accession: P06795; Swissprot_id: MDR1_MOUSE; Gi_number: 126927; Description: Multidrug resistance protein 1 (P-glycoprotein 1);

Seq ID: 888; Accession: P51533; Swissprot_id: PDRA_YEAST; Gi_number: 1709621; Description: ATP-dependent permease PDR10;

Seq ID: 889; Accession: P22817; Swissprot_id: IDE_DROME; Gi_number: 124156; Description: INSULIN-DEGRADING ENZYME (INSULYSIN) (INSULINASE) (INSULIN PROTEASE);

Seq ID: 890; Accession: O22060; Swissprot_id: SPS1_CITUN; Gi_number: 3915023; Description: SUCROSE-PHOSPHATE SYNTHASE 1 (UDP-GLUCOSE-FRUCTOSE-PHOSPHATE GLUCOSYLTRANSFERASE 1);

Seq ID: 891; Accession: O81108; Swissprot_id: ACA2_ARATH; Gi_number: 12229639; Description: Calcium-transporting ATPase 2, plasma membrane-type (Ca2+-ATPase, isoform 2);

Seq ID: 893; Accession: Q9S7J8; Swissprot_id: AHM5_ARATH; Gi_number: 12229667; Description: Copper-transporting ATPase RAN1 (Responsive-to-antagonist; 1);

Seq ID: 894; Accession: Q07158; Swissprot_id: TPS1_KLULA; Gi_number: 586113; Description: ALPHA, ALPHA-TREHALOSE-PHOSPHATE SYNTHASE [UDP-FORMING] 56 KD SUBUNIT (TREHALOSE-6-PHOSPHATE SYNTHASE) (UDP-GLUCOSE-GLUCOSEPHOSPHATE GLUCOSYLTRANSFERASE);

Seq ID: 895; Accession: P93400; Swissprot_id: PLD_TOBAC; Gi_number: 3914361; Description: PHOSPHOLIPASE D PRECURSOR (PLD) (CHOLINE PHOSPHATASE) (PHOSPHATIDYLCHOLINE-HYDROLYZING PHOSPHOLIPASE D);

Seq ID: 896; Accession: P49608; Swissprot_id: ACOC_CUCMA; Gi_number: 1351856; Description: ACONITATE HYDRATASE, CYTOPLASMIC (CITRATE HYDRO-LYASE) (ACONITASE);

Seq ID: 897; Accession: P22817; Swissprot_id: IDE_DROME; Gi_number: 124156; Description: INSULIN-DEGRADING ENZYME (INSULYSIN) (INSULINASE) (INSULIN PROTEASE);

Seq ID: 898; Accession: P49333; Swissprot_id: ETR1_ARATH; Gi_number: 1352397; Description: ETR1 protein;

Seq ID: 899; Accession: P33302; Swissprot_id: PDR5_YEAST; Gi_number: 464819; Description: SUPPRESSOR OF TOXICITY OF SPORIDESMIN;

Seq ID: 900; Accession: P54802; Swissprot_id: ANAG_HUMAN; Gi_number: 1703303; Description: Alpha-N-acetylglucosaminidase precursor (N-acetyl-alpha-glucosaminidase) (NAG);

Seq ID: 901; Accession: P29141; Swissprot_id: SUBV_BACSU; Gi_number: 135023; Description: Minor extracellular protease VPR precursor;

Seq ID: 902; Accession: P53681; Swissprot_id: CRK_DAUCA; Gi_number: 1706130; Description: CDPK-related protein kinase (PK421);

Seq ID: 903; Accession: P46401; Swissprot_id: BCCA_MYCTU; Gi_number: 1168278; Description: Acetyl-/propionyl-coenzyme A carboxylase alpha chain [Includes: Biotin carboxylase; Biotin carboxyl carrier protein (BCCP)];

Seq ID: 904; Accession: Q02779; Swissprot_id: M3KA_HUMAN; Gi_number: 6686295; Description: MITOGEN-ACTIVATED PROTEIN KINASE KINASE KINASE 10 (MIXED LINEAGE KINASE 2) (PROTEIN KINASE MST);

Seq ID: 906; Accession: Q06850; Swissprot_id: CDP1_ARATH; Gi_number: 729092; Description: Calcium-dependent protein kinase, isoform AKI (CDPK);

Seq ID: 907; Accession: P48422; Swissprot_id: C861_ARATH; Gi_number: 13878905; Description: Cytochrome P450 86A1 (CYPLXXXVI) (P450-dependent fatty acid omega-hydroxylase);

Seq ID: 908; Accession: P25297; Swissprot_id: PH84_YEAST; Gi_number: 1346710; Description: INORGANIC PHOSPHATE TRANSPORTER PHO84;

Seq ID: 909; Accession: P16157; Swissprot_id: ANK1_HUMAN; G1 number: 113884; Description: Ankyrin 1 (Erythrocyte ankyrin) (Ankyrin R);

Seq ID: 910; Accession: P46032; Swissprot_id: PT2B_ARATH; Gi_number: 1172704; Description: Peptide transporter PTR2-B (Histidine transporting protein);

Seq ID: 911; Accession: P26514; Swissprot_id: XYNA_STRLI; Gi_number: 6226911; Description: ENDO-1,4-BETA-XYLANASE A PRECURSOR (XYLANASE A) (1,4-BETA-D-XYLAN XYLANOHYDROLASE A);

Seq ID: 912; Accession: Q02775; Swissprot_id: SLU7_YEAST; Gi_number: 401091; Description: PRE-MRNA SPLICING FACTOR SLU7;

Seq ID: 913; Accession: Q04468; Swissprot_id: TCMO_HELTU; Gi_number: 417863; Description: TRANS-CINNAMATE 4-MONOOXYGENASE (CINNAMIC ACID 4-HYDROXYLASE) (CA4H) (C4H) (P450C4H) (CYTOCHROME P450 73);

Seq ID: 914; Accession: P55034; Swissprot_id: PSD4_ARATH; Gi_number: 1709794; Description: 26S proteasome regulatory subunit S5A (Multiubiquitin chain binding protein);

Seq ID: 915; Accession: P06782; Swissprot_id: SNF1_YEAST; Gi_number: 134588; Description: CARBON CATABOLITE DEREPRESSING PROTEIN KINASE;

Seq ID: 917; Accession: O64668; Swissprot_id: PSNH_ARATH; Gi_number: 6093852; Description: Presenilin homolog;

Seq ID: 919; Accession: P26300; Swissprot_id: ENO_LYCES; Gi_number: 119354; Description: ENOLASE (2-PHOSPHOGLYCERATE DEHYDRATASE) (2-PHOSPHO-D-GLYCERATE HYDRO-LYASE);

Seq ID: 920; Accession: P37287; Swissprot_id: PIGA_HUMAN; Gi_number: 585696; Description:

N-acetylglucosaminyl-phosphatidylinositol biosynthetic protein (GlcNac-PI synthesis protein) (Phosphatidylinositol-glycan biosynthesis, class A protein) (PIG-A);

Seq ID: 921; Accession: P21997; Swissprot_id: SSGP_VOLCA; Gi_number: 134920; Description: SULFATED SURFACE GLYCOPROTEIN 185 (SSG 185);

Seq ID: 922; Accession: O15269; Swissprot_id: LCB1_HUMAN; Gi_number: 6685579; Description: Serine palmitoyltransferase 1 (Long chain base biosynthesis protein 1) (LCB 1) (Serine-palmitoyl-CoA transferase 1) (SPT 1) (SPT1);

Seq ID: 923; Accession: P13728; Swissprot_id: SGS3_DROYA; G1 number: 134469; Description: Salivary glue protein SGS-3 precursor;

Seq ID: 924; Accession: P93846; Swissprot_id: CP51_SORBI; Gi_number: 5921924; Description: Cytochrome P450 51 (CYPL1) (P450-L1A1) (Obtusifoliol 14-alpha demethylase);

Seq ID: 925; Accession: P70315; Swissprot_id: WASP_MOUSE; Gi_number: 2499130; Description: Wiskott-Aldrich syndrome protein homolog (WASP);

Seq ID: 926; Accession: P13728; Swissprot_id: SGS3_DROYA; Gi_number: 134469; Description: Salivary glue protein SGS-3 precursor;

Seq ID: 927; Accession: P47179; Swissprot_id: DAN4_YEAST; Gi_number: 1352944; Description: Cell wall protein DAN4 precursor;

Seq ID: 928; Accession: Q9UJY5; Swissprot_id: GGA1_HUMAN; Gi_number: 14548066; Description: ADP-RIBOSYLATION FACTOR BINDING PROTEIN GGA1 (GOLGI-LOCALIZED, GAMMA EAR-CONTAINING, ARF-BINDING PROTEIN 1) (GAMMA-ADAPTIN RELATED PROTEIN 1);

Seq ID: 929; Accession: Q02779; Swissprot_id: M3KA_HUMAN; Gi_number: 6686295; Description: MITOGEN-ACTIVATED PROTEIN KINASE KINASE KINASE 10 (MIXED LINEAGE KINASE 2) (PROTEIN KINASE MST);

Seq ID: 930; Accession: P05143; Swissprot_id: PRP3_MOUSE; Gi_number: 131002; Description: PROLINE-RICH PROTEIN MP-3;

Seq ID: 931; Accession: P08548; Swissprot_id: LIN1_NYCCO; Gi_number: 126296; Description: LINE-1 REVERSE TRANSCRIPTASE HOMOLOG;

Seq ID: 932; Accession: P04802; Swissprot_id: SYDC_YEAST; Gi_number: 135100; Description: ASPARTYL-TRNA SYNTHETASE, CYTOPLASMIC (ASPARTATE-TRNA LIGASE) (ASPRS);

Seq ID: 933; Accession: Q9UKL6; Swissprot_id: PPCT_HUMAN; Gi_number: 15214192; Description: PHOSPHATIDYLCHOLINE TRANSFER PROTEIN (PC-TP);

Seq ID: 935; Accession: O13302; Swissprot_id: IDH1_AJECA; Gi_number: 13124301; Description: Isocitrate dehydrogenase [NAD] subunit 1, mitochondrial precursor (Isocitric dehydrogenase) (NAD+-specific ICDH);

Seq ID: 936; Accession: Q27546; Swissprot_id: IUNH_CRIFA; Gi_number: 2497465; Description: INOSINE-URIDINE PREFERRING NUCLEOSIDE HYDROLASE (IU-NUCLEOSIDE HYDROLASE) (PURINE NUCLEOSIDASE);

Seq ID: 937; Accession: P27545; Swissprot_id: LSS1_MOUSE; Gi_number: 137047; Description: Longevity assurance homolog 1 (UOG-1 protein);

Seq ID: 938; Accession: Q02440; Swissprot_id: MY5A_CHICK; Gi_number: 547967; Description: Myosin Va (Myosin 5A) (Dilute myosin heavy chain, non-muscle) (Myosin heavy chain P190) (Myosin-V);

Seq ID: 939; Accession: Q9DCG6; Swissprot_id: PHZ2_MOUSE; Gi_number: 18202860; Description: Probable oxidoreductase 0610038K03Rik;

Seq ID: 940; Accession: P06237; Swissprot_id: NOH4_RHIME; Gi_number: 128469; Description: NODULATION PROTEIN H (HOST-SPECIFICITY OF NODULATION PROTEIN D);

Seq ID: 941; Accession: Q43062; Swissprot_id: PME_PRUPE; Gi_number: 6093744; Description: Pectinesterase PPE8B precursor (Pectin methylesterase) (PE);

Seq ID: 942; Accession: P39101; Swissprot_id: CAJ1_YEAST; Gi_number: 729007; Description: CAJ1 protein;

Seq ID: 943; Accession: P33479; Swissprot_id: IE18_PRVKA; Gi_number: 462387; Description: IMMEDIATE-EARLY PROTEIN IE180;

Seq ID: 944; Accession: Q06136; Swissprot_id: FVT1_HUMAN; Gi_number: 544358; Description: Follicular variant translocation protein 1 precursor (FVT-1);

Seq ID: 945; Accession: P17180; Swissprot_id: PER3_ARMRU; Gi_number: 129812; Description: Peroxidase C3 precursor;

Seq ID: 946; Accession: P48490; Swissprot_id: PP1_PHAVU; Gi_number: 1346765; Description: SERINE/THREONINE PROTEIN PHOSPHATASE PP1;

Seq ID: 948; Accession: P22196; Swissprot_id: PER2_ARAHY; Gi_number: 129808; Description: Cationic peroxidase 2 precursor;

Seq ID: 949; Accession: P57760; Swissprot_id: ST16_RAT; Gi_number: 13124540; Description: Serine/threonine protein kinase 16 (Protein kinase PKL12) (Myristoylated and palmitoylated serine-threonine kinase) (MPSK) (TGF-beta stimulated factor 1) (TSF-1);

Seq ID: 950; Accession: P24289; Swissprot_id: NUP1_PENCI; Gi_number: 128906; Description: NUCLEASE P1 (ENDONUCLEASE P1) (DEOXYRIBONUCLEASE P1);

Seq ID: 951; Accession: P22420; Swissprot_id: VE2—HPV47; Gi_number: 137682; Description: REGULATORY PROTEIN E2;

Seq ID: 953; Accession: Q60715; Swissprot_id: P4H1_MOUSE; Gi_number: 2498740; Description: PROLYL 4-HYDROXYLASE ALPHA-1 SUBUNIT PRECURSOR;

Seq ID: 954; Accession: P78621; Swissprot_id: SEPA_EMENI; Gi_number: 15214279; Description: CYTOKINESIS PROTEIN SEPA (FH1/2 PROTEIN) (FORCED EXPRESSION INHIBITION OF GROWTH A);

Seq ID: 959; Accession: P16273; Swissprot_id: PRPX_HORVU; Gi_number: 1346809; Description: PATHOGEN-RELATED PROTEIN;

Seq ID: 961; Accession: P41151; Swissprot_id: HSF1_ARATH; Gi_number: 12644262; Description: HEAT SHOCK FACTOR PROTEIN 1 (HSF 1) (HEAT SHOCK TRANSCRIPTION FACTOR 1) (HSTF 1);

Seq ID: 962; Accession: Q38841; Swissprot_id: AG12_ARATH; Gi_number: 12643746; Description: Agamous-like MADS box protein AGL12;

Seq ID: 964; Accession: Q9NRA0; Swissprot_id: SPH2_HUMAN; Gi_number: 17369316; Description: Sphingosine kinase 2 (SK 2) (SPK 2);

Seq ID: 965; Accession: P72660; Swissprot_id: LEP1_SYNY3; Gi_number: 6225603; Description: Probable signal peptidase I-1 (SPase I-1) (Leader peptidase I-1);

Seq ID: 966; Accession: P93531; Swissprot_id: C7D7_SOLCH; Gi_number: 5915836; Description: CYTOCHROME P450 71D7;

Seq ID: 968; Accession: P52835; Swissprot_id: F3ST_FLABI; Gi_number: 1706738; Description: FLAVONOL 3-SULFOTRANSFERASE (F3-ST);

Seq ID: 970; Accession: Q06003; Swissprot_id: GOLI_DROME; Gi_number: 462193; Description: Goliath protein (G1 protein);

Seq ID: 971; Accession: Q9ZNV5; Swissprot_id: CEN_ARATH; Gi_number: 17366125; Description: CENTRORADIALIS-like protein;

Seq ID: 972; Accession: Q99090; Swissprot_id: CPR2_PETCR; Gi_number: 2842757; Description: LIGHT-INDUCIBLE PROTEIN CPRF-2;

Seq ID: 974; Accession: Q9MB73; Swissprot_id: LGT_CITUN; Gi_number: 13431605; Description: Limonoid UDP-glucosyltransferase (Limonoid glucosyltransferase) (Limonoid GTase) (LGTase);

Seq ID: 975; Accession: P48809; Swissprot_id: RB27_DROME; Gi_number: 1346955; Description: Heterogeneous nuclear ribonucleoprotein 27C (hnRNP 48) (HRP48.1);

Seq ID: 976; Accession: P13230; Swissprot_id: GRP3_ARTSA; Gi_number: 121634; Description: Glycine-rich protein GRP33;

Seq ID: 977; Accession: P20024; Swissprot_id: MYB1_MAIZE; Gi_number: 127580; Description: Myb-related protein Zm1;

Seq ID: 978; Accession: Q9NVW2; Swissprot_id: RNFB_HUMAN; Gi_number: 13124522; Description: RING FINGER PROTEIN 12 (LIM DOMAIN INTERACTING RING FINGER PROTEIN) (RING FINGER LIM DOMAIN-BINDING PROTEIN) (R-LIM) (NY-REN-43 ANTIGEN);

Seq ID: 979; Accession: P22988; Swissprot_id: LDHA_HORVU; Gi_number: 126033; Description: L-lactate dehydrogenase A (LDH-A);

Seq ID: 980; Accession: P34802; Swissprot_id: GGPP_ARATH; Gi_number: 13432144; Description: GERANYLGERANYL PYROPHOSPHATE SYNTHETASE, CHLOROPLAST PRECURSOR (GGPP SYNTHETASE) (GGPS) [INCLUDES: DIMETHYLALLYLTRANSFERASE; GERANYLTRANSTRANSFERASE; FARNESYLTRANSTRANSFERASE];

Seq ID: 981; Accession: P87146; Swissprot_id: IM22_SCHPO; Gi_number: 3219815; Description: MITOCHONDRIAL IMPORT INNER MEMBRANE TRANSLOCASE SUBUNIT TIM22 HOMOLOG;

Seq ID: 982; Accession: O26934; Swissprot_id: ARGC_METTH; Gi_number: 8927968; Description: N-acetyl-gamma-glutamyl-phosphate reductase (N-acetyl-glutamate semialdehyde dehydrogenase) (NAGSA dehydrogenase);

Seq ID: 983; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 984; Accession: Q02817; Swissprot_id: MUC2_HUMAN; Gi_number: 2506877; Description: MUCIN 2 PRECURSOR (INTESTINAL MUCIN 2);

Seq ID: 985; Accession: O23066; Swissprot_id: C862_ARATH; Gi_number: 5915846; Description: Cytochrome P450 86A2;

Seq ID: 986; Accession: P18583; Swissprot_id: SON_HUMAN; Gi_number: 586013; Description: SON PROTEIN (SON3);

Seq ID: 991; Accession: P19275; Swissprot_id: VTP3_TTV1V; Gi_number: 139655; Description: VIRAL PROTEIN TPX;

Seq ID: 992; Accession: P47735; Swissprot_id: RLK5_ARATH; Gi_number: 1350783; Description: Receptor-like protein kinase 5 precursor;

Seq ID: 994; Accession: P13816; Swissprot_id: GARP_PLAFF; Gi_number: 120943; Description: GLUTAMIC ACID-RICH PROTEIN PRECURSOR;

Seq ID: 995; Accession: P80073; Swissprot_id: MYB2_PHYPA; Gi_number: 462669; Description: Myb-related protein Pp2;

Seq ID: 996; Accession: Q41144; Swissprot_id: STC_RICCO; Gi_number: 3915039; Description: SUGAR CARRIER PROTEIN C;

Seq ID: 997; Accession: P33215; Swissprot_id: NED1_MOUSE; Gi_number: 462692; Description: NEDD1 protein;

Seq ID: 998; Accession: P51617; Swissprot_id: IRA1_HUMAN; Gi_number: 8928535; Description: Interleukin-1 receptor-associated kinase 1 (IRAK-1);

Seq ID: 999; Accession: P29128; Swissprot_id: ICP0_HSVBJ; Gi_number: 124136; Description: Trans-acting transcriptional protein ICP0 (P135 protein) (IER 2.9/ER2.6);

Seq ID: 1000; Accession: P19338; Swissprot_id: NUCL_HUMAN; Gi_number: 128841; Description: Nucleolin (Protein C23);

Seq ID: 1002; Accession: P13645; Swissprot_id: K1CJ_HUMAN; Gi_number: 547749; Description: Keratin, type I cytoskeletal 10 (Cytokeratin 10) (K10) (CK 10);

Seq ID: 1003; Accession: P52839; Swissprot_id: FSTL_ARATH; Gi_number: 1706917; Description: Flavonol sulfotransferase-like (RaRO47);

Seq ID: 1005; Accession: P24814; Swissprot_id: GRR1_YEAST; Gi_number: 121649; Description: GRR1 protein;

Seq ID: 1007; Accession: O43791; Swissprot_id: SPOP_HUMAN; Gi_number: 8134708; Description: Speckle-type POZ protein;

Seq ID: 1008; Accession: Q06003; Swissprot_id: GOLI_DROME; Gi_number: 462193; Description: Goliath protein (G1 protein);

Seq ID: 1009; Accession: P09651; Swissprot_id: ROA1_HUMAN; Gi_number: 133254; Description: Heterogeneous nuclear ribonucleoprotein A1 (Helix-destabilizing protein) (Single-strand binding protein) (hnRNP core protein A1);

Seq ID: 1010; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1011; Accession: P15533; Swissprot_id: RPT1_MOUSE; Gi_number: 133482; Description: Down regulatory protein of interleukin 2 receptor;

Seq ID: 1012; Accession: Q9S8P4; Swissprot_id: RHRE_PEA; Gi_number: 18203442; Description: Rhicadhesin receptor precursor (Germin-like protein);

Seq ID: 1013; Accession: P46897; Swissprot_id: ATH7_ARATH; Gi_number: 1168548; Description: HOMEOBOX-LEUCINE ZIPPER PROTEIN ATHB-7 (HD-ZIP PROTEIN ATHB-7);

Seq ID: 1014; Accession: P13983; Swissprot_id: EXTN_TOBAC; Gi_number: 119714; Description: Extensin precursor (Cell wall hydroxyproline-rich glycoprotein);

Seq ID: 1015; Accession: P18583; Swissprot_id: SON_HUMAN; Gi_number: 586013; Description: SON PROTEIN (SON3);

Seq ID: 1016; Accession: Q02516; Swissprot_id: HAP5_YEAST; Gi_number: 2493550; Description: TRANSCRIPTIONAL ACTIVATOR HAP5;

Seq ID: 1017; Accession: Q9Y252; Swissprot_id: RNF6_HUMAN; Gi_number: 13124536; Description: RING FINGER PROTEIN 6;

Seq ID: 1019; Accession: P11845; Swissprot_id: IPP2_RABIT; Gi_number: 1170582; Description: Protein phosphatase inhibitor 2 (IPP-2);

Seq ID: 1020; Accession: Q09151; Swissprot_id: GLU3_ORYSA; Gi_number: 1707986; Description: GLUTELIN TYPE-A III PRECURSOR;

Seq ID: 1021; Accession: P20698; Swissprot_id: PRO7_ORYSA; Gi_number: 130959; Description: PROLAMIN PPROL 17 PRECURSOR;

Seq ID: 1022; Accession: P14323; Swissprot_id: GLU4_ORYSA; Gi_number: 121476; Description: GLUTELIN PRECURSOR;

Seq ID: 1023; Accession: P29518; Swissprot_id: BT1_MAIZE; Gi_number: 231654; Description: Brittle-1 protein, chloroplast precursor;

Seq ID: 1024; Accession: P28968; Swissprot_id: VGLX_HSVEB; Gi_number: 138350; Description: GLYCOPROTEIN X PRECURSOR;

Seq ID: 1025; Accession: Q01883; Swissprot_id: RA17_ORYSA; Gi_number: 548660; Description: SEED ALLERGENIC PROTEIN RA17 PRECURSOR;

Seq ID: 1026; Accession: P53682; Swissprot_id: CDP1_ORYSA; Gi_number: 1705733; Description: Calcium-dependent protein kinase, isoform 1 (CDPK 1);

Seq ID: 1027; Accession: Q08047; Swissprot_id: GLGB_MAIZE; Gi_number: 1169911; Description: 1,4-alpha-glucan branching enzyme IIB, chloroplast precursor (Starch branching enzyme IIB) (Q-enzyme);

Seq ID: 1028; Accession: P55241; Swissprot_id: GLG1_MAIZE; Gi_number: 1707924; Description: Glucose-1-phosphate adenylyltransferase large subunit 1, chloroplast precursor (ADP-glucose synthase) (ADP-glucose pyrophosphorylase) (AGPASE S) (Alpha-D-glucose-1-phosphate adenyl transferase) (Shrunken-2);

Seq ID: 1029; Accession: Q42980; Swissprot_id: OLE1_ORYSA; Gi_number: 3334280; Description: OLEOSIN 16 KD (OSE701);

Seq ID: 1030; Accession: Q02921; Swissprot_id: NO93_SOYBN; Gi_number: 730165; Description: EARLY NODULIN 93 (N-93);

Seq ID: 1032; Accession: P07206; Swissprot_id: PULA_KLEPN; Gi_number: 131589; Description: Pullulanase precursor (Alpha-dextrin endo-1,6-alpha-glucosidase) (Pullulan 6-glucanohydrolase);

Seq ID: 1033; Accession: P18165; Swissprot_id: LOR1_MOUSE; Gi_number: 126390; Description: LORICRIN;

Seq ID: 1034; Accession: Q43093; Swissprot_id: UGS3_PEA; Gi_number: 2833384; Description: Glycogen [starch] synthase, chloroplast precursor (GBSSII) (Granule-bound starch synthase II);

Seq ID: 1036; Accession: P23509; Swissprot_id: GLGS_SOLTU; Gi_number: 232164; Description: Glucose-1-phosphate adenylyltransferase small subunit, chloroplast precursor (ADP-glucose synthase) (ADP-glucose pyrophosphorylase) (AGPASE B) (Alpha-D-glucose-1-phosphate adenyl transferase);

Seq ID: 1037; Accession: P38560; Swissprot_id: GLN2_MAIZE; Gi_number: 585202; Description: GLUTAMINE SYNTHETASE ROOT ISOZYME 2 (GLUTAMATE-AMMONIA LIGASE);

Seq ID: 1038; Accession: P40602; Swissprot_id: APG_ARATH; Gi_number: 728867; Description: ANTER-SPECIFIC PROLINE-RICH PROTEIN APG PRECURSOR;

Seq ID: 1039; Accession: Q07322; Swissprot_id: EC40_DAUCA; Gi_number: 1706562; Description: EMBRYOGENIC-CELL PROTEIN 40 (ECP40);

Seq ID: 1040; Accession: P09789; Swissprot_id: GRP1_PETHY; Gi_number: 121627; Description: GLYCINE-RICH CELL WALL STRUCTURAL PROTEIN 1 PRECURSOR;

Seq ID: 1041; Accession: P80873; Swissprot_id: GS39_BACSU; Gi_number: 3123232; Description: GENERAL STRESS PROTEIN 39 (GSP39);

Seq ID: 1042; Accession: P15590; Swissprot_id: GLB1_MAIZE; Gi_number: 121205; Description: Globulin-1 S allele precursor (GLB1-S) (7S-like);

Seq ID: 1043; Accession: P27061; Swissprot_id: PPA1_LYCES; Gi_number: 130718; Description: Acid phosphatase precursor 1;

Seq ID: 1044; Accession: P93329; Swissprot_id: NO20_MEDTR; Gi_number: 3914142; Description: EARLY NODULIN 20 PRECURSOR (N-20);

Seq ID: 1046; Accession: P21997; Swissprot_id: SSG-P_VOLCA; Gi_number: 134920; Description: SULFATED SURFACE GLYCOPROTEIN 185 (SSG 185);

Seq ID: 1047; Accession: P12624; Swissprot_id: MACS_BOVIN; Gi_number: 585447; Description: MYRISTOYLATED ALANINE-RICH C-KINASE SUBSTRATE (MARCKS) (ACAMP-81);

Seq ID: 1048; Accession: Q02516; Swissprot_id: HAP5_YEAST; Gi_number: 2493550; Description: TRANSCRIPTIONAL ACTIVATOR HAP5;

Seq ID: 1049; Accession: Q9SYQ8; Swissprot_id: CLV1_ARATH; Gi_number: 12643323; Description: RECEPTOR PROTEIN KINASE CLAVATA1 PRECURSOR;

Seq ID: 1050; Accession: P13983; Swissprot_id: EXTN_TOBAC; Gi_number: 119714; Description: Extensin precursor (Cell wall hydroxyproline-rich glycoprotein);

Seq ID: 1051; Accession: P21997; Swissprot_id: SSG-P_VOLCA; Gi_number: 134920; Description: SULFATED SURFACE GLYCOPROTEIN 185 (SSG 185);

Seq ID: 1052; Accession: P13983; Swissprot_id: EXTN_TOBAC; Gi_number: 119714; Description: Extensin precursor (Cell wall hydroxyproline-rich glycoprotein);

Seq ID: 1054; Accession: Q02280; Swissprot_id: CIKE_DROME; Gi_number: 399253; Description: Potassium channel protein eag;

Seq ID: 1055; Accession: P46573; Swissprot_id: APKB_ARATH; Gi_number: 12644274; Description: PROTEIN KINASE APK1B;

Seq ID: 1056; Accession: P32583; Swissprot_id: SR40_YEAST; Gi_number: 548976; Description: SUPPRESSOR PROTEIN SRP40;

Seq ID: 1057; Accession: Q9UNQ0; Swissprot_id: ABG2_HUMAN; Gi_number: 17433731; Description: ATP-binding cassette, sub-family G, member 2 (Placenta-specific ATP-binding cassette transporter) (Breast cancer resistance protein);

Seq ID: 1058; Accession: P46573; Swissprot_id: APKB_ARATH; Gi_number: 12644274; Description: PROTEIN KINASE APK1B;

Seq ID: 1060; Accession: P57721; Swissprot_id: PCB3_HUMAN; Gi_number: 12230427; Description: Poly (rC)-binding protein 3 (Alpha-CP3);

Seq ID: 1061; Accession: P22059; Swissprot_id: OXYB_HUMAN; Gi_number: 129308; Description: Oxysterol-binding protein;

Seq ID: 1062; Accession: P14328; Swissprot_id: SP96_DICDI; Gi_number: 134780; Description: SPORE COAT PROTEIN SP96;

Seq ID: 1063; Accession: P40603; Swissprot_id: APG_BRANA; Gi_number: 728868; Description: ANTER-SPECIFIC PROLINE-RICH PROTEIN APG (PROTEIN CEX);

Seq ID: 1064; Accession: Q11207; Swissprot_id: PPOL_ARATH; Gi_number: 1709740; Description: Poly [ADP-ribose] polymerase (PARP) (ADPRT) (NAD(+) ADP-ribosyltransferase) (Poly[ADP-ribose] synthetase);

Seq ID: 1065; Accession: Q06548; Swissprot_id: APKA_ARATH; Gi_number: 1168470; Description: Protein kinase APK1A;

Seq ID: 1066; Accession: P53392; Swissprot_id: SUT2_STYHA; Gi_number: 1711617; Description: HIGH AFFINITY SULPHATE TRANSPORTER 2;

Seq ID: 1067; Accession: P18583; Swissprot_id: SON_HUMAN; Gi_number: 586013; Description: SON PROTEIN (SON3);

Seq ID: 1068; Accession: P41230; Swissprot_id: SMCX_MOUSE; Gi_number: 17380305; Description: SmcX protein (Xe169 protein);

Seq ID: 1069; Accession: Q9Y705; Swissprot_id: ALP4_SCHPO; Gi_number: 18203637; Description: Spindle pole body component Alp4;

Seq ID: 1070; Accession: P52409; Swissprot_id: E13B_WHEAT; Gi_number: 1706551; Description: GLUCAN ENDO-1,3-BETA-GLUCOSIDASE PRECURSOR ((1→3)-BETA-GLUCAN ENDOHYDROLASE) ((1→3)-BETA-GLUCANASE) (BETA-1,3-ENDOGLUCANASE);

Seq ID: 1071; Accession: P10978; Swissprot_id: POLX_TOBAC; Gi_number: 130582; Description: Retrovirus-related Pol polyprotein from transposon TNT 1-94 [Contains: Protease; Reverse transcriptase; Endonuclease];

Seq ID: 1072; Accession: P33485; Swissprot_id: VNUA_PRVKA; Gi_number: 465445; Description: PROBABLE NUCLEAR ANTIGEN;

Seq ID: 1073; Accession: Q07423; Swissprot_id: HEX6_RICCO; Gi_number: 1708191; Description: HEXOSE CARRIER PROTEIN HEX6;

Seq ID: 1074; Accession: P13816; Swissprot_id: GARP_PLAFF; Gi_number: 120943; Description: GLUTAMIC ACID-RICH PROTEIN PRECURSOR;

Seq ID: 1075; Accession: P93531; Swissprot_id: C7D7_SOLCH; Gi_number: 5915836; Description: CYTOCHROME P450 71D7;

Seq ID: 1076; Accession: Q00808; Swissprot_id: HET1_PODAN; Gi_number: 3023956; Description: Vegetatible incompatibility protein HET-E-1;

Seq ID: 1077; Accession: Q41819; Swissprot_id: IAAG_MAIZE; Gi_number: 2501499; Description: INDOLE-3-ACETATE BETA-GLUCOSYLTRANSFERASE (IAA-GLU SYNTHETASE) ((URIDINE 5'-DIPHOSPHATE-GLUCOSE:INDOL-3-YLACETYL)-BETA-D-GLUCOSYL TRANSFERASE);

Seq ID: 1078; Accession: Q9UMN6; Swissprot_id: TRX2_HUMAN; Gi_number: 12643900; Description: TRITHORAX HOMOLOG 2 (MIXED LINEAGE LEUKEMIA GENE HOMOLOG 2 PROTEIN);

Seq ID: 1079; Accession: P27934; Swissprot_id: AM3E_ORYSA; Gi_number: 113683; Description: ALPHA-AMYLASE ISOZYME 3E PRECURSOR (1,4-ALPHA-D-GLUCAN GLUCANOHYDROLASE);

Seq ID: 1080; Accession: P03211; Swissprot_id: EBN1_EBV; Gi_number: 119110; Description: EBNA-1 NUCLEAR PROTEIN;

Seq ID: 1081; Accession: P42777; Swissprot_id: GBF4_ARATH; Gi_number: 1169863; Description: G-box binding factor 4;

Seq ID: 1082; Accession: O89114; Swissprot_id: DJB5_MOUSE; Gi_number: 18202246; Description: DnaJ homolog subfamily B member 5 (Heat shock protein Hsp40-3) (Heat shock protein cognate 40) (Hsc40);

Seq ID: 1083; Accession: P28656; Swissprot_id: NPL1_MOUSE; Gi_number: 1709338; Description: Nucleosome assembly protein 1-like 1 (NAP-1 related protein) (Brain protein DN38);

Seq ID: 1085; Accession: Q9NR09; Swissprot_id: BIR6_HUMAN; Gi_number: 12585192; Description: BACULOVIRAL IAP REPEAT-CONTAINING PROTEIN 6 (UBIQUITIN-CONJUGATING BIR-DOMAIN ENZYME APOLLON);

Seq ID: 1086; Accession: P37702; Swissprot_id: MYRO_ARATH; Gi_number: 585536; Description: Myrosinase precursor (Sinigrinase) (Thioglucosidase);

Seq ID: 1090; Accession: O35973; Swissprot_id: PER1_MOUSE; Gi_number: 6093673; Description: Period circadian protein 1 (Circadian pacemaker protein Rigui) (mPER) (M-Rigui);

Seq ID: 1091; Accession: P05143; Swissprot_id: PRP3_MOUSE; Gi_number: 131002; Description: PROLINE-RICH PROTEIN MP-3;

Seq ID: 1092; Accession: Q9NYV4; Swissprot_id: CRK7_HUMAN; Gi_number: 12643825; Description: CELL DIVISION CYCLE 2-RELATED PROTEIN KINASE 7 (CDC2-RELATED PROTEIN KINASE 7) (CRKRS);

Seq ID: 1093; Accession: P50156; Swissprot_id: TIPG_ORYSA; Gi_number: 1729971; Description: TONOPLAST INTRINSIC PROTEIN, GAMMA (GAMMA TIP) (AQUAPORIN-TIP);

Seq ID: 1095; Accession: Q9SFF9; Swissprot_id: GL17_ARATH; Gi_number: 18203443; Description: Germin-like protein subfamily 1 member 7 precursor;

Seq ID: 1096; Accession: P32110; Swissprot_id: GTX6_SOYBN; Gi_number: 417148; Description: PROBABLE GLUTATHIONE S-TRANSFERASE (HEAT SHOCK PROTEIN 26A) (G2-4);

Seq ID: 1097; Accession: Q06003; Swissprot_id: GOLI_DROME; Gi_number: 462193; Description: Goliath protein (G1 protein);

Seq ID: 1099; Accession: P39163; Swissprot_id: CHAC_ECOLI; Gi_number: 12644253; Description: CATION TRANSPORT PROTEIN CHAC;

Seq ID: 1101; Accession: Q38924; Swissprot_id: PPAF_ARATH; Gi_number: 2499542; Description: IRON(III)-ZINC(II) PURPLE ACID PHOSPHATASE PRECURSOR (PAP);

Seq ID: 1102; Accession: Q99090; Swissprot_id: CPR2_PETCR; Gi_number: 2842757; Description: LIGHT-INDUCIBLE PROTEIN CPRF-2;

Seq ID: 1103; Accession: P52565; Swissprot_id: GDIR_HUMAN; Gi_number: 1707892; Description: Rho GDP-dissociation inhibitor 1 (Rho GDI 1) (Rho-GDI alpha);

Seq ID: 1105; Accession: O54956; Swissprot_id: DPE2_MOUSE; Gi_number: 3913512; Description: DNA POLYMERASE EPSILON SUBUNIT B (DNA POLYMERASE II SUBUNIT B);

Seq ID: 1107; Accession: Q50634; Swissprot_id: SECD_MYCTU; Gi_number: 2498898; Description: Protein-export membrane protein secD;

Seq ID: 1108; Accession: P08548; Swissprot_id: LIN1_NYCCO; Gi_number: 126296; Description: LINE-1 REVERSE TRANSCRIPTASE HOMOLOG;

Seq ID: 1110; Accession: Q9ZSK5; Swissprot_id: ZOG_PHALU; Gi_number: 6226510; Description: Zeatin O-glucosyltransferase (Zeatin O-beta-D-glucosyltransferase);

Seq ID: 1112; Accession: P28968; Swissprot_id: VGLX_HSVEB; Gi_number: 138350; Description: GLYCOPROTEIN X PRECURSOR;

Seq ID: 1119; Accession: P42768; Swissprot_id: WASP_HUMAN; Gi_number: 1722836; Description: WISKOTT-ALDRICH SYNDROME PROTEIN (WASP);

Seq ID: 1122; Accession: O08816; Swissprot_id: WASL_RAT; Gi_number: 13431956; Description: Neural Wiskott-Aldrich syndrome protein (N-WASP);

Seq ID: 1125; Accession: P21997; Swissprot_id: SSGP_VOLCA; Gi_number: 134920; Description: SULFATED SURFACE GLYCOPROTEIN 185 (SSG 185);

Seq ID: 1126; Accession: P10220; Swissprot_id: TEGU_HSV11; Gi_number: 135576; Description: LARGE TEGUMENT PROTEIN (VIRON PROTEIN UL36);

Seq ID: 1127; Accession: P42158; Swissprot_id: KC1D_ARATH; Gi_number: 1170622; Description: CASEIN KINASE I, DELTA ISOFORM LIKE (CKI-DELTA);

Seq ID: 1128; Accession: Q9NZW4; Swissprot_id: DSPP_HUMAN; Gi_number: 17865470; Description: Dentin sialophosphoprotein precursor [Contains: Dentin phosphoprotein (Dentin phosphophoryn) (DPP); Dentin sialoprotein (DSP)];

Seq ID: 1130; Accession: Q9Y5T5; Swissprot_id: UBPG_HUMAN; Gi_number: 6686071; Description: Ubiquitin carboxyl-terminal hydrolase 16 (Ubiquitin thiolesterase 16) (Ubiquitin-specific processing protease 16) (Deubiquitinating enzyme 16) (Ubiquitin processing protease UBP-M);

Seq ID: 1131; Accession: Q02817; Swissprot_id: MUC2_HUMAN; Gi_number: 2506877; Description: MUCIN 2 PRECURSOR (INTESTINAL MUCIN 2);

Seq ID: 1133; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1134; Accession: P21997; Swissprot_id: SSGP_VOLCA; Gi_number: 134920; Description: SULFATED SURFACE GLYCOPROTEIN 185 (SSG 185);

Seq ID: 1135; Accession: P13983; Swissprot_id: EXTN_TOBAC; Gi_number: 119714; Description: Extensin precursor (Cell wall hydroxyproline-rich glycoprotein);

Seq ID: 1137; Accession: P43293; Swissprot_id: NAK_ARATH; Gi_number: 1171642; Description: Probable serine/threonine-protein kinase NAK;

Seq ID: 1141; Accession: P20026; Swissprot_id: MYB1_HORVU; Gi_number: 127579; Description: Myb-related protein Hv1;

Seq ID: 1143; Accession: P13983; Swissprot_id: EXTN_TOBAC; Gi_number: 119714; Description: Extensin precursor (Cell wall hydroxyproline-rich glycoprotein);

Seq ID: 1144; Accession: P70315; Swissprot_id: WASP_OUSE; Gi_number: 2499130; Description: Wiskott-Aldrich syndrome protein homolog (WASP);

Seq ID: 1145; Accession: P33313; Swissprot_id: CNS1_YEAST; Gi_number: 465507; Description: CYCLOPHILIN SEVEN SUPPRESSOR 1 (STI1 STRESS-INDUCIBLE PROTEIN HOMOLOG);

Seq ID: 1146; Accession: P50172; Swissprot_id: DHI1_MOUSE; Gi_number: 1706408; Description: Corticosteroid 11-beta-dehydrogenase, isozyme 1 (11-DH) (11-beta-hydroxysteroid dehydrogenase 1) (11-beta-HSD1) (11 beta-HSD1A);

Seq ID: 1147; Accession: P08079; Swissprot_id: GDB0_WHEAT; Gi_number: 121099; Description: GAMMA-GLIADIN PRECURSOR;

Seq ID: 1148; Accession: P20026; Swissprot_id: MYB1_HORVU; Gi_number: 127579; Description: Myb-related protein Hv1;

Seq ID: 1149; Accession: Q9UGP9; Swissprot_id: WDR5_HUMAN; Gi_number: 12230771; Description: WD-repeat protein 5;

Seq ID: 1150; Accession: Q41276; Swissprot_id: AP1_SINAL; Gi_number: 3913047; Description: Floral homeotic protein APETALA1 (MADS C);

Seq ID: 1151; Accession: P49634; Swissprot_id: UBIQ_ACACA; Gi_number: 1351348; Description: UBIQUITIN;

Seq ID: 1153; Accession: P01103; Swissprot_id: MYB_CHICK; Gi_number: 127591; Description: Myb proto-oncogene protein (C-myb);

Seq ID: 1154; Accession: Q08446; Swissprot_id: SGT1_YEAST; Gi_number: 2498910; Description: SGT1 PROTEIN;

Seq ID: 1156; Accession: P42736; Swissprot_id: CDI3_ARATH; Gi_number: 1168862; Description: CADMIUM-INDUCED PROTEIN AS30;

Seq ID: 1158; Accession: P20025; Swissprot_id: MYB3_MAIZE; Gi_number: 127582; Description: Myb-related protein Zm38;

Seq ID: 1159; Accession: P17483; Swissprot_id: HXB4_HUMAN; Gi_number: 547692; Description: HOMEOBOX PROTEIN HOX-B4 (HOX-2F) (HOX-2.6);

Seq ID: 1163; Accession: Q09790; Swissprot_id: APS1_SCHPO; Gi_number: 1175461; Description: Diadenosine 5',5'''-P1,P6-hexaphosphate hydrolase (Ap6A hydrolase);

Seq ID: 1164; Accession: O08808; Swissprot_id: DIA1_MOUSE; Gi_number: 6014968; Description: Diaphanous protein homolog 1 (Diaphanous-related formin 1) (DRF1) (mDIA1) (p140mDIA);

Seq ID: 1165; Accession: O65740; Swissprot_id: DEF2_CAPAN; Gi_number: 17373811; Description: Defensin J1-2 precursor;

Seq ID: 1166; Accession: O00763; Swissprot_id: CO_HUMAN; Gi_number: 2493312; Description: ACETYL-COA CARBOXYLASE 2 (ACC-BETA) [INCLUDES: BIOTIN CARBOXYLASE];

Seq ID: 1167; Accession: O04716; Swissprot_id: MSH6_ARATH; Gi_number: 6226648; Description: DNA mismatch repair protein MSH6-1 (AtMsh6-1);

Seq ID: 1168; Accession: O08638; Swissprot_id: MYHB_MOUSE; Gi_number: 13431676; Description: MYOSIN HEAVY CHAIN, SMOOTH MUSCLE ISOFORM (SM-MHC);

Seq ID: 1170; Accession: P47990; Swissprot_id: XDH_CHICK; Gi_number: 1351438; Description: XANTHINE DEHYDROGENASE/OXIDASE [INCLUDES: XANTHINE DEHYDROGENASE (XD); XANTHINE OXIDASE (XO) (XANTHINE OXIDOREDUCTASE)];

Seq ID: 1171; Accession: Q42877; Swissprot_id: RPB2_LYCES; Gi_number: 11134656; Description: DNA-directed RNA polymerase II 135 kDa polypeptide (RNA polymerase II subunit 2);

Seq ID: 1172; Accession: Q05609; Swissprot_id: CTR1_ARATH; Gi_number: 1169128; Description: Serine/threonine-protein kinase CTR1;

Seq ID: 1173; Accession: P04323; Swissprot_id: POL3_DROME; Gi_number: 130405; Description: Retrovirus-related Pol polyprotein from transposon 17.6 [Contains: Protease; Reverse transcriptase; Endonuclease];

Seq ID: 1174; Accession: Q16531; Swissprot_id: DDB1_HUMAN; Gi_number: 12643730; Description: DNA DAMAGE BINDING PROTEIN 1 (DAMAGE-SPECIFIC DNA BINDING PROTEIN 1) (DDB P127 SUBUNIT) (DDBA) (UV-DAMAGED DNA-BINDING PROTEIN 1) (UV-DDB 1) (XERODERMA PIGMENTOSUM GROUP E COMPLEMENTING PROTEIN) (XPCE) (X-ASSOCIATED PROTEIN 1) (XAP-1);

Seq ID: 1175; Accession: P10978; Swissprot_id: POLX_TOBAC; Gi_number: 130582; Description: Retrovirus-related Pol polyprotein from transposon TNT 1-94 [Contains: Protease; Reverse transcriptase; Endonuclease];

Seq ID: 1176; Accession: Q9NR09; Swissprot_id: BIR6_HUMAN; Gi_number: 12585192; Description: BACULOVIRAL IAP REPEAT-CONTAINING PROTEIN 6 (UBIQUITIN-CONJUGATING BIR-DOMAIN ENZYME APOLLON);

Seq ID: 1177; Accession: P21448; Swissprot_id: MDR1_CRIGR; Gi_number: 126924; Description: Multidrug resistance protein 1 (P-glycoprotein 1);

Seq ID: 1178; Accession: P55180; Swissprot_id: GALE_BACSU; Gi_number: 1730193; Description: UDP-glucose 4-epimerase (Galactowaldenase) (UDP-galactose 4-epimerase);

Seq ID: 1179; Accession: Q12381; Swissprot_id: PR01_SCHPO; Gi_number: 12230438; Description: Pre-mRNA splicing factor prp1;

Seq ID: 1180; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1181; Accession: P47179; Swissprot_id: DAN4_YEAST; Gi_number: 1352944; Description: Cell wall protein DAN4 precursor;

Seq ID: 1182; Accession: Q05609; Swissprot_id: CTR1_ARATH; Gi_number: 1169128; Description: Serine/threonine-protein kinase CTR1;

Seq ID: 1183; Accession: P22579; Swissprot_id: SIN3_YEAST; Gi_number: 2507475; Description: PAIRED AMPHIPATHIC HELIX PROTEIN;

Seq ID: 1184; Accession: P58463; Swissprot_id: FXP2_MOUSE; Gi_number: 17433012; Description: Forkhead box protein P2;

Seq ID: 1185; Accession: P30181; Swissprot_id: TOP1_ARATH; Gi_number: 267146; Description: DNA topoisomerase I;

Seq ID: 1186; Accession: P11087; Swissprot_id: CA11_MOUSE; Gi_number: 2506305; Description: Collagen alpha 1(I) chain precursor;

Seq ID: 1187; Accession: P45181; Swissprot_id: PQQL_HAEIN; Gi_number: 1175759; Description: Probable zinc protease pqqL;

Seq ID: 1188; Accession: Q9QYY8; Swissprot_id: SPAS_MOUSE; Gi_number: 12230605; Description: Spastin;

Seq ID: 1190; Accession: O75317; Swissprot_id: UBP-C_HUMAN; Gi_number: 6707738; Description: Ubiquitin carboxyl-terminal hydrolase 12 (Ubiquitin thiolesterase 12) (Ubiquitin-specific processing protease 12) (Deubiquitinating enzyme 12) (Ubiquitin hydrolyzing enzyme 1);

Seq ID: 1191; Accession: Q55738; Swissprot_id: GYRA_SYNY3; Gi_number: 8469101; Description: DNA gyrase subunit A;

Seq ID: 1192; Accession: Q99614; Swissprot_id: TTC1_HUMAN; Gi_number: 12585378; Description: TETRATRICOPEPTIDE REPEAT PROTEIN 1 (TPR REPEAT PROTEIN 1);

Seq ID: 1193; Accession: P14328; Swissprot_id: SP96_DICDI; Gi_number: 134780; Description: SPORE COAT PROTEIN SP96;

Seq ID: 1194; Accession: Q02817; Swissprot_id: MUC2_HUMAN; Gi_number: 2506877; Description: MUCIN 2 PRECURSOR (INTESTINAL MUCIN 2);

Seq ID: 1195; Accession: P46607; Swissprot_id: HGL2_ARATH; Gi_number: 2506525; Description: Homeobox protein GLABRA2 (Homeobox-leucine zipper protein ATHB-10) (HD-ZIP protein ATHB-10);

Seq ID: 1196; Accession: Q01432; Swissprot_id: AMD3_HUMAN; Gi_number: 399033; Description: AMP deaminase 3 (AMP deaminase isoform E) (Erythrocyte AMP deaminase);

Seq ID: 1197; Accession: Q63003; Swissprot_id: 5E5_RAT; Gi_number: 2498095; Description: 5E5 ANTIGEN;

Seq ID: 1198; Accession: P10978; Swissprot_id: POLX_TOBAC; Gi_number: 130582; Description: Retrovirus-related Pol polyprotein from transposon TNT 1-94 [Contains: Protease; Reverse transcriptase; Endonuclease];

Seq ID: 1199; Accession: P34703; Swissprot_id: EMB5_CAEEL; Gi_number: 462008; Description: EMB-5 protein;

Seq ID: 1201; Accession: Q9SYQ8; Swissprot_id: CLV1_ARATH; Gi_number: 12643323; Description: RECEPTOR PROTEIN KINASE CLAVATA1 PRECURSOR;

Seq ID: 1203; Accession: P08547; Swissprot_id: LIN1_HUMAN; Gi_number: 126295; Description: LINE-1 REVERSE TRANSCRIPTASE HOMOLOG;

Seq ID: 1204; Accession: P74361; Swissprot_id: CLPB_SYNY3; Gi_number: 2493734; Description: ClpB protein;

Seq ID: 1205; Accession: P11369; Swissprot_id: POL2_MOUSE; Gi_number: 130402; Description: Retrovirus-related POL polyprotein [Contains: Reverse transcriptase; Endonuclease];

Seq ID: 1206; Accession: P29141; Swissprot_id: SUBV_BACSU; Gi_number: 135023; Description: Minor extracellular protease VPR precursor;

Seq ID: 1207; Accession: P04839; Swissprot_id: C24B_HUMAN; Gi_number: 115211; Description: Cytochrome B-245 heavy chain (P22 phagocyte B-cytochrome) (Neutrophil cytochrome B, 91 kDa polypeptide) (CGD91-PHOX) (GP91-PHOX) (Heme binding membrane glycoprotein GP91PHOX) (Cytochrome B(558) beta chain) (Superoxide-generating NADPH oxidase heavy chain;

Seq ID: 1208; Accession: Q06548; Swissprot_id: APKA_ARATH; Gi_number: 1168470; Description: Protein kinase APK1A;

Seq ID: 1209; Accession: Q13316; Swissprot_id: DMP1_HUMAN; Gi_number: 7673998; Description: DENTIN MATRIX ACIDIC PHOSPHOPROTEIN 1 PRECURSOR (DENTIN MATRIX PROTEIN-1) (DMP-1);

Seq ID: 1211; Accession: Q9NQE7; Swissprot_id: TSSP_HUMAN; Gi_number: 13633990; Description: THYMUS-SPECIFIC SERINE PROTEASE PRECURSOR;

Seq ID: 1212; Accession: Q9NRA0; Swissprot_id: SPH2_HUMAN; Gi_number: 17369316; Description: Sphingosine kinase 2 (SK 2) (SPK 2);

Seq ID: 1213; Accession: Q02817; Swissprot_id: MUC2_HUMAN; Gi_number: 2506877; Description: MUCIN 2 PRECURSOR (INTESTINAL MUCIN 2);

Seq ID: 1214; Accession: Q9SYQ8; Swissprot_id: CLV1_ARATH; Gi_number: 12643323; Description: RECEPTOR PROTEIN KINASE CLAVATA1 PRECURSOR;

Seq ID: 1215; Accession: Q14258; Swissprot_id: Z147_HUMAN; Gi_number: 12585547; Description: Zinc finger protein 147 (Estrogen responsive finger protein) (Efp);

Seq ID: 1216; Accession: Q9EPQ0; Swissprot_id: NKX3_RAT; Gi_number: 17865499; Description: Sodium/potassium/calcium exchanger 3 precursor (Na(+)/K(+)/Ca(2+)-exchange protein 3) (Fragment);

Seq ID: 1217; Accession: P40781; Swissprot_id: CYP4_CYNCA; Gi_number: 729273; Description: CYPRO4 PROTEIN;

Seq ID: 1218; Accession: P56344; Swissprot_id: CYSA_CHLVU; Gi_number: 3023607; Description: Probable sulfate transport ATP-binding protein cysA;

Seq ID: 1219; Accession: P46573; Swissprot_id: APKB_ARATH; Gi_number: 12644274; Description: PROTEIN KINASE APK1B;

Seq ID: 1220; Accession: P78621; Swissprot_id: SEPA_EMENI; Gi_number: 15214279; Description: CYTOKINESIS PROTEIN SEPA (FH1/2 PROTEIN) (FORCED EXPRESSION INHIBITION OF GROWTH A);

Seq ID: 1221; Accession: Q13614; Swissprot_id: MTR2_HUMAN; Gi_number: 12644410; Description: MYOTUBULARIN-RELATED PROTEIN 2;

Seq ID: 1222; Accession: P93329; Swissprot_id: NO20_MEDTR; Gi_number: 3914142; Description: EARLY NODULIN 20 PRECURSOR (N-20);

Seq ID: 1223; Accession: Q9XHL5; Swissprot_id: HMD3_ORYSA; Gi_number: 11133198; Description: 3-hydroxy-3-methylglutaryl-coenzyme A reductase 3 (HMG-CoA reductase 3);

Seq ID: 1224; Accession: P79051; Swissprot_id: RH16_SCHPO; Gi_number: 14195095; Description: DNA REPAIR PROTEIN RHP16 (RAD16 HOMOLOG);

Seq ID: 1225; Accession: P39968; Swissprot_id: VAC8_YEAST; Gi_number: 731400; Description: Vacuolar protein 8;

Seq ID: 1226; Accession: Q9QYY8; Swissprot_id: SPAS_MOUSE; Gi_number: 12230605; Description: Spastin;

Seq ID: 1227; Accession: Q06850; Swissprot_id: CDP1_ARATH; Gi_number: 729092; Description: Calcium-dependent protein kinase, isoform AK1 (CDPK);

Seq ID: 1228; Accession: Q9TV36; Swissprot_id: FBN1_PIG; Gi_number: 13626617; Description: Fibrillin 1 precursor;

Seq ID: 1229; Accession: P05659; Swissprot_id: MYSN_ACACA; Gi_number: 127758; Description: Myosin II heavy chain, non muscle;

Seq ID: 1231; Accession: P08548; Swissprot_id: LIN1_NYCCO; Gi_number: 126296; Description: LINE-1 REVERSE TRANSCRIPTASE HOMOLOG;

Seq ID: 1233; Accession: Q46948; Swissprot_id: THIJ_ECOLI; Gi_number: 6686342; Description: 4-methyl-5(B-hydroxyethyl)-thiazole monophosphate biosynthesis enzyme;

Seq ID: 1235; Accession: P52706; Swissprot_id: MDL1_PRUSE; Gi_number: 1708971; Description: (R)-MANDELONITRILE LYASE ISOFORM 1 PRECURSOR (HYDROXYNITRILE LYASE 1) ((R)-OXYNITRILASE 1);

Seq ID: 1236; Accession: O23066; Swissprot_id: C862_ARATH; Gi_number: 5915846; Description: Cytochrome P450 86A2;

Seq ID: 1237; Accession: Q41144; Swissprot_id: STC_RICCO; Gi_number: 3915039; Description: SUGAR CARRIER PROTEIN C;

Seq ID: 1238; Accession: O88508; Swissprot_id: DM3A_MOUSE; Gi_number: 17374900; Description: DNA (cytosine-5)-methyltransferase 3A (DNA methyltransferase MmuIIIA) (DNA MTase MmuIIIA) (M.MmuIIIA);

Seq ID: 1239; Accession: Q42534; Swissprot_id: PME2_ARATH; Gi_number: 17865767; Description: Pectinesterase 2 precursor (Pectin methylesterase 2) (PE 2);

Seq ID: 1240; Accession: P13526; Swissprot_id: ARLC_MAIZE; Gi_number: 114156; Description: ANTHOCYANIN REGULATORY LC PROTEIN;

Seq ID: 1241; Accession: O00401; Swissprot_id: WASL_HUMAN; Gi_number: 13431960; Description: Neural Wiskott-Aldrich syndrome protein (N-WASP);

Seq ID: 1242; Accession: Q02817; Swissprot_id: MUC2_HUMAN; Gi_number: 2506877; Description: MUCIN 2 PRECURSOR (INTESTINAL MUCIN 2);

Seq ID: 1243; Accession: P34693; Swissprot_id: SYT1_CAEEL; Gi_number: 464829; Description: SYNAPTOTAGMIN I;

Seq ID: 1244; Accession: P21997; Swissprot_id: SSGP_VOLCA; Gi_number: 134920; Description: SULFATED SURFACE GLYCOPROTEIN 185 (SSG 185);

Seq ID: 1245; Accession: P25777; Swissprot_id: ORYB_ORYSA; Gi_number: 129232; Description: ORYZAIN BETA CHAIN PRECURSOR;

Seq ID: 1246; Accession: P16166; Swissprot_id: UFO1_MAIZE; Gi_number: 136743; Description: Flavonol 3-O-glucosyltransferase (UDP-glucose flavonoid 3-O-glucosyltransferase) (Bronze-1) (BZ-MCC allele);

Seq ID: 1247; Accession: Q42586; Swissprot_id: PYR5_ARATH; Gi_number: 2499945; Description: Uridine 5'-monophosphate synthase (UMP synthase) [Includes: Orotate phosphoribosyltransferase (OPRtase); Orotidine 5'-phosphate decarboxylase (OMPdecase)];

Seq ID: 1248; Accession: O42904; Swissprot_id: PR31_SCHPO; Gi_number: 12230414; Description: Pre-mRNA splicing factor prp31;

Seq ID: 1250; Accession: P54001; Swissprot_id: P4HA_RAT; Gi_number: 1709530; Description: PROLYL 4-HYDROXYLASE ALPHA SUBUNIT PRECURSOR;

Seq ID: 1251; Accession: P25011; Swissprot_id: CG21_SOYBN; Gi_number: 116157; Description: G2/mitotic-specific cyclin S13-6 (B-like cyclin);

Seq ID: 1252; Accession: Q99615; Swissprot_id: TTC2_HUMAN; Gi_number: 6831707; Description: TETRATRICOPEPTIDE REPEAT PROTEIN 2 (TPR REPEAT PROTEIN 2);

Seq ID: 1253; Accession: P16081; Swissprot_id: NIA1_ORYSA; Gi_number: 128186; Description: NITRATE REDUCTASE 1 (NR1);

Seq ID: 1254; Accession: P49299; Swissprot_id: CYSZ_CUCMA; Gi_number: 1345933; Description: CITRATE SYNTHASE, GLYOXYSOMAL PRECURSOR (GCS);

Seq ID: 1255; Accession: P32857; Swissprot_id: PTM1_YEAST; Gi_number: 417551; Description: Protein PTM1 precursor;

Seq ID: 1256; Accession: P41214; Swissprot_id: LIGA_HUMAN; Gi_number: 13638201; Description: LIGATIN (HEPATOCELLULAR CARCINOMA-ASSOCIATED ANTIGEN 56);

Seq ID: 1257; Accession: P27483; Swissprot_id: GRP_ARATH; Gi_number: 121640; Description: GLYCINE-RICH CELL WALL STRUCTURAL PROTEIN PRECURSOR;

Seq ID: 1259; Accession: P10978; Swissprot_id: POLX_TOBAC; Gi_number: 130582; Description: Retrovirus-related Pol polyprotein from transposon TNT 1-94 [Contains: Protease; Reverse transcriptase; Endonuclease];

Seq ID: 1260; Accession: Q9R9N3; Swissprot_id: ODP2_RHIME; Gi_number: 8474223; Description: Dihydrolipoamide acetyltransferase component of pyruvate dehydrogenase complex (E2);

Seq ID: 1261; Accession: P09406; Swissprot_id: RU17_XENLA; Gi_number: 134091; Description: U1 small nuclear ribonucleoprotein 70 kDa (U1 snRNP 70 kDa) (snRNP70) (U1-70K);

Seq ID: 1262; Accession: P27937; Swissprot_id: AM3B_ORYSA; Gi_number: 113680; Description: ALPHA-AMYLASE ISOZYME 3B PRECURSOR (1,4-ALPHA-D-GLUCAN GLUCANOHYDROLASE);

Seq ID: 1263; Accession: P06865; Swissprot_id: HEXA_HUMAN; Gi_number: 123079; Description: Beta-hexosaminidase alpha chain precursor (N-acetyl-beta-glucosaminidase) (Beta-N-acetylhexosaminidase) (Hexosaminidase A);

Seq ID: 1264; Accession: Q42798; Swissprot_id: C931_SOYBN; Gi_number: 3913192; Description: CYTOCHROME P450 93A1;

Seq ID: 1265; Accession: P09406; Swissprot_id: RU17_XENLA; Gi_number: 134091; Description: U1 small nuclear ribonucleoprotein 70 kDa (U1 snRNP 70 kDa) (snRNP70) (U1-70K);

Seq ID: 1266; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1267; Accession: O95405; Swissprot_id: MADI_HUMAN; Gi_number: 15214067; Description: MOTHERS AGAINST DECAPENTAPLEGIC HOMOLOG INTERACTING PROTEIN (MADH-INTERACTING PROTEIN) (SMAD ANCHOR FOR RECEPTOR ACTIVATION) (RECEPTOR ACTIVATION ANCHOR) (HSARA) (NOVEL SERINE PROTEASE) (NSP);

Seq ID: 1268; Accession: P21997; Swissprot_id: SSGP_VOLCA; Gi_number: 134920; Description: SULFATED SURFACE GLYCOPROTEIN 185 (SSG 185);

Seq ID: 1269; Accession: Q05859; Swissprot_id: FOR4_MOUSE; Gi_number: 544344; Description: FORMIN 4 (LIMB DEFORMITY PROTEIN);

Seq ID: 1270; Accession: O04940; Swissprot_id: CDS1_SOLTU; Gi_number: 3121837; Description: PHOSPHATIDATE CYTIDYLYLTRANSFERASE (CDP-DIGLYCERIDE SYNTHETASE) (CDP-DIGLYCERIDE PYROPHOSPHORYLASE) (CDP-DIACYLGLYCEROL SYNTHASE) (CDS) (CTP:PHOSPHATIDATE CYTIDYLYLTRANSFERASE) (CDP-DAG SYNTHASE) (CDP-DG SYNTHETASE);

Seq ID: 1271; Accession: Q46948; Swissprot_id: THIJ_ECOLI; Gi_number: 6686342; Description: 4-methyl-5(B-hydroxyethyl)-thiazole monophosphate biosynthesis enzyme;

Seq ID: 1272; Accession: P15268; Swissprot_id: MOSA_MAIZE; Gi_number: 127243; Description: AUTONOMOUS TRANSPOSABLE ELEMENT EN-1 MOSAIC PROTEIN (SUPPRESSOR-MUTATOR SYSTEM PROTEIN) (SPM);

Seq ID: 1274; Accession: P34881; Swissprot_id: DNM1_ARATH; Gi_number: 462650; Description: DNA (cytosine-5)-methyltransferase AthI (DNA methyltransferase AthI) (DNA Metase AthI) (M.AthI);

Seq ID: 1276; Accession: Q58849; Swissprot_id: AROD_METJA; Gi_number: 11386641; Description: 3-dehydroquinate dehydratase (3-dehydroquinase) (Type I DHQase);

Seq ID: 1277; Accession: P55039; Swissprot_id: DRG2_HUMAN; Gi_number: 1706518; Description: Developmentally regulated GTP-binding protein 2 (DRG 2);

Seq ID: 1278; Accession: P18161; Swissprot_id: KYK2_DICDI; Gi_number: 125874; Description: TYROSINE-PROTEIN KINASE 2;

Seq ID: 1279; Accession: Q02817; Swissprot_id: MUC2_HUMAN; Gi_number: 2506877; Description: MUCIN 2 PRECURSOR (INTESTINAL MUCIN 2);

Seq ID: 1280; Accession: Q01594; Swissprot_id: ALLN_ALLSA; Gi_number: 399028; Description: ALLIIN LYASE PRECURSOR (ALLIINASE) (CYSTEINE SULPHOXIDE LYASE);

Seq ID: 1281; Accession: O87708; Swissprot_id: CLPX_CAUCR; Gi_number: 6225165; Description: ATP-dependent Clp protease ATP-binding subunit clpX;

Seq ID: 1282; Accession: O43791; Swissprot_id: SPOP_HUMAN; Gi_number: 8134708; Description: Speckle-type POZ protein;

Seq ID: 1283; Accession: O43791; Swissprot_id: SPOP_HUMAN; Gi_number: 8134708; Description: Speckle-type POZ protein;

Seq ID: 1284; Accession: P17731; Swissprot_id: HIS8_BACSU; Gi_number: 3123224; Description: HISTIDINOL-PHOSPHATE AMINOTRANSFERASE (IMIDAZOLE ACETOL-PHOSPHATE TRANSAMINASE);

Seq ID: 1285; Accession: O08333; Swissprot_id: K6P1_STRCO; Gi_number: 3122290; Description: 6-phosphofructokinase 1 (Phosphofructokinase 1) (Phosphohexokinase 1) (ATP-PFK);

Seq ID: 1286; Accession: Q12196; Swissprot_id: RIO1_YEAST; Gi_number: 2500508; Description: RIO1 PROTEIN;

Seq ID: 1287; Accession: Q02817; Swissprot_id: MUC2_HUMAN; Gi_number: 2506877; Description: MUCIN 2 PRECURSOR (INTESTINAL MUCIN 2);

Seq ID: 1288; Accession: O43791; Swissprot_id: SPOP_HUMAN; Gi_number: 8134708; Description: Speckle-type POZ protein;

Seq ID: 1289; Accession: P49972; Swissprot_id: SR52_LYCES; Gi_number: 1711512; Description: SIGNAL RECOGNITION PARTICLE 54 KD PROTEIN 2 (SRP54);

Seq ID: 1290; Accession: P43293; Swissprot_id: NAK_ARATH; Gi_number: 1171642; Description: Probable serine/threonine-protein kinase NAK;

Seq ID: 1291; Accession: P48612; Swissprot_id: PELO_DROME; Gi_number: 1352736; Description: PELOTA PROTEIN;

Seq ID: 1292; Accession: P55081; Swissprot_id: MFA1_HUMAN; Gi_number: 1709012; Description: Microfibrillar-associated protein 1;

Seq ID: 1293; Accession: Q08466; Swissprot_id: KC22_ARATH; Gi_number: 13638265; Description: CASEIN KINASE II, ALPHA CHAIN 2 (CK II);

Seq ID: 1294; Accession: Q42712; Swissprot_id: FATA_CORSA; Gi_number: 8469219; Description: Oleoyl-acyl carrier protein thioesterase, chloroplast precursor (18:0-acylcarrier protein thioesterase) (18:0-ACP thioesterase) (Acyl-[acyl-carrier protein] hydrolase) (Fragment);

Seq ID: 1295; Accession: P41892; Swissprot_id: CC7_SCHPO; Gi_number: 1168817; Description: Cell division control protein 7;

Seq ID: 1296; Accession: P43035; Swissprot_id: LIS1_MOUSE; Gi_number: 1170795; Description: PLATELET-ACTIVATING FACTOR ACETYLHYDROLASE IB ALPHA SUBUNIT (PAF ACETYLHYDROLASE 45 KDA SUBUNIT) (PAF-AH 45 KDA SUBUNIT) (PAF-AH ALPHA) (PAF-AH ALPHA) (LISSENCEPHALY-1 PROTEIN) (LIS-1);

Seq ID: 1297; Accession: P22503; Swissprot_id: GUN_PHAVU; Gi_number: 1346225; Description: ENDOGLUCANASE PRECURSOR (ENDO-1,4-BETA-GLUCANASE) (ABSCISSION CELLULASE);

Seq ID: 1298; Accession: P95982; Swissprot_id: SYY_SULSO; Gi_number: 2501078; Description: Tyrosyl-tRNA synthetase (Tyrosine-tRNA ligase) (TyrRS);

Seq ID: 1300; Accession: O49923; Swissprot_id: ADK_P-HYPA; Gi_number: 17366025; Description: Adenosine kinase (AK) (Adenosine 5'-phosphotransferase);

Seq ID: 1301; Accession: O08816; Swissprot_id: WASL_RAT; Gi_number: 13431956; Description: Neural Wiskott-Aldrich syndrome protein (N-WASP);

Seq ID: 1302; Accession: Q99KV1; Swissprot_id: DJBB_MOUSE; Gi_number: 17375610; Description: DnaJ homolog subfamily B member 11 precursor;

Seq ID: 1305; Accession: Q99758; Swissprot_id: ABC3_HUMAN; Gi_number: 7387524; Description: ATP-binding cassette, sub-family A, member 3 (ATP-binding cassette transporter 3) (ATP-binding cassette 3) (ABC-C transporter);

Seq ID: 1307; Accession: P43291; Swissprot_id: ASK1_ARATH; Gi_number: 1168529; Description: Serine/threonine-protein kinase ASK1;

Seq ID: 1309; Accession: P42730; Swissprot_id: H101_ARATH; Gi_number: 1170149; Description: HEAT SHOCK PROTEIN 101;

Seq ID: 1310; Accession: P30148; Swissprot_id: TAL-B_ECOLI; Gi_number: 401158; Description: Transaldolase B;

Seq ID: 1311; Accession: P37370; Swissprot_id: VRP1_YEAST; Gi_number: 2507155; Description: VERPROLIN;

Seq ID: 1312; Accession: Q9XI18; Swissprot_id: KAD_THEMA; Gi_number: 9910756; Description: Adenylate kinase (ATP-AMP transphosphorylase);

Seq ID: 1313; Accession: P03211; Swissprot_id: EBN1_EBV; Gi_number: 119110; Description: EBNA-1 NUCLEAR PROTEIN;

Seq ID: 1314; Accession: Q04629; Swissprot_id: PSLA_YEAST; Gi_number: 18202481; Description: PSL10 protein;

Seq ID: 1315; Accession: P70315; Swissprot_id: WASP_MOUSE; Gi_number: 2499130; Description: Wiskott-Aldrich syndrome protein homolog (WASP);

Seq ID: 1316; Accession: Q9D832; Swissprot_id: DJB4_MOUSE; Gi_number: 18202849; Description: DnaJ homolog subfamily B member 4;

Seq ID: 1318; Accession: O07597; Swissprot_id: DAAA_BACSU; Gi_number: 3121979; Description: D-alanine aminotransferase (D-aspartate aminotransferase) (D-amino acid aminotransferase) (D-amino acid transaminase) (DAAT);

Seq ID: 1319; Accession: P13686; Swissprot_id: PPA5_HUMAN; Gi_number: 130722; Description: Tartrate-resistant acid phosphatase type 5 precursor (TR-AP) (Tartrate-resistant acid ATPase) (TrATPase);

Seq ID: 1320; Accession: P06921; Swissprot_id: VE2_HPV05; Gi_number: 1352839; Description: REGULATORY PROTEIN E2;

Seq ID: 1321; Accession: P29518; Swissprot_id: BT1_MAIZE; Gi_number: 231654; Description: Brittle-1 protein, chloroplast precursor;

Seq ID: 1322; Accession: Q12899; Swissprot_id: Z173_HUMAN; Gi_number: 17380344; Description: Zinc finger protein 173 (Acid finger protein) (AFP);

Seq ID: 1323; Accession: P74667; Swissprot_id: DAPF_SYNY3; Gi_number: 2494041; Description: Diaminopimelate epimerase (DAP epimerase);

Seq ID: 1324; Accession: P93531; Swissprot_id: C7D7_SOLCH; Gi_number: 5915836; Description: CYTOCHROME P450 71D7;

Seq ID: 1325; Accession: P52425; Swissprot_id: GPDA_CUPLA; Gi_number: 1708025; Description: GLYCEROL-3-PHOSPHATE DEHYDROGENASE [NAD+];

Seq ID: 1326; Accession: Q01042; Swissprot_id: IE68_HSVSA; Gi_number: 266334; Description: IMMEDIATE-EARLY PROTEIN;

Seq ID: 1327; Accession: P21997; Swissprot_id: SSG-P_VOLCA; Gi_number: 134920; Description: SULFATED SURFACE GLYCOPROTEIN 185 (SSG 185);

Seq ID: 1329; Accession: P10978; Swissprot_id: POLX_TOBAC; Gi_number: 130582; Description: Retrovirus-related Pol polyprotein from transposon TNT 1-94 [Contains: Protease; Reverse transcriptase; Endonuclease];

Seq ID: 1332; Accession: O60315; Swissprot_id: SIP1_HUMAN; Gi_number: 13124503; Description: ZINC FINGER HOMEOBOX PROTEIN 1B (SMAD INTERACTING PROTEIN 1);

Seq ID: 1333; Accession: O10296; Swissprot_id: IAP1_NPVOP; Gi_number: 2497245; Description: Apoptosis inhibitor 1 (IAP-1);

Seq ID: 1334; Accession: P37370; Swissprot_id: VRP1_YEAST; Gi_number: 2507155; Description: VERPROLIN;

Seq ID: 1335; Accession: Q9UBV2; Swissprot_id: SE1L_HUMAN; Gi_number: 13878770; Description: SEL-1 HOMOLOG PRECURSOR (SUPPRESSOR OF LIN-12-LIKE PROTEIN) (SEL-1L);

Seq ID: 1338; Accession: Q40680; Swissprot_id: EF1B_ORYSA; Gi_number: 6166140; Description: ELONGATION FACTOR 1-BETA (EF-1-BETA);

Seq ID: 1339; Accession: P14328; Swissprot_id: SP96_DICDI; Gi_number: 134780; Description: SPORE COAT PROTEIN SP96;

Seq ID: 1341; Accession: P14328; Swissprot_id: SP96_DICDI; Gi_number: 134780; Description: SPORE COAT PROTEIN SP96;

Seq ID: 1342; Accession: O22815; Swissprot_id: MLO5_ARATH; Gi_number: 6137253; Description: MLO-like protein 5 (AtMlo5);

Seq ID: 1343; Accession: Q02817; Swissprot_id: MUC2_HUMAN; Gi_number: 2506877; Description: MUCIN 2 PRECURSOR (INTESTINAL MUCIN 2);

Seq ID: 1345; Accession: P78621; Swissprot_id: SEPA_EMENI; Gi_number: 15214279; Description: CYTOKINESIS PROTEIN SEPA (FH1/2 PROTEIN) (FORCED EXPRESSION INHIBITION OF GROWTH A);

Seq ID: 1347; Accession: Q12849; Swissprot_id: GRF1_HUMAN; Gi_number: 2500579; Description: G-rich sequence factor-1 (GRSF-1);

Seq ID: 1349; Accession: P08393; Swissprot_id: ICP0_HSV11; Gi_number: 124134; Description: Trans-acting transcriptional protein ICP0 (Immediate-early protein IE110) (VMW110) (Alpha-0 protein);

Seq ID: 1350; Accession: Q9UMN6; Swissprot_id: TRX2_HUMAN; Gi_number: 12643900; Description: TRITHORAX HOMOLOG 2 (MIXED LINEAGE LEUKEMIA GENE HOMOLOG 2 PROTEIN);

Seq ID: 1352; Accession: P11219; Swissprot_id: AGI_ORYSA; Gi_number: 113509; Description: LECTIN PRECURSOR (AGGLUTININ);

Seq ID: 1353; Accession: P04146; Swissprot_id: COPI_DROME; Gi_number: 13124684; Description: Copia protein [Contains: Copia VLP protein; Copia protease;];

Seq ID: 1354; Accession: P93531; Swissprot_id: C7D7_SOLCH; Gi_number: 5915836; Description: CYTOCHROME P450 71D7;

Seq ID: 1355; Accession: P28968; Swissprot_id: VGLX_HSVEB; Gi_number: 138350; Description: GLYCOPROTEIN X PRECURSOR;

Seq ID: 1357; Accession: P76004; Swissprot_id: YCGM_ECOLI; Gi_number: 9789812; Description: Protein ycgM;

Seq ID: 1358; Accession: P33296; Swissprot_id: UBC6_YEAST; Gi_number: 464983; Description: UBIQUITIN-CONJUGATING ENZYME E2-28.4 KD (UBIQUITIN-PROTEIN LIGASE) (UBIQUITIN CARRIER PROTEIN);

Seq ID: 1360; Accession: P51530; Swissprot_id: DN2L_HUMAN; Gi_number: 2506893; Description: DNA2-like homolog (DNA replication helicase-like homolog);

Seq ID: 1362; Accession: P05143; Swissprot_id: PRP3_MOUSE; Gi_number: 131002; Description: PROLINE-RICH PROTEIN MP-3;

Seq ID: 1363; Accession: P93411; Swissprot_id: CG1C_ORYSA; Gi_number: 3334144; Description: G1/S-SPECIFIC CYCLIN C-TYPE;

Seq ID: 1365; Accession: O15145; Swissprot_id: AR21_HUMAN; Gi_number: 3121765; Description: ARP2/3 COMPLEX 21 KDA SUBUNIT (P21-ARC) (ACTIN-RELATED PROTEIN 2/3 COMPLEX SUBUNIT 3);

Seq ID: 1366; Accession: P37398; Swissprot_id: VIV_ORYSA; Gi_number: 586238; Description: VIVIPAROUS PROTEIN HOMOLOG;

Seq ID: 1367; Accession: P25032; Swissprot_id: EMP1_WHEAT; Gi_number: 119319; Description: DNA-BINDING EMBP-1 PROTEIN;

Seq ID: 1368; Accession: Q43716; Swissprot_id: UFOG_PETHY; Gi_number: 2501497; Description: Flavonol 3-O-glucosyltransferase (UDP-glucose flavonoid 3-O-glucosyltransferase) (Anthocyanin rhamnosyl transferase);

Seq ID: 1369; Accession: P52285; Swissprot_id: FP21_DICDI; Gi_number: 1706890; Description: GLYCOPROTEIN FP21 PRECURSOR;

Seq ID: 1370; Accession: P21997; Swissprot_id: SSG-P_VOLCA; Gi_number: 134920; Description: SULFATED SURFACE GLYCOPROTEIN 185 (SSG 185);

Seq ID: 1372; Accession: P40602; Swissprot_id: APG_ARATH; Gi_number: 728867; Description: ANTER-SPECIFIC PROLINE-RICH PROTEIN APG PRECURSOR;

Seq ID: 1373; Accession: P36044; Swissprot_id: MNN4_YEAST; Gi_number: 3915759; Description: MNN4 PROTEIN;

Seq ID: 1376; Accession: P34127; Swissprot_id: MYBH_DICDI; Gi_number: 462671; Description: Myb-like protein;

Seq ID: 1377; Accession: P20025; Swissprot_id: MYB3_MAIZE; Gi_number: 127582; Description: Myb-related protein Zm38;

Seq ID: 1379; Accession: P28968; Swissprot_id: VGLX_HSVEB; Gi_number: 138350; Description: GLYCOPROTEIN X PRECURSOR;

Seq ID: 1382; Accession: O15194; Swissprot_id: NIF1_HUMAN; Gi_number: 17865502; Description: Nuclear LIM interactor-interacting factor 1 (NLI-interacting factor 1) (NIF-like protein) (YA22 protein) (HYA22);

Seq ID: 1384; Accession: P13027; Swissprot_id: ARRS_MAIZE; Gi_number: 114217; Description: ANTHOCYANIN REGULATORY R-S PROTEIN;

Seq ID: 1385; Accession: P52285; Swissprot_id: FP21_DICDI; Gi_number: 1706890; Description: GLYCOPROTEIN FP21 PRECURSOR;

Seq ID: 1389; Accession: P80073; Swissprot_id: MYB2_PHYPA; Gi_number: 462669; Description: Myb-related protein Pp2;

Seq ID: 1391; Accession: P14328; Swissprot_id: SP96_DICDI; Gi_number: 134780; Description: SPORE COAT PROTEIN SP96;

Seq ID: 1392; Accession: Q00765; Swissprot_id: DP1_HUMAN; Gi_number: 232007; Description: POLYPOSIS LOCUS PROTEIN 1 (TB2 PROTEIN);

Seq ID: 1394; Accession: Q9ZDW6; Swissprot_id: FER2_RICPR; Gi_number: 7227897; Description: Ferredoxin, 2Fe-2S;

Seq ID: 1397; Accession: Q40374; Swissprot_id: PR1_MEDTR; Gi_number: 2500715; Description: PATHOGENESIS-RELATED PROTEIN PR-1 PRECURSOR;

Seq ID: 1399; Accession: P33488; Swissprot_id: ABP4_MAIZE; Gi_number: 461451; Description: AUXIN-BINDING PROTEIN 4 PRECURSOR (ABP);

Seq ID: 1400; Accession: P10220; Swissprot_id: TEGU_HSV11; Gi_number: 135576; Description: LARGE TEGUMENT PROTEIN (VIRION PROTEIN UL36);

Seq ID: 1403; Accession: P52499; Swissprot_id: RCC1_CANAL; Gi_number: 1710046; Description: RCC1 protein;

Seq ID: 1404; Accession: P10243; Swissprot_id: MYBA_HUMAN; Gi_number: 1171089; Description: Myb-related protein A (A-Myb);

Seq ID: 1405; Accession: P45344; Swissprot_id: YADR_HAEIN; Gi_number: 1175501; Description: Protein HI1723;

Seq ID: 1406; Accession: P20967; Swissprot_id: ODO1_YEAST; Gi_number: 730221; Description: 2-OXOGLUTARATE DEHYDROGENASE E1 COMPONENT, MITOCHONDRIAL PRECURSOR (ALPHA-KETOGLUTARATE DEHYDROGENASE);

Seq ID: 1408; Accession: P42798; Swissprot_id: RS1A_ARATH; Gi_number: 1173218; Description: 40S ribosomal protein S15A;

Seq ID: 1413; Accession: Q9ZNV5; Swissprot_id: CEN_ARATH; Gi_number: 17366125; Description: CENTRORADIALIS-like protein;

Seq ID: 1415; Accession: P81489; Swissprot_id: PRP-P_HUMAN; Gi_number: 3914451; Description: SALIVARY PROLINE-RICH PROTEIN II-1;

Seq ID: 1416; Accession: P15941; Swissprot_id: MUC1_HUMAN; Gi_number: 547937; Description: MUCIN 1 PRECURSOR (POLYMORPHIC EPITHELIAL MUCIN) (PEM) (PEMT) (EPISIALIN) (TUMOR-ASSOCIATED MUCIN) (CARCINOMA-ASSOCIATED MUCIN) (TUMOR-ASSOCIATED EPITHELIAL MEMBRANE ANTIGEN) (EMA) (H23AG) (PEANUT-REACTIVE URINARY MUCIN) (PUM) (BREAST CARCINOMA-ASSOCIA>;

Seq ID: 1417; Accession: P03360; Swissprot_id: POL_AVIRE; Gi_number: 130584; Description: POL polyprotein [Contains: Reverse transcriptase; Endonuclease];

Seq ID: 1419; Accession: P23246; Swissprot_id: SFPQ_HUMAN; Gi_number: 1709851; Description: SPLICING FACTOR, PROLINE-AND GLUTAMINE-RICH (POLYPYRIMINE TRACT-BINDING PROTEIN-ASSOCIATED SPLICING FACTOR) (PTB-ASSOCIATED SPLICING FACTOR) (PSF) (DNA-BINDING P52/P100 COMPLEX, 100 KDA SUBUNIT);

Seq ID: 1420; Accession: Q61768; Swissprot_id: KINH_MOUSE; Gi_number: 2497519; Description: KINESIN HEAVY CHAIN (UBIQUITOUS KINESIN HEAVY CHAIN) (UKHC);

Seq ID: 1421; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1422; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1423; Accession: P16157; Swissprot_id: ANK1_HUMAN; Gi_number: 113884; Description: Ankyrin 1 (Erythrocyte ankyrin) (Ankyrin R);

Seq ID: 1424; Accession: P54121; Swissprot_id: AIG2_ARATH; Gi_number: 1703220; Description: AIG2 protein;

Seq ID: 1425; Accession: P26810; Swissprot_id: POL_MLVF5; Gi_number: 130641; Description: POL POLYPROTEIN [CONTAINS: PROTEASE; REVERSE TRANSCRIPTASE; RIBONUCLEASE H];

Seq ID: 1426; Accession: P23246; Swissprot_id: SFPQ_HUMAN; Gi_number: 1709851; Description: SPLICING FACTOR, PROLINE-AND GLUTAMINE-RICH (POLYPYRIDINE TRACT-BINDING PROTEIN-ASSOCIATED SPLICING FACTOR) (PTB-ASSOCIATED SPLICING FACTOR) (PSF) (DNA-BINDING P52/P100 COMPLEX, 100 KDA SUBUNIT);

Seq ID: 1427; Accession: Q06548; Swissprot_id: APKA_ARATH; Gi_number: 1168470; Description: Protein kinase APK1A;

Seq ID: 1428; Accession: Q02496; Swissprot_id: MUC1_MOUSE; Gi_number: 547938; Description: Mucin 1 precursor (Polymorphic epithelial mucin) (PEMT) (Episialin);

Seq ID: 1429; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1430; Accession: O00268; Swissprot_id: T2D3_HUMAN; Gi_number: 3024681; Description: TRANSCRIPTION INITIATION FACTOR TFIID 135 KDA SUBUNIT (TAFII-135) (TAFII135) (TAFII-130) (TAFII130);

Seq ID: 1431; Accession: Q02817; Swissprot_id: MUC2_HUMAN; Gi_number: 2506877; Description: MUCIN 2 PRECURSOR (INTESTINAL MUCIN 2);

Seq ID: 1432; Accession: O18746; Swissprot_id: HSP1_PLAMS; Gi_number: 3023963; Description: Sperm protamine P1;

Seq ID: 1433; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1434; Accession: Q02817; Swissprot_id: MUC2_HUMAN; Gi_number: 2506877; Description: MUCIN 2 PRECURSOR (INTESTINAL MUCIN 2);

Seq ID: 1435; Accession: Q9SJL6; Swissprot_id: GS27_ARATH; Gi_number: 11132470; Description: Probable 27 kDa Golgi SNARE protein (Golgi SNAP receptor complex member 2);

Seq ID: 1436; Accession: P21997; Swissprot_id: SSGP_VOLCA; Gi_number: 134920; Description: SULFATED SURFACE GLYCOPROTEIN 185 (SSG 185);

Seq ID: 1439; Accession: P10587; Swissprot_id: MYHB_CHICK; Gi_number: 3915778; Description: Myosin heavy chain, gizzard smooth muscle;

Seq ID: 1441; Accession: O96614; Swissprot_id: SER1_GALME; Gi_number: 9087201; Description: Sericin-1 (Silk gum protein 1);

Seq ID: 1445; Accession: P28968; Swissprot_id: VGLX_HSVEB; Gi_number: 138350; Description: GLYCOPROTEIN X PRECURSOR;

Seq ID: 1448; Accession: Q9UKN7; Swissprot_id: MY15_HUMAN; Gi_number: 13124361; Description: Myosin XV (Unconventional myosin-15);

Seq ID: 1449; Accession: Q02817; Swissprot_id: MUC2_HUMAN; Gi_number: 2506877; Description: MUCIN 2 PRECURSOR (INTESTINAL MUCIN 2);

Seq ID: 1450; Accession: Q13303; Swissprot_id: KVB2_HUMAN; Gi_number: 18202496; Description: Voltage-gated potassium channel beta-2 subunit (K+ channel beta-2 subunit) (Kv-beta-2) (HKvbeta2);

Seq ID: 1451; Accession: P27884; Swissprot_id: CCAA_RABIT; Gi_number: 399201; Description: VOLTAGE-DEPENDENT P/Q-TYPE CALCIUM CHANNEL ALPHA-1A SUBUNIT (CALCIUM CHANNEL, L TYPE, ALPHA-1 POLYPEPTIDE ISOFORM 4) (BRAIN CALCIUM CHANNEL I) (BI);

Seq ID: 1452; Accession: P18583; Swissprot_id: SON_HUMAN; Gi_number: 586013; Description: SON PROTEIN (SON3);

Seq ID: 1453; Accession: P04146; Swissprot_id: COPI_DROME; Gi_number: 13124684; Description: Copia protein [Contains: Copia VLP protein; Copia protease];

Seq ID: 1454; Accession: P13983; Swissprot_id: EXTN_TOBAC; Gi_number: 119714; Description: Extensin precursor (Cell wall hydroxyproline-rich glycoprotein);

Seq ID: 1456; Accession: O08808; Swissprot_id: DIA1_MOUSE; Gi_number: 6014968; Description: Diaphanous protein homolog 1 (Diaphanous-related formin 1) (DRF1) (mDIA1) (p140mDIA);

Seq ID: 1457; Accession: P29836; Swissprot_id: ICP0_HSVBK; Gi_number: 266331; Description: Trans-acting transcriptional protein ICP0 (P135 protein) (IER 2.9/ER2.6);

Seq ID: 1462; Accession: Q9UKN7; Swissprot_id: MY15_HUMAN; Gi_number: 13124361; Description: Myosin XV (Unconventional myosin-15);

Seq ID: 1463; Accession: Q05860; Swissprot_id: FMN1_MOUSE; Gi_number: 544346; Description: Formin 1 isoforms I/II/III (Limb deformity protein);

Seq ID: 1465; Accession: Q05085; Swissprot_id: CHL1_ARATH; Gi_number: 544018; Description: Nitrate/chlorate transporter;

Seq ID: 1467; Accession: Q9NVW2; Swissprot_id: RNFB_HUMAN; Gi_number: 13124522; Description: RING FINGER PROTEIN 12 (LIM DOMAIN INTERACTING RING FINGER PROTEIN) (RING FINGER LIM DOMAIN-BINDING PROTEIN) (R-LIM) (NY-REN-43 ANTIGEN);

Seq ID: 1469; Accession: O58263; Swissprot_id: PFDA_PYRHO; Gi_number: 12230417; Description: Prefoldin alpha subunit (GimC alpha subunit);

Seq ID: 1470; Accession: P27572; Swissprot_id: NU4M_WHEAT; Gi_number: 128766; Description: NADH-UBIQUINONE OXIDOREDUCTASE CHAIN 4;

Seq ID: 1471; Accession: O08808; Swissprot_id: DIA1_MOUSE; Gi_number: 6014968; Description: Diaphanous protein homolog 1 (Diaphanous-related formin 1) (DRF1) (mDIA1) (p140mDIA);

Seq ID: 1474; Accession: P08742; Swissprot_id: COX1_MAIZE; Gi_number: 1169027; Description: CYTOCHROME C OXIDASE POLYPEPTIDE I;

Seq ID: 1476; Accession: P54970; Swissprot_id: ILL2_ARATH; Gi_number: 1708462; Description: IAA-AMINO ACID HYDROLASE HOMOLOG 2 PRECURSOR;

Seq ID: 1480; Accession: O00233; Swissprot_id: PSD9_HUMAN; Gi_number: 12230943; Description: 26S proteasome regulatory subunit p27 (26S proteasome non-ATPase subunit 9);

Seq ID: 1481; Accession: P21519; Swissprot_id: MAM_DROME; Gi_number: 126721; Description: NEUROGENIC PROTEIN MASTERMIND;

Seq ID: 1487; Accession: P12978; Swissprot_id: EBN2_EBV; Gi_number: 119111; Description: EBNA-2 NUCLEAR PROTEIN;

Seq ID: 1489; Accession: P93329; Swissprot_id: NO20_MEDTR; Gi_number: 3914142; Description: EARLY NODULIN 20 PRECURSOR (N-20);

Seq ID: 1490; Accession: Q07878; Swissprot_id: VP13_YEAST; Gi_number: 2499125; Description: VACUOLAR PROTEIN SORTING-ASSOCIATED PROTEIN VPS13;

Seq ID: 1491; Accession: P41410; Swissprot_id: RA54_SCHPO; Gi_number: 3123262; Description: DNA REPAIR PROTEIN RHP54 (RAD54 HOMOLOG);

Seq ID: 1492; Accession: P10978; Swissprot_id: POLX_TOBAC; Gi_number: 130582; Description: Retrovirus-related Pol polyprotein from transposon TNT 1-94 [Contains: Protease; Reverse transcriptase; Endonuclease];

Seq ID: 1493; Accession: P14922; Swissprot_id: SSN6_YEAST; Gi_number: 117936; Description: GLUCOSE REPRESSION MEDIATOR PROTEIN;

Seq ID: 1494; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1495; Accession: Q05654; Swissprot_id: RDPO_SCHPO; Gi_number: 1710054; Description: RETROTRANSPOSABLE ELEMENT TF2 155 KDA PROTEIN;

Seq ID: 1496; Accession: Q9SYQ8; Swissprot_id: CLV1_ARATH; Gi_number: 12643323; Description: RECEPTOR PROTEIN KINASE CLAVATA1 PRECURSOR;

Seq ID: 1497; Accession: Q24492; Swissprot_id: RFA1_DROME; Gi_number: 2498844; Description: REPLICATION PROTEIN A 70 KDA DNA-BINDING SUBUNIT (RP-A) (RF-A) (REPLICATION FACTOR-A PROTEIN 1) (SINGLE-STRANDED DNA-BINDING PROTEIN) (DM-RPA1);

Seq ID: 1498; Accession: Q05654; Swissprot_id: RDPO_SCHPO; Gi_number: 1710054; Description: RETROTRANSPOSABLE ELEMENT TF2 155 KDA PROTEIN;

Seq ID: 1499; Accession: P10394; Swissprot_id: POL4_DROME; Gi_number: 130407; Description: Retrovirus-related Pol polyprotein from transposon 412 [Contains: Protease; Reverse transcriptase; Endonuclease];

Seq ID: 1500; Accession: P29375; Swissprot_id: RBB2_HUMAN; Gi_number: 1710032; Description: Retinoblastoma-binding protein 2 (RBBP-2);

Seq ID: 1501; Accession: P40477; Swissprot_id: N159_YEAST; Gi_number: 731862; Description: Nucleoporin NUP159 (Nuclear pore protein NUP159);

Seq ID: 1502; Accession: P10394; Swissprot_id: POL4_DROME; Gi_number: 130407; Description: Retrovirus-related Pol polyprotein from transposon 412 [Contains: Protease; Reverse transcriptase; Endonuclease];

Seq ID: 1503; Accession: Q9NZW4; Swissprot_id: DSPP_HUMAN; Gi_number: 17865470; Description: Dentin sialophosphoprotein precursor [Contains: Dentin phosphoprotein (Dentin phosphophoryn) (DPP); Dentin sialoprotein (DSP)];

Seq ID: 1504; Accession: P28968; Swissprot_id: VGLX_HSVEB; Gi_number: 138350; Description: GLYCOPROTEIN X PRECURSOR;

Seq ID: 1505; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1506; Accession: P18583; Swissprot_id: SON_HUMAN; Gi_number: 586013; Description: SON PROTEIN (SON3);

Seq ID: 1508; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1510; Accession: P49118; Swissprot_id: BIP_LYCES; Gi_number: 1346172; Description: Luminal binding protein precursor (BiP) (78 kDa glucose-regulated protein homolog) (GRP 78);

Seq ID: 1513; Accession: P35817; Swissprot_id: BDF1_YEAST; Gi_number: 5921175; Description: BDF1 PROTEIN;

Seq ID: 1514; Accession: P19683; Swissprot_id: ROC4_NICSY; Gi_number: 133248; Description: 31 kDa ribonucleoprotein, chloroplast precursor;

Seq ID: 1515; Accession: P25822; Swissprot_id: PUM_DROME; Gi_number: 131605; Description: MATERNAL PUMILIO PROTEIN;

Seq ID: 1516; Accession: Q9SYQ8; Swissprot_id: CLV1_ARATH; Gi_number: 12643323; Description: RECEPTOR PROTEIN KINASE CLAVATA1 PRECURSOR;

Seq ID: 1517; Accession: O97159; Swissprot_id: CHDM_DROME; Gi_number: 13124018; Description: CHROMODOMAIN HELICASE-DNA-BINDING PROTEIN MI-2 HOMOLOG (DMI-2);

Seq ID: 1518; Accession: P04929; Swissprot_id: HRPX_PLALO; Gi_number: 123530; Description: HISTIDINE-RICH GLYCOPROTEIN PRECURSOR;

Seq ID: 1520; Accession: P08393; Swissprot_id: ICP0_HSV11; Gi_number: 124134; Description: Trans-acting transcriptional protein ICP0 (Immediate-early protein IE110) (VMW110) (Alpha-0 protein);

Seq ID: 1522; Accession: P43293; Swissprot_id: NAK_ARATH; Gi_number: 1171642; Description: Probable serine/threonine-protein kinase NAK;

Seq ID: 1525; Accession: P26599; Swissprot_id: PTB_HUMAN; Gi_number: 131528; Description: Polypyrimidine tract-binding protein (PTB) (Heterogeneous nuclear ribonucleoprotein I) (hnRNP I) (57 kDa RNA-binding protein PPTB-1);

Seq ID: 1526; Accession: P04323; Swissprot_id: POL3_DROME; Gi_number: 130405; Description: Retrovirus-related Pol polyprotein from transposon 17.6 [Contains: Protease; Reverse transcriptase; Endonuclease];

Seq ID: 1528; Accession: P47179; Swissprot_id: DAN4_YEAST; Gi_number: 1352944; Description: Cell wall protein DAN4 precursor;

Seq ID: 1529; Accession: Q63003; Swissprot_id: 5E5_RAT; Gi_number: 2498095; Description: 5E5 ANTIGEN;

Seq ID: 1530; Accession: Q94981; Swissprot_id: ARI1_DROME; Gi_number: 18202622; Description: Ariadne-1 protein (Ari-1);

Seq ID: 1533; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1534; Accession: P19837; Swissprot_id: SPD1_NEPCL; Gi_number: 1174414; Description: SPIDROIN 1 (DRAGLINE SILK FIBROIN 1);

Seq ID: 1535; Accession: P21997; Swissprot_id: SSG-P_VOLCA; Gi_number: 134920; Description: SULFATED SURFACE GLYCOPROTEIN 185 (SSG 185);

Seq ID: 1537; Accession: P07237; Swissprot_id: PDI_HUMAN; Gi_number: 2507460; Description: PROTEIN DISULFIDE ISOMERASE PRECURSOR (PDI) (PROLYL 4-HYDROXYLASE BETA SUBUNIT) (CELLULAR THYROID HORMONE BINDING PROTEIN) (P55);

Seq ID: 1538; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1539; Accession: P40602; Swissprot_id: APG_ARATH; Gi_number: 728867; Description: ANTERSPECIFIC PROLINE-RICH PROTEIN APG PRECURSOR;

Seq ID: 1540; Accession: P48731; Swissprot_id: ATH1_ARATH; Gi_number: 1351999; Description: Homeobox protein ATH1;

Seq ID: 1542; Accession: P02845; Swissprot_id: VIT2_CHICK; Gi_number: 138595; Description: VITELLOGENIN II PRECURSOR (MAJOR VITELLOGENIN) [CONTAINS: LIPOVITELLIN I (LVI); PHOSVITIN (PV); LIPOVITELLIN II (LVII); YGP40];

Seq ID: 1543; Accession: Q02817; Swissprot_id: MUC2_HUMAN; Gi_number: 2506877; Description: MUCIN 2 PRECURSOR (INTESTINAL MUCIN 2);

Seq ID: 1544; Accession: O08816; Swissprot_id: WASL_RAT; Gi_number: 13431956; Description: Neural Wiskott-Aldrich syndrome protein (N-WASP);

Seq ID: 1545; Accession: P23116; Swissprot_id: IF3A_MOUSE; Gi_number: 6686292; Description: EUKARYOTIC TRANSLATION INITIATION FACTOR 3 SUBUNIT 10 (EIF-3 THETA) (EIF3 P167) (EIF3 P180) (EIF3 P185) (P162; PROTEIN) (CENTROSOMIN);

Seq ID: 1546; Accession: P23246; Swissprot_id: SFPQ_HUMAN; Gi_number: 1709851; Description: SPLICING FACTOR, PROLINE-AND GLUTAMINE-RICH (POLYPYRIMIDINE TRACT-BINDING PROTEIN-ASSOCIATED SPLICING FACTOR) (PTB-ASSOCIATED SPLICING FACTOR) (PSF) (DNA-BINDING P52/P100 COMPLEX, 100 KDA SUBUNIT);

Seq ID: 1548; Accession: P28284; Swissprot_id: ICP0_HSV2H; Gi_number: 124135; Description: Trans-acting transcriptional protein ICP0 (VMW118 protein);

Seq ID: 1549; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1550; Accession: Q02817; Swissprot_id: MUC2_HUMAN; Gi_number: 2506877; Description: MUCIN 2 PRECURSOR (INTESTINAL MUCIN 2);

Seq ID: 1551; Accession: P28968; Swissprot_id: VGLX_HSVEB; Gi_number: 138350; Description: GLYCOPROTEIN X PRECURSOR;

Seq ID: 1553; Accession: P21997; Swissprot_id: SSG-P_VOLCA; Gi_number: 134920; Description: SULFATED SURFACE GLYCOPROTEIN 185 (SSG 185);

Seq ID: 1554; Accession: P18583; Swissprot_id: SON_HUMAN; Gi_number: 586013; Description: SON PROTEIN (SON3);

Seq ID: 1555; Accession: P08640; Swissprot_id: AMYH_YEAST; Gi_number: 728850; Description: GLUCOAMYLASE S1/S2 PRECURSOR (GLUCAN 1,4-ALPHA-GLUCOSIDASE) (1,4-ALPHA-D-GLUCAN GLUCOHYDROLASE);

Seq ID: 1556; Accession: P13290; Swissprot_id: VGLG_HSV2H; Gi_number: 138297; Description: GLYCOPROTEIN G;

Seq ID: 1557; Accession: O43791; Swissprot_id: SPOP_HUMAN; Gi_number: 8134708; Description: Speckle-type POZ protein;

Seq ID: 1559; Accession: O43516; Swissprot_id: WAIP_HUMAN; Gi_number: 13124642; Description: WISKOTT-ALDRICH SYNDROME PROTEIN INTERACTING PROTEIN (WASP INTERACTING PROTEIN) (PRPL-2 PROTEIN);

Seq ID: 1560; Accession: P43335; Swissprot_id: PHS_PSEAE; Gi_number: 1172494; Description: Pterin-4-alpha-carbinolamine dehydratase (PHS) (4-alpha-hydroxy-tetrahydropterin dehydratase) (Pterin carbinolamine dehydratase) (PCD);

Seq ID: 1562; Accession: P04694; Swissprot_id: ATTY_RAT; Gi_number: 114714; Description: Tyrosine aminotransferase (L-tyrosine:2-oxoglutarate aminotransferase) (TAT);

Seq ID: 1563; Accession: O82768; Swissprot_id: H1S2_ARATH; Gi_number: 11132859; Description: Histidine biosynthesis bifunctional protein hisIE, chloroplast precursor [Includes: Phosphoribosyl-AMP cyclohydrolase (PRA-CH); Phosphoribosyl-ATP pyrophosphatase (PRA-PH)];

Seq ID: 1564; Accession: P41878; Swissprot_id: PAD1_SCHPO; Gi_number: 3334476; Description: PROTEIN PAD1/SKS1;

Seq ID: 1566; Accession: P22793; Swissprot_id: TRHY_SHEEP; Gi_number: 586122; Description: Trichohyalin;

Seq ID: 1567; Accession: P22420; Swissprot_id: VE2_HPV47; Gi_number: 137682; Description: REGULATORY PROTEIN E2;

Seq ID: 1568; Accession: P27320; Swissprot_id: FER_SYNY3; Gi_number: 2507573; Description: Ferredoxin I;

Seq ID: 1569; Accession: P08393; Swissprot_id: ICP0_HSV11; Gi_number: 124134; Description: Trans-acting transcriptional protein ICP0 (Immediate-early protein IE110) (VMW110) (Alpha-0 protein);

Seq ID: 1570; Accession: P10569; Swissprot_id: MYSC_ACACA, Gi_number: 127749; Description: Myosin IC heavy chain;

Seq ID: 1571; Accession: P31271; Swissprot_id: HXAD_HUMAN; Gi_number: 2828197; Description: Homeobox protein Hox-A13 (Hox-1J);

Seq ID: 1572; Accession: P48384; Swissprot_id: THIM_PEA; Gi_number: 1351239; Description: THIOREDOXIN M-TYPE, CHLOROPLAST PRECURSOR (TRX-M);

Seq ID: 1573; Accession: P28968; Swissprot_id: VGLX_HSVEB; Gi_number: 138350; Description: GLYCOPROTEIN X PRECURSOR;

Seq ID: 1576; Accession: Q02817; Swissprot_id: MUC2_HUMAN; Gi_number: 2506877; Description: MUCIN 2 PRECURSOR (INTESTINAL MUCIN 2);

Seq ID: 1578; Accession: Q02283; Swissprot_id: HAT5_ARATH; Gi_number: 399900; Description: Homeobox-leucine zipper protein HAT5 (HD-ZIP protein 5) (HD-ZIP protein ATHB-1);

Seq ID: 1580; Accession: P08393; Swissprot_id: ICP0_HSV11; Gi_number: 124134; Description: Trans-acting transcriptional protein ICP0 (Immediate-early protein IE110) (VMW110) (Alpha-0 protein);

Seq ID: 1585; Accession: P03186; Swissprot_id: TEGU_EBV; Gi_number: 135574; Description: LARGE TEGUMENT PROTEIN;

Seq ID: 1586; Accession: Q9Y7B6; Swissprot_id: PANB_EMENI; Gi_number: 8134629; Description: 3-methyl-2-oxobutanoate hydroxymethyltransferase (Ketopantoate hydroxymethyltransferase);

Seq ID: 1588; Accession: Q06003; Swissprot_id: GOLI_DROME; Gi_number: 462193; Description: Goliath protein (G1 protein);

Seq ID: 1591; Accession: P26861; Swissprot_id: RM06_MARPO; Gi_number: 417682; Description: MITOCHONDRIAL 60S RIBOSOMAL PROTEIN L6;

Seq ID: 1592; Accession: O00401; Swissprot_id: WASL_HUMAN; Gi_number: 13431960; Description: Neural Wiskott-Aldrich syndrome protein (N-WASP);

Seq ID: 1593; Accession: P09065; Swissprot_id: HME1_MOUSE; Gi_number: 462292; Description: Homeobox protein engrailed-1 (Mo-En-1);

Seq ID: 1595; Accession: P33485; Swissprot_id: VNUA_PRVKA; Gi_number: 465445; Description: PROBABLE NUCLEAR ANTIGEN;

Seq ID: 1597; Accession: Q05063; Swissprot_id: LYOX_CHICK; Gi_number: 462560; Description: Protein-lysine 6-oxidase precursor (Lysyl oxidase).

TABLE 12

| Promoter Name | Unigene number | forward primer | reverse primer | PCR product size (bp) | Description |
|---|---|---|---|---|---|
| RC1 | AC00713825/ 12797_s_at | TACAAAAAAGCAGG CTCAAATTTTGGGTC ATGGATTAGTTTCACGC SEQ ID NO 6002 | TACAAGAAAGCTGGGT CTTCTCCTATCTGCATA AAATGGTATTTCACA SEQ ID NO 6003 | 1970 | |
| RC2 | AC000132.6/ 16420_at | TACAAAAAAGCAGG CTCAAGCCGCTTTCA CTTGACGGAACTTGC SEQ ID NO 6004 | TACAAGAAAGCTGGGT GGCTTATTTGCACCGG TATAAAGTTAGGGATC SEQ ID NO 6005 | 1003 | |
| RC3 | WT755/ 14701_s_at | TACAAAAAAGCAGG CTAGGCAACCCACCC TTCGGTGGTTG SEQ ID NO 6006 | TACAAGAAAGCTGGGT CCACGATGCAGAATAA AGGCATAAATTCAGAAGCA SEQ ID NO 6007 | 1260 | |
| RC4 | AF08012011/ 16935_s_at | TACAAAAAAGCAGG CTGGCACCTTCAAGT ACCAGTTTCCTTGAAATG SEQ ID NO 6008 | TACAAGAAAGCTGGGT ATCCAAACTACTCTCC GCGAAGTGTGTG SEQ ID NO 6009 | 1970 | |
| RC5 | Z151571/ 16982_at | TACAAAAAAGCAGG CTGCAACGAATTTAA TGGTGCAATCGGATCATG SEQ ID NO 6010 | TACAAGAAAGCTGGGT CGCAGAGGCTTATATA GAGGGGAG SEQ ID NO 6011 | 1897 | |
| RC6 | AL023094323/ 16515_s_at | TACAAAAAAGCAGG CTGCTCTAGCTTTAG TCCCGGTTTGGTAACACC SEQ ID NO 6012 | TACAAGAAAGCTGGGT CTTGCTTCCTCTTCTCT CTCCTCTCCGATG SEQ ID NO 6013 | 952 | |
| RC7 | ATU5629/ 15180_s_at | TACAAAAAAGCAGG CTGTCGACGTTACAT GAGGAACTTTCTTGTGC SEQ ID NO 6014 | TACAAGAAAGCTGGGT CCTCGGGTGTTTTGGTT TGGAGAG SEQ ID NO 6015 | 1940 | |
| RC8 | AF063901/ 14737_s_at | TACAAAAAAGCAGG CTCAGGCCATACAGC TCTATCGCCTCAGCCAG SEQ ID NO 6016 | TACAAGAAAGCTGGGT CACACACACACACACA AAGGCCCATCAGGCCC SEQ ID NO 6017 | 1276 | |
| RC9 | OS001432 | TACAAAAAAGCAGG CTGCATCCTCAACAT ACTGAAACAATGTACT | TACAAGAAAGCTGGGT GTGGAGGAGCACGCAG AGGA | 2050 | Similar to gi\|3461812\|gb\|AAC32906.1\|putative basic blue protein (plantacyanin) |

TABLE 12-continued

| Promoter Name | Unigene number | forward primer | reverse primer | PCR product size (bp) | Description |
|---|---|---|---|---|---|
| | | AAC SEQ ID NO 6018 | SEQ ID NO 6019 | | [*Arabidopsis thaliana*] |
| RC10 | OS004268 | TACAAAAAAGCAGG CTATGCCAGCCAAAT TGCCGGCCAAAGTGC CAAC SEQ ID NO 6020 | TACAAGAAAGCTGGGT TGCCGGCCGGTGGGCT GGTGCCT SEQ ID NO 6021 | 1947 | Similar to YPU3_RHOCA P26159 *RHODOBACTER CAPSULATUS* (*RHODOPSEUDOMONAS CAPSULATA*). HYPOTHETICAL 5.8 KD PROTEIN IN PUHA 5 REGION (ORF55). |
| RC11 | OS004356 | TACAAAAAAGCAGG CTCCAATATGGATAC AATCCGAGTAGTCCT TGTCG SEQ ID NO 6022 | TACAAGAAAGCTGGGT CGTCCATCTTTCCTTGC TCCTCTCACT SEQ ID NO 6023 | 1929 | Similar to SAHH_PYRFU P50251 *PYROCOCCUS FURIOSUS*. ADENOSYLHOMOCYSTEINASE (EC 3.3.1.1) (S-ADENOSYL-L-HOMOCYSTEINEHYDROLASE) (ADOHCYASE) (FRAGMENT). |
| RC12 | OS005221_r_at | TACAAAAAAGCAGG CTCGAGCAGGTATCG AGCATTGCCGTC SEQ ID NO 6024 | TACAAGAAAGCTGGGT TGTCACCCACCCCAAT CAAGCTAAGCTATCT SEQ ID NO 6025 | 2053 | |
| RC13 | OS024307_r_at | TACAAAAAAGCAGG CTATGTGTAACACGC ATGGTGTGATGG SEQ ID NO 6026 | TACAAGAAAGCTGGGT GTTGGATGAGGAGAAG GATGGATGG SEQ ID NO 6027 | 2000 | Similar to gi|8777294|dbj|BAA96884.1| gb|AAD26867.1~ gene_id: MAB16.4~ similar to unknown protein [*Arabidopsis thaliana*] |
| RC14 | OS014617.1_f_at | TACAAAAAAGCAGG CTGTGCTGTAATAGC TTGCCTTTGCTAAATC SEQ ID NO 6028 | TACAAGAAAGCTGGGT GCTTAGTAGTAGTAAT TGTTATTGTCTCCGG SEQ ID NO 6029 | 1989 | Similar to gi|4191792|gb|AAD10161.1| hypothetical protein [*Arabidopsis thaliana*] |
| RC15 | OS025078.1_r_at | TACAAAAAAGCAGG CTAGCATCAAGAACC AGTGAACGATGG SEQ ID NO 6030 | TACAAGAAAGCTGGGT TAAGGGGGTGTTTGGA TATAGGGTG SEQ ID NO 6031 | 1934 | Similar to gi|5932544|gb|AAD56999.1| AC009465_13 hypothetical protein [*Arabidopsis thaliana*] |
| RC16 | OS003603.1_r_at | TACAAAAAAGCAGG CTGAACTCTGGTCGT CATCACCACACC SEQ ID NO 6032 | TACAAGAAAGCTGGGT TTGGAGAGCTCGAGAG AGAGGGTTG SEQ ID NO 6033 | 1951 | Similar to YCE2_YEAST P25572 *SACCHAROMYCES CEREVISIAE* (BAKER S YEAST). HYPOTHETICAL 13.3 KD PROTEIN IN PD11-GLK1 INTERGENIC REGION. |
| RC17 | OS_ORF010093_r_at | TACAAAAAAGCAGG CTGCGCAAAACGGTA TAGGTCTGAACG SEQ ID NO 6034 | TACAAGAAAGCTGGGT AGAGACTGGTAGTAGC AGGGGGTGG SEQ ID NO 6035 | 1923 | Open Reading Frame OS_ORF010093 ST(R) HTC060970-A01.F.4 FRAME: 1 ORF: 2 LEN: 891 |
| RC18 | OS019298_r_at | TACAAAAAAGCAGG CTCGCATATCTTATT GCTCCGTAGTTCGTA TGAG SEQ ID NO 6036 | TACAAGAAAGCTGGGT CTGCTCGGCGAGGCAG GG SEQ ID NO 6037 | 1927 | Similar to YR01_CAEEL Q10014 *CAENORHABDITIS ELEGANS*. HYPOTHETICAL 26.0 KD PROTEIN T25E4.1 IN CHROMOSOME II PRECURSOR. |
| RC19 | OS004151_r_at | TACAAAAAAGCAGG CTACGATCAGACTCC TAATTGCCGCTC SEQ ID NO 6038 | TACAAGAAAGCTGGGT CATTGCGGCCAAAGCA AAGC SEQ ID NO 6039 | 1965 | Similar to gi|3406035|gb|AAC29139.1|TINY [*Arabidopsis thaliana*] |
| RC20 | OS012854_r_at | TACAAAAAAGCAGG CTCTCGGAACACGAA AACCAACTCAAC SEQ ID NO 6040 | TACAAGAAAGCTGGGT TTCCGATCTCTTCCCAT TTCCATTC SEQ ID NO 6041 | 1991 | Similar to YY19_HUMAN P09002 *HOMO SAPIENS* (HUMAN). HYPOTHETICAL Y-CHROMOSOMAL 19 KD PROTEIN. |
| RC21 | OS023348_r_at | TACAAAAAAGCAGG CTGGCATAGGATTAT GAATGGATGGTGC SEQ ID NO 6042 | TACAAGAAAGCTGGGT CATCCTTAGATGCGCG GCCAG SEQ ID NO 6043 | 1985 | Similar to Y168_HUMAN P50749 *HOMO SAPIENS* (HUMAN). HYPOTHETICAL PROTEIN KIAA0168. |
| RC22 | OS003824_r_at | TACAAAAAAGCAGG CTGGAGCATGATCTC TTTATAACTAACTTT ACATG SEQ ID NO 6044 | TACAAGAAAGCTGGGT GCGGGCCCGATGCGATC GG SEQ ID NO 6045 | 1992 | Similar to gi|8096630|dbj|BAA96201.1| hypothetical protein [*Oryza sativa*] |
| RC23 | OS007113_r_at | TACAAAAAAGCAGG CTGTGATATACGCAT AAGGAATTATTTCCTCCG SEQ ID NO 6046 | TACAAGAAAGCTGGGT GAGCACGTGGTGCGAG GGAAG SEQ ID NO 6047 | 1970 | Similar to gi|6553904|gb|AAF16570.1| AC012563_23 hypothetical protein [*Arabidopsis thaliana*] |
| RC24 | OS008815_r_at | TACAAAAAAGCAGG CTTTCGAAATCGTGC ATTCAACAAAGC SEQ ID NO 6048 | TACAAGAAAGCTGGGT GCTAGCAAGGGAGAG GTAGCGGAAG SEQ ID NO 6049 | 1940 | Similar to gi|1785674|emb|CAA69779.1| orf153a [*Arabidopsis thaliana*] |

TABLE 12-continued

| Promoter Name | Unigene number | forward primer | reverse primer | PCR product size (bp) | Description |
|---|---|---|---|---|---|
| RC25 | OS004598_r_at | TACAAAAAAGCAGG CTCTGTCACCGTCTT GACCCGACTTC SEQ ID NO 6050 | TACAAGAAAGCTGGGT GCGAACTAGATGGCGA GATTTGGTC SEQ ID NO 6051 | 1976 | Similar to LSHB_MOUSE O09108 *MUS MUSCULUS* (MOUSE). LUTROPIN BETA CHAIN PRECURSOR (LUTEINIZING HORMONE) (LSH-B) (LH-B) (FRAGMENT). |
| RC26 | OS021684_r_at | TACAAAAAAGCAGG CTGTACCCATGCCTT GCAACAATGTCC SEQ ID NO 6052 | TACAAGAAAGCTGGGT AAGTCGCGCCACATTG CTGTCATC SEQ ID NO 6053 | 1913 | Similar to IHA_SHEEP P38440 *OVIS ARIES* (SHEEP). INHIBIN ALPHA CHAIN (FRAGMENT). |
| RC27 | OS_ORF001938_r_at | TACAAAAAAGCAGG CTGCAAGGTGGACAA TGTGTGGAGTTC SEQ ID NO 6054 | TACAAGAAAGCTGGGT CAGAAGAGGAGTGATG GAGAAGAAGGC SEQ ID NO 6055 | 1949 | Open Reading Frame OS_ORF001938 HTC011169-A01.13 FRAME: 1 ORF: 2 LEN: 1011 |
| RC28 | OS_ORF013133_r_at | TACAAAAAAGCAGG CTGGGACCCATAGTC ACTGGGTGTTTG SEQ ID NO 6056 | TACAAGAAAGCTGGGT GCAGTCCCTCCTCTT GCAGC SEQ ID NO 6057 | 1976 | Open Reading Frame OS_ORF013133 HTC083102-A01.R.9 FRAME: -3 ORF: 2 LEN: 684 |
| RC29 | OS005221_r_at | TACAAAAAAGCAGG CTTGGAGGAACGAA GCAGTAGCACAAG SEQ ID NO 6058 | TACAAGAAAGCTGGGT TGTCACCCACCCCAAT CAAGCTAAG SEQ ID NO 6059 | 1957 | Similar to gi|8099126|dbj|BAA90498.1| rice ESTs AA754121, AW155454, D48581 correspond to a region of the predicated gene; unknown protein [*Oryza sativa*] |
| RC30 | OS_ORF001266_r_at | TACAAAAAAGCAGG CTCAAGCTCACCGGC GTCGTACTC SEQ ID NO 6060 | TACAAGAAAGCTGGGT CCACCGCCATCGACTC CTACTG SEQ ID NO 6061 | 1920 | Open Reading Frame OS_ORF001266 HTC007198-A01.6 FRAME: -2 ORF: 1 LEN: 669 |
| RC31 | OS_ORF013948_r_at | TACAAAAAAGCAGG CTCCCGTCAGTTTAA ATATAGGCACCCG SEQ ID NO 6062 | TACAAGAAAGCTGGGT GCCAGGGGCAAGGGTA GGAGAG SEQ ID NO 6063 | 1946 | Open Reading Frame OS_ORF013948 HTC089691-A01.R.17 FRAME: 2 ORF: 4 LEN: 738 |
| RC32 | OS_ORF014602_r_at | TACAAAAAAGCAGG CTCTCCAATCCTCGT CAATCCCATC SEQ ID NO 6064 | TACAAGAAAGCTGGGT GTTGGACTGACATGTG GGGC SEQ ID NO 6065 | 1997 | Open Reading Frame containing a Sage tag sequence near 3 end OS_ORFO14602 ST(F) HTC094277-A01.F.15 FRAME: 3 ORF: 1 LEN: 546 |
| RC33 | OS009022_r_at | TACAAAAAAGCAGG CTGTACATGTACCTG CATCAGAATCTAGTTC SEQ ID NO 6066 | TACAAGAAAGCTGGGT GCCACGTACGTTACGA TCAGTAAC SEQ ID NO 6067 | 1999 | Similar to gi|5006851|gb|AAD37696.1| AF145727_1 homeodomain leucine zipper protein [*Oryza sativa*] |
| RC34 | OS_ORF001266_r_at | CACCCGGAGAAGCTC ACGCCCTTG SEQ ID NO 6068 | GTATGTTCGCCGTGGC CATTTG SEQ ID NO 6069 | 1843 | Similar to gi|3461812|gb|AAC32906.1|putative basic blue protein (plantacyanin) [*Arabidopsis thaliana*] |
| RC35 | OS002956.1_s_at | CACCCTTGCGTGCAA TGATAGATGGTG SEQ ID NO 6070 | GAAATCGAACCGGACC CGAAC SEQ ID NO 6071 | 1212 | Similar to YPU3_RHOCA P26159 *RHODOBACTER CAPSULATUS* (*RHODOPSEUDOMONAS CAPSULATA*). HYPOTHETICAL 5.8 KD PROTEIN IN PUHA 5 REGION (ORF55). |
| RC36 | OS008536.1_r_at | CACCAGACACTGCAG AGATCCTCTTG SEQ ID NO 6072 | CCATGAGATAGATGTG GATGAGGTCC SEQ ID NO 6073 | 1926 | Similar to SAHH_PYRFU P50251 *PYROCOCCUS FURIOSUS*. ADENOSYLHOMOCYSTEINASE (EC 3.3.1.1) (S-ADENOSYL-L-HOMOCYSTEINEHYDROLASE) (ADOHCYASE) (FRAGMENT). |
| RC37 | OS009022_r_at | CACCAGACGAGTCTA GTGTCCATATAG SEQ ID NO 6074 | CACCCATCACAAGCCA ATGCAGAAGC SEQ ID NO 6075 | Doublechect 3' primer | |
| RC38 | OS022635_r_at | CACCTCCGGTGTACT TCGAGATAGTC SEQ ID NO 6076 | GACAAAGGAGTAGGAT CAATGCATGC SEQ ID NO 6077 | 1890 | Similar to gi|8777294|dbj|BAA96884.1| gb|AAD26867.1~ gene_id: MAB16.4~ similar to unknown protein [*Arabidopsis thaliana*] |

TABLE 13

Table of Rice promoter sequences tested in Example 14

| Identifier and Description | SEQ ID NO. |
|---|---|
| RA1_Syn518; Internal TMRI Rice GeneChip; Aleurone; Sequence Length 1854; AffyID OS012042_f_at; Contig ID CLC3338 | 6078 |
| RC17_Syn505; Internal TMRI Rice GeneChip; Constitutive; Sequence Length 1923; AffyID OSORF010093_r_at; Contig ID CL059867.90.94 | 6079 |
| RC22_Syn506; Internal TMRI Rice GeneChip; Constitutive; Sequence Length 1992; AffyID OS003824_r_at; Contig ID CLB19594.1 | 6080 |
| RC9_Syn503; Internal TMRI Rice GeneChip; Constitutive; Sequence Length 2050; AffyID OS001432_r_at | 6081 |
| REM13-1573 | 6082 |
| REM7-1567 | 6083 |
| REN5-549 | 6084 |
| RTG1-1580 | 6085 |
| RR1-1577 | 6086 |
| RS13_Syn512; Internal TMRI Rice GeneChip; Seed; Sequence Length 1994; AffyID OS003454.1_at Contig ID CL052017.5.3 | 6087 |
| RS15_Syn513; Internal TMRI Rice GeneChip; Seed; Sequence Length 1875; AffyID OS004734_at; Contig ID CL003323.137.114 | 6088 |
| RS25_Syn392; Internal TMRI Rice GeneChip; Seed specific (RS25 −2); Sequence Length 1969; AffyID: OS001550.1_at; Contig ID CL019182.106 | 6089 |
| RS26_Syn393; Internal TMRI Rice GeneChip; Seed specific (RS26 −1); Sequence Length 1994; AffyID: OS000191_at; Contig ID CL002551.147.31 | 6090 |
| RS3_Syn383; Internal TMRI Rice GeneChip; Seed specific (RS3 −1); Sequence Length 1953; AffyID: OS013446.1_f_at; Contig ID CLC12009 | 6091 |
| RS-4_Syn384; Internal TMRI Rice GeneChip; Seed specific (RS4 −3); Sequence Length 1977; AffyID: OSOO 12678_at; Contig ID CL006073.219 | 6092 |
| RS5-547 | 6093 |
| RS6_Syn385; Internal TMRI Rice GeneChip; Seed specific (RS6 −3); Sequence Length 1974; AffyID: OS001637.1_f_at; Contig ID CL034645.143.17 | 6094 |
| RS8_Syn386; Internal TMRI Rice GeneChip; Seed specific (RS8 −1); Sequence Length 1993; AffyID: OS009204_at; Contig ID CL012813.114 | 6095 |
| RT16-1620 | 6096 |
| RT27-1617 | 6097 |

REFERENCES

Abel et al., *Science*, 232:738 (1986).
Aharoni et al., *Plant Cell*, 5:613 (2000).
Altschul et al. *Nucleic Acids Res.*, 25:3389 (1997).
Altschul et al., *J. Mol. Biol.*, 215:403 (1990).
An et al., *EMBO J.*, 4:277 (1985).
Aoyama et al., *Plant Journal*, 11:605 (1997).
AtMas, et al, *Plant Mol. Biol.*, 2:335 (1983).
Auch & Reth, *Nucleic Acids Research*, 18:6743 (1990).
Ballas et al., *Nucleic Acids Res.*, 17:7891 (1989).
Bansal et al., *Proc. Natl. Acad. Sci. USA*, 89:3654 (1992).
Barkai-Golan et al., *Arch. Microbiol.*, 116:119 (1978).
Barton et al., *Plant Physiol.*, 85:1103 (1987).
Batzer et al., *Nucleic Acid Res.*, 19:5081 (1991).
Beals et al., *Plant Cell*, 9:1527 (1997).
Belanger et al., *Genetics*, 129:863 (1991).
Bernal-Lugo and Leopold, *Plant Physiol.*, 98:1207 (1992).
Bevan et al., *Nucl. Acids Res.*, 11:369 (1983).
Bevan et al., *Nature*, 304:184 (1983).
Bevan, *Nucl. Acids Res.*, 12:8711 (1984).
Bird et al., *Plant Molecular Biology*, 11:651 (1988).
Bisaro, *Homologous Recomb. Gene Silencing Plants*, pp. 219-70, Paszkowski & Jerzy (eds.) (1994).
Blackman et al., *Plant Physiol.*, 100:225 (1992).
Blochlinger & Diggelmann, *Mol Cell Biol* 4:2929 (1984).
Bol et al., *Ann. Rev. Phytopath.*, 28:113 (1990).
Bouchez et al., *EMBO J.*, 8:4197 (1989).
Bouchez et al., *EMBO Journal*, 8:4197 (1989).
Bourouis et al., *EMBO J.*, 2:1099 (1983).
Bowler et al., *Ann. Rev. Plant Physiol.*, 43:83 (1992).
Branson and Guss, *Proc. North Central Branch Entomological Society of America* (1972).
Broakgert et al., *Science*, 245:110 (1989).
Brown et al., *PNAS USA*, 97:262 (2000).
Byrne et al. *Plant Cell Tissue and Organ Culture*, 8:3 (1987).
Callis et al., *Genes and Develop.*, 1:1183 (1987).
Callis et al., *J. Biol. Chem.*, 265:12486 (1990).
Campbell and Gowri, *Plant Physiol.*, 92:1 (1990).
Castrsana et al., *EMBO J.*, 7:1929 (1988).
Chandler et al., *Plant Cell*, 1:1175 (1989).
Chee et al. *Plant Physiol.*, 91:1212 (1989).
Chee et al., *Methods Mol. Biol.*, 44:101 (1995).
Christou et al. *Proc. Natl. Acad. Sci. USA*, 86:7500 (1989).
Christou et al., *Biotechnology*, 9:957 (1991).
Christou et al., *Plant Physiol.*, 87:671 (1988).
Coe et al., In: *Corn and Corn Improvement*, Sprague et al. (eds.) pp. 81-258 (1988).
Cordero et al., *Plant J.*, 6:141 (1994).
Corpet et al. *Nucleic Acids Res.*, 16:10881 (1988).
Coxson et al., *Biotropica*, 24:121 (1992).
Crameri et al., *Nature Biotech.*, 15:436 (1997).
Crameri et al., *Nature*, 391:288 (1998).
Crossway et al., *BioTechniques*, 4:320 (1986).
Cuozzo et al., *Bio/Technology*, 6:549 (1988).
Cutler et al., *J. Plant Physiol.*, 135:351 (1989).
Czako et al., *Mol. Gen. Genet.*, 235:33 (1992).
Czapla and Lang, *J. Econ. Entomol.*, 83:2480 (1990).
Datta et al., *Bio/Technology*, 8:736 (1990).
Davies et al., *Plant Physiol.*, 93:588 (1990).
Dayhoff et al., *Atlas of Protein Sequence and Structure*, Natl. Biomed. Res. Found., Washington, C.D. (1978).
De Blaere et al., *Meth. Enzymol.*, 143:277 (1987).
De Block et al. *Plant Physiol.*, 91:694 (1989).
De Block et al., *EMBO Journal*, 6:2513 (1987).
Della-Cioppa et al., *Plant Physiology*, 84:965-968 (1987).
Dellaporta et al., in *Chromosome Structure and Function*, Plenum Press, 263-282 (1988).
Dennis et al., *Nucleic Acids Res.*, 12:3983 (1984).
Depicker et al., *Plant Cell Reports*, 7:63 (1988).
DeRisi et al., *Science*, 278:680 (1997).
Desprez et al., *Plant J.*, 14:643 (1998).
Diekman & Fischer, *EMBO*, 7:3315 (1988).
Duggan et al., *Nat. Genet.*, 21:10 (1999).
Dunn et al., *Can. J. Plant Sci.*, 61:583 (1981).
Dure et al., *Plant Mol. Biol.*, 12:475 (1989).
Eisen et al., *PNAS USA*, 95:14863 (1998).
Ellis et al., *EMBO Journal*, 6:3203 (1987).
Elroy-Stein et al., *Proc. Natl. Acad. Sci. U.S.A.*, 86:6126 (1989).
English et al., *Plant Cell*, 8:179 (1996).
Erdmann et al., *J. Gen. Microbiol.*, 138:363 (1992).
Everett et al., *Bio/Technology*, 5:1201 (1987).
Fitzpatrick, *Gen. Engineering News*, 22:7 (1993).
Franken et al., *EMBO J.*, 10:2605 (1991).
Fromm et al., *Nature (London)*, 319:791 (1986).
Fromm et al., *Bio/Technology*, 8:833 (1990).
Gallie et al., *Nucleic Acids Res.*, 15:3257 (1987).
Gallie et al., *The Plant Cell*, 1:301 (1989).
Gan et al., *Science*, 270:1986 (1995).
Gatehouse et al., *J. Sci. Food Agric.*, 35:373 (1984).

Gatz, *Current Opinion in Biotechnology*, 7:168 (1996).
Gatz, *Annu. Rev. Plant Physiol. Plant Mol. Biol.*, 48:89 (1997).
Gelfand, eds., *PCR Strategies* Academic Press, New York (1995).
Gelvin et al., *Plant Molecular Biology Manual*, (1990).
Giege et al., *Plant J.*, 15:721 (1998).
Gordon-Kamm et al., *Plant Cell*, 2:603 (1990).
Goring et al, *PNAS*, 88:1770 (1991).
Graham et al., *Biochem. Biophys. Res. Comm.*, 101:1164 (1981).
Graham et al., *J. Biol. Chem.*, 260:6555 (1985).
Graham et al., *J. Biol. Chem.*, 260:6561 (1985).
Gritz et al., *Gene*, 25:179 (1983).
Gruber, et al., *Vectors for Plant Transformation*, in: Methods in Plant Molecular Biology & Biotechnology" in Glich et al., (Eds. pp. 89-119, CRC Press, 1993).
Guerineau et al., *Mol. Gen. Genet.*, 262:141 (1991).
Guerrero et al., *Plant Mol. Biol.*, 15:11 (1990).
Gupta et al., *PNAS*, 90:1629 (1993).
Haines and Higgins (eds.), Nucleic Acid Hybridization, IRL Press, Oxford, U. K.
Hammock et al., *Nature*, 344:458 (1990).
Hemenway et al., *EMBO Journal*, 7:1273 (1988).
Henikoff & Henikoff, *Proc. Natl. Acad. Sci. USA*, 89:10915 (1989).
Hiei et al., *Plant J.*, 6:271 (1994).
Higgins et al., *CABIOS*, 5:151 (1989).
Higgins et al., *Gene*, 73:237 (1988).
Hilder et al., *Nature*, 330:160 (1987).
Hinchee et al. *Bio/Technology* 6:915 (1988).
Hoekema, In: *The Binary Plant Vector System*. Offset-drukkerij Kanters B. V.; Alblasserdam (1985).
Huang et al., *CABIOS*, 8:155 (1992).
Hudspeth & Grula, *Plant Molec. Biol.*, 12, 579 (1989).
Hughes et al., *J. Mol. Biol.*, 296:1205 (2000).
Ikeda et al., *J. Bacteriol.*, 169:5612 (1987).
Ikuta et al., *Biotech.*, 8:241 (1990).
Ingelbrecht et al., *Plant Cell*, 1:671 (1989).
Innis et al., *PCR Protocols: A Guide to Methods and Applications*, Academic Press, Inc., San Diego, Calif. (1990).
Innis and Gelfand, eds., *PCR Methods Manual* (Academic Press, New York) (1999).
Innis et al., eds., *PCR Protocols: A Guide to Methods and Applications* (Academic Press, New York (1995).
Jefferson et al, *EMBO J*, 6: 3901-3907 (1987).
Jobling et al., *Nature*, 325:622 (1987).
John et al., *Proc. Natl. Acad. Sci. USA*, 89:5769 (1992).
Johnson et al., *PNAS USA*, 86:9871 (1989)
Joshi et al., *Nucleic Acid Res.*, 15:9627 (1987).
Kaasen et al., *J. Bacteriol.*, 174:889 (1992).
Kagaya et al., *Nucleic Acids Res.*, 27:470 (1999).
Karlin and Altschul, *Proc. Natl. Acad. Sci. USA*, 87:2264 (1990).
Karlin and Altschul, *Proc. Natl. Acad. Sci. USA*, 90:5873 (1993).
Karsten et al., *Botanica Marina*, 35:11 (1992).
Katz et al., *J. Gen. Microbiol.* 129:2703 (1983).
Kehoe et al., *Trends Plant Sci.*, 4:38 (1999).
Keller et al., *EMBO Journal*, 8:1309 (1989).
Keller et al., *Genes Dev.*, 3:1639 (1989).
Klein et al., *Nature*, 327:70 (1987).
Klein et al., *Bio/Technology*, 6:559 (1988).
Klein et al., *Plant Physiol.*, 91:440 (1988).
Klein et al., *Proc. Natl. Acad. Sci. USA*, 85:4305 (1988).
Knauf, et al., Genetic Analysis of Host Range Expression by Agrobacterium In: *Molecular Genetics of the Bacteria-Plant Interaction*, Puhler, A. ed., Springer-Verlag, New York, 1983.
Koehl P. and Delarue M., *Curr. Opin. Struct. Biol.*, 6:222 (1996).
Kohler et al., *Plant Mol. Biol.*, 29:1293 (1995).
Koster and Leopold, *Plant Physiol.*, 88:829 (1988).
Koziel et al., *Biotechnology*, 11:194 (1993).
Kridl et al., *Seed Science Research*, 1:209 (1991).
Kriz et al., *Mol. Gen. Genet.*, 207:90 (1987).
Kunkel et al., *Methods in Enzymol.*, 154:367 (1987).
Kunkel, *Proc. Natl. Acad. Sci. USA*, 82:488 (1985).
Lam et al., *Plant Cell*, 1:1147 (1989).
Landolt, Biosystematic Investigation on the Family of Duckweeds: The family of Lemnaceae—A Monograph Study. Geobatanischen Institute ETH, Stiftung Rubel, Zurich (1986).
Langridge et al., *Proc. Natl. Acad. Sci. U.S.A.*, 86:3219 (1989).
Langridge et al., *Cell*, 34:1015 (1983).
Lashkari et al., *PNAS USA*, 94:8945 (1997).
Laufs et al., *PNAS*, 87:7752 (1990).
Lawton et al., *Mol. Cell. Biol.*, 7:335 (1987).
Lee and Saier, *J. Bacteriol.*, 153 (1982).
Lesyng B. and McCammon J A, *Pharmocol. Ther.* 60:149 (1993).
Levings, *Science*, 250:942 (1990).
Lindsey et al., *Transgenic Research*, 2:3347 (1993).
Lindstrom et al., *Der. Genet.*, 11: 160 (1990).
Lockhart et al., *Nat. Biotechnol*, 14:1649 (1996).
Lockhart and Winzeler, *Nature*, 405:827 (2000).
Lommel et al., *Virology*, 181:382 (1991).
Loomis et al., *J. Expt. Zool.*, 252:9 (1989).
Lorz et al., *Mol. Gen. Genet.* 199:178 (1985).
Lyznik et al., *Nucleic Acids Res.*, 21:969 (1993).
Ma et al., *Nature*, 334: 631 (1988).
Macejak et al., *Nature*, 353:90 (1991).
Maki et al., Methods in Plant Molecular Biology & Biotechnology, Glich et al., 67-88 CRC Press, (1993).
Maleck et al., *Nat. Genet.*, 26:403 (2000).
Mansson et al., *Gen. Genet.*, 200:356 (1985).
Mariani et al, *Nature*, 347:737 (1990).
Martinez et al., *J. Mol. Biol.*, 208:551 (1989).
McBride et al., *Plant Molecular Biology*, 14:266 (1990).
McBride et al., *PNAS USA*, 91:7301 (1994).
McCabe et al., *Bio/Technology*, 6:923 (1988).
McElroy et al., *Mol. Gen. Genet.*, 231:150 (1991).
Meinkoth and Wahl, *Anal. Biochem.*, 138:267 (1984).
Messing and Vierra, *Gene*, 19:259 (1982).
Michael et al., *J. Mol. Biol.*, 26: 585 (1990).
Mogen et al., *Plant Cell*, 2:1261 (1990).
Moore et al., *J. Mol. Biol.*, 272:336 (1997).
Mundy and Chua, *EMBO J.*, 7:2279 (1988).
Munroe et al., *Gene*, 91:151 (1990).
Murakami et al., *Mol. Gen. Genet.*, 205:42 (1986).
Murata et al., *FEBS Lett.*, 296:187 (1992).
Murdock et al., *Phytochemistry*, 29:85 (1990).
Murray et al., *Nucleic Acids Res.*, 17:477 (1989).
Myers and Miller, *CABIOS*, 4:11 (1988).
Napoli et al., *Plant Cell*, 2:279 (1990).
Narasimhulu et al., *Plant Cell* 8: 873-886, (1996).
Needleman and Wunsch, *J. Mol. Biol.*, 48:443-453 (1970).
Newman et al., *Plant Physiol.*, 106:1241 (1994).
Niedz et al., *Plant Cell Reports*, 14:403 (1995).
Odell et al., *Mol. Gen. Genet.*, 113:369 (1990).

Odell et al., *Homologous Recomb. Gene Silencing Plants,* 219-70, Paszkowski & Jerzy (eds) (1994).
Odell et al., *Nature,* 313:810 (1985).
Ohtsuka et al., *J. Biol. Chem.,* 260:2605 (1985).
Ow et al., *Science,* 234:856 (1986).
Pacciotti et al., *Bio/Technology,* 3:241 (1985).
Park et al., *J. Plant Biol.,* 38:365 (1985).
Paszkowski et al., *EMBO J.,* 3:2717 (1984).
Pear et al., *Plant Molecular Biology,* 13:639 (1989).
Pearson and Lipman, *Proc. Natl. Acad. Sci.,* 85:2444 (1988).
Pearson et al., *Meth. Mol. Biol.,* 24:307 (1994).
Perlak et al., *Proc. Natl. Acad. Sci. USA,* 88:3324 (1991).
Phillips et al., In Corn & Corn Improvement, 3rd Edition 10 Sprague et al. (Eds. pp. 345-387) (1988).
Phi-Van et al., *Mol. Cell. Biol.,* 10:2302 (1990).
Piatkowski et al., *Plant Physiol.,* 94:1682 (1990).
Potrykus et al., *Mol. Gen. Genet.,* 199:183 (1985).
Potrykus, *Trends Biotech.,* 7:269 (1989).
Poulsen et al., *Mol. Gen. Genet.,* 205:193 (1986).
Prasher et al., *Biochem. Biophys. Res. Comm.,* 126:1259 (1985).
Proudfoot, *Cell,* 64:671 (1991).
Quigley et al., *J. Mol. Evol.,* 29:412 (1989).
Ralston et al., *Genetics,* 119:185 (1988).
Reed et al., *J. Gen. Microbiol.,* 130:1 (1984).
Reina et al., *Nucleic Acids Res.,* 18:6425 (1990).
Reina et al., *Nucleic Acids Res.,* 18:7449 (1990).
Reymond et al., *Plant Cell,* 12:707 (2000).
Richmond et al., *Curr Opin Plant Biol.,* 3:108 (2000).
Riggs et al., *Proc. Natl. Acad. Sci. USA,* 83:5602 (1986).
Rossi et al., *Biophys. J.,* 80:480 (2001).
Rossolini et al., *Mol. Cell. Probes,* 8:91 (1994).
Rothstein et al., *Gene,* 53:153 (1987).
Ruiz, *Plant Cell,* 10:937 (1998).
Safak et al., *Mol. Cell. Biol.,* 19:2712 (1999).
Sambrook et al., *Molecular Cloning: A Laboratory Manual* (2d ed., Cold Spring Harbor Laboratory Press, Plainview, N.Y.) (1989).
Sanfacon et al., *Genes Dev.,* 5:141 (1991).
Sanford et al., *Particulate Science and Technology,* 5:27 (1987).
Schaffer et al., *Curr Opin Biotechnol.,* 11:162 (2000).
Schena et al., *Science,* 270:467 (1995).
Schenk et al., *PNAS USA,* 97:11655 (2000).
Schmidhauser and Helinski, *J. Bacteriol.,* 164:446 (1985).
Schwob et al., *Plant J.,* 4:423 (1993).
Shagan et al., *Plant Physiol.* 101:1397 (1993).
Shapiro, *Mobile Genetic Elements,* Academic Press, N.Y. (1983).
Shimamoto et al., *Nature,* 338:274 (1989).
Simpson, *Plant Mol. Biol.,* 19:699 (1985).
Skriver and Mundy, *Plant Cell,* 2:503 (1990).
Skuzeski et al., *Plant Molec. Biol.* 15: 65-79 (1990).
Slater et al., *Plant Mol. Biol.,* 5:137 (1985).
Smith et al., *Adv. Appl. Math.,* 2:482 (1981).
Smith et al., *Mol. Gen. Genet.,* 224:447 (1990).
Smith et al., *Plantas* 168:94 (1986).
Southern et al., *Nature Genet.,* 21:5-9 (1999).
Spencer et al., *Theor. Appl. Genet,* 79:625 (1990).
Stalker et al., *Science,* 242:419 (1988).
Staub et al., *EMBO J.,* 12:601 (1993).
Staub et al., *Plant Cell,* 4:39 (1992).
Steifel et al., *The Plant Cell,* 2:785 (1990).
Stemmer, *Nature,* 370:389 (1994).
Stemmer, *Proc. Natl. Acad. Sci. USA,* 91:10747 (1994).
Stief et al., *Nature,* 341:343 (1989).
Stouggard, *The Plant Journal,* 3:755 (1993).
Sukhapinda et al., *Plant Mol. Biol.,* 8:209 (1987).
Sullivan et al., *Mol. Gen. Genet.,* 215:431 (1989).
Surles et al., *Protein Sci.,* 3:198 (1994).
Sutcliffe, *PNAS USA,* 75:3737 (1978).
Svab et al., *Proc. Natl. Acad. Sci. USA,* 87:8526 (1990).
Svab et al., *Proc. Natl. Acad. Sci. USA,* 90:913 (1993).
Tamayo et al., *PNAS USA,* 96:2907 (1999).
Tarczynski et al., *PNAS USA,* 89:2600 (1992).
Thillet et al., *J. Biol. Chem.,* 263:12500 (1988).
Thompson et al., *EMBO J,* 6:2519 (1987).
Tijssen, Laboratory Techniques in Biochemistry and Molecular Biology-Hybridization with Nucleic Acid Probes, Elsevier, New York (1993).
Tomes et al., *Plant Cell, Tissue and Organ Culture: Fundamental Methods,* Springer Verlag, Berlin (1995).
Tomic et al., *NAR,* 12:1656 (1990).
Tremousaygue et al., *Plant J.,* 20:553 (1999).
Turner et al., *Molecular Biotechnology,* 3:225 (1995).
Twell et al., *Plant Physiol.,* 91:1270 (1989).
Ugaki et al., *Nucl. Acids Res.,* 19:371 (1991).
Ulmasov et al., *Plant Mol. Biol.,* 35:417 (1997).
Upender et al., *Biotechniques,* 18:29 (1995).
Vaeck et al., *Nature,* 328:33 (1989).
van der Krol et al., *Plant Cell,* 2:291 (1990).
vanTunen et al., *EMBO J.,* 7:1257 (1988).
Vasil et al., *Biotechnology,* 11:1553 (1993).
Vasil et al., *Mol. Microbiol.,* 3:371 (1989).
Vasil et al., *Plant Physiol.,* 91:1575 (1989).
Vernon and Bohnert, *EMBO J.,* 11:2077 (1992).
Vodkin, *Prog. Clin. Biol. Res.,* 138:87 (1983).
Vogel et al., *EMBO J.,* 11:157 (1992).
Walker and Gaastra, eds., *Techniques in Molecular Biology,* MacMillan Publishing Company, New York (1983).
Wandelt et al., *Nucleic Acids Res.,* 17:2354 (1989).
Wang et al., *Mol. Cell. Biol.,* 12:3399 (1992).
Waterman, M. S. Introduction to Computational Biology: Maps, sequences and genomes. Chapman & Hall. London (1995).
Watson et al., *Corn: Chemistry and Technology* (1987).
Watrud et al., in *Engineered Organisms and the Environment* (1985).
Weeks et al., *Plant Physiol.,* 102:1077 (1993).
Weissinger et al., *Annual Rev. Genet.,* 22:421 (1988).
Wenzler et al., *Plant Mol. Biol.,* 13:347 (1989).
White et al, *Nucl Acids Res,* 18, 1062 (1990).
Wolter et al., *EMBO Journal,* 11:4685 (1992).
Wyn-Jones and Storey, *Physiology and Biochemistry of Drought Resistance in Plants,* Paleg et al. (eds.), pp. 171-204 (1981).
Xiang and Guerra, *Plant Physiol.,* 102:287 (1993).
Yamaguchi-Shinozaki et al., *Plant Cell Physiol.,* 33:217 (1992).
Yamamoto et al., *Nucleic Acids Res.,* 18:7449 (1990).
Yanagisawa and Schmidt, *Plant J.,* 17:209 (1999).
Yanagisawa et al., *Plant J.,* 21:281-288 (2000).
Yuan et al., *Plant J.,* 15:821 (1998).
Zhang et al., *Proc. Natl. Acad. Sci. USA,* 94:4504 (1997).
Zhu et al., *Nat. Biotechnol.,* 18:555-558 (2000).
Zhu et al., *Plant Physiol.* 124:1472 (2000).
Zhu et al., *Proc. Natl. Acad. Sci. USA,* 96:8768-8773 (1999).
Zukowsky et al., *PNAS USA,* 80:1101 (1983).

All publications, patents and patent applications are incorporated herein by reference. While in the foregoing specification this invention has been described in relation to certain preferred embodiments thereof, and many details have been set forth for purposes of illustration, it will be apparent to those skilled in the art that the invention is susceptible to additional embodiments and that certain of the details described herein may be varied considerably without departing from the basic principles of the invention.

LENGTHY TABLES

The patent contains a lengthy table section. A copy of the table is available in electronic form from the USPTO web site (http://seqdata.uspto.gov/?pageRequest=docDetail&DocID=US07550578B2). An electronic copy of the table will also be available from the USPTO upon request and payment of the fee set forth in 37 CFR 1.19(b)(3).

SEQUENCE LISTING (6097 sequences)

SEQ ID NO: 1 - DNA, 1951 bp, Oryza sativa
atggcgggcaagggcgagggtccggccatcggcatcgaccttggcacgacctactcgtgcgtgggcgtttggcagcacgaccgcgtggagatcatcgccaacgaccagggcaaccgcaccaccccctcctacgtcggcttcaccgactccgagaggctcatcggagatgctgccaagaaccaggtcgccatgaaccccatcaacaccgtctttggatgccaagcgtctcattggcaggaggtttagcgatgcttctgttcagagtgacattaagctctggcccttcaaggtgattgctggacctggtgacaagcctatgattgttgtccagtacaagggtgaggagaagcagtttgctgcagaagagatctcctccatggtcctcatcaagatgcgtgagattgctgaggcctaccttggcaccaccatcaagaatgccgttgtcactgttcctgcctacttcaatgactcccagaggcaggccaccaaggatgctggagtgattgctggtctcaatgtcatgcgtatcatcaacgagccgactgctgcagctattgcctatggtcttgataagaaggccaccagcgttggtgagaagaatgtcctcatctttgaccttggaggtggtacctttgatgtctccctccttaccattgaggagggtatctttgaggtcaaggccacagctggtgacacccatcttggtggtgaagattttgacaatcgtatggtcaaccactttgtgcaagaattcaagaggaagaacaagaaggatatcactggcaaccccagggctctcaggaggttgaggacagcttgtgagagggcaaagaggaccctgtcctccactgcccagaccaccattgagatcgattccctgtatgagggcatcgacttctactcaaccatcacccgtgccaggtttgaggagctcaacatggatctcttcaggaagtgtatggagcctgtggagaagtgcctcagggatgctaagatggacaagagctctgttcatgatgttgtccttgttggtggctccactaggatcccgagggtgcagcagctcctgcaggatttcttcaacggcaaggagctttgcaagaacatcaacccagatgaggctgttgcttatggtgctgctgtccaggctgccatcttgagtggtgagggcaacgagaaggtccaggacctcctcctgttggatgttacccctctctctctcggtttggagactgctggtggtgtcatgaccgttttgatcccaaggaacaccaccattcccaccaagaaggagcaggtcttctccacctactccgacaaccagcctggtgtgctcatccaggtttatgagggtgagaggaccaggacacgtgacaacaacctgctggggaagtttgagctctctggaatccctcctgctcccaggggtgttccacagatcactgtttgcttcgacattgatgccaatggtatcctgaacgtgtctgctgaggacaagaccaccgggcagaagaacaagatcaccattaccaacgacaagggcaggcttagcaaggaggagattgagaagatggtccaggaggccgagaagtacaagtcagaggatgaggagcacaagaagaaggtggagtccaagaacgcgctggagaactacgcctacaacatgcgcaacaccatcaaggatgagaagatcgcctcgaagctcccggcagcggacaagaagaagatcgaggatgccatcgaccaggccatccagtggctggacggcaaccagctcgctgaggctgatgagttcgatgacaagatgaaggagctggagggcatctgcaaccccatcatcgccaagatgtaccagggcgctggcgcggacatggccggcggcatggacgaggacgatgctcccccggctggcggcagcggtgctggccccaagatcgaggaggtcgactaa

SEQ ID NO: 2 - DNA, 1694 bp, Oryza sativa
  misc_feature (577)..(577): n = any nucleotide
  misc_feature (580)..(580): n = any nucleotide
  misc_feature (584)..(584): n = any nucleotide
  misc_feature (590)..(590): n = any nucleotide
  misc_feature (612)..(612): n = any nucleotide
  misc_feature (614)..(614): n = any nucleotide
  misc_feature (1034)..(1034): n = any nucleotide
  misc_feature (1159)..(1159): n = any nucleotide
  misc_feature (1601)..(1601): n = any nucleotide
atggccggcgggaagaagctgaggccgctcgcccgcggcatggggatgccgtgctagggcacccagcggcggcgcgcgcggccggcgacggtggctcccgaggcgacgcgagtttcccccaggcggcgcgcgggctcagggcagcgcgagctcaagacgtgggtctccgaccgcctcgcggtccagctcgtcggtggagatgaggagggagcgggagtggcggcgggtgcgggagcagcagtcgcggtgcggggaggtggcgggcgggacggcggcggagtgcgccgcgcttgtcgtcctcgcggccgtccacgtccccgccacgccgtctgtggtgggcgccgccgcggtgtccgctccacgaagcggaaggagatgggcgagctcctcgccctggacgtcgcctccccaaggtcgctggccgtcgcggccaccaaggctaggaaggtagaggccgagttcccagccacgcccatgaccgaacacctcgtcgacatggagaagcaggtgtgggcgagcttctacagcgccggcttctggaggagcccctcgcaacgagaggacaggagccgtggtngtngctnggcaangccatcgttgagctcgccggcnanggcgagcggcacggccgggactcagccggcgagggcaaccggcgtcgctgggactcagccggcaagggcaaccggcgctaccgggactcggccagcgtgggcaaccggagaagacaagcgtacgtgcgtcgaactatggcaatccgcaagcaattagtgcaagtgcaaccgaaaaagatcgagatgtggcagtggcagcctccgcctctccatccaggggtcgtcaccatggcgaagcacaagctacagttggaggacctgtcgcagacgtgccggcgagaccactactgcgtcaggtgcgtccacgccttctgctcccactgctgcgatgaccaccacttcgtcccgctcggctcccacatcgtcatccccatcgccggtgtcgacgccgccaccggcaagcccgtcatccccgcgcantaccctcgccgccccgacctgcccatcaccgacttcgtcatcggtctcatcaacgccaacgacttcgccgaggagcaccccagggacgcctactgcatgtactgcttcatggccttctccaccgngctctgccaccaccaccacacctgcgccgccgactgcgtcctccgcatcgtccgaagccacgacggccgccactgcgtccgctgcaccggcgacgagccgtggttcccttacatggagagcgtcctgggcgaccccgtggctgtcgaggaggaggagggcgacgacggcgaggtggtggctgtgctgctgctgctgcccgtgctgaggaggagctcaccgaccgcgtgcgtacactgcggcggcgaggtgcccaaacacatgcgccgctcggtgctctgctcgccggcctgcgacgcggcccaccaactggaggtcgcccagcgcagggagcgcagggacgccgtgctcgccgcgcgccgcctcgccaagctgaacatccatgccgtttgatcaattcttgtactgtattagcgctcattgatttgatctcgtaattctcanatctgtatgttgacccgtgtcttttttttttcgactccccgtgtctataaactattattagtaaattactttcgtgccggcaatatcttttaa

SEQ ID NO: 3 - DNA, 1450 bp, Oryza sativa
cgcagagaaaggcgtcttcgtactcgcctctctccgcgccccgccgccatgagggagtgcatctcgatccacatcgggcaggccggtatccaggtcgggaacgcgtgctgggagctctattgcctcgagcatggcatccagcagcctgatggacagatgcccggtgacaagaccgttgggggaggtgatgatgcttttaacaccttcttcagtgagactggtgctgggaagcatgtcccccgtgctgtcttcgtcgatcttgagcctaccgtgattgatgaggtgaggactggtgactaccgccagctcttccaccctgagcagctcatcagtggcaaggaggatgcagccaacaactttgcccgtggtcactacaccattggcaaggagattgttgatctgtgccttgaccgcatcaggaagcttgccgacaactgcactggtctccagggcttccttgtgttcaacgctgttggaggaggaacgggctccggtctcggttcccttctccttgagcgtctctctgtggactatggcaagaagtccaagctcgggttcaccgtgtacccgtcccctcaggtctccacctctgtggttgagccatacaacagtgtcctctccacccactccctccttgagcacaccgatgtcgctgtcctgctcgacaatgaggccatctatgacatctgccgccgctccctcgacattgagcgcccaacctacaccaacctcaacaggcttgtgtcccagcaggtcatctcctcactgactgcctccctgaggttcgatggtgctctgaatgtggatgtcaacgagttccaaaccaacctggtgccctacccgaggatccacttcatgctttcctcctacgccccggtgatctcggccgagaaggcctaccacgagcagctctccgtggcggagatcaccaacagcgccttcgagccgtcctccatgatggccaagtgcgacccgcgccacggcaagtacatggcgtgctgcctgatgtaccgcggcgacgtggtccccaaggacgtgaacgccgcggtggccaccatcaagacgaagcgcaccatccagttcgtggactggtgccccacggggttcaagtgcggcatcaactaccagccgcccagcgtcgtcccggggggagacctggccaaggtgcagagggccgtgtgcatgatctccaactccaccagcgtcgtcgaggtgttctcccgcatcgacatcaagttcgacctcatgtactccaagcgcgccttcgtccactggtacgtcggcgagggcatggaggagggggagttctccgaggcccgcgaggacctcgccgcgctggagaaggactacgaggaggtcggctccgagttcgacgatggtgacgagggtgatgagggtgacgagtactagagttgattactgctgctatcctatgatctgtccgtgtggg

SEQ ID NO: 4 - DNA, 1146 bp, Oryza sativa
atgcagatctttgtgaagactctcactggcaagaccataacccttgaggttgagtcctcggataccattgacaatgtaaaggccaagatccaggacaaggagggaatcccaccggaccagcagcgtctcatcttcgctggcaagcagcttgaagatgggcgcacgcttgctgactacaacatccagaaggaatccaccctccaccttgtcctccgcctccggggaggcatgcaaatctttgtcaagaccttgactggcaagactatcacccttgaggttgagtcttctgatactattgacaacgttaaggcaaagatccaggacaaggaagggattcccccggaccagcagcgtctgatctttgctggcaagcagctcgaggatggtaggacccttgctgactacaacatccagaaggagtccacccttcaccttgttctccgcctaaggggaggaatgcagatcttcgtgaagacccttactggcaagaccattacgcttgaggttgagtcatcagacacgatcgacaacgtgaaggcgaagatccaggacaaggagggcattcccccagatcagcagcgtcttatttttgccggcaagcagctggaggatggcaggaccctcgctgactacaacatccagaaggagtccacccttcaccttgttctgcgcctaaggggtggaatgcagattttcgtcaagactctcactggcaagactattaccctggaggttgagagctcagacaccattgacaacgtgaaggcgaagatccaggataaggagggcatccccccggaccagcagagactcatcttcgctggtaagcagctggaggatggccgcacccttgccgactacaacattcagaaggagtctaccctacacttggtgctccgcctcaggggtggtatgcagatcttcgtcaagactcttactggcaagaccattactctggaggttgagagctccgataccatcgacaatgtgaaggctaagatccaggacaaggaaggtattcccccagaccagcagcgcctgatcttcgccggcaagcagctggaagatggccgtaccctcgccgactacaacattcagaaggagtctaccctccacctggtgctccgcctcaggggtggtcagtaa

SEQ ID NO: 5 - DNA, 1042 bp, Oryza sativa
atgatcacgggtacctcccaggctgactgtgccgtgctcatcattgactccaccactggtggttttgaggctggtatctccaaggatggccagacccgtgagcacgctcttcttgctttcactcttggtgtgaagcagatgatctgctgctgcaacaaggatggatgccaccactcccaagtactccaaggcccgttacgatgaaatcgtgaaggaagtctcatcctacctgaagaaggtcggctacaaccctgacaagattcccttcgttcccatctctgggtttgagggtgacaacatgattgagaggtccaccaaccttgactggtacaagggccccaccttgcttgaggctcttgaccagatcaacgagcccaagaggccatcagacaagcccctgcgtcttccccttcaggacgtgtacaagatcggtggtattggcaccgtgcctgtgggtcgtgttgagactggagtcctcaagcctggtatggtggtgacctttggtcccagcggcctgaccactgaggtcaagtcggttgagatgcaccacgaggctctccaggaggctcttcctggtgacaacgtcgggttcaacgtgaagaacgttgcggtgaaggatctgaagcgtgggtacgtggcctccaactccaaggatgaccctgccaaggaggctgccagcttcacctcccaggtgatcatcatgaaccaccctggccagatcggcaacggctacgccccagtgctggactgccacacctcccacattgccgtcaagtttgctgagctggtgaccaagatcgacagacgatctggtaaggagctggagaaggagcccaagttcctcaagaacggtgatgctggtatggttaagatgattcccaccaagcccatggttgtggagaccttctctgagtaccctcctcttggtcgttttgccgtgcgtgacatgaggcaaacggtggctgttggcgtcatcaagaacgtggagaagaaggacccaaccggtgccaaggtgaccaaggctgccgccaagaagaaatga

SEQ ID NO: 6 - DNA, 738 bp, Oryza sativa
  misc_feature (217)..(217): n = any nucleotide
atggctgacaaggcgctgacgtcgacgatgacgtcatcgccggcggcggctcggcacctcgtgctcgctggcgaacgacggtgcggcggcgcaaacggagggcaccaacgcgaagagctcggctcggcgaactcaccgagcacttggacgatggcaaacgacgacggatgacgacggcggcaaggttaaggcggcggcggtcttcgggtcgccggtnacggcggtgctccggtgggaaacggcggcaacggaggggtggatgaggtgctgctcctcctcgcgagcccgatggtggcgacgacgaccgatggcggcagctgcaacggcggcgcggcgcggctggaccgacggcggcggtggagaacttcggggcgacggagtcggcggcgctccgacgatctgcggcagaaacggaggacgggacaaggacggcggcgaccttgcgaacctggcgacggccttcccgagtgacggcggcgactggagcagcggcgcagcacggccggactcacggcgacggcaacggcgcacgagctaacgtggaggcggcgctacaagcgacggcgggctaaggcgaaggtggcggcggatagaggaggtcccggggatccttttgtaggggctaggaggcggtgacagaggcccacggcgaccggcggcgagatggaaggttttagggttttggaaagagaagctaaccaaatcggcattgattccgacgatttccaaacgaattag

SEQ ID NO: 7 - DNA, 705 bp, Oryza sativa
atggtgggacccacgtgtgctccacatgtcatcctcactcctccccttcttcctcctctctcccctttcttcatctctctcccctctcctctctcaggcgtgctggagagggagcggcacgcggtggtgccggtgggagagggagcagcgcacgcccttcgccgtaaccagcctcctcactctcgtcggcgccgccggcagcagcggagcggtgcgcggatctggagaaagagggaggggagaaaggagaatacaacctcgtcgtcgctcctctcttctccaccgccaccaagctcgtcagcggccacccgccggagagaggagcttccccttccccttcttccacccgaacggcactatcacgtgccccttcgtccccagtgctctggctccgcaacgcggcagcgagggacccatggatcgccgcgccggcgagggaggtcgcgggtgtgggggccgtcaccgccgggtgcccggcccgctcctcctcgccccactccggccgccgccactccttgcctctccggccgccaccactcctccccgccgctccaccgccgccaccactccatcccggcgcttcggctggagagagaagagggagagagaggagagagaggggatagtcagaaggggtagtgactagtgaggattataggtggggttcacgtgggcccaaccatttttttattattgtgtgtgtga

SEQ ID NO: 8 - DNA, 688 bp, Oryza sativa
  misc_feature (129)..(129): n = any nucleotide
  misc_feature (187)..(187): n = any nucleotide
gtggaggggcggcgtcagcgcgctagagcaggcggagcggcggcgtctccgggcgagcgcggctgcggcaggtggcggacgagcgggcaagcggcggctcagcggcggcgtcttcgggcgcgggcggancagagggccgggggacgcgccggagctccgtccgctcccgtcgctgcggcgcgccacnacgctgggctcctctgatgagtgcgacggcggcgggaaccagcggcgagaagaacagcacgccagagcgacctagggctaggagtagagcgctgctcgccgccggtcttggggaagcggcggcgtcggggagagtggagagagaggcattcgactgccacccccctctgattcctccgccaccggcggcgacatctctgtcggccgcggggatcccctcccggaacaggagcccgtcccggatcccgccaccacctcccgccgcggttgcccacagtccgccgccgctctcgccggctgtcgcctcgctcctgcctgcttcgcatgccgctgccgctctcgccggccgtcgccccgcccgtctcggctcgtccaagaagacgagagaagagaagaaagggaaaaaagaagggatgtgggcccgcaccgttttctctcacttacatgtgggcccacgtattttatttatttatttttgctgactaaaatgccacgtcagtga

SEQ ID NO: 9 - DNA, 514 bp, Oryza sativa
atgttggtctaccaggatctgcttaccgggtgacgagctcctgtcggattcgttcccctacagagagatcgagaacggcatcctctgggaagtcgatggcaagcagtgggtcgttcaaggagctattgatgtggacattggtgccaacccatctgctgagggtggtggtgatgatgagggtgttgatgaccaagctgtgaaggtggtcgacattgtggacaccttccgtcttcagcaggagcaacctccttttgacaagaagcagtttgtgaccttcatgaagcgctacatcaagaacctctccgccaagctggatgcggaaaagcaagaggaattcaagaagaacattgagggtgccaccaagtacttgcttggaaagctcaaggaccttcagttctttgttggtgagagcatgcatgatgatggcggcttggtgtttgcctactacaaggacggagccaccgacccaaccttcctttacttctctcatgggctgaaggaggtcaagtgctga

SEQ ID NO: 10 - DNA, 499 bp, Oryza sativa
atggcggcgccggatgttgagtaccgctgcttcgtcggcggcctcgcctgggccaccgacgaccgctccctcgaagccgccttctccaccttcggcgagatcctcgagtccaagatcatcaacgatcgggagacggggaggtcgcgcgggttcgggttcgtgacgttctcgagcgagcaggccatgcgcgacgccatcgaggggatgaacggcaaggagctcgacggccgcaacatcaccgtcaacgaggcccagtcgcgccgctccggaggcggaggcggaggcggctacggccagcgcggcggaggcggaggctacggtggcggcggcggctacggtggtggcggcggcggtggccggcaactccgacgggaactggaggaactgaggcggcggcggcggcggcggggggagacatgagagatggaggaggaggaaggcgatggatacatgggctgatgttagaggcccggacggttcattgggccgtcggatttag

SEQ ID NO: 11 - DNA, 422 bp, Oryza sativa
atgtgggccccacatgccagcctcactcctctcttcttccctctcccttctctctcttcttccctttcccctctctctctccttccgggcagaggacggcgcgggtgggcgtcggagcaggcgagctccggcggcggcggcgggcgtggtcggcgccgccccccgaccggagcgccgcctgtccgcgtgaaggcgagtagcgcggcgacgccctggaagacgccatcgacgccgccatccgtgtcgccgccaccgaccacccggacgccctcccgcccgccgtgctggacgccgcccggcgagaggagggagcagagagatggggattggggagagccggagagaggaggaagaagaggattggattcggtcatttgagaatgacatatggggcccacgtgggccccaccatatttttttaa

SEQ ID NO: 12 - DNA, 366 bp, Oryza sativa
atggcccggatcgacccggggccgatcggacgggcggtggcgacccggctcggctcggctcaaggccagccgaccggccacggcgatggcgacggcgcgcgcgcgcgaacgcgttgccagcgacggcaaccggtggcggaggcgacggcgcaaaggcgacgcgaaggcggcggcgctaagcggcggctaggaaggagagggaggggaatagaggggagaggaagcctcaccgagtggccggcgcggaggaagatgacagcgaacggcgatggcaagccacgggaggacgacggcaaccggcggacgggcttcggtgagacacctcctccccttcctctccctctcccgcgccgcctagccgcttag

SEQ ID NO: 13 - DNA, 312 bp, Oryza sativa
atgtctgggagaggcaagggcggcaaggggctcgggaagggcggcgcgaagaggcacaggaaggtgctgcgcgacaacatccaggggatcacgaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggattcggcggctag

SEQ ID NO: 14 - DNA, 1281 bp, Oryza sativa
  misc_feature (393)..(393): n = any nucleotide
  misc_feature (401)..(401): n = any nucleotide
  misc_feature (721)..(721): n = any nucleotide
  misc_feature (1236)..(1236): n = any nucleotide
atggccaccgcgaagccagcctctccctcgccgccgccgagcaccgccgtcgtcccggccgccaataccgcagcagccgcggacaagccggcggtcgagcagctcctggaggtggcggaggacgaggtcgtcatcgacttcaagcccaacgccaagtgccgcgctgacctccgcctccgctcgctgcacccgtccctccccgtcgccttcaaggtccagacctcctcccctctcaagttcctcgtcagccccccgcgcggcgccgtgcagccgctctcgtcggcctccctccgcgtcgtgctccgcccgcagcagcacgctcccgcgtccttcccgcgctcccgaggcgaccgcttcctcgtgctctcctccctctccgccgcgcacctcgantcctccgnctcctccagcgccgctaccggcggcaccaccgccatccgcctccgcgtgttcttcggcgggccgtacctgctccgcctcgcggcggaagccggggacgccgcggccgtgcgcctcatcctgcgccggcagccgcacctcctgccgctcctggagcccgaggcggcggtgcccgacggcgccgagcagtgggcgccactgcacgcggtggccgcgaggggggacaccggggaggtgaggcgcctggggccggactcgatgggagcgcgcgaccgtgaggggaggaccgccctccacgttgccgccgcggccggggaggcgnaggcggcggcggcgctggtggacatgggcgccgacgccgcggcgaccgacgcgcgcgggaggactccactggacgtcgcgcgcgagaagggctatcaagaagtggtggacgtcctggaacggtgggaactggtcatgacggcggcgaggcgaggcgacctccagagcctcgagtccctcctcagcaagcgcgccggcgtccggggacgtgaccagtacggcctgacggcgctccaccttgctgccatcaaagggcactgcgacgtgatcgcgctgctcgccgggtcaggctgcatggacatcgagtgcgaggacgtggaagggcaccgcccgctgcacctcgccgtcgaaggcggcagcgccgaggccgtcgagctgctgctcgacatgggcgccgaagtgcacgccgccaccaggcggggcgcgacgccgctccagatggccgtgacgatggggtacgaggccatcgcgctgctgctgcgaggccgtggcgccgacgaggcggccgcgccggcnttgtgcatcgcgtcctcgtcttcctcctcgatatcgtgtgcgtag

SEQ ID NO: 15 - DNA, 534 bp, Oryza sativa
atggtggccgtgctcgccctcctctccaccggcctctccctctccctctcccgcgcggacctcgccgctgtcgtcgtcgctgagccgcggctgctctgcgcgaaggccgaccgtgcgtcgtcgcgcttctccgcccgcccgaccgcgatggtggtcgtgctcgccctcctctccaccggcctctccctctccctctcccgcgcggacctcgctgccgttgtcatcgccgagccgcggctgctctgcgcgaaggccgacaccatcgccgccagcgctcggttgggtcatcccgtccgtcgtcgtcgccgagcccaccgccgccgacgtcgcccgagcccgccgccgtcgctgtcgcccgagccgtctaccgccgccgtcggcgagccccccgcagccgctcatcgacgccatcaaggaggccggtggcgaccacgtccggaggtgagggcagaggcggcgtcggtcatggttgttgcaaacggcgttgtcggtggttgcaaatggcgctcatcccatccctccctcgttccttga

SEQ ID NO: 16 - DNA, 348 bp, Oryza sativa
ccgagcggcgacacggacggcaggcgcggacaggcgcggcagaggctgacggcagcggcgaccaggcggtcggccaccacggcacgcgcgcgcgggaagcaacgggcggcgcggcgatttgagcggcgcggctcgggcacgcgtgctgactcgcggcgcagacggcgcaggcgcggcacgggcggcgaccgcacgggcgcgtgcatgcgaacaacggcgcgcgggaagcagcagcgagggagcggagagggagggctcggctcggcgcggctcatgcgcacgcgcgcgcggcgcgcgggcagagcggagaagagggagggagagagagagagcgagagagagagatag

SEQ ID NO: 17 - DNA, 2037 bp, Oryza sativa
atggcgtgggcgcgcgtcgagtcgcgctgccccttctgcaaggcccgcttccgcaccatcacccgcccgcccgtccccggccgcttcccttcccagcgcgtcgtcgccgtccccgagcgcaaccaggcttgcaacccttcgggcaatggcagcagcactgtagacgctgatctctatgcaaacaccagctgtagcgtatgtaacctctccaatgatgatgaactgctgatgttgtgcgagctctgcgattctgctgtgcacacttactgtgccggtctaggcactgaaattcctgagggtgactggttctgtacggactgcatgacagccaaggaggagcattcgaggtgtgagattgacgatgacaattctagtgatcatggtgaatttaaaatcaccattgaagttccaatagctgatccagttgctgctccttccatttcggatattgtggatgagggtcactctccaaatttagtacaaaggtcaagtgtgcagagcaacaggccttccatttctgatccagttccttccatttatgatattgtggatgacgattacaccacaattccaataggcaggggtatttccgttggaccacaatgccctgaatctcctcaggagcgagaaaatagtcgggtgtgttcgcatgcccgttctcgcattgagtctgagagagctagaacactgcgtaactctcgcaatcttggtagccgtataagggaactgcgtgagaactggtctgctctccgttcaggttcgattgggtttgcaacacaattacacaataggagaaggggaaatggtgctggtacttgtgatattgaagaacgccatcggtccacaacaaccttcatggaggtggctgcttcctcatctggtcatgctaaaaaaatttcacctaagaatagttctgatgtgcacaaggcatggaaaatgctagaaatggcaaaatcatctggtgggaagaagaaacctgacaacccttcctccctcaattgcagtgttccattctccatggggaatagatcgacttcatacagcccaattgatgcaattttaggacataagaataacaagctgtatgatggaataactcagaaaaacaacgcggaacaacaccgtagtacaaacatggaaaataaacctccaacaatgaattttggagaatgccgtaaactgcaggagaaattccatgggtcagctcatggaagaacaccttctacaattatgaggcaggaaagtttgactggtaaagtttcctcatcaagcaataatgagaagcataatcgtagtataaacatggaaaataggcctccaacagtgaattttggagaacaccgtaaactgcaagagagtgcatcagttcatggaagaataccttctacagttatgatgcaggaaaatttgaatggtaaagttgcctcatcaagcaataatgaggatgcaggtcaaatatttgaatcttcacgtgacgtaagcagaccagagaaatccaaaccagttgtatcctgtccgcttacgttcagtttactatctggccagtccatggtgacctcatcacaacaattaagacctggatggagccaatctaccgaaatggtaagctctcaggaaccatcagccactgcggcatctattgacatcggtacagctggagcaaacgacaaagttaaaggttctagaccagatcgtcttgagcgcaagagaaaacttggttctgaaacacatgatgacaagggatccaagagatctatgtcaagttgtaaaataagaaaaagtgatatttcatttttggccatacgtgagttgaagctgctcaatatagacaaaacttatggttctgacaccttcaaggaagttgctcgagcagcaacgcatactgttttggcctcctgtggattggaacattcaccatcggtagctcttgcactcccaagaccgttacttaaggtgaaacatcctgcaacagatagtgtagacagtgtagacatgttgtacattctgtaccatgttaaggaagtcattagaatgtga

SEQ ID NO: 18 - DNA, 1239 bp, Oryza sativa
  misc_feature (99)..(99): n = any nucleotide
atggctctatctggaataactggactgatagagtttcttgcagtatttgtttattgcccttgccgtgttgtaatactaacagttggtgttggggtgggntgggggcgtgtaatagtggaggagtatggtactagcgcccttatttgcctaagggcagatgatttgattggtcaggacattattatcttggtcgtactgtggaaatgggtttgggaggctatagcggtagacgacgcgtccagaccgtgtgcgtgcgtgcgtgtggctaaagaaaggagttgttcagagatgatggatgggatcaagtgggcaagtgctcaacaaatcaagcaagcagagagtagtagatcgagtgatcggaggatggggtcgcggtacgaggtggaggtgacggtgtcgtcggcgcgggacctcaagaacgtcaactggcgcaacggcgacctcaagccctacgccgtgctctgggtcgacgacggcgccaagtgctccacccgcgtcgacctcgacaacgccgacaaccccaactgggacgacaagctcaccctccctctccccccctcctcccgcctcgacgacgccctcctctacctcgacgtcgtccacgccaacgccgccgagggcgtcaagccgctcgtcggctccgcccgcctcccgctccgcgacgtcctcgacgacgccggcgtaggcgcccgcgtctcccgctccctccgcctcaagcgcccctccggccgcccccagggacgcctcgacctccgcctcgccgtccgcgagtccgcgcgctactacgacccctcgccctacccggctccctacggccaacccgccggaacacgcgacccctatggcgccccgcctccggcctacagctccggctcaggcgggcagtacccgtacggtggtggctacggctcaggcgggtacgcggcgccgccggcagggtacccgagcgcctacggggcgccgccacagccagcgtacggcggcgcgcctcctgtggcggcgtacggtgcagcaggtggggcgccggtggttgtggaggagacgaagaagaagagcaagatggggatggggacagggctggcggtgggcgcggcggcgggcgtgctgggagggctggcgctggccggcggcgcgagctacctggaggacaagttcgaggagggcgtggcggagaaggtggaggacgatctcgacagagacgacgactacgccgccggcggctacgacgacgactattaa

SEQ ID NO: 19 - DNA, 1050 bp, Oryza sativa
atgcagcctcgttggcagcggcgacgagcggacacggcatcggcggcggcgtcgtcggcggcggtggtgacgagcggacgcggcatcggtggcggcgacaagcggacgcggcctcggtggcggcggcgaccggcggacgcggcttcggcggaggcggcggcgacgagcggacgtggcctcgtcggggttcttgctagttcattgctagttcatgcgtcggggacccggggagaggttgcggtaggtcagatcatgtatggtgcacaacaccaccggtggggagatgcagccggaggcccagctaccagcccatcgcgcaaccagaaaagccccaaaccgtcttatttctcatcaggctcatcaaaccaggccatcctccacgcggtcccccctccggccacgcccacgcctgcgccgcatccggaatcttcgggcccacggataaaacgagacagcgtccccggaatcgaatctcccgtgtgcatccatcgatccaccacctctcccgacgctgctcactcgcgtactacagtactcctatactactacaccgcggcgcgtgcggtgaaacgtgtcccgtctccccgagctacgtgtacgtgttacccacgcgccatgcggtccctcgtctcccgcaccgcgccccccgcgcgcccgacgtcgctgcggggccgtggcgccggtgccgtcgcggctggccatggacaggccacgtttggccgtcgcgccgttcacggcggctggctcgtcgcgatccgtctccgcgcacggtgccggtgcggcggcgggacggagccggtggaggcccggaaggagagggaaggaggaccggggaagggggaggaggaggaggaggaggccgcggcggcggaggagctggaggtgctggaggaggaggccatgggcggtggcgacgaggggcgccgccccacggactacgaccgccgcgcgcacatcttcgaggagagctcccgggtgttcagcgcactgaagcaccggcacgacgacggccacggcttgaacggcgaccacggcgccgcggcggcttag

SEQ ID NO: 20 - DNA, 624 bp, Oryza sativa
  misc_feature (537)..(537): n = any nucleotide
atggccgacgaaggcgagctcctcgccggcggcgagcccgtccggccgccgcggctggaggacgcggggctcgaggactgcgccctcccgccggagtccatcgccgaggccttctccctcgccgccatggccgtctcgtcccgcctcgcccatttctccctctccgacgacgacgacgacgacgacgaggacctcctcctcccgccgcgtggcggcggccccgggggatgcgtggaagactcgggcccgacgtgcggggacatcccggatgccctcgtcggggtgggaggcgaccgcgggagcggcgccgacgaggtcttggtggtcggcggcggaaccgttgagggcggagacgaggtggtcgtcggagggcccggggacgaggaggatagggttgtggtggtcggggaggagcggggcgaaaagcttggttctgacaatggctgcgtcgaggggatccgggaaggaatcgctgattcggatcccggagaaggcaatggagaagaagggaaggagaaggaggaggagaaggtggangtggtggtgggctttggaaaaggcgatcttggggggaaaatttcgcgtgagcccgattgggaactctactactacctttgggcatag

SEQ ID NO: 21 - DNA, 482 bp, Oryza sativa
  misc_feature (44)..(44): n = any nucleotide
  misc_feature (98)..(98): n = any nucleotide
  misc_feature (105)..(105): n = any nucleotide
  misc_feature (120)..(120): n = any nucleotide
  misc_feature (176)..(176): n = any nucleotide
  misc_feature (310)..(313): n = any nucleotide
  misc_feature (480)..(480): n = any nucleotide
atgggtgggagggtatttctgtcctttcctgtttcacgagaggnaaaaaatcgtcgggtaagcatcggcgcctggaccggcgctcgagggggacggcngcgggcngacggacgtgcggcngcggcgactggacgcgcgctcgagggggacggcggtgggcggacagacgcatggcngtggcaacggctggggggggctggacgcgacaggctcgagggggctggcggcgggcggacggacgcctggcggcggcggcggctggacgtgcggcggctgaagggggctagatgcggcgggctcgagggggacnnnngcaggcagactgacgcgcggcggcggcggccggctacgtcagcctcgattggcgacgatgacggcggcggccggctggatgggcgacggtggcggccggctggatgcacgacggcggcggcggcggcctcgattggcgacgagctggatgcgcgggctcgatgcgtnac

SEQ ID NO: 22 - DNA, 474 bp, Oryza sativa
  misc_feature (116)..(116): n = any nucleotide
  misc_feature (118)..(118): n = any nucleotide
  misc_feature (364)..(364): n = any nucleotide
ggacggcggagcggcgcgaagccggcggagagggaggcggaggcggagacggcggaacgcgaaggaggagtcggcggcggcgggtccgaagtcgtgcagctccggccgccgctccntnctctcccgtcggccgccacgggccgctcctctgccatcggccgccgcgccacgctttgcccgaggcccgccgcagctgcttcctcggatccaaggctgcctcattctgagcgtcctcgctgccgagatccaagggcgccgccactgcttccccggacgacctcgactcccgcgggctctccgccgccgctccgaccgccgtcgtgccgccgttgtcccgccagcttcgcgcgccgccgctccggcngccgtcgtgccgccgttgcccccgccggcttcgcgcgccgccgctccgaccgctgtcgtgccgccgctggccaccgctccgtccacgtggggaaaagagaagtaggatag

SEQ ID NO: 23 - DNA, 462 bp, Oryza sativa
  misc_feature (247)..(247): n = any nucleotide
atgaatgtgccggtccgcctgcgaaaatctattttcgcaggcgaacctcttaagcggcgccgcttaagagtctcaaaacccaccccctccctctcccctctcctcccctcccctctcctccccacggccggcctctcccacggcggctacagcgcggaaagcggcggggcggcgcgcggcgtccggcggcttggggcggcggtggtggctcccctcccccctccctcccagatctgggaggagggangggggaggccggcggcggcggcgacgacgacgacggcgcagggccgcggcgacgacgacgagcgggggccgcggcggcggctctcctcccccctccctcccagatctggccggaggagggaggagggaggccggcggcggcggctacggcgcggggcggcggcggctcccctcccccctccctcccagattataacatctcagcctagggcttaa

SEQ ID NO: 24 - DNA, 321 bp, Oryza sativa
atgttcatgaaattcatcggcggtggaggcagcagcatcgactacggctatggcggcggcatcggctacggctacggcgacatcggcaacatcggctatggctatggcggcggcggctgcatcggctacggtagcggaggcggcggcatcgactacggctacagcggcggcatcggcggcggcggagcgtatccgtacgcggggaggccggatccgtcgcttgccactgcggggaggccggatccgtcgccggcgacctcggggatgacggcggcgggctacgggaaggcggcgacaacgatggtgttgatttttgattag

SEQ ID NO: 25 - DNA, 5877 bp, Oryza sativa
  misc_feature (674)..(674): n = any nucleotide
  misc_feature (5856)..(5856): n = any nucleotide
ggcgagcttaggaggagcagcggtggcgagcgagcctgggaggagcgacggcggcaggcgaacttgggaggagtaggagcggcggcggcgggtgagcgcggcgcggcgacaacaggcgagtgtaggaggagcgtcggcagtgggcgagcctgggacaagcggcagcagtgaaggcgggcgagagaaggaggagcagcggcaagcgagcgcggcgatgacaagtaaagtggcggcggcggcgggcgaggttgaaggcggcggttgagagtagagagagaagagagaaagaatgagagagggtgaaaaggataaggaagaaaaaagaaaaaaaatcaaagggtagaaccgtacttacacagccgtttctctctccaattctcccagatataataaaataatctcgtgggtgtccagcaactaattactatttttttgcggtaattagtagcggcgctgacgggcgagcttaggaggagtagcggtggtgagcaagtttgggaggagcgacggcggcgggcgaacctgagaggagtaggagtgacgatggtgggtgagtgcggcgggcggagcggcgacgacgggcgagcgcaggaggaggtgcggcggcagcgggcgaggttgaaggcgtcggttgagaaagaatgagagagggaggaaaggataaggaagaaaangaaaaaaaaaatcaaagggtagaaccgtacttacactgccgtttctctctagtgtccagcaactaattactagttttttacggtgccctgcagcagaaacgcgttacggtgtctcttagctaattacacatttttttatatccggtagcaaattttaccaaaacaaaaggcatgatctttctttaaaaaaaaggaaaaaaaaagaacaagcaagaatcatacgatgcagccgctcccttgctagtacatgacgccaacaatccaacatatacatgcaaataaatctatccaaaaaccggcacgaaatcaaaagaaaaattatctgcttgagctcaccaaccatttttatatcggcaatggcggatgggggtaaccccaccggcgagccggagccacctcggcccccttcctcgtgtataaataagggccccggccatggcaatcctcgcaccaatccattccacctccgttaaccccgttcgttttatttgcgtttacttcgtttcttgggaaggcacttccttctcttcctaggaagcaggcttgaggagccaagaggaagaggagagcaatgggggaagctgccggcgaccgcgtcctgagccgcctccacagcgtcagggagcgcatcggcgactccctctccgcccaccccaatgagctcgtcgccgtcttcaccagcaggctggttaacctcggaaagggaatgcttcaggcccaccagatcattgctgagtacaacaacgcaatctctgaggctgatcgtgagaagctgaaggacggtgcttttgaggatgtcctgaggagtgcacaggcaggaggggattgttatctccccatgggttgcccttgccatccgcccgaggcccggtgtctgggagtatgtgagggtcaatgtgagcgagctcgctgttgagttgctgacagtccccgagtacttgcagttcaaggaacagcttgtggaagaagggcaccaacaacaactttgtgcttgagctggatttcgagccattcaatgcctccttccctcgtccttctctgtcgaagtccattggcaatggtgtgcagttcctcaacaggcatctgtcatcgaagctcttccatgacaaggagagcatgtacccactgctcaacttccttcgtgcacacaactacaagggcatggaccatgatgttgaatgacagaatccgcagtctcagtgctctccaaggtgctctgaggaaggctgaggagcatctttctggtctttcagcagacaccccttactcagaattccaccacagtacaggttccaggaacttggtctggagaagggttggggtgactgtgccaagcgttcccaggagaccattcacctccttttggaccttcttgaggcccctgatccgtccaccctcgagaagttccttggaacaatcccaatggtgttcaatgttgtcattatgtccccacacggttacttcgcgcaagccaatgtcttgggttaccctgacactggagggcagaaggttgtctacattttggaccaagtccgtgctatggagaatgagatgcttctgaggatcaagcagcaaggtctcaatattacaccacgcatccttattgtcaccaggttgctccctgatgcaactggcaccacctgcggtcagcgtcttgagaaggtccttggcaccgagcacacccacatcctacgtgtgcctttcagaactgaaaatggaattgttcgcaagtggatctcacgttttgaagtctggccgtacctggaaacattcactgatgatgtcgcgcacgaaattgctggagagctccaggccaatcctgacttgatcatcggaaactacagtgacggaaaccttgttgcatgcttgcttgcacacaagatgggtgttacccattgtaccattgcccatgcgcttgagaaaaccaagtaccccaactctgacctctactggaagaagtttgaggatcactaccacttctcatgccagttcacaactgacttgattgcgatgaaccacgctgacttcatcatcaccagtaccttccaagagattgccggaaacaaggacactgttggtcagtatgagtctcacatggcattcaccatgcctggtctgtaccgtgttgtccacggtattgatgtttttgacccgaagtttaacattgtctcgcctggtgcggacatgtccatctacttcccttactctgagtctcgtaagaggctcacctccctccacccagagattgaggagttgctctacagcgaagttgacaacaacgagcacaagtttatgctgaaggacaggaacaagccaatcatcttctccatggctcgtcttgaccgtgtcaagaacttgactggtctggttgagctgtatggtcgcaaccctcgcctgcaagagctggttaaccttgtggttgtctgtggtgaccatggcaacccatctaaggacaaggaggagcaggctgagttcaagaagatgtttgaccttattgagcaatacaacttgaatggccacatccgctggatctccgcgcagatgaaccgtgtccgcaacggtgagctctaccgttacatctgcgacaccaagggtgcttttgtgcagcagcccgctttctacgaggcattcggtctcactgttgttgagtccatgacctgtggtctcccgacattcgcaaccgcctatggtggtccagctgagatcatcgtgaacggagtgtctggcttccacattgacccataccagggtgacaaggcctcggcgctgctcgttgagttctttgagaagtgccaggaagaccccagccactggaccaagatctcgcagggcggtcttcagcgtatcgaggagaaatacacctggaagctctactctgagaggctgatgaccctcaccggcgtctacggattctggaagtacgtctcgaacctggagaggcgtgaaacccgccgctaccttgagatgctgtatgccctcaagtaccgcaccatggctagcaccgtcccgttggccgtcgagggcgagccgtcgaacaagtgagctggccaacatctcaggctgagactctgaaagaggagagcattggagtttctttgctttgtttccattctctggtttcagagatgaaaagagaagagagatatttcaggatgctttgcattcctaggcactgctctttttccttaagaaagtaaggtcgattgaatttgggagttttctagtttgatttagttgggggtgagttcagtggaatgtggtgtgtggttggtgctctgtctcctcttgttattgggatgttacctatgaataatagaaacggccttggtgccgtttctgcaataatatattgtagcatccttgtttccaagaaaaaattgtcactgaaatgctcacttctccttggggttatcttactgtttatttatgtttcaccaatcgaaatccttactgtgcatctttgactataaaacatatgatttcctagattttttttttactccctccatttcatattataagttgtttgacttttttctagtcaaacgggaaataacctcaaggcacccagcacgacgattttctcttccttcttagacacaatcacgcagcgatacttggccacctgggaatacgagatattgatactttttctaacctttttcattgtttttatcccttttacttatatgttatttaaactaatatttttaatcaaatagataattaaattttttacccaaaacaaacatattatcaaaatatattaaatgttaattgtaaggaaactaattttgtgtggtagatattaaatatattttaatataaactggtcaaaattaagtaaatttgactaggaaaaatgtccaaacgacttataacataaaatggagggagtagtaattatcatgacatattaataatattagttagtagtaatttttacacgtatattagtaattactgtgagttactagtaacattatatattactacaaatatttacaattttattagaaaaacatttgagagtggcatttgttatgaatccgatggacataatgcactaaatatttttatgagtgacctaccatatctacaaatgtgttgcttaaaaaggtatgagtatttatttcctacttttttatataaataaatgtaagaaaaaaatatatcgttaatgtatatgtctatctaaaaagtaatttcatcacattaaaacatttaataaattttgtggtattgtaaaataataagatattctatctaaactagttttaagtcgttaacacatatgtaaacagttttacattacatgtaaattagtttttattccctaatgggcaaccgatgagtctcttattatctactttaatagcagactcttcagctataaatactcgtcattattcaatactaatatattgtcggtcttaaaaagtatgagtatagtttaactccatagtgttgccacaaatattcatcataataatggtattactttcgatgctaaaatgtatgtatattttttattcaccttatctaaatatccaataagtatttaggaccatttgtaagaatcctaggttataggacaagtgtttccaagaaaaccttttttttttggaaaacatggatatgttcaagtattaatcactaaacattggcttattaataaaaatccattatctagaaaaatgaaccactaaaccatccattttcctgcatgttttgtgcaaataacagtaggttgaactgtggcaatagctaaatagcgccatgtccatttgtgaatgtaaatatgttcgtgagaagtacttccttccttcacaaatataagagattttgggtttatatttttatccacaggattctactaaccaccactcattatttaattcacttaattttacatcactaccctcatcatttaataagaagtattatagtctttttttccccttcatctttactcatttcttcgaaaaattctcaacataaaatagaatgtggtctattgcctggacaaaggcacaacaaatttaaacaaacatttgttcatatttgttgtattaggctatttcatatcctgtcgtagtctttaaaaacaaacctagaaaggccctaatttagggggtgcccaaacaccccctaacctaacatgtctgtaccatcatcaccntggtactacagtattatctag

SEQ ID NO: 26 - DNA, 2404 bp, Oryza sativa
atggctcctgaggcggcggcggcggccttgaagccgatgaaggcaacgtcggacggcgtgttccagggggaggaccccctggaagcggccctgcctctggccatcgtgcagatttgcatcgtcgtcgtgctcacccgcgtgctcgccttcttcctccgcccgctccggcagccgcgcgtcatcgcggagatcatcgtacgttcagggcggcatcatgctcggcccgtccgcgatcggccggaacagcgcgttcatcaacacggtgttccccaagcagagcctcacggtgctcgacaccctcgccaacatcggcctcctcttcttcctcttcctcgtcggcctcgagctcgacctccgcgccatccgccgcacgggagctggcgcgctcgccatcgccgtcgccggcatctccctccccttcgtcctcgggatcggcacctccgtcgtcctccagaacaccgtcaaccgcggcgtccccacggggcccttcctcgtcttcatgggcgtcgccctctccatcaccgcgttcccggtgctggcgcgcatcctcgccgagctcaagctgctcaccaccgacctcggccgcatggccatgtccgcggcggccgtgaacgacgtcgccgcgtggatactcctcgcgctcgccatcgcgttgtcgggctccggctcgcctttcgtgtcgctctgggtgctcctcagcggcgtcggcttcgtcctctcgtcgttcttcttcatccggccgctgctctcgtggatggcgcggcgatcccccgagggcgagcccgtgaaggagctatacatatgcacgacgctcaccatcgtgctcgccgccggcttcatcaccgacaccatcggcatccacgcgctgttcggcgccttcatcgtcggcatcatcgtgcccaaggaagggcccttcgctggcgtcctcctggagaaggtggaggacctcatctctggcctcttcctgccgctctacttcgtgtcgagtggcctcaagaccaacgtcctgaccatcaagggcggggactcgtgggggctcctcgtgctcgtcgtcgcgacggcgtgcatcggcaagatcggcggcacagtgctcgcgtcgctcatcgtgcgtgtgccgctccgtgaggcggtgacgctcggggtgctgatgaacaccaaggggctcgtggagctcatcgtgctcaacatcggcaaggaccggcacgtcctcaacgacgagaccttcgccatcctcgtgctcatggcgctcataaacaccttcatcaccacgccgctggtgatggccatctacaagccggcgcggcgcgcccccccgtacaagaaccgcgccgtccagcgcccgaaccccgacgacgagctccgcatgatggtgtgcttccacagcacgcgaaacatccccaccatgatcaacctcatggagtcgtcgcgtgggacgcggcggcgcggcatcaccgtgtacgccatgcacctcgtcgagctctcggagcggtcgtccgccatcaacatggtccacaaggcgcggcgcaacgggatgccgttctggaaccggcggcgcaacggggacggcgaccagctcgtcgtcgcgttcgagacgtaccagcagctgagccacgtgtccattcgcgccatgacggccatctccgacctccacaccatccacgaggacgtggtcaccagcgcgcaccagaagcgcgccgcgctcatcgtgctccccttccacaagctccaccagatggacggccacatggagtccctcggcgacgagtaccagcacatcaaccagcgggtgctccaccacgcgccgtgctccgtcggcatcctcgtcgaccgcggcctcggcggcgccgcgcaggtcgccgccagcgacgtgtcctacaacatcgtcgtcctcttcttcggcggccgggacgaccgcgaggccctctcctacgccacgcgcatggtcgagcacccgggcatcgcactccacgtgatacgcttcgtcccagagtccggcggcggcggcgcgaacgacaaagccgcggcggacgatgcgttcctcgcagagttccgcggcaaagtcgccggcgggaacgactccatccggtacgaggagaggacgtccagagggaaggcggacgtggtggaggcgatcaaggcgatgggtccgaccaacctgttcctcgttggacaggggtcgccgtgcgcgccgctgatggaaccgagcgctgagtgcccggagctcgggccggtggggagctacctggcgatgccggacttctcgacggtggcgtcggtgctggtgatgaagcagtacgacccgacggcggagcactacgaactcgtcgaggagtcgcggacaccgccgtggacatcgacacaccggggcctcgtagagggtgatgcccttagtcgtaagtcgtaa

SEQ ID NO: 27 - DNA, 2387 bp, Oryza sativa
  misc_feature (435)..(435): n = any nucleotide
  misc_feature (440)..(440): n = any nucleotide
atggggaagcgcgcgcgccacggcggctccggcaggtcccactccccctacttcgagtcccagctccgccgcctcatcaccgacggcggactctcctcctcctccgccgaggacgtcgccatcgccctccgctcccgcttccccgagttccgccgccacaagctcgaccccttcacctccgccgtccgccgcgccctcaactccatcccctccgactcccactccgactccgccgacgactcccacgcctccactccctcccaacgccgccgccgccgcccccgccacgacgcccatgccaccgcctcatcctccacctccctctccgacgacgccgcgcacccaccgcctccccccatctacgacgtcaccaagtccatgctccgcacccagtacgcctcccagactcccaagcgagacaccggcagcaaccancagcnggaaatcgagatcgccgccgagaagccccgccgattaatcacctccgatggcggcgccggcggcgaggccaagccggagtccgctccacctagcgaaggaggcgatagagggggcaaggggcccacgttttcggatcttggggggatggagtcggtgatagagcagctaatgatggaggtggtggtgcccctatgccatccggaggtgccgcgctggcttggggttaagcctgtggctgggctgctgctgcacgggccaccaggctgcggcaagaccacgctcgctcatgccatcgccaatgagaccggcgtgccattctacaagatatcggcgccggaggttgtgtccggggtctctgggggcttctgaggaaaacatcagaagcctgtttaagaaggcgtacaggactgctccatcaattgtatttatagatgagatagatgcgattgcatccaagagggagaatctgcaacgggaaatggaacgacggatagttacacagttaatgacatgcatggatgaataccaccaacaaattggctctggtagcggtgatgtgggttcagagtcagctgaaaagaaacctggctatgttattgtcattggagctacaaatagacctgacgctgttgaccaagcacttcgtaggccaggaaggtttgatcgagagatctctcttggtgttccagatgagtatgcacggaaaaagatacttatgatgcttacccggaatcttcgactggaaggtcagttggacttgttgaagatagcaagggccacatcaagctttgttggtgcggacttgaaggcattggtggataaagcggggaatctagcaatgaagagaataattgatagaagaagagctcagttttgtcaggagcatgatgaaaacagcaagcacgactggtggagacaaccttgggatgcaaatgagatagagggcctgagtattacaatggatgattttgagaggaagcaaccaagatggttcaaccatctttgagaagagaaggattttcttctatccctgatgtcacatgggatgacgttggaggccttgattcgctaaggaaagagtttgaccgctacattatccgatgtatcaagcaacctgaagaatataaggtgaacatacttacagacatttggattgaatatgcaagctggctttttgctgtttggaccacccggttgtgggaaaacactgatagcaaaagcagttgcgcatgaggcaggggcaaattttattcatattaagaggggccagagctgttgaacaagtatgttggtgagagtgaatcagaagttaggaaaattttcatccgtgcacaaactaatacaccatgcatcctgttttttgacgagagttgcttattgaacttgatggtgctggtgaacggaaagcagaattgatgtgatagatgatgcagcacttcgacctggtagatttggcaagaaacattatgtacctttacctggtgctgatgagcgggtttcgatattgagagccctcgctcggaacaaaccgatctcctccagtgttgatttgggtgcactggcacgtagagaggaatgcaaaaatctcactggtgctgacctagcatcaatgggaacctatgggacattttgtgaatgaagcagccatggcagcattggaagagaggctggagttcctggagaatggggaatcgtcaatgagctcatcatctgcgattgagctccctcattttgaacgtgctctagcaaaaatgcagccatcagtatctgaacagagcgaggagatgtacatcagattgtcatggtcaacccttttgatgacacgtttcaccttggttttgttctttggtcacaacagcaaaggagacactacgaggcgttgtgcaagaaatactccgcaagctgatatatattgcgccatgcttacagagatccatgtcctctga

SEQ ID NO: 28 - DNA, 2103 bp, Oryza sativa
atggcgtcggagaccgagacgttcgccttccaggccgagatcaaccagctgctgtccctcatcatcaacaccttctactccaacaaggagatcttcctccgcgagctcatctccaactcctccgatgcattggataagattaggttcgagagcctcacggacaagagcaagctcgatgcgcagccggagctgttcatccacattgtccccgacaaggctagcaacaccctgtcgatcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcagcagctggaataccttgaggaacgtcgcctcaaggatctggtgaagaagcattctgagttcatcagctaccctatctccttatggactgagaagacaaccgagaaggagatttctgatgatgaagacgaggaagagaagaaggatgctgaggagggaaaggttgaggatgttgatgaggagaaggaagagaaagagaagaaaaagaagaagatcaaggaagtctctcatgagtggaacgtgatgaacaagcagaaacctatttggttgaggaagccagaggagatcaccaaggaagagtatgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggccttctccaagaatctcaagcttggcatccatgaggactccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttccttgagaagctgaagaagaagggatatgaggtcctgtacatggttgatgccattgatgagtacgctgttggtcagcttaaggagtttgagggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtcgagcaagaagaccatggagatcaacccggagaattccatcatggacgagctccgcaagcgtgccgatgctgacaagaacgacaagtctgtgaaggacctggtgatgctgctcttcgagactgccctcctgacctccggcttcagccttgaggaccccaacaccttcggcaccaggatccaccggatgctcaagctcggcctgagcatcgacgaggacgagtctgctgaggctgacgccgacatgccgccgctggaggacgacgccggcgagagcaagatggaggaggtcgactaa

SEQ ID NO: 29 - DNA, 1869 bp, Oryza sativa
  misc_feature (1813)..(1813): n = any nucleotide
  misc_feature (1832)..(1832): n = any nucleotide
  misc_feature (1843)..(1843): n = any nucleotide
  misc_feature (1847)..(1847): n = any nucleotide
  misc_feature (1868)..(1868): n = any nucleotide
atggccaaggaggcaatggcgacaccgacacggccgcaggtcagggagacgtggccggcgggtggcggcggcggcggcggtggttggatgggcgttggctccggcgagagggtggcgagcgcgtacgacctcgtggagcagatgcactacctgtacgtgcgcgtcgtcagggcgcgcgggctcacggcggcggcgagcacggtcgccggcggcggcgggtgcaacccgtacgtggaggtgcggctcgggaactaccggggcacaacgcggcaccacgagcggaaggcggcgccggagtggaaccaggtgttcgccttctcgcgggagcgcgtccaggcctcggtgctcgaggtgttcgtcagggacaaggacgccgtggcggcggcgcccgtgcgcgtgccgccggacagcccgctcgcgccgcagtggtaccgcctcgaggacgtcggcggcggaggcggcagggcggtgcagggagaggtcatgctcgcggtgtgggtcggcacgcaggccgacgaggcgttcgcggacgcgtggcacgccggcgcggcgtcggtgcgcggaggcggcgacggcgtggcggccgtgcagagcacgcggtccaaggtgtacgtgacgccgaagctgtggtacctccggataagcgtgctcgaggcgcaggacgtcgtcccgggcgccgtcgccggcgcaggcggcgacaagggacggcacggcgaggccttcgtcgtcgtcaaggtgcaagtcggcggcgtgacgctccggaccaagccgtgctgccgcccgacgagcccatcgtggaacgaggagctggtgttcgtcgtggcggagccgttcgacgagccggcggtgctcgtcatcgaggcccgggcggcgcacccgggcaaggacgagatcgtcagccgcgccgtgctgccgctcaccctcttcgagaggcgcctcgaccggcgcggcgcggccgcggccacgcacacgcagtcgcagtggttcagcctggagccgttccccgccttcgccggccgcgtgcacctccgggcgtgcctcgacggcgcctaccacgtcatggacgagcccgccatgtacgccagcgacacgcgccccacggcgaggcagctgtggcgcccgcccatcggcgtgctcgaggtcggcgtcctcggcgcgcagggcctccccccgatgaagaccgccgccgacggcggccggggcaccaccgacgcgtactgcgtcgccaagtacggccacaagtgggtgcgcacccgcaccgtcgtcgactcctccaccccgcggtggaacgagcagtacacctgggaggtctacgacccgtgcacggtgctcacgctcgccgtgttcgacaactgcaacctcggcaatggcggcggcggcggcaaggaccagaggatcggcaaggtgaggatacgcctctcgacgctggagatggacagggtgtacaccaacgcgcaccggctcgtggtgctgcacccgtcggggttgcgcaagaacggcgacgtctgcctcgccgtgcgcctcacctgcctgtccctcgccagcgtcttgcgcctctacggcgagccgctcctccccggggcgcactacgtccaccccttcgccgtcgcgcagctcgacggcctcaggcggcaggcggtgggcgtcgtggcggcgcggctgggccgcgccgagccgccgctgcggcgggaggtcgtggagtacatgctcgacgccggctcccacctgtggagcatccggcggagcagggccaacttcctccgcgccaaggcgctgctctccggcgccgccggcgcggcccgttggctcgccnacttttgccactggaggancccgcgaagangatncttggggcacttctgctcgtna

SEQ ID NO: 30 - DNA, 1759 bp, Oryza sativa
  misc_feature (1584)..(1584): n = any nucleotide
  misc_feature (1587)..(1587): n = any nucleotide
  misc_feature (1602)..(1602): n = any nucleotide
atgataacgggggcggacttctaccacgtgatgacggcgatggtgccgctgtacgtggcgatgatcctggcgtacgggtcggtgaagtggtggcgcatcttcacgcccgaccagtgctccgggatcaaccgcttcgtggcgctcttcgccgtcccgctcctctccttccacttcatctccaccaacaacccctacaccatgaacctccgcttcatcgccgccgacaccctgcagaagctcatcgtcctcgcgctcctcaccctgtggagccacctctcccgccgcggctccctcgagtggaccatcaccctcttctccctctccacgctgcccaacacgctcgtcatggggatcccgctgctgaaggggatgtacggggagttctccggtagcctcatggtgcagatcgtggtgctccagtgcatcatctggtacacgctgatgctcttcatgttcgagtaccgcggcgccaggatcctcatcaccgagcagttcccggacaccgcgggcgccatcgcgtccatcgtcgtggacgccgacgtcgtgtcgctcgacgggcggagggacatgatcgagacggaggccgaggtgaaggaggacggcaagatacacgtcaccgtgcgccgctccaacgcgtcgcgctccgacgtctactcgcggcgctccatggggttctccagcaccacgccgcggccgagcaacctcaccaacgccgagatctactcgctgcagtcgtcgcgcaacccgacgccgcggggctccagcttcaaccacactgacttctactccatggtcgggcgcagctccaacttcgccgccggggacgcgttcggggtgcgcaccggcgccaagccgcggccgtccaactacgaggaggacgcggcggcgcccaacaaggccggcagcaatacccggcgcccaacccggccatggcggcgccgcccaagcccaagaaggcggccaacggccaggccaagggcgaggacggcaaagacctccacatgttcgtctggagctccagcgcgtcgcccgtgtccgacgtcttcggcaacggcgccgagtacaacgacgccgccgccgtcaaggaggacggcgtggagagggacgacttcagcttcgggaacagaggcgtcgccgagagggacgcggaggccggcgacgagaagagcgtggcggcggcggtgtcggcggcgccgacggcgatgccgccgacgagcgtgatgacgcggctcatcctgatcatggtgtggcgcaagctcatccgcaaccccaacacctactccagcctcatcggcctcatctggtcgctcgtctgcttccgcaggtggaacttcgagatgccggcgatcatcctgaaatccatctccatcctctccgacgccggcctcggcatggccatgttcagcctcggggctgttcatggcgctgcagccgcggatcatcgcgtgcgggaacaaggtggcgacgttcgccatggcggtgcggttcctgaccggcccggccgtcatggccgccgcctccatcgccgtcggcctccgcggcacgctcctccacgtcgccatcgtgcagcaggcagcgttgccncanggcattgtccccttngtcttcgccaaggagtacagcgtgcaccccgacattctcagcacggcgtcatctttggcatgctcatcgcgctgcccaatcacgctggtgtactacatcctgctggggctgtgactgtgaacaaccaccaccaagaacagcatgtttttgcaggtga

SEQ ID NO: 31 - DNA, 1681 bp, Oryza sativa
cgcagagaaaggcgtcttcgtactcgcctctctccgcgcctccgcgcttttcctcctcctctcccctctctcccttctccgccgccgtcgcagcatcaacccaatccgccgccatgagggagtgcatctcgatccacatcggccaggccggtatccaggtcgggaacgcgtgctgggagctctactgcctcgagcatggcatccagcaggctgatggtcagatgcccagtgacaggactgttggtggaggtgatgatgctttcaacaccttcttcagtgagactggtgctgggaagcatgttccccgtgctgtatttgttgatcttgagcctactgtgattgatgaggtgaggactggttgctaccgccagctcttccaccctgagcagctcatcaatggcaaggaggatgcagctaacaactttgcccgtggtcactacaccagttggcaaggagattgttgatctgtgccttgaccgcatcaggaagcttgctgacaactgcactggtctccaaggtttccttgtgttcaacgctgttggaggtggaacgggctctggtcttggttcccttctcctggagcgcctttctgtggactatggcaagaagtccaagcttgggttcactgtgtacccatcccctcaggtctccacctctgtggttgagccatacaacagtgtcctctctacccactccctccttgagcacactgatgttgctgttctgcttgataatgaggccatctatgacatctgccgccgctcccttgacattgagcgcccaacctacaccaacctcaacaggcttgtgtctcagcaggttatctcatccctgaccgcctccctgaggtttgatggtgctctgaacgtggatgtcaatgagttccagaccaaccttgtgccctacccaaggatccacttcatgctttcgtcctacgctccagtgatctctgcggagaaggcctaccatgagcaactctctgttgccgagatcaccaacagtgccttcgagccatcctccatgatggccaagtgcgaccctcgccacggcaagtacatggcctgctgcctcatgtaccgcggcgatgtcgtgcccaaggacgtgaacgccgccgtcgccaccatcaagaccaagcgcaccatccagttcgtggactggtgcccgacggggttcaagtgcggcatcaactaccagccgcccagcgtcgtccccagcggcgacctcgccaaggtgcagagggccgtgtgcatgatctccaactccaccagcgtcgtggaggtgttctcccgcatcgaccacaagttcgacctcatgtactccaagcgcgccttcgtccactggtacgtgggtgagggcatggaggagggtgagttctctgaggcccgtgaggatctcgccgcgttggagaaggactacgaggaggttggcgctgagtccgacgagaatgaggatggcgatgatggtgacgagtactagaggagtcgtcgtcgtctgggggcttgatgttctgtgtgtcaaggcctgattgataactgctgctatcccatgatctgccagtgtggagttatcctgttgccgtgtgcgtgtgtcttcgagacatttgcttgtggtgatctgatgtttggggcttaatgggcttacaaccctcgttgttgtaacctgtgtgccctgttttatgtga

SEQ ID NO: 32 - DNA, 1450 bp, Oryza sativa
  misc_feature (376)..(376): n = any nucleotide
  misc_feature (382)..(382): n = any nucleotide
  misc_feature (582)..(582): n = any nucleotide
atggagtcggatcaggggaagctgttcatcggcggcatctcgtgggagaccaccgaggagaagctccgcgaccacttcgccgcctacggcgacgtctcccaggccgccgtcatgcgcgacaagctcaccggccgcccccgcggcttcggcttcgtcgtcttctccgacccttcctccgtcgacgccgccctcgtcgacccccacaccctcgacggccgcacggtatcccctctcaaaccctagcgaatattcgcgttggattccctcctctcaagggttgatgtgaagcgggcgctctcgcgggaggagcagcaggccgcgaaggcggcgaaccctagcgcgggggggaggcacgcctccggtgggggcggtggtnggggangcgccggtggtggtggtggtggcggcggtggtgacgccggcggtgcgcggacgaagaagatcttcgtcggcgggctgccctccaacctgacggaggacgagttccggcagtacttccagacctacggggtcgtcaccgacgtcgtcgtcatgtacgaccagaacacgcagcggccgagggggttcgggttcatcaccttngacgcggaggacgccgttgaccgcgtgctgcacaagaccttccatgacctgagcgggaagatggtggaggttgaagcgcgccctgcccagggaggccaaccctggctccggcagtggtggccgttccatgggaggcggcggtgggggttaccagagtaacaatgggccgaactccaattctgggggctatgatagcagaggtgacgctagcaggtatggtcaggcgcagcagggtagtggtggttatcccggttatggtgctggaggatatggtgctggtacggttggttatggatatgggcatgctaaccctggaactgcgtatgggaattatggggctggaggatttggaggtgttcctgctgggtatggtgggcattatggcaatccaaatgcgcctggttcaggttaccagggtggtcctccaggagcaaacagaggaccatggggtggtcaagctccgtctggttatggcactgggagttatggtggcaatgcaggctatgctgcttggaacaactcttctgctggaggtaatgcacccactagtcaggccgctggtgcaggcacaggctatgggagccagggctatggatatggtggatatggaggagatgcatcgtatggtaatcatggtggatatgggggttatggaggaaggggagatggtgctggcaatccagctgctggcggtggatctgggtatggtgctggctatggaagcgggaatggcggttctggttatccaaatgcttgggctgatccttcacaaggtggagggtttggggcttcagtcaatggagtgtctgaaggccaatcaaattatggcagtggttatggtggtgtgcaacctagggttgctcagtaa

SEQ ID NO: 33 - DNA, 1406 bp, Oryza sativa
gccgaccgtagggacctccgagcgaaaccactgagagcgaatgctaccaaagagggtcgtgaaagagaagaccaccgtcttcagctcctgctgcctcgtcggggcaggtaccgaacacggtcgacgcggcgaaggcagccgcagcggctagcgcgctccagaccagggcggagaccctttcgacaggccagctgctggtgccccaagccgcttcgtcatagccggcaacggtttcgaccgcgctcgccgccgcacaagtcaaccccgacctctaagcacatgtcgaagccgacatggaggccatgcgccggaacatgacgcgactccaagacatggttcgtcagatgcaagaacagcagcaggcgtataagacggcgaggcaggccaaggtcgcttcggctccaatcctccagtattcggcgggctacatcccaccccaagtctacccgcaagcaccaatccagccccatccgccacaagccatgcaaatgccagtatacttcactgggcagcctccaaccacagcaatgcaaccggcccctcatgtgcagccgcaagctcagccggtcgctgcccaaggagcaaaccaagaaccaaactaggtcaccatggcatggacccagccgacgttcgacccatccatggcggcccaccaagcatcaccgatcagggctaggcagccgaacactgtggcccagccgcatgcgcaagccatgacctcgcccttcgccacgccatatccacagcaaggtgccgcgaacagggcggggggcgaaaaggggctaccactgagtgggggaatcaagatccgtccaatcccaccccagttcaagttcccacccgtcccacgctattcgggcgaaacggatctaaaagagttcttgtccatctacgagtccgcgatcgaagccgctcatggagacgaaaataccaaggcgaaggtaatacatctcgctctagacggcatcgcccgttctttgtacttcaatttaccagctaacagcatttactcatagaagcaattgcgcgatgtctttgtccttaactttcgaggcacctacgaggagccgaagacgcagcagcatctactcggtattcgcaagaggcctggggaattgataagggagtacatgcgtcgcttctcgcaagcccgatgtcaagtgcaggacataactgaggcgtccgtcatcaacgccgcttcggccgggctgctcgagggcaaactcacaagaaaaatcgccaacaaagagccgcaaacgcttgagcacctacttcgcatcattgacgggtacgtgtcacgcccggaatttctatccaaaattccaaacgcttacatgtgtgttaagccctcgtccaggaatcaaccgaggcacacaatgacaatattgataatagagtacaaataa

SEQ ID NO: 34 - DNA, 1405 bp, Oryza sativa
  misc_feature (901)..(902): n = any nucleotide
atggcgagcggcggcggcggcgtgaggctgaaggccgggacgcggccgccgtgggtggggctagcggcggcggtgtgggtgcagatggcggcggggaacgcgtacacgttcccgctctactcgccggcgatcaaggcggcgctggggtacacgcagcagcagctcgccgtgctgggcgtcgccaaggacgtcggcgagaacttcggcgtcgtcgccggcgtgctctgcaacagcttcccgccctgggtggtgctgctcgtcggcgcggccttctgcttcgtcggctacggcgcgctctggctcgccctagcaatggcaacaaacagcaacgcgtggttcctgacagccgtgctggtgaccaacatgcgcaacttcccgctccgccgcggcgtcgtcgccggcctcctcaagggctacatcggcgtcagcgccgccctcttcacccaggtcttctccggcgtgctccaccgctcgccgacgagcctcctcctcctcctcgccaccggcctccccaccatatgcctcgccaccatgccgtctacctcgtgacaaccaccgtcctcggcaacgccatcaaactctccgatgcaaccagctacacgcttttcatcgtcaccgtgcttctgcttcttgcgccgctcgcgatcccggtgaagatgacattgttcaggagtaagaggcggcggccgaggagaggggaggacttcgagttcagtgaggcgcttgtcaaggctgatttctggctgctgttcgttggatacttcattggagttggaacgggtgtcaccgtgctgaacaatctggcacagattggtgttgctgctggtattggtgacactacggttttgttgtccctgtttgcgcttggtaacttctttggccgccttggtggaggtgcaanntcagagaaatttgtcaggttaggtcgacattgttggttcctaggccaatatggatggcgttgacgcaaaccgtcctcgtcgtcgcttacctctgtttggcctatactctcggcccagccgtcgcctacgcttgcacggccaccgttggcctttgctacggcgtgcaattctcagtgatgattccaacgacctcagagctgttcgggctcaagaacttcggcctcttctacaacctcatgtccctggcgaacccgctcggcgcagcgctcttctccggtgagctcactggtcgactatacgacgaggaggccgcgaggcaacaacattctggtggtgtgtgccttggcccaggatgcttcagggccgcgttcgtggtgctcgccggtgcctgctcggtggggacggcggtgagcttggtattggcggcaaggatacagccggtttacatggctctctactctggcgggtcgttcaggttgcctaacgcgtcacagcaacattga

SEQ ID NO: 35 - DNA, 1332 bp, Oryza sativa
atggccgtgcggcaccacctccttccggggtctcctcgccgccgcaccgcacacaacctctcatcttcctccctccgcaaaagctccgaagcctccctcctccacaaggttccctgcgccgccctccgctccctcctcgccaatctcaacgacgtcctcctcaccaccaggctcttcctcctcttccccgccgtcctcctcgccatcgccgccacttacctccacttcggacagcaggtgtgggtgtttgtgcttagcttaatcggcctcgttcctcttgctgagcgactcagcttcctcaccgacagattgcattttacaccggtcctactggtgggaggactactgaacgcgacatttgggaacgtgacggaggtgataatcgcgctgttggcgctgcgagaaggaaagattgaggtggtgaaatgctccctgctgggatccatcctctccaacctgctgcttgtcctcggcacctccctcttcctcgccggcatcgccaacctccgcgcccaccagccgtacgacaccaagcaagctcacgtcaacaccgccctcctcatgctcgccgtcctctgccactccctgccgctcatgctcaggtacgccgtcacctccggcgaccacgccatcgtctccggcgacgccgccctccacctgtcgcgtgcctgcagcatcctcatgctcatcgcctacctggcctacctcttcttccaactcaacacgcatcgccagctgtttgagccccaacaggttgaggatgatgacgacgatgatttagtgatcgctcaagatgatgagccagtactgggattctcgagtgccatgatttggctggctctcatgactctcctgactgcgctcttgtcagggtatgttgtgagcacaattgaggcggcctcagaatcatgggaactatcagtgagcttcattagcatcatcttgcttcccatcgttgggaacgcagcagagcatgccggtgccgtcatatttgctctcaagaacgatattactctcggagtgtctttgggctctgccacacagatctccatgtttgtggttccagtgagtgtgattgtagcctggactatgggaatcccaatggatcttgatttcaacctgctggagactggctctctgtttctagcaatattagtgacagccttcaccctccagcaggagggagaatcacattatctgaagggattgattcttgtcctgtgctacgctgtcatcagcgtgtgctttttcgttataagacggcgttctgcaggtatatgttatgttatgtactttctactacagtatgtaggaagcactactagacagtag

SEQ ID NO: 36 - DNA, 1251 bp, Oryza sativa
atggaggagcagcagcaggtggaggtggaggtggaggtgccgtcctacttcgtgtgccccatctcgctgcagatcatgcgcgacccggtgacgctccccaccggcatcacctacgaccgcgacggcatcgagcgatggctcctcaccgccggcacctgcccgctcaccaagcagcccgtgccgcccgactgcgaccccacgcccaaccacaccctgcgccgcctcatccagtcgtggtgcgccctccacgccgaccatggcgtcgacctcgtccccacccccaagccccccgccgaccgcgcccgcgtcgccgacctcgtctcccgcctccgcgccgccacgagctccgctgccctcctcgacgcgctgcgcgagctcagggacgttgccgccgagagcgagcgtaacaggaagctcctcgccgccgtccccggcgcggtggatgttctggccgccgtcgtcgtcgcgtcgtgtcgagacgccaaggccgcgtgcgacgaggccctcgagatcgtctgctcgctggagctctcggagcggtgcctggcgcggctcgtcgagaggaacgaggagctcgtcgacgcgctcgtcgccacgctgcagcggacgaacaccacgtcccgggcgcacgcggcgctgctcctggaggccgtgacggcggtcatgccgtcgaacaggctggtgtccctcccggaggaggtgttcggtgaggcggtgcagctgctccgcgacagggtatcgagcccggcgacgagggcggcgctgcacgtgctggtcggcacgacgtcgtggggccgcaaccgcgtgaaggcggtggacgccggcgcggtggcggtgctggtcgacatgctcctggacgggccagtcgagcggcgcgggtgcgagctggccctggcggcgctggaccggatgtgcgggtgcgcggaggggcgggcggcgctggtgtcgcacggcgcgggcgtggcggtggtggggaggaaggtgctgagggtgtcggaggtgcgagcgccagaagcgtgcggtgctgcggtcggtggcgaggcacgcggcgacggcggcggtggtgcaggagatggggcagacgggggcggtggagaagctgtgcgtggtggcgcagtcggagcagtgcggggagaggacgcgggagcgggcgcgggagacgctgcggctgcacgccagagcgtggaggaactcgccctgcttgcagcctcacctccaggccctctacccttcttgctgatcgaattctga

SEQ ID NO: 37 - DNA, 1156 bp, Oryza sativa
atggacaagaagaataacatccgtaatatgtccgtcattgctcatgtggaccacggtaacactgttgctatggttggtttggatcagttcaatgaagttctcagtgtcccctgttgtgcgtgttgctgttcagtgcaaggttgcctctgatctgcccaagcttgttgagggtttgaagcgtctggcgaagtctgatcctatggtgctctgtactattgaggagtctggtgagcatatcattgctggtgctggagagcttcaccttgaaatttgcttgaaggatctgatcattgtttccccacctgttgtttctttccgtgagactgtccttgagaagtcgtgccgtactgttatgagcaagtccccgaacaagcacaaccgtctctacatggaagctcgccccttggaggagggattggctgaggccattgatgacggtcgtattggcccacgtgatgatcccaaggtgcgctccaagatcctgtctgaggagttcggctgggacaaggatcttgcaaagaagatttggtgttttggacctgagacaactggccccaacatggtggttgatatgtgtaagggagttcagtatctgaatgaaatcaaggattccgttgtggctggtttccagtgggcatcaaaggagggtgctctggctgaggagaacatgcgtggtatctgctttgaggtgtgcgatgttgttctccatgctgatgctattcacagaggtggtggccaggtcattcccacggccaggagggtcatctatgcttctcagctcacagcaaagcccaggcttcttgagcccgtctacctggtggagatccaggcccctgagaatgcccttggtggtatctatggtgttctgaaccagaagagaggacatgtgttcgaggagatgcagaggcctggtacccctctgtacaacatcaaggcttacctccctgtcatcgagtcctttgggttctcaagccagcttagggctgcgacatctggccaggccttcccccagtgtgtgttcgaccattgggacatgatgacctctgatcctcttgaagctggctcgcaggcttcaaccctggtgcaggatatccgcaagaggaagggtctcaaggagcagatgactcccctctccgatttcgaggacaagctctaa

SEQ ID NO: 38 - DNA, 1129 bp, Oryza sativa
atggactccgtccgctccggcccctacggccacatcttccgcccggacaacttcgtcttcggccagtccggcgccggcaacaactgggccaagggacactacaccgagggcgccgagctcatcgacgccgtcctcgacgtcgtacgaaaggaggccgagaactgcgactgcctccaaggggttccaggtttgccactcgcttggcggcggcacggggtccggcatgggcacgctcctcatctccaagatccgggaggagtaccccgaccggatgatgctcaccttctccgtcttcccctcgcccaaggtctccgacaccgtggtggagccctacaacgccaccctctccgtccaccagctcgtcgagaacgccgacgagtgcatggtgctcgacaacgaggccctctacgacatctgcttccgcaccctcaagctcaccaccccaagcttcggcgacctcaaccacctcatctccgccaccatgagcggcgtcacctgctgcctccgcttccccggccagctcaactccgacctccgcaagctcgccgtcaacctcatccccttccctcgcctccacttcttcatggtcggcttcgccccgctcacctcccgcggctcgcagcagtaccgcgccctcaccgtcccggagctcacccagcagatgtgggacgccaagaacatgatgtgcgccgccgacccccgccacggccgctacctcaccgcctccgccatgttccgcggcaagatgtccaccaaggaggtggacgagcagatgctcaacgtccagaacaagaactcctcctacttcgtcgagtggatccccaacaatgtcaagtccaccgtctgcgacatcccccccaccggcctcaagatggcctccaccttcatcggcaactccacctccatccaggagatgttccgccgcgtcagcgagcagttcaccgccatgttccgcaggaaggccttcttgcactggtacacgggcgagggcatggacgagatggagttcaccgaggctgagagcaacatgaacgacctcgtctccgagtaccagcagtaccaggacgccaccgccgacgacgagggtgaatacgaggatgaggaagaagaggctgatctccaggactaa

SEQ ID NO: 39 - DNA, 1084 bp, Oryza sativa
  misc_feature (701)..(701): n = any nucleotide
  misc_feature (705)..(705): n = any nucleotide
  misc_feature (744)..(744): n = any nucleotide
  misc_feature (756)..(756): n = any nucleotide
  misc_feature (769)..(769): n = any nucleotide
  misc_feature (776)..(776): n = any nucleotide
  misc_feature (779)..(779): n = any nucleotide
  misc_feature (782)..(783): n = any nucleotide
  misc_feature (796)..(796): n = any nucleotide
  misc_feature (805)..(805): n = any nucleotide
  misc_feature (912)..(912): n = any nucleotide
  misc_feature (975)..(975): n = any nucleotide
  misc_feature (1055)..(1055): n = any nucleotide
  misc_feature (1061)..(1061): n = any nucleotide
atggctcacgagatgatgggtggcttcttcggccatccgccgccgccgcctgcgacggcggcggtgggtgaggaggaggacgaggtggtggaggagacggaggagggtggccatggcggaggagttcaggggaagctttgcgcgaggggacactggcggccggcggaggacgccaagctcaaggacctcgtcgcgcagtacggcccccagaactggaacctcatcgccgagaagctcgacggcagatcagcagggaagagctgcaggctgaggtggttcaaccagctggacccgaggattaaccggagggcgttcacggaggaggaggaggagcggctcatggcggcgcaccgggcgtacggcaacaagtgggcgctcatcgcccgcctcttccccggccgcaccgacaacgccgtcaagaaccactggcacgtcctcatggcgcgccgccaccgcgagcagtccggcgccttccgccgccgcaagccttcctcctcctccgcctcccccgcccccgcccccgcgccgccgccgccgccgcagcccgtcgtcgcgctccaccaccaccaccaccggtactcgcagcagtacagcgggtacagcggcgccgccgagtccgacgagtcggcctccacctgcaccaccgacctctccctcagctccggcagcgccgcggccgccgccgccgccgccgcggcggnaaanatcccctgctgcttctaccagagcacgccggggcgcttnttcctcttccancgccgcgttccgngcgcctngcntcnnggcggcggctaanacggtggcntttttccccggtggatggtgtggctgtcggtggtggcttgggcgccgccgcgctggtcgacggcgccggggggctcgccgcggcccgccggggcggagaaggcggancgcgcgctcggcgcgaacgtggacgccgccgcgggagccatggcgtgcggggcggcggcaaantcgtagcctgcaccggggaagaacgccaccgtgtcagccgccgccgcgacgcaaggccccgcggcacgcgccgttgaaanaggaanaggcacgcggcttgctctggtaa

SEQ ID NO: 40 - DNA, 1079 bp, Oryza sativa
  misc_feature (30)..(31): n = any nucleotide
  misc_feature (36)..(36): n = any nucleotide
  misc_feature (46)..(46): n = any nucleotide
  misc_feature (190)..(190): n = any nucleotide
  misc_feature (203)..(203): n = any nucleotide
  misc_feature (487)..(487): n = any nucleotide
  misc_feature (511)..(511): n = any nucleotide
  misc_feature (514)..(514): n = any nucleotide
  misc_feature (649)..(649): n = any nucleotide
gaggaggccgggcaggctgatccgatggcnngcgangagcgacgcnaaccggcgaacggcggcgaggtggattggggggttagcaccggaagagagaggaggccaaggggaatcgattcaacggagcggattagccgggggaagaacgacggcggccgacggcggagggggagatcaaggggatccccgngagcgtggtggcnagagggattgacaagaggggagccgacggcggcggattttgacggcgatcgtcggcggcgagcaaagggggaaaacttcaccagggcaacgggggttcgattcgttggagctggagcatctacgcgaggtcgcgagctcattccatcggtcgagagggcacgggcgacgccgagagaggccggcgacggcgagcgacgcccgggacagagcaagggcgcgcggcgagatgtgacgaatggcggcgggcgcggcgcagcgtgcgacaggggaaaagggggcgcgnccggggaagaagagatggagaggngcnaggatgggggcggcgcggagctccttgtcgactcctcgtgctcgctagctccccgacacgcacgacggcagaggagggcgagaacgacgacgaacggcgagacggcagtggtgtgatggaggagaggaaaccggnaggcggcgtggagtggcgggggccatggatgacgtcggcaatgacggtggcggtcggtttggcatggagcgggggcaaggcggcagcgcgtggcgtcagcggcgcaagggctgatggcggcggcgaccgggtggcgagcgcgcgcgcgggaagggcgaccggcgaattcaaacggcggcggcgggaatcggcgccggggagaggagttcgacgagagagagagagagagaggaaggagacaagagaggcgctgcttctctcgctcggcgcgtgcagcgcacgtgcggggaggaggaggagcggccgagaggagaagatgggctggaaaagggaaaaacggcccaacgaccaagagggaggtgaaacggctgagggagggaggtgggctaagggggaaaacggcccacaatacccgagggaggtaaaatag

SEQ ID NO: 41 - DNA, 1065 bp, Oryza sativa
  misc_feature (226)..(226): n = any nucleotide
  misc_feature (560)..(560): n = any nucleotide
acagaagagaggccaaggcgcgcaagctccatggacgcaccgcggtcgcggcggccggcaagggatcgatgagccctcatccagccgcggcgggacggcctggatgtgggtgcggaggaggaggaggaggaggagagggtggggcgagaataggtggatggagaggaggagaggagaggaggcatcggctaaatttaagaggacgcgcgcgcgcgtggggcggcgngtcgtgtcgtcggcagggagatgccaagcggcggcggtgttcccgagaggctccggtctccggcgtacggccggcggcggcgctggagtgtggaggaagcgacaaaggacagcaacaggcgggagcaggccgacaacggcaagggagttgggtggcaagcgggggaggagatggggggcgcagctcaccgcgaggagcaggacgatgtggtcgcagcgccggcagagtgatgtggtcgcggcggcggggttcccggcgagccgcgcagacgagggggagcagcgagccacgcagacgagggggagaaggcggtggcgcaacggcgtgagggcgnaggcggagcacacgaccggcctgcacgccatggtggcggtggaggacgttgtcgaggagatcccccacctcaccctatccatggcagccaccgccaaatgccgccgccgtcttcactccccgccacgcccgcgtctcctccgctcgccgccggctccacttgcccaccgtcgtgcgccacagccgcctttccaccgtctcccaaccgccggatgccaccgccgtcactgccgctccagtggtgaagagaaaggctgggggagagaatgaaagaagggagagagagagggaggaggaagaagggcaccccccaccgtgtcgccgccgacctcgccgacgccaaagggcatcaccatgccaatgaggcccgcctagccgggctccttcccttcccattcgcctcactttgctccacaccaacaccagcccaccacccgctgccggcctctcagatgccttgccacccgtccttgtccaccacccaccgcctgtctattgcctcctag

SEQ ID NO: 42 - DNA, 1029 bp, Oryza sativa
atggatttttttggtttggatgatgcagggttcggccgcatcggcaggctggtggccagggtggcgctgcagagcgaggatgtcgagctcgttgccgtcaacgatcccttcatcaccaccgagtacatgacatacatgttcaagtatgacaccgtccacggccagtggaagcatcatgaggtcaaggtcaaggactccaagaccctcatctttggcacgaaagaggttgcggtgttcggctgcagaggaaccctgaggagatcccatgggctgcggctggtgctgaatacgttgttgagtctactggtgttttcaccgacaaggacaaggcagcagctcacttgaaggggtggtgccaagaaggtcgtcatttctgctcccagcaaagacgcccccatgttcgttgttggtgtcaacgagaaggagtacaagtctgacgttaacattgtctccaacgctagttgcaccaccaactgcctggctcctctcgccaaggtcatcaatgacagatttggcatcgttgagggtttgatgaccactgtccatgccatcactgacagctacccagaagactgttgatgggccctcgatgaaggactggagaggtggaagggctgctagcttcaacatcattcctagcagcactggagctgccaaggctgtcggcaaggtgcttcctgccctcaatggaaagctgactggaatggctttccgtgttcccacagtcgatgtttccgttgttgatctgactgttaggcttgagaagcccgccagctatgaccagatcaaggctgcaatcaacagggaggaggctgagggcaagctcaagggcatccttggatacgttgaggaggaccttgtttccactgacttccagggtgacagcagagcacccgtgtgatcgacctgatccgtcacatgcacagcaccaactagacgagccctcctcatggaggcctgcagatacaggggagttgtgttttgccccagagaagagtagatgaagcctcttccgagaataaattttaa

SEQ ID NO: 43 - DNA, 1021 bp, Oryza sativa
  misc_feature (119)..(119): n = any nucleotide
  misc_feature (127)..(127): n = any nucleotide
  misc_feature (556)..(556): n = any nucleotide
atgggctcctcaagcccaacacgcaatcaccaccatcggtcacgcgtgacgcaaaccccacagcccccctcccctctatataagcctctgcgccgcgctcctccgaaccctagccgcanatccccgnctcttcccgccgccgtccgccgcgcgcacgccgccgccgccatggggaggagacctgcaaggtgctatcgccagatcaagaacaagccgtaccccaagtcaaggtactgccgtggtgtccctgaccccaagatcaggatctacgatgtcgggatgaagaagaagggtgtggatgagttctcccactgtgtgcatctcgtctcttgggagaaggagaatgtcaccagtgaggctcttgaggctgcgcgtatcgcgtgcaacaagtacatgaccaagtctgcaggaaaggatgccttccacctcagggttcgggttcacccgttccatgtgctccgtatcaacaagatgctttcgtgtgccggggcagataggctccagactggaatgaggggtgcttttgggaagccacagggaacctgtgctagggtgnatattggccaggtcctcctttctgtgcggtgcaagcccaacaatgctgtccatgccagcgaagccctccgtcgtgccaagttcaagttccctggtcgccaaaagatcattgagagtagaaagtgaggggtttcaccaagttcagccgcgatgaatacgtcaggcttaagagcgagggtagaatcatgcctgatggtgtcaatgctaagagctacttggttgccatggtcgcctctctgctcgtgcccccgggaaggccttcctctcagccgcttagatatatctatccttatcatctgtgggaaacgaaatatcggacctttttgtttgtttgtagactcgatcatatatcactttgttgaaccctgaatcaccaagtgtctggtgctatattgcctggtctgaagctatcttgtgttgaacatctttatctgaaatatatatcagatgactttcgtgtcgctaa

SEQ ID NO: 44 - DNA, 1014 bp, Oryza sativa
  misc_feature (741)..(741): n = any nucleotide
  misc_feature (792)..(792): n = any nucleotide
atgcgggtgcagtgcgacgtctgcgccgccgagccggccgcggtgctctgctgcgccgacgaggccgcgctctgctccgcctgcgaccgccgcgtccaccgcgccaaccgcctcgccagcaagcaccgccgcctcccgctcgtccacccgtcctcctcctcctccggcgacggtggcgccgccgccgcgccgctgtgcgacgtgtgcagggagaagaggggcctcgtgttctgcgtcgaggaccgcgccatcctgtgcgccgactgcgacgagcccatccactccgccaacgacctcaccgccaagcacacccgcttcctcctcgtcggcgccaagctctcccccgccgcgctcgccgaacagccgctcccgtcctccgactgcagctccgacgacgacgccgccgccgccgccaccgaggaggagtaccactcctccgccgcatccaccggcgccgcagtgagcgcgcctcttgacgcctccagcaacggcgccggtggcggaggaggagtaggagggagcagcatctccgactacctcaccaccatctgccccggctggcgcgtcgaggacctcctccccgacgacgacgccttcgccgccgccgccgcggtgagtactaccaacccattgctccgccgtgttcttgctacgtctccatcgatgaagccgagactaacctacgattccttggagcagcaggcggggaaagagaaggacgagcgcgtgccgttcctcgangccgacctgttcgacgtggtcgccggccggccggagaagaagggcggcgcntgggcgccgcacgtgccgcacctgccggcgtggtgcctcgacgaggtgccggtcgtcgtcgccgcgtcggcggcgccagcggcgacacctgtaaaggcgaagcagggacacgtgcgggacagccactggagcgacagcgacgcgttcgccgtgccggagttctcgccgccgccgccgccggccaagagggcgcggcccagctcgcagttctggtgcttctga

SEQ ID NO: 45 - DNA, 977 bp, Oryza sativa
aagcgcggcgacggcgtcgtcggcatcgacaactacaactcctactacgacccgtcgctgaagaaggcgcggcgcgccctcctgggctcgcacggcgtgttcgtcgtcgacggcgacatcaacgacggccgcctcctcgccaagctgttcgacgtcgtccccttcacccacgtcctccacctcgccgcgcaggccggcgtccgctacgccatggagaacccctcgtcgtacgtccgctccaacgtcgccggcctcgtctccctcctcgagtcctgcaaggacgccgacccgcagccggccgtcgtctgggcctcctcctcctccgtctacggtctcaacgacgccgtccccttctccgaggcgcaccgcaccgacaagccggcgtcgctctacgccgccaccaagaaagccggcgaggccatcacccacacctacaaccacatctacggcctctccatcaccggcctccgcttcttcacggtgtacggtccctggggccgccccgacatggcctacttcttcttcacccgcaacatcctgcaggggaagccggtcaccgtctaccggggccgtgatcacgtcgacatcgccagagggacttcacctacatcgacgacatcgtgcgggggtgcctggcggcgctggacacggctgggcggagcacgggcgggggcgggaggaagcgcggggcggcgccgtacaggatcttcaacctcgggaacacgtcgccggtgacggtgccggcgctggtggcgatgctggagaggtgcctgatggtgaaggcgaggaggcacgtcgtcgagatgcccggcaatggcgacgtgcccttcacccacgccaacatcagcctggcgagggagcagctcgggtacaagccgacgaccagcctcgagatggggctcaagaagttcgtccggtggtacctctcctactacggctacaacagaggaactcacgcattcaggagccgcttgtga

SEQ ID NO: 46 - DNA, 950 bp, Oryza sativa
atggggggagaggtggtgcgtcactggaacgctgacgtgaacggcatctccctccacgtcgccgagcagggccccgccgacggcccgccggtgctcctcatccatggcttcccggagctctggctgtcgtggcgccaccagatggccgccctcgccgcccgcggcttccgcgccctcgcccccgacctccgcggctacggcgactccaccgtccccgacgaccccgccgcctacaccgtcttccacatcgtcggagacctcgtcgccctcctcgatcacctcgccctccccaaggtgatggtggtggggcacgacttgggagctcaggtggcgtggcatctctgcctcttccgcccggacatgctgctcgccgtcgtcaacctcggcgtccccttcttcccccgggggcctagctcgctctcggaggcattcgcagggcgcgatggcctctacatcatgcagttccagcaggaaccagggagagctgaaagagcatttgcccgttatgatgttgcaactgtcctgaaaaagttcttctccattgaaatcgatgacctcaccgcaccccctggagtggagatcatagactttcttgaggcacgttcgacaccgcttccatggatctccgaggaagaacttggccagtacgcggaaaagtttcagaagtctgggttcacaggacccatcaactactaccgcatgatggacacgcaccctggcaaaacgcgaaaattatggtgcctacaaagttcatttgtggtgacaaggacactggtctcaagtcctttggaactgagcactttgtcaagagcggtgctttcaagtccgtcgttccaaatcttgaggttgtcatcattgaaggtcaccatttcatccagcaagagcaggccgagagagtgaattcggagatattgtcctacttcgataagttcactggtgagaaggcatga

SEQ ID NO: 47 - DNA, 897 bp, Oryza sativa
  misc_feature (44)..(44): n = any nucleotide
  misc_feature (57)..(57): n = any nucleotide
aactcgacgatctgggttggcgacctccagtattggatggacgngaactacctccanagctgtttcggacccagcggcgagaaagttatccgcaatagacaaactggacaatccgagggatatggttttgtagagttctactctcacggatcggcagagaaggctcttcagaattttactggtcatgtgatgcctaacactgatcgacctttcaagttaaactgggcttcatatagcatgggtgaaaagcgatctgaagttgcttctgactactcaattttcgttggtgatctagctgctgatgttactgatgaaatgttgatggagctttttgctaataagtaccgctctgtgaaaggagctaaagttattattgatgcaaacacaggccgttctaggggctatgggtttgttagatttggagatgacaatgacaaatcccatgcaatgactgaaatgaatggtgcgtattgctctactaggccaattcgtattggacctgcaactcccagaaggtcttcaggttggtgggctcgatccaaatgtcagcgaagatgagctgaggaaggcatttgccaaatatggtgatgttgcctctgtaaaaattcctctagggaagcaatgtggctttgttcaattcgtcagcaggcggaagaagcactgcaaggattgaatggatcagtcattggaaagcaggcagttcgcctttcatggggccgcagcccatcacataaacagcagtctagggctgattctggcagccgaagaaacaatatgtactatgggacgccattctacggtggatacggttatgcctcccccgtcccgcaccctaacatgtatgctgctgcatatggagcctaccctgtctatggcagtcagcagctagtgagctag

SEQ ID NO: 48 - DNA, 894 bp, Oryza sativa
atgggccgccggcccattctcccctttccttccccctcccccttgctgggccggccgcaggccgaggcccagccaggccgcccgcctccctcctctcccggggtcgccgacaggtggggcccacctgtcgggtctttccccttcctccggccgacgccgcgcccgcaaccgccgcacccgaaaccgccgccgcgtccacgtctccgcctcctccgggccacgtcggccacgcccgcgcgtgcgccgcgtctcccgcgcccactctcctctctctcccgctcgcatccgcgcccgagatggccgggattcgattttcgaatcccgcctctctctcttcccccactcccccacgtcggccggcgattcccgcctctcccggccacgtccggtcctctcaccccctatttaagcatcgccgtcgtcccctctcactttttccccattccgccgtactctctcgagcctcccatcgctctcgcgccgtgcgcccatccgcagccgccgtttccgctactccggccgccgctagccgccgttagggtcgccgccaggccgcgccatcgccgccgtcgggttcgcgtggccgggatccaccccgtccacctctcctccgtcgagagggcaccccgaagctcgtccgtcctcccgtggcttgccgtcaccgttcgccatcgtcttcctccgcgccggccaccctcggtgaggcatcccctcccctcttttccccttcctctcctcttagtgccgcgccgccgcttcaagtcgcgcgctgtcgccttcgaccgccgccgcctcgcgtgccgccggtcgctgccgtcgtcggtcgcatgcgtcgccggcaacgcgttcgcgcgcgcgtcgtcgccgtcgccgcggtcggtcggccggccttga

SEQ ID NO: 49 - DNA, 879 bp, Oryza sativa
  misc_feature (424)..(424): n = any nucleotide
ctgaccaaaaagaccaaagccatggcgccttccctcgccacctcttccaccctcgctctcttcctcctcgtcgccgtctccatcgccgacgccgcgacattcgccatcaccaacaggtgccagtacacggtgtggccggcggcggtgccatcgggcggcggcacgaagctcgacccggggcagacgtggaccatcaacgtgccggccgggacgacgggcgggcgcgtgtgggcgcgcacgggctgcggtttcgacggcagcggcaacgggcagtgccagacgggcgactgcggcgggaagctgcggtgcacggcgtacggcgcggcgcccaacaccctggccgagttcgcgctgaaccagtggaacaacctcgacttcttcgacatctccctcatcgacggcttcaacgtgcccatggccttcntccccgccggcagcggcgccgggtgccccaaaggcgggccgcggtgcgccacggccatcacgccgcagtgcccccagcgagctgagggcgcccggcgggtgcaacaacgcgtgcacggtgttcaggcaggacaggtactgctgcaccggatcggcggccaacagctgcggcccgaccaactactcggagttcttcaagcggctgtgcccggacgcctacagctaccccaaggacgacgcctccagcacctacacttgcccggccggcaccaactaccaggtcgtcttctgcccatgatcgaacgcgcgcgcgcgcgcgcggctgatcgatcgatctctgatgatcttgggatttgtatgatcgatgcatgtgtggatgtaaccgtgatatacgtacctaagaataagtttgcacgcgcaaacgaggataagtttatgttatcgatctttgaataa

SEQ ID NO: 50 - DNA, 834 bp, Oryza sativa
atggcggagcgcggcggcgagcgtggcggcgagcgcggcgggttcggccgcggcttcgggcgcggcggtcgcggcgaccgcggagggcgccgtggcgggcgccgcggcccgcgccaggaggaggagaagtgggtgcccgtcaccaagctcggccgcctcgtgaaggaaggcaggttctccaagatcgaggagatctacctccactccctccccgtcaaggagcaccagatcgtggagaccctcgtgccggggctcaaggacgaggtgatgaagatcacacccgtgcagaagcagacgcgcgccgggcagcgcacccggttcaaggcgttcgtcgtcgtcggcgacaacaacggccacgtcgggctgggggtcaagtgcgccaaggaggtggccaccgccatccgcggcgccatcatcctggccaagctgtccgtggtgcccgtcaggaggggttactggggtaacaagatcgggcagccgcacaccgtgccgtgcaaggtcaccggaaagtgtggctctgtcaccgtgcgcatggtgcccgccccgaggggttcgggtattgtcgccgcccgcgtgcccaagaaggtgctgcagttcgccggcattgaggatgtcttcacctcgtcccgtggatccaccaagacccttggcaacttcgtcaagtttgtgcaggccacctttgactgcctgatgaagacttatggattccttactcctgacttctggagggacaccaagttcgtcaagtctccattccaggagtacaccgacctcttggccaagccgactaaggctcttatgattgatgcacctgtcgagaacgtagaggcttag

SEQ ID NO: 51 - DNA, 808 bp, Oryza sativa
taggaggcatccaagccaagaagagggagagcaccaaggacacgcgactagcagaagccgagcgaccgcctcctcgatccatatcttccggtcgagttcttggtcgatctcttccctcctccacctcctcctcacaggatactgcttgttcttatgattcatttcctttgtgcagttcttggtgtagcttgccactttcaccagcaaagtttcatgtctgatctcgacattcagatcccaactgccttcggatccctttgctgaggccaatgctggagactctggtgcggctgcaggatcaaaggactacgttcatgtacgcatccagcagcgtaatggccgtaagagcctgaccactgtccagggattgaagaaggaattcagctacaacaagatcctcaaagatctcaagaaagagttttgctgcaatggtactgttgtccaggacccagagcttggccagaggtcattcaacttcagggtgatcagaggaaaaacgtatcaaattttcttgttcagcaggccggcattgtgaagaaggaacacatcaagattcatggtttctgagcaactgccaaaaccattgcaaagactatagtttggggtggagtatacttggttgtgtacatgcctgcgtgttccattgtacacacaaaacctagccacctcttgactcttgagtgtatgcttgttacccgtgtgttgaagtttgtaagaggcaccatcactatagatgatggcttgtgtccctctttcatcaagattgaataatatatgctactttgagagcgctatcctgcttgcctga

SEQ ID NO: 52 - DNA, 766 bp, Oryza sativa
  misc_feature (357)..(357): n = any nucleotide
cttaggtagtgtttggttgcaaggatgggatgggatgggatgagatgaacccacttttaggagtgtttggttgagaggtgagtgggacgggatggtccctggagaggaatattcctctcagatccgggatgaaacggtccgccgaaatcggccggaccaatccatcccacttcgacggagcccatggcgtcagctcccgtagcctcccgctcggctccgccgcaacgccgcccgtcgtcagctcccacaacctcccgctcagctccgccgcggcaccgccacggccgcccgtccctcccccggcaccactccctctcccggtgctgctccgttctcctccgcctgcttcctccaccntgcctcgcctccacgaccggtcgtcgcctcgtctgcgactgaccgccgtcgctcgtccgcgttcgcctccgcaaccggccgccgttgctcgtccgcgcctcgtcgcctccgcgaccggccgccgctcgtctgcgcctcgcctcgccttgcctccacaaccggtcgctgcctcgtccgcgaccgcttccgcggccaaccaccgtcgctcatccgcgcctcgcctcgcctctcctcgcctccacgaccagtcgccgcctcgtccgcgaccgaccgccgccactcgtccgcgcctcgcctcacctcgcctccgcgaccggccgccgccgctcatccgcgcccgcctccgcctctcctccgctcgcgccgacgagctcctccatccccattctcaccactcgctccaacctag

SEQ ID NO: 53 - DNA, 758 bp, Oryza sativa
atgatgggggccacttctccgtcaggcctggagctcaccatggctgtccccggcctcagctcctctggttcagcagaaggggccggttgcaacaacaacaacgccggtggcggctgcaacatgagggacctggacatcaaccagccggcgagcggcggcgaggaggaggagttcccgatgggcagcgtggaggaggacgaggaggagaggggcgtcggtgggccccaccgccccaagaagctccgcctctccaaggagcagtcccgcctcctcgaggagagcttccgcctcaaccataccctcacgccggaagcaaaaggaggccttggcgatcaaactgaagctgcggccgaggcaggtggaggtctggtttcagaaccgtagggcaagaggacgaagctgaagcagacggagatggagtgcgagtacctgaagcgctgcttcgggtcgctgacggaggagaaccgccggctgcagcgggaggtggaggagctgcgggcgatgcgggtggccccgcccacggtgctctcgccgcacaccaggcagccgctcccggcgtccgcgctcaccatgtgcccccgctgcgagcgcatcaccgccgccaccggcccgcctgccgtgcgcccgccgccgtcgtcagccgccgccgccgccccctcgcccttccaccctcgccgcccctctgcggccttctaggcccaaggtctcgcatcctaaaggccacaaaaagatgggcctcgccgtcccgtgtaaattga

SEQ ID NO: 54 - DNA, 747 bp, Oryza sativa
  misc_feature (247)..(247): n = any nucleotide
  misc_feature (254)..(254): n = any nucleotide
  misc_feature (262)..(262): n = any nucleotide
  misc_feature (289)..(289): n = any nucleotide
  misc_feature (295)..(295): n = any nucleotide
  misc_feature (306)..(306): n = any nucleotide
  misc_feature (329)..(329): n = any nucleotide
  misc_feature (333)..(333): n = any nucleotide
  misc_feature (578)..(578): n = any nucleotide
  misc_feature (661)..(661): n = any nucleotide
atggaggacgtcgtcaccgacgcgccgccgccgtcccgcttctccccggacgacctcgacaacttcgccgctccaccgccgcagcccacccctatcctcgtcgtctcccccgccaaccctagccccgccccgcgccgcctcctcatcctcctcatctccccgacctcgctcgcgctcctcccccacctcccctcgccgcctccgctgcacgcctccctcctcctccccgagttcccccttggggcgntcccagncacccatncgcgtgtatctccatgccccctcgggnaccctncttgccgccgnaaaagggcccggcccccgttccngccnaaccgcgcgcgcgccgtcgccaggagcctcgtgtccgccctcagcccgaggaggtgctggtgctcgacgcggtccggagccggggcctacaggggcaagctcgccgcggacgagcccgtggaggggaagctggagaccagggcggcgcgggggccgggaagcgtcggcgcggcccgcggcgtggcggcgctggccccgcccgggagcgtggtggacgggctcggcgccgcggtgttggcggagtncgagatgcgcgggaaggcggcgagcatggtggtgacgtggccggagggcgcgaggccggcggagttcggcgtcatgcggcgcntggcggcggagctcggcgtcgacccggccaaggcggcggccgggagggtcgccggccgggccgagctggacgcgctgtacacttga

SEQ ID NO: 55 - DNA, 726 bp, Oryza sativa
gggagctcggcgtcggcgctcctcgggacgaaggcggaacggcggcccggcggcgttccgcgagcgggaaccagcggacggcggctggaaggacctagggaggatgggggagaggttaggagggggaaagaggcctcccagcggcatgaatcgctggtcggaggtgagaacgggcggcagatgctcaccggcgcgaggggaaccgtgtcccggcgggatcctggccgtgaaaagcggcggccgaggtgctcctcggcgctgcgaagcgagcggcggcggcggcgctgcttggggtgagcggcgccaagcggcggctggaggtggtaaagacggtggagagaggtggtgcgcgtggcgacggtgtttcagaggcggggaggggaaatggagcggatgccggggtgcggtgggacgctgcaatgctataggtggcagcggcgcagtgcgggggcgacggaagcggcgacggcgcgcggctggagggtcgtcggcgtgcggcggcacacgggagtggcgtggggagctcgagagagcgcgcaggagggggcacgtctgcacgcgcgcgggagcgtggaggcgcgcggaggaagcggcgtcgtggggtggctcaggcggccatggcggcagttggagctggaagaaagggatgacaggtggggtccacgggtcccacctgtcgaagagagagggagggagaggccggctggggaggcagaacagacttga

SEQ ID NO: 56 - DNA, 689 bp, Oryza sativa
  misc_feature (404)..(404): n = any nucleotide
atggaggcggcggcggaggaggagaggctgaggtatctggagttcgtgcagcaggcggcggcgcaggtgctggtgctggcggcggcggcgtacgcgtacgccaagcagggcgccggcccgctccgccccggtgttgaccacgtcgagggcaccgtcaaggccgtcgtcggccccgtctacgaaccgcttccatggcgtccccctcgacctcctcaagttcctcgaaccgcaaggttggtgagtccgtccaggagctggaccgccgcgtgccgccggtggtgaaggaggcgccgggcctggcccgctcggcggcggcggaagtgcggcaagcggggctcgtcggcacggcgacggggctggccaagtcggcgatcgcccgcgccgagcccagggcgcgggacctntacacccggtacgagcccgtggcggagcgcaaggcggcggaggcgtgggcggcgctgaaccgcctcccgctcgtgccgtcggtgacccgcgccgtgctccccgccgccgcgagcctctcggcgaggtacaacacggcagtggccgacggcgccaagcgcggcagcgccgtcgccacctacctcccgctcgtccccaccgagcgcctctccagggtgttcggctacccgctcgccgacgccgccacctcgccggcgccggagatgcagcccatcccgtcgcagtaa

SEQ ID NO: 57 - DNA, 651 bp, Oryza sativa
ccgcagctccccccgttctcctcctcctcctccgtggcgtcgtcgtcgtctccgccgctcccctcctccgtctcggtcgccatcgccggcgacgggttcggccccccgcccaacacgctcaccgagcccgtgttggacaccgtcaagcgcgacctcgctcgcatcgtcagcaacctcaagctcgtcgtcttcccaaaccctttccgtgaggaccccgggaaggcgctgcgcgactgggatctctggggccctttcttcttcatcgtcttcctcggcctcaccctctcctggtcagcctccgtcaagaagtctgaagtgtttgctgttgcttttgctgtactagctgctggtgctataattctcacattgaatgtgctgctcctgttgtagggtgggcgcatcaacttctttcagagcctgagtcttcttggatactgcctgttccctttggatgtcggagctttgatttgcatgctgaaggataatgtactactgaagatcattgcagtagtggttacattggcctggagctcctgggcagcatatccattcatgagtgctgctgttaacccaaggagaaaggcgttggcactatatcctgtcttccttatgtacgtctctgttgggttcctcatcatcgcaatagattaa

SEQ ID NO: 58 - DNA, 648 bp, Oryza sativa
  misc_feature (77)..(77): n = any nucleotide
atgctcggcttctccgtccatcatagtgtgacggggtttcgtggagattggttggttgctcacgccgcgtgtttttngttttttttttggggggttttgcaggcgtcggagaagaagcagtcgaacccgatgcgggaaatcaaggtgcagaagctcgtgctcaacatctccgtcggcgagagcggcgacaggctcacccgcgcctccaagaggtgttggagcagctgagtgggcagagcccagttttctccaagggcgaggtacaccgtgaggtcattcggtatccgtcgtaacgagaagatcgcgtgctacgtcaccgtcaggggcgagaaggccatgcagcttttggagagtggcctcaaggtcaaggagtacgagctgctgaggaggaacttcagcgagaccggatgcttcgggttcggtatccaggagcacattgatcttggcatcaacgacccgtcaactggtatttatggcatggacttctatgttgttcttgagcgtgctggataccgtgttgctcgccggcgcaggtgcaagtcccgtgttggaatccagcacagggtgaccaaggaagatgccatgaagtggttccaggtcaagtatgagggtgtcatcctcaacaaggcccaagcaaacacgtcgtaa

SEQ ID NO: 59 - DNA, 639 bp, Oryza sativa
  misc_feature (46)..(46): n = any nucleotide
atggatctgctcggcgggtgcggcggcgacagccgcggcggcgtcntcggcggcggcggaggggaggacgaggtggtcgacctcgaggtgaaggttcccgccgggtgggagaggcggcttgatctcatgttgcagtcagggaagacgttcttgactcctcggctccagggcgtccatgtcggccaccaagacctcaacctgcctccgccgccgtcctccgccgccgcggccgcgtcgacgtcggccgcggtctgcacgctcgacatggtccgctccgcgctcgagcgcgccacggccgggaggtcggccgccgccgccgccgcgcgtggctccccggccacgtcgtcgtcgtcgtcggcgtccacctcctcgtcctcctcctccatcggcaagcgccaccgcttgccgccctcaggcggcgccgccgcgacgcccgcgagcccgtccatgcgtgcggccgcctgcccgtcctgcctcacctacgtgctcatcgccgaggcggacccccggtgcccgcgttgcgccggcaacgtcccgccgctcgccgggaagccccgggaagcctccgccggcgccggcgacggcagcgggaagaagcccaagattgacctgaatgcggcggccgacgacaccgagtga

SEQ ID NO: 60 - DNA, 598 bp, Oryza sativa
  misc_feature (429)..(429): n = any nucleotide
atgaaacccaccgcgccgccctcctccgaaaactcaaaatttcgccgatctcccgctcaaccccaccgcctacttaaaccccccgtcgcccatcgccatcctcacctcactccaatcccccaattcccaaatcctccaagctctcgcgcttccgattccaagcagcagcagccagtccagttcccaaatggcccgcacgaagcagacggcgaggaagtccaccggcggcaaggcgccgaggaagcagctggcgacgaaggcggcgcgcaagtcggccccggcgaccggcggcgtgaagaagccccaccgcttcaggccgggaaccgtcgcgctccgggagatccgcaagtaccagaagagcacggagctgctcatccgcaagctgccgttccagcggctggtgcgggagatcgcgcaggacttcaagancgacctccgcttccagagctccgccgtcgccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcgtag

SEQ ID NO: 61 - DNA, 593 bp, Oryza sativa
ccacgtcgcccttacgagaaggagcgtcttgatgcagagctgaagctagtgggtgagtatggactgaggtgcaagcgtgagctgtggcgtgttcagtatgctttgagccgtatccgtaacaatgcaaggcacctgctcacacttgatgagaagaatccacgccgcatcttcgagggtgaggcactgcttcgccgcatgaaccgttatgggctccttgctgatgggcagaacaagcttgattatgtccttgccctcactgttgagaacttcctcgcaaggcgtcttcagactcttgtcttcaaggctggcatggccaagtccatccaccatgctcgtgtcctgatcaggcaacgccacatcaggtcggcaggcaaattgtcaacatcccgtcgttcatggtgagggttgagtctgagaaacacattgacttctcactgacaagcccattcggtggaggcccccctggtagggtgaagaggaagaaccagaagaaggcaagcggcggtggcggtgatggtgaggaggaagatgaggaatgagaagaagtttgcaactagttgtttccgtaatgatcataaaactttctgtgctga

SEQ ID NO: 62 - DNA, 583 bp, Oryza sativa
  misc_feature (455)..(455): n = any nucleotide
  misc_feature (513)..(513): n = any nucleotide
  misc_feature (550)..(550): n = any nucleotide
  misc_feature (563)..(563): n = any nucleotide
gggaaaaggcgggggagctcggcgtcggcgctccctgggacgaaggcggaacggcggcccgacggcgttccgcgaacgggaaccggcggacggcggctagaaggacctggggaggatgggggagaggttaggagggggagagagggctcccagcggcatgaatcgctggtcggaggtgagaacaggcggcggatgcgcaccggcgcgaggggaaccgtgttccggtggaatcccggccatgaaaagcggcggccgaggtgctcctcggcgctgcgaagcgagcggcggcgacagcgcgacttggggggagcggcgccaagcggtggctggagtcggcggcggcggtggaaggaggtagtgcgcgtggcgacggtgcttcggaggcgggaaggggaaatggagcggatgccggggtgcggcacgacgcggcgaagccgctggtggcggtcgcgcgnaacggcggtggtgggaacggctgtggcgaccggctggagggtcgtcggcaaacggcgncgggaagttccaacggtgccggggtggttttcgtgcnacgggagggctcngacgaggggaaaagggaaag

SEQ ID NO: 63 - DNA, 581 bp, Oryza sativa
atgggaggtggcaaggacaagcatgacgagagcgacaaggggctcttctctaacatgatgcacggcgttgccggcggccatgggtatcctcctcaccagggataccctcctcagggctacccgccgccgccgggagcgtacccgcctcctccgggggcttatccccctcctcctggggcttaccctccaccacctggggcataccctccacagcatgggtaccctcagcctggtggctaccctcaacatggtggctaccctcctgcgggctaccccggatcatctgggcaccagggtatggcggccatgggagtagcggtggaggacacatgggagcaatgctggctggaggcgccgctgcggctgctgcagcctatggggcacacaagatctcttctcatggccatggtggacacatgggctatggaggccatggaggctttggtggttacggccatggctacggcggtcaccacggcggcaagttcaagcatggcaagcacggccaccatggcaagttcaagcatggcaagcatgggcacggcatgttcggtggtggcaagttcaagaagtggaagtaa

SEQ ID NO: 64 - DNA, 559 bp, Oryza sativa
atgtctgatcacagcagcagcgacgggcagaggcaatgccgccgccgtggcgtcggcgtcgacgtcgagctcgacgccgccatggcgctcgcggacatggccggcgccgcgcccggacaacccgaggcgtcgccgccgccgcacgccactcaggagatggcgagcacgaggctgagcctcgagctggggaaggtcggaatccagtcgtcgccgccatgctccagcagctcaagcgccggccaccccgcgatgcagcccgccgccgcggccacggcggcgccgggctacggccccaggccacgccacatgctcaccgaggagaaggaggcgaagcgtctccggcgagtgctcgccaaccgggaatccgcccggcaaaccatcctccgccgccaggcgatccgagatgaattggcaagaaaagttgcagatttgtcgtcgcagaacgagaccatgaaaaagggagaaggacgtggtgatgcaggagtatctctcactgaaggagacaaacaagcagctgaaagaacaggcacagttgcacctctcgctttcgctaatctga

SEQ ID NO: 65 - DNA, 552 bp, Oryza sativa
atggcttcttcctccgacctcatcctctacaacctcgtccccgcccaacccctaaaccctagcgccatccccaaccctaaccccgacctctccatcgccgccgccgagcccccctcctccgacggcgccacccctcgccgcgtcaggcccaggaagtccccctcctcctccgaccgccactccaaggtcgccggccgcggccgccgcgtccgcatcccggccatggtggccgcccgcgtcttccagctcacccgcgagctcggccaccgcaccgacggggagaccatcgagtggctactccgccaggccgagccctccatcatcgccgccaccgggacgggcgtcaccccggaggaggcgccccccgccgccgtcgccatcggctcttcctcggtcgccgccgccgccgccgccggcgggcatgggggcgcgttcgtccatgtgccttactacaccgcgctcctcatgcagccgcctaacgcggacgagccccccatggcatccgctgcctccgcctcgggcaccaccgccgccgacgagaacaataattaa

SEQ ID NO: 66 - DNA, 538 bp, Oryza sativa
atggcccccaccgtgatggcctcctcggccacctccgtggctccattccaagggctcaagtccaccgccgggctccccgtcagccgccgctccaccaactcgggcttcggcaacgtcagcaatggcggaaggatcaagtgcatgcagtttattcaggtgtggccaattgagggcatcaagaagttcgagaccctatcgtacctgccaccactcaccgtggaggatcttttgaagcagatcgagtacctgcttcgatccaagtgggtgccttgcctcgagttcagcaaggttggattcgtctaccgtgagaaccacaggtctcccgggtactacgatggcaggtattggaccatgtggaagctgcccatgttcggctgcaccgatgccacccaggtgctcaaggagctcgaggaggccaagaaggcctaccccgatgcctttgtccgtatcatcggcttcgacaacgtcaggcaggtgcagttgattagcttcatcgcctacaagcccccaggttgcgaggagtctggtggcaactaag

SEQ ID NO: 67 - DNA, 528 bp, Oryza sativa
  misc_feature (244)..(244): n = any nucleotide
atggggtactcaccggcgcgcgaggagaagcaagctccggcggcgggattgaccggggaaacggcagacggggtggcgcacaagcttgcgaacccggcggcgtcgtcggcgcggtgcggcgacggctctagcggtggcggatcccccgccgtttgcgggcgcgcgagctagcgggaggtgagcggcgacgtgggcgtgcggcacgggcggagtgggcgcgggagcagcgggatacgcggcggcntgggcggtggtttcgacggcggttggcgcgggcgtgggcggccggaggttagggaaagggctgacaggtgggccccacctgtcagcgcccgagagggagagggaggccgggtgaacttcgggagtgggagggaggagcgggccggcgcgggaggaaatgggccggcggcccaagaaaaggaaaaaggagggaaaagaaaagataaaaggaaaaaggattttcccagggatttaatattgcactttgcttattttaattggttaaaattatttccaatgctctga

SEQ ID NO: 68 - DNA, 515 bp, Oryza sativa
atggaaaacagtgggcagcaccgcagcagcaaaggaagaaagcccccaaacgaaacgggtgaggggcattttcgtcattccatacaggtcacctccaaactcgccaagcgaaccacactgcgtcactgtgataaaagccgctctgcacccactccgtccacttcctctctctctctcctaccgtcgccttccactttcccctctctctctctctccgccgccgccgacgccgacgatggcctccagccgctgggtccgaccggagtctcaggtgtacccgctgttcgcggcgatgggcgtggccgtcggcatctgcggcttccagctcttccgcaacatcaccggcaaccccgaagtcagtcagggttaacaaggtagggagggcagctggagtgctcgagaaccatgaggagggaaggcgctacgcagagcatgggctaagaaactatgtgcgcgacaagacccctgagatcatgccagctatcaacaagttcttcactgagccaacaaaatga

SEQ ID NO: 69 - DNA, 485 bp, Oryza sativa
  misc_feature (8)..(8): n = any nucleotide
  misc_feature (21)..(21): n = any nucleotide
  misc_feature (39)..(39): n = any nucleotide
  misc_feature (115)..(115): n = any nucleotide
  misc_feature (219)..(219): n = any nucleotide
  misc_feature (225)..(225): n = any nucleotide
  misc_feature (273)..(273): n = any nucleotide
gcggcttntattattccttcnggcggcggttgcggcggntgcgacggccgcggattgatagcgtggcaacggctgagggcagcagtggcgacggccgaggtcggatcggcccctncgctgcagcggcgggaggagcggtggccgcccagaggcgccctcccaccgctagatccggcgggaggaagggctccggagctgcgccgcctcgccatcctcccngccgcnacctaatgcgtcggtcgatccagcggtggcggctccctccgccccctntcgccttcctccggcggcggtggcagcgtcggcggcagccgcgggcggatccggcggcggcgggcggatccaacggcggaggctccctcctccgccgcctctcttctccctccggcggcggtggcggcggctgcgacggccgcggattgatagcgtggcgacggctgagggcagcagtggcgacggccgaggtcggatccggcggattgtga

SEQ ID NO: 70 - DNA, 470 bp, Oryza sativa
gcgccctagccccgtgagacctcgcgccgccgtcgtcgccgccgctccagccgtgcgccgctgtcgctccagtcgtcgccgtcgctcggggaggtcgccatcgtggtcgccgtcgcgtcgccgtcctcgtccgccccttcaccgtcgctgtcaaccaccggagcaccgtcgccgtcgtcaagccgaagagtgccgccgccttttcctcgtcgccgacatcgtccggtcatcgtccgccgtcgttttggtcaccgaggtgtcatccgtttgctccgccgcgccgtaattcgccggcgagcatgcgcgcccgagatgccgccggtggtgacgtcgtcgctgacgtcatcgtcgtcgtccatccgattccgacgtttccggagagtccgttttcgcaggagaagaatttgaagagttccaaggccagcaagtgtcacgccctgaagtacccctcccttactctaaattcataa

SEQ ID NO: 71 - DNA, 468 bp, Oryza sativa
atgcagatcttcgtgaagaccctgacggggaagacgatcacgctggaggtggagtcctcggacaccatcgacaacgtgaaggcgaagatccaggacaaggaggggatcccgcccgaccagcagcggctcatcttcgccggcaagcagctggaggacgggcgcaccctcgccgactacaacatccagaaggagtcgaccctccacctggtgctccgcctccgcggcggcgccaagaagcgcaagaagaagacgtacaccaagcccaagaagcagaagcacaagcacaagaaggtgaagctcgccgtgctccagttctacaaggtggacgacgccaccggcaaggtcacccgcctccgcaaggagtgccccaacgccgagtgcggcgccggcaccttcatggccaaccacttcgaccgccactactgcggtaagtgcggcctcacctacgtctacaaccagcaggcttag

SEQ ID NO: 72 - DNA, 456 bp, Oryza sativa
atgtcggaatcgaaggccgccgcggcggtgaccctccgcacccgcaagttcatgacgaaccgcctcctctcccgcaagcagttcgtgctcgaggtgctccacccgggccgcgccaacgtctccaagaggcggatctgaaggagaagctggcgaagctgtacgaggtgaaggactccaactgcatcttcgtgttcaagttccgcacccacttcggaggcggcaagtccaccggattcggcctcatctacgacaacctcgacgccgccaagaagtacgagcccaagtacaggctcatcagggaatggtcttgccactaaggtagagaagtcacgtaagcagatgaaggaacggaagaacagagcaaagaagatccgtggtgtgaagaaggtcagtaccaagtatcaacccagcattttgagcatttatgttaacaatattgcaatagtatttaggtag

SEQ ID NO: 73 - DNA, 454 bp, Oryza sativa
atgcagatcttcgtgaagaccctaacggggaagaccatcacgctcgaggtcgagagcagcgacaccatcgacaatgtcaaggccaagatccaggacaaggaagaggcatccctccggaccagcagcgcctcatcttcgccggcaagcagctggaggatggccgcaccctggccgactacaacatccagaaggagtccacgctccacctcgtcctccgcctccgcggtggcatcatcgagccctccctccaggccctcgcccgcaagtacaatcaggacaagatgatctgccgcaacaggtgctatgctcggctgcaccccagggctgtcaactgccgcaagaagaagtgcggccacagcaaccagcagctgaggcccaagaagaagatcaagaactagagtttgagatatcatttccgcggatcattgaaatcaacaggaagatcagagtttaa

SEQ ID NO: 74 - DNA, 447 bp, Oryza sativa
  misc_feature (172)..(172): n = any nucleotide
  misc_feature (261)..(261): n = any nucleotide
atgtcgtcgccttcgcgccggagctccagcccggagagcaacaccagcggcggcggcggtggcgccgacgagcggaagaggaagaggatgctgtcgaacagggagtcggcgaggcgatccagggcgaggaagcagcagaggctggaggagctgatcgccgaggcggcgcgcntccaggccgagaacgcgcgcgtcgaggcgcagatcggggcctacgcgggggagctgagcaaggtcgacggcgagaacgcggtgctccgngcccgccacggcgagctcgccgggcgcctccaggcgctcggcagcgtcctggagatcctccaggtggccggcgcgcccgtcgacatcccggagatccccgacgacccgctgctccgcccatggcagccgccgttcgcggcccagcccatcgtcgccaccgccatggccgacgccttccagttctga

SEQ ID NO: 75 - DNA, 445 bp, Oryza sativa
cgatggcccgcaccaagcagacggcgaggaagtccaccggcggcaaggcgccgaggaagcagctggcgacgaaggcggcgcgcaagtcggccccggccaccggcggcgtgaagaagccccaccgcttccgccccggcaccgtcgcgctccgggagatccgcaagtaccagaagagcaccgagctgctgatccgcaagctgccgttccagcgcctggtgcgggagatcgcgcaggacttcaagaccgacctccgcttccagagctccgccgtcgccgcgctgcaggaggcggccgaggcctacctcgtcgggctcttcgaggacaccaacctctgcgccatccacgccaagcgcgtcaccatcatgcccaaggacatccagctcgcccgccgcatccgtggcgagagggcctaggcgtgatctgctcgagaggctgtgataccctg

SEQ ID NO: 76 - DNA, 441 bp, Oryza sativa
atgacaacgcgcttcaagaagaaccggaagaagcgcggccacgtgtcggccgggcacgggcgcatcgggaagcaccgcaagcaccccggaggccgcggtaacgccggagggatgcaccaccaccggatcctgttcgacaagtaccacccgggctacttcggcaaggtcggcatgcgctacttccacaagctcagcaacaggttccactgccccgccgtcaacgtcgagcgcctctggtccatggtgcccaccgacaaggccgccgaggccggcgccggcaaggcccccgtcatcgacgtcacccagttcggctacaccaaggtgctcggcaaggggatgcttcccccgcagaggcccatcgtcgtcaaggccaagctcatctccaaggtcgccgagaagaagatcaaggccgccggcggcgccgtcctcctcaccgcctag

SEQ ID NO: 77 - DNA, 429 bp, Oryza sativa
atggggaagacacgtggtatgggagctgggcgcaagctcaagacccaccgcaggaaccagagatgggcagacaaggcctacaagaagagccacttgggtaatgagtggaagaaaccctttgctgggtcatctcatgccaagggcatcgttctggagaagattggtattgaggccaagcagcccaactctgccatccgtaagtgtgctcgtgtgcagcttgtgaagaatgggaagaagattgctgcctttgtgcccaatgacggttgcctgaacttcattgaggaaaatgatgaggtgttgattgctggatttggtcgtaagggccatgctgtgggagatattcctggtgtccgattcaaggtcgtcaaggtctctggtgtgtctctccttgctctcttcaaggagaagaaggagaagcccaggtcttag

SEQ ID NO: 78 - DNA, 422 bp, Oryza sativa
aagacacgtggtatgggagctgggcgcaagctcaagacccacaggagaaaccagaggtgggccgacaaagcatacaagaagagccatcttggcaatgaatggaagaaaccctttgctggttcatctcatgcaaagggcattgtccttgaaaagatggcattgaagctaagcagccaaactctgctatccgtaagtgtgctcgtgttcagttggtgaagaatgggaagaagatagctgcctttgtgccgaacgatggttgcttgaacttcatcgaggaaaatgacgaggtgctcatcgctgggtttggtcgtaagggacatgctgtgggagacattcccggtgtccgtttcaaggtggtgaaggtctccggcgtctctctcctcgccctcttcaaggagaagaaggagaagccaagatcttaa

SEQ ID NO: 79 - DNA, 420 bp, Oryza sativa
  misc_feature (41)..(41): n = any nucleotide
  misc_feature (209)..(209): n = any nucleotide
  misc_feature (228)..(228): n = any nucleotide
atggaggtgggcgccgtgagctgctaccggagagggagttngcggcgatgcgccgctgctctcgccctcgccgtagtcgtcgtcttcgccgcggacactcagcgccttcgccgagaacaccgagcgccttctcgccctgccgccccgctgccgccgagctcatgcccgcccactcgcgccgagctcgcgccgagctcatgcccgcccantcgcgccgagctcgccgangcctccccccaaccgcgcggcagcggtcggcgaccccttcccccgggtgcctgctctaggcccgtcgacctcgccgtcatcgtcagcggccccgccggcctcgccgaggcgggcctctccgtctgccgccccgctgccgccatcaagctcgcgcctgcgccgacctcgtcccatcgcgcgggttcccggtga

SEQ ID NO: 80 - DNA, 411 bp, Oryza sativa
atgaccttcaagcgcaggaacggcggccgcaacaagcatggccgcggccatgtgaagtacatccgctgctccaactgcgccaagtgctgccccaaggacaaggccatcaagaggttccaggtgaggaacatcgtcgagcaggcggccatcagggatgtccaggaggcgtgcgtccatgacggatacgtcctcccgaagctgtacgccaaggtccatcactgcgtctcctgcgccatccacgcccacatcgtccgtgtccgctcccgcgagaaccgcagggaccgcaggccgccggagaggttcaggcgcagggaggataggcctactggacctcgccctggtggtgctggtggacctggtgcccctgctgctgctggacctggtggcccccctaatgttgctcgcacctaa

SEQ ID NO: 81 - DNA, 401 bp, Oryza sativa
  misc_feature (133)..(133): n = any nucleotide
  misc_feature (378)..(378): n = any nucleotide
  misc_feature (381)..(381): n = any nucleotide
  misc_feature (390)..(390): n = any nucleotide
ggtgtgacaccggccggcgccgtgggtcccacgcgtcagccgcacctaagggcgcgggcggctgacggccgggccccacgcggcagccactcggcgcgcccgagggcggccaagccggcacagccggcgggangcggcgcccgcgcccctatggtcgccggcggtggccataggcacggcagagcggcggctgagagagggaaagggaagggggaaaagaagaggcggtccacggctcaccctaggtcgacggcgacgacgaaaaaggcggccggagcggaggaaggcggcggcgcggctcgggtcgacggggtcgacggcgttccggcgggcggcgagcgaaatggaggggtggacgaggtcggcgaggattcggcnaanccgaaggangcggccccaag

SEQ ID NO: 82 - DNA, 399 bp, Oryza sativa
  misc_feature (58)..(59): n = any nucleotide
atggtgagcctccctctccctctctcatctcgccgcgacatctctctctctccgccgnnttctcaccgatgcttctctcggtatggctctcttctgactcgcgattccgttgttgttcttggtggttcgcaggtgaagtactcgagggaggcgaacaaccccaccaagtccaaggccatgggccgggacttgcgtgtgcacttcaagaggtgaaaggtctggatgttgatactctttatgtgtcccacattcaagttaaccaggcccagaagcagaggcgccgtacctaccgtgctcatggacgcatcaacctacatgtcctccccgtgccacattgagcttatcctgtcagagaaggaagaaccagtgaagaaagaggtatgtgcatctgtaccttga

SEQ ID NO: 83 - DNA, 387 bp, Oryza sativa
  misc_feature (35)..(35): n = any nucleotide
gggaacgcggccgccgtggtggcggcgtcggcctncgcgccgccggggccgagcaagaagcgcttccggaccaagttcacggcggagcagaaggagcggatgcgtgaattcgcgcaccgcgtcgggtggcgcatccacaagcccgacgcagccgccgtcgacgcgttctgcgcccaggtcggcgtctcccgccgcgtcctcaaggtgtggatgcacaacaacaaacacctcgccaagacgcccccgtcgccgacatcgcagccgccgccgccgccgctccaccacgatccttctcctcctccccctcctcaccaccaccaccaccaccatcaccaccaccacccaccacaacaccatcagcagcagcagcagcagcatgatgcatga

SEQ ID NO: 84 - DNA, 378 bp, Oryza sativa
  misc_feature (116)..(116): n = any nucleotide
atggcgggaagaggcagtgccatggcggcggttggtgtgctggtgctcctctgcgtgctcctccacggcgagatggccgagtcggcggtgttcaccgtcggcgaccgcggcgggtnggggatgggggcgggatcgtgggcgaacgggaagcggttcaaggccggcgacgtgctggtgttcaagtacgactcgtcggcgcacaacgtggtggcggtgaacgccgccgggtacaagggctgcaccgccgccccgcgcggcgccaaggtgtacaagtccggcaacgaccgcgtcaccctcgcccgcggcaccaactacttcatctgcaacttccccggccactgccaggccggcatgaagatcgccgtcaccgccgcctag

SEQ ID NO: 85 - DNA, 371 bp, Oryza sativa
gcccggatcaaggtcgacgagctacgggggaagaacaaggcggagctgcaggcccagctcaaggacctcaaggcggagctctccctcctccgcgtcgccaaggtcaccggcggcgcccccaacaagctctccaagataaggtggtgcgcacgtcgatcgcgcgggtgctgacggtgatctcgcagaagcagagggcggcgctgcgtgaggcgtacaagaagaagagcctcctccccctcgacctccgccccaagaagacccgcgccatccgccgccgcctcaccaagcaccagcagctttcgctgaagacggagagggaaaagaagcgcgagaagtatttccccatgaggaagtatgccatcaaggcgtag

SEQ ID NO: 86 - DNA, 362 bp, Oryza sativa
  misc_feature (252)..(252): n = any nucleotide
tcgtcagcgccatcgccgccaccgccggcactgaacgtgagcaggcagatcaccgggacgctaaccaacctgacgttgcgcgccatcatgggggagtgcggcttccggtggcgtgaggagttcctgaagacgtttgggcgaggcgcagaagaagcgccgcctccttctcctaccgcctccacccgcgttagctctagcccgctaccgccaccgccgcttcagctcccaccggtcaccaccactccagccccngccccgtcgccgcttcaacccgtgctccccgcggacggtggaaggggagagaaagagaaataaagagagaagggagaaagagggggatgagaagaaagagagaggatgac

SEQ ID NO: 87 - DNA, 339 bp, Oryza sativa
atggcgccgccgcagcccaagtcggggctcttcgtcggcatcaacaagggccacgtcgtcaccaagcgcgagctgccacctcgcccgtccgaccgcaaggggtttgtcaggggcttgattagggaggttgtgggatttgctccatatgagaaacgaatcactgagcttctgaaggttggaaaggacaagcgtgcactgaaggtcgctaagagaaagctcggtacccacaagagagcaaagaagaagagagaggagatggcgggtgtcatcaggaagatgaggtgtgtgtctttactactgcattctgcaatttcattgttgatgttctctgttttttag

SEQ ID NO: 88 - DNA, 335 bp, Oryza sativa
atgtatcttctcctaatctttgtgtgtattgttgctttgctttgcagtcgctgttgtggtgtttgcttcatccaccgccaccatgcagaacgaggagggtcagatggtggacctctacgtccccaggaagtggctcggccacgaacaggatcatcaccgccaaggaccacgcctcggtccagatcaacattgggcatgtggatgagaatgggctgtacgatggccgcttcaccacctttgctctctctgggttcatccgtgctcagcagggagatgctgacagtgctctggataggctgtggcagaagaggaaggctgaggtcaagcagcagtag

SEQ ID NO: 89 - DNA, 321 bp, Oryza sativa
atggctggtgctacggctgccggcgctgccgctgccgcggcggggacgggagccgggtcgccgtgcggcgcgtgcaagttcttgcggcggcggtgcgtgccggagtgcgtgttcgcgccctacttcagctcggagcaaggggcggcgaggttcgcggcgatccacaaggtgttcggcgccagcaacgcctccaagctcctctcccacctccccgtcgccgaccgctgcgaggccgtcgtcaccatcacctacgaggcccaggccaggctccgcgaccccgtctatggctgcgtcgcccaaatcttcgccctccagcagcag

SEQ ID NO: 90 - DNA, 2799 bp, Oryza sativa
atggtggggcccacgtgtcccactgtcatctccctctccccactcggctctccctcttcttcctcatcacgccgcagcatgctgacgacgacgacggcagccgaagcatcggcggaattgccggctgcggcaggccgcggcgaagggcccacgaggagcggagggccgggcggagcggcggaggcagcagggcgcgggcggcggaggtggccggaggaggagggagaggaggaggtcgccgccgagtttcgctgcctagaggacggcaacgaggtcggcctcttcgccgtgttcgacggccactccgacaccgacatcgccaccttcatccggccccacaagtcatctccctctccccacatgtcctcttgtgcggccgccgtcctccgcctccgccggccttcgccccaggccatgctgccaactacgacgacgccgcctcctctcgccctcccatggcgtcaccctccccttgtcgaactcgaactccgcgccgccacggccggctgtcccttctatctccatggagatggaggaggcggcgaggttgaggaggtcgccgcggggccaggcgaaccacggcgcggaggaggcggccacgcggccgacgctcgatccagcgaggctgtggccgtggcggcggtatggccgatgaaggcggaggcgccggtgggggatggtggcgctggtggcgagccggccccggaaggatggcgcgacgacgacggccgatgcggcggcggcgccggcgagcgtgaggaggccgcggggtcggcgtccaagaggcggcgcttcacgtggcgtggcggcgtcccagcgccgatgaagacggtgacggcaacaacttcgagggacggcggcggcggcctcggtggcgctcccgctaggcggaagcagaggcgacccggcttggccaagctctgccgggcgccggccgtgagcgaggcagaagcagctgcagccgattcggctgtgcgcggaggcggcgcccgtgcagcggggaggcatttttgcttggtgctgcaggtggcttctaggagaaggaaggggaggacgaaaatcggattcggtggagagagagcacagacgggtcccacttccttttattttgcttcctcttttcttctctctttctcggtctcatctcttcctgctctctctgtcacgcgtgcgttggccagggtgacgggcggtcggcgtgcgacggccgggcgcggcggcgcgacagcgcgtccgtgcgcacgggggagaggcggctcggctcgatgcggcggccaggcagcgcagagaggaggagccgggcgcagaggggagccggggcacggcgacgggcagaggaggtggccggtggcgatggacgtggaggctggcggcggaggaaggggagaggagctcggcggcggtaggagagaggaggctggagatccgacgcggaagaggaggcctacggtgtggaggaggatgccggcatgctgcgatggagaggaggacgacggcggggatggagaggagactggcggcggtgaagaaaggctgccgcggtgcgggcggcgcgcgacggcttggcgcggcggccgggaggcaacacagaggggaggaacagaggtgacggtggatgggaaagcagaggagggactacaaggcggcggccgcggaggtgaccgcacgtcagcgctcggcccgacgccatggcggcttgggtcgggcggagacggcggtggcagtggaagtggaggaagggcagaggcacggggaggaggagccgggcggcgaggttgggggtgtcgatggcgggccgcacacatggcgctgccactcggcggcgtcctggagcgaggccaagacgacagcggggagggcatggcgcaacgcggcggcgcgggcgacggccgaacacatcgcgcgcgcaagaggacggaggcggaggcaatagaggaggagcgatgcgcgggcgccgcgcaaggaggatgcgacgatgcgcacgacggcggcatcgcgcggaggcaaagacaagagcaaaagaagaacagagaggagggaggaaaacacggaaaggaaggaggaaggaggagatgctcacgtcgcggcagccgggtagcggcacaccgtgcgtggtcgatgggcgtcgatgctcggctcgcggttcatcctcggctcgaacacagccacagaggatgctatgggtcggacgtcgacacgaaactgcctcacgactgtgcgcatgcatgcagcctgctgcgtgatgaggcatgtgttgctgactaccctttgtttactgtatgcggtgcttgtctgcctgagctaattgacacgatgaattgggccaaaattcacaagtctgcagagtggagcaatagaggaggccaccagccgaaattgggctggattgggccagccccaggttcagccgaaccaatcctggcgccgtcggatctaggttttggtgtggacgtccaggattgcatcccaatgacggttggagggcacttcggacaattccccttccacaaccgagtccgaaagtcttcggaagagttcggatgctttggtgcgggtataatgtttgcttatgcaattactctatgtcatgacgatgatattagagaagtatctggtagtttagatgtggtgtctagattacgggatattattatttggggttatatattgcggatgagagggtattcctccgtatttagccccggttgtatggtcatgacgggctgtcgtaaggaactcggcagtcaggggtggcttctcgaagtaccaggagggcatcggaaagagggtattagctag

SEQ ID NO: 91 - DNA, 1611 bp, Oryza sativa
atgtggacccccaaaagaagaaaagctctgagcacagatgggtgcaccaagtccacgtacaccgagtgtcacgggttcacgacccccgctgcagaagaccgggcgctccgtggaacgagtccacgcccgcccagctccttccttctgcgctacggctgtcagagctctactacctccgtgaacctggctcaccgtgaaccagcaacccataccacctcctcggcttctcctctccggcttctcgcttccctttcccacagttcgcttcgccggcctcctccgccgcgcagaatgcgtctcccgctccgccgcgcgctctcccccgcggcagttcggcgcgccttctccacggccgccgcctcgcgccctcagtgggcgatgatccgccaggcgccgccggtcagatctccgtcgccgcacgcgtccctcctgctcgccgagcccccgcgcgactcctacctcctcgtgccggaccacctcatcgaccggcgtccgggccccgaccccagcagcgacatccgggggatcctaggcggcacggtccacgccacgagcggcgacggcggcctcctcctcgtcgtctacatggactcccacgccccggcccccatcatctccaagatcgtcaccggcgcctttcctgctcggcctcgggtcagcgatctcgccggcctcgacttgagcgacccagacttcatccgtttcgtctgcaaccccatcaccggcgagctgttccgcctcccggacatcgacggcaccaagaagaccatgttccgcggctgcgacaacgccggcctcctcacccgctccgcagccggagccgggcacggctcgcctgacagctacgccgtcgccgtgctcggcgaggaccgcaacggcgggaccttcaacatgcggcggttcctctcgcgaaccgggaagtgggagaagctagtgggcttaccatccccgctcccgctcacgcggcggatggacatgtacaccgaggcggtggcgttcgccggacggctatggtgggccgacctgacttggggcgtcgtctccgccgacccgttcagcgactggccggagctccacttcgtcgagctcccgaggaacagtgtgtggccagtgcccagcacagatcttgtacaagagcaggctatgcaccggcgtctgggaatcagcgaggggaggctgcgctacgtcgaggtgtcccaggaggatcctttcgtggtcagctcatttgcccttgacgacgacggcagcggctggacgctggagcacgaggtggcgcttggtcgaatctgccaggtgaagggaggaggcccgagggacaccgcgcggattgccgtcattgacccactgaacgcaagcgtcatgtatctgatcgttggcaaacatgttcttggtgttgatatggacatggggaaggtgatgggttgttcactggcagatgaaactgaaggccctccatatgctatcacctctgtccttaaaccatgtgtgctcccaccatggctttcatcaagcaaaatccctgctgcaggaactttttcacgcgacaatggtgacgccaaaagcaagactttatcagacatattggttcgtgcagacagcgacaagaggtga

SEQ ID NO: 92 - DNA, 1296 bp, Oryza sativa
atgagtaaatccaatcatccccggaattccgaatgtccacgagcccacactccgtcggttgaatatatacgtagctggatacgaggtacaaagcgagtacgcctagtacacgagagatcaaaagagctgccttttgactctgtgcatacgctgcatgcagacgagacaattaatgaattaaacacggcagcacacaagctagctgatcagcgctggtgcgtagtagctaacgatggtggcctccatggcgtccgccgcgttcgtcctcgttgccatcgtcctcccgatctcgccgttcgcccatgctcagcggacaacacagccacccattgtggcgccaacaatgccaccaacaccaccgcccacacaaccaccgtctcccggaccgatggcgccgatgccgtcaccacctcccccaactcaaccaccatccccgggaccgatgccgccgatgccaccaccaccggcgccgatgccgtcacctccaccaatgcaaccaccgtccccaggacctatgccgccgatgccaccacccccggcgccgatgccgtcgccaccgccgccaacacaaccgccgtccccaggacccatgccgccgatgccgtcacctccaccaatgcaaccaccgtccccaggacccatgccgccgatgccaccaccaccagcgccgatgccgtcgccaccgccgccaacacagccaccgtccccaggacccatgccgccgatgccaccacctctggggcgccgatgccgtcacctccacccaatgcaaccaccgtccccaggacccatgccgtcgccaccgccgccaacacaaccgccgtccccaggacccatgccgccgatgccaccacctccggcgccgatgccgtcacctccaccatatgcaaccaccgacccatgccaccgatgccgtcgccaccgccgccaacacaaccgccgtccccaggacccatgccgccgatgccgtcacctccaccaatgcaaccaccgacccatgccgtcgccaccgccgccaacacaaccgccgtccccaggacccatgccgccgatgccaccaccaccagcgccgatgccgtcgccaccgccgccaacacagccaccgtccccaggacccatgccgccgatgccaccacctccggcactgatgccgtcaccgcctccgccaacacaaccgccgtccccaggaccgatgccgccaacgccaccacctccggcgccgatgccgtcaccgcctccgcaaaaccaaccaccaccacccggccgttgcccactcatcaaaatagttatccttaa

SEQ ID NO: 93 - DNA, 1128 bp, Oryza sativa
  misc_feature (723)..(723): n = any nucleotide
atgggccttgttattaacaacaaagttatccaggcttggaataagttcactttgggcccctctatttgtcgcttagtccgattttcgtcccttggtcgcaaaaccgggtacgacaagtcccccaactttcgaaaccgtttaaatgttgtccctcgggcagttattgcatctgacgtcatcctctctatcctctctctccctgttctatcgctctccagccggcggaacgggatgggcggcggccggagcgggcgacggcggggcggagcggcggcggaggcagagcggggcggagccgaagggcgaagcggggcgggcggctgccgaagcggggtgaagcgggggcaagcggatgtcgtcgagccgtcgccatcctcgccgcggcggacaccgacgccgaccgcgcccaacgacgacgagcgcgcggagaaggatgaggcggcggaggctgtggtgttcatcaacggggaggacgatgaggcgacgatctgtccgggttcaggggcctggcctgtgaacgttgtctgctggaagcgcgcaatttgtttggaattcatggcgaaggagcttggcgcttcgacggcgtcggttcttgaccccgtagccgacgacggcgaggagcgcgacggcggtgaggaagacgtagacgtcgtcgggaccgacctcgccgctgccgtcgcgcacgagggctccggctgctacgtcctcaccgtcctccgccgngccctccgtcctcgccggaagcaggaagggtgccgcccgggtcgtcacgcgcgccgcccattctccccgtcggccgctgctcgtcggtcgtcctccccattggtcgccgcccgtcctggtgccccttctccccgccggtcaccgcccatcccggcgccccttctccccgccagtcgccgcccgtcgcgccattctcctcgccgacagtcacccatctcttcgttgcctgtcacgccgtccaccccgccggccgctgctcgtctcggcgccctagctgcatctcctcctcctccggcggccaccgccggacactgccccttctccccgccggccaccgcccgtcggccgtcgcgcccgagagaggagaggagggagagagacgaagagaggggagatggggagtga

SEQ ID NO: 94 - DNA, 1116 bp, Oryza sativa
atgcccttgatcgccatcggcagtaatgcatataataatttgattatcccggtgctcaaaactttttctcgccaacttctagatctcagattttttccaaccccccatatggtatttgtcgctgagaaacttgttacatctgttcccttgcaagaccaagctgttaagtctagtgccacaatatacggctgtcaggcaaagcagttcacaagaaaaccggctaaaacccaccgctacactactaaccatgatggcggagcccaaatgcaggacgtcgtcgccaagctaaacacaaaagccacccaacagctcccacaccgcagaagaggtgttatcgttgccgagctagccgcccaagcgacccagcagcgccgacttcacaaccacagcgacactaaagccatgaaagtcgccaaagcaaaaagcagctccgacatccaacaatggacatcagccaagccaccgaggagccacttcctttacacggccagcaccacaactcctaggaagagactgcaacataaacaaccaaagagcgtgacacccaccacgagaaacaaagcggacccaagaaggcgaaggcctcgccgaacacaatgtatgagagcttttgaaccgaaaaggaccatcaacagtcgtcaatgtgttggaacttctccgaagcgacgccccaaaggaggacacgacgtcgtaactccgccgccgccgctcgtccgaagccggaacaagctccgtcgtcgtcgcaaccaccaggccgccacagcctctatcgccacggctgtgaccccgcgcgcaaggacgccgaaacgcaaacgccgcaaccggcgcaagcaagccgccgttgccggccaaccccgtgtggggaccggatccggtcctaccgacgccggatctggccgccggcgaccgctgcacccgcgagacctctctccggtcatggcatcgccccagccgccgcgcctgcgagaggagtctgttttttttcgggtcatgcttatcctgtccactcgttcttttcgagaaggaagcagtagcccaatgaaaaccatgctgctactagtctttgatcaaatgtctgaaatacttcaaaaagtggatgaatgggagaaattttga

SEQ ID NO: 95 - DNA, 1113 bp, Oryza sativa
atgctaaatcacccggatcaatccctaccgtccatccgtatctgcatcgccatgatctacgatccctaccgtccagtgtccaccacgatttcaccctctccaccgcgcaaacaccgcgagaagactacgcctccgcgctactcactcctcgcgtgtacggctccgctgcctcactccaccgctgcccctgccagagccgagttcttctccagccgtcgtcgccgcactccaccgctgccccgccggagccgaggtcttccccagccgccgccggaacccgagaccacccttgacggcacagaggtcgttccaagccgccaccgcactccaccgcagcctgcccccaccggcacaatggtggttccatcttctgccggaccagtgcccgggattgcccccgacggtgccgaggtcattcccagccgctgccgcactctaccacagcctgcccccaccagccacgagttcagcatgcatagacacaatgcaggtccctattcagctcaaattgacattctggacattggaccacctcacctcgcgccgcgacatcaccaccgttactgctacatacaaactgctgcattcccctttctgttggattgtagctgcacgctcgacaaaccggcaatccccatccggttgcctctacgaagactgcacaaaaacggaggtctgctgttgagccatagattttggattaagcataaccggactcagcaagagatgtccacagagttcgtcattaaatctgaggagcgtgagctcaacccgaacaacaaaccctgcatggagcaagctgctctcgaaccgccacctcgtcgacgggctatcatcatgcaccacgagcagcaagctccgggcgacagcagatccagacgatgcaagccacgagaagtcaccgcacgcaacgctaggaacggggtggcaacctcccggccgcaaacgacgatgcagccgccgccgccgccgcaaggagccagctccttccgtcgattcatccacaggtctttggatctcgcacctccaccgccaccaactgccgtcgccgccgaccacaacggcacccatggagactcgtcggcaaaaacaccaactaaggacaaaccctaa

SEQ ID NO: 96 - DNA, 1080 bp, Oryza sativa
atgcagcgcctctccgtgggatcggcaggcggcaagccccgcctcctcgagggcggcgcggcggcgggggaggaggaggaggaggaggagaaggccgggaaggcggggcgggcggcgccggacaggtccatccacatcatccccgtgctcacgctcctctgcttcctcgtcctcttccttctctcccacgacccggcttcctcctccctcgccatcgccaccgattcgccggtgctggccgccgctcgcaccctcgaggccacagtgctggtctgttactgcagcggaaacgacggcgtccatcgcccgcagcggcggcgtccaccgccggttaaagcaggagccgaggctggcccgcggccgaaggatggggatggcgctgcggcggcggcgctgacggctaaggctaaggctggatgtgacgtcagcgcagcgcagctagccgttggattcgttgttggaatcgaagacccttctcactttttcttttttggcgaggaagctgatttcgaccgttctgctgctacctgggtggctcatggtcatggctggagcgcgtcgatggagtcggcgacgtcgtcggaggccgagatcgcgcccgcgctggccgccgacacggtcgacctcgccggagagctcatcggaatcacgcgatgcttttccccttttctgggtgaaatcgaattggacggagatcgaacagaagcagaaatccccaacccaatcggaggaggaagagaagggcggcggcggcgagcggagatggtgaggaaggcgaaggtcgagttcgacgagagcccgccggatgacttcgacccgaagaacccgtacggggacccggtggcgatgctggagtacagggagcacctggtgagggagaagtggatccagatcgagaccgccaagatcatccgcgaccgcctccgctggtgctaccgcatcgagggcgtcaaccaccaccagaagtgccgccacctcgtcgaccagtacctcgaggccacccgcggcgtcggatggggcaaggacgcccgcccgccggagctgcacgatcccaagaaggtggttgaggccgacgagtag

SEQ ID NO: 97 - DNA, 912 bp, Oryza sativa
atgggtataatctacttcagaaacggagctggagcgcccccaaccactcaaaggcgtgagctgcatgcgccaccaaaaagagtccttcctgttggctgctctatcgccggtgatgaggtcgcaaggcgcgccggagggtctcgtgcaactcgtagcaacggaaaccatttgcctttcctggcgtatgtgtacaccggggacggagttgctgcgggcaggcatgcacgcgatcgagcggtagctttgacagacagcgagaggcaacgcgtggcacagcagaggaaagagaggagcggggcgccggtgctccgattgctgggaggtggcgacaccggtggccaagtaccagccggtacagagagcaagggagaggacgtgactcccgctcgggcgcccgatgggaggaggttaaaatcggacgctgacgtcagcatgacggagaagtgggtgggcccaacaggtgcacatgtggggggagggggagcgaccgattttcctacctcccccggtcgaccgatgctggcattctcccaagggagatggccagaacggcagatggaagggcttggctccggcggtaaagaaggtgatggtggtggtaggatggggggaacgagtgagggagatcgaccgatgggcgatggcagctggtggcgccttctcttctttattttccatctctctccaaatctttccctcgtcgatggtgttcgcccgctgctgcgcttgctccccatgccgccaccgccggcggatgctgccgcggggttccattgctgttgccgctccagctccgcacgtgcggcgcagctgctgcggcggccttatgcagctgcactgctgtgctgctgctccgctactgcggcagctgctgcgccgcaagctgctgcgcgactatgcccaagaaaatga

SEQ ID NO: 98 - DNA, 813 bp, Oryza sativa
  misc_feature (423)..(423): n = any nucleotide
atgattcccaaaaaaaggaaaacaagtctgactatctctttagacgcccggtcgctctgcctcgggggcgatgcgggcggcgaaacaagccgcgtcgcccccgtccctctcctcccctcccacgcctcgccgccgccggcaaagctgggcggctgcaaggacggcggcggcagggctctctctctccaccgctcgcagtggagttggacggggcgccggcaaggcgccgacgacgaggaagaaccgacgacggcgaccagatccggcgccgggatgcacggatccggtacccccatggccggatctgctgctccgggcggcggcgagccgggtcggcaagtcgcagcatcggcggcgtggaggtggtgccttcggcggccggagggccgcgtcgacggccggagggcggcctcggtggcgtgnaatctggccggacggctggcggcggcgctcgcggccgtggtgcagctgcgcgaagtgatgcacgtgcagcagctgctagccgagggcgtggcagatgactgcatctggccggcgcagcagcgtttggaggaagggtcggagaccggcttggcgcagagaggcgcagccaatggcagcggaggccggctcggcgcgagaagcgcggccggcggtggaggaggcgaccttggtgagtggaggagctgccagtgggtgtggcgcggtcttcggcgcacgaaggctagccggcggagggcgccggtgcaggggtcccacatgtcgacagaggttgattggcagtggagcatcggtgtgtcagccgtggtttcgcaggtggtgagcggcaggtga

SEQ ID NO: 99 - DNA, 792 bp, Oryza sativa
atgcccaccggcgtgcacccctcctccttcctcactggtgcacacccccctcctccgtcttcaccgacggatccagcggcaacgaatcaagcgggtggcagatctggtgacggcgagtcaagcgtgtggtggatccggcggcggcgactttcgcgggtgacagtctggtggagtcaaggaggggaggttggtggcagcaaggcagcatatggagcgtcggggaggaggccaggggcggcggctgccccactctctcccctcacctccctctttttgatttggctggagaggaggaggccggtggcggcgcggcaacaagggggagagcggtgcgcggtggcccctcccctccatgatatgtggcgggcgggcgccagagcggcggcagcggcggaggaagctgaagcggtggcggcggcctcgccaagtggagagaggagaggaagaggagagcagggccggaagggagaggggagaggcggagccgccgagctcgtgttgtcgccgccaccgccgccgccggtgcctcctcccgcactcgcgctcacgacagcgctgccgcgtgctgacccggagtggcggcgacgcgtcccgtgggtggtggctatggccgcagccgacaaggtcggagacgagagcggcggcggcggcggcgggcgtacgaggggcggcggacggctggtctcgatctggtactctgcatggtcggggaggttcgacggcgaagactacgaggaggaggagatagagggggcgggcagcagccggacgatccagcttaactgctactag

SEQ ID NO: 100 - DNA, 780 bp, Oryza sativa
  misc_feature (60)..(60): n = any nucleotide
  misc_feature (71)..(71): n = any nucleotide
atggtcgccggcagtgggcggcagcggcgctggatgtggcggcacacacgggtggcaacngggaaaggganagggggctcaccaagaggacggggacggcgaggcgaagtcgggaaggcggccgacgacgaggattggcggtggcgcttctcgggttggggtcggggacggcgctccggcgactcccgaccgcggcggaggtgcggccgaggtcagcaggacctgggaagcaaagaggaggggttagaggagggagaggcatcgcggcacggcgaggaacaccagccgagcaccaacatttgtggcgagactcaccggggagacgattacggtggctcccggcggcgaggaggtggtggccgagggtgctctcgtccttgcgtggccgagggaggcgacggctaccgcgaggaggtcgggaacggcgggaatcagcgatcggaggcagcaaatgaggtggcgacctcggatcgatggcgaaagtggtgctccggcggtggactgggcaaacaaagtggcggccggccttgctcttgcgacggcgaagtcaatggcgcaagcggcaagtcacggtggaggttgaagcggcggtggcgggctactgaggcagcgaacggcggtggtggctcgggtacgcggtgcagaggtggttccgacagggatacagggaggcagagcagatgccgaggtgtggctcggcgtggcggagccgatggtggcagtggcacggcgcggcgatggccaaggcggcgggaggcggcggctggagcacgccggtga

SEQ ID NO: 101 - DNA, 753 bp, Oryza sativa
atgaccgacgtgacaaccccacctgctgttgatggaagatatggtgcaggaaggacgatcggggagtattcacagttcctcttctttttctgcccgctcgtctctccatctcatcacctccgcccgctcctctctctgtctccgaccgtggcgaagaaggcgattgtggtcacgtcgagcgcaaggggtaccgccggcggttcccgccgccgccgctccctccttgccctccccgaccaccgccgcctccctcctcgcatctccggcgacgccgccctcgtcggtgcacggatctggcatgccggcagctggatccagtgggccggcaccatctctatgtcaccaccacctgtctctcttgccacatcctctctctctccggtgcctctctctctccttgccacccgtcatcgctgcctctctctcccgtcgtcgccgatggagaggggcacgcggggcacggtggccggggttggggccgccgtcagcgactcaacctcctcgccgcctcaggctcctcactactgccgtcggcctcctcccagtgacgaggtcgagggtagaaggggaaatcgtaggtgcggtagccgtgtccacgggcgccccaagctcccaacgcgtcgcctggttgcgactccccacgaaaagctagcgaggcgcggagagagccacgtcccccagcagagggacgcattccatcatgaggggacgtcatggacgaaaaagcaaatggccatcgatggagggcactag

SEQ ID NO: 102 - DNA, 741 bp, Oryza sativa
atgtcagcggctgcgggcgcgagtccatggtggatcgggttcacggactggggagaaggggcgcaccacatggcgccgacgtggcacacacgcggaacacacgcggtggtcacgtggcccggaggaggcggaggcgtgggcgcggcggcggttgcgggcgcggcggcgcggcttaaggtgggagacgggtccgacagcagctcgacgaggaggagcgacggcggcggttcggcgaggaggagaggcggcggtggttcggcaaggagaagggcgcgcagcggtgacgccgccaccgttggccacctcaccaccttcgtctcccgtctccacggccggcgagcgaaggggcggtggcgccgggaggaggaggcgccggttggggaagggcgcgagcagcgctggcgtcgattggggaagggtgggggcagcgttggtcgggaaagggcaagagcggtgccgacgtcgggttgggcggtggagtcggcctcaatggcgtcggagtccttgggcgacggcggggaggcagtgcgtgcagcggcggaggggaggcggcgggaacaccggcacctcgcccttcatcacctcctcctcctcctcttcctccacctcctcgtcggtggatctgggccggcgtgggacgagaggaggagcggcggcggcgtctcggcgaggaggagcggcggtgacgacgaagtgaggaggagcggtggcaatggcgaagtgaggaggatcaagagataa

SEQ ID NO: 103 - DNA, 729 bp, Oryza sativa
  misc_feature (252)..(252): n = any nucleotide
atgcacacgccgccgcagcttcaccggaagcttcgcctcgaccaccaccaccaccaccaccggcctcagctcccccgccgccgccgccttcacatgccgcgcgatggcgacatgcgcgcgcgttgctgggccgagctgtaccacgacgcgtcggctgctcacggcggcgtggtggcgaacggtgcggcggcggcggcgacgagcccggcgtcgccggcgggatcgacaggcgggagcccgacgcgggcgccnggggttgaggggccgcgcttggggaagccggcgaggaggcggtccagggcgtcgcggcgcgcgcccgtgacgctgctcaacacggacaccaccaacttccgcgccatggtgcagcagttcaccggcatcccggcgccgcccgcgggcgcgttcgcggggcccggcggcgttccggtcatcaacttcggctccgactacggcttcaccggcgccgtccttcccttctccgaccacctccaaccgcgccggccgacgttccaggaccaccaacagctcctccgaccgcagcagcagtacaccggcgcaccgttcggttacggcaacctgcagcaagccggcggcgccggcaccggcgccggcgacatgttcagccacgcgctgagctcggccgaggacaggttgctcctgcagagcctccagtcagctcagatgcctacttccgccgctaaccacagcgctaatggttacttcgcctaa

SEQ ID NO: 104 - DNA, 711 bp, Oryza sativa
atggcctccgtctcgctctattccatttccattccgttctacagcgacgttcgcggagcggagttaagagagggagagacgcagcaaccaacagcacgcgcggggctgagggggatgaaggccgagaaggcagcggtcgccgtcggcggcggcggcggcggcgacgagtggcggtgccggaagcacccggtggcgagatccggcggcggggtgtgcccgcactgcctccgcgacaggctcctccgcctctgccccaactgcgcgcacgtgcgaccctgcccctgcacgtgcgcgtccccgtcctcctcctcgtcggcgtccggcgaagcggtcggccgggtccacaccctcatcgagcgggagcaccggattgcgcggtcacggtccctcgccgcgtgctgctccctcgcggcggcctccaccgcagcagccactgccggcgcggtcggggggaggcggaaggcgagggtctgggggtggccgccgttctggaagcccgcggccaaggacggcgttgctgctgcggcggaggaggacgaggaggaggagggggggatggggctcgcgaggtcgagctcggtctccgcgacggtagtggaggcaaaagcggcggccgcggcggcgaaggcgcggtgggggtggcacttcccgagcccgctcaaggcgttccggcaccggagatcgtcggcgagcatgccggagcgaggatga

SEQ ID NO: 105 - DNA, 630 bp, Oryza sativa
  misc_feature (555)..(555): n = any nucleotide
  misc_feature (578)..(578): n = any nucleotide
  misc_feature (600)..(600): n = any nucleotide
atgcccgggcagcggggcggcgaggcgttgtcggcgttggtggcggtgaggaagagtcaccagtgggcatcgacgtcggcggcgtggatggcgagaggcggcggggacggcgacggtgaagcacagagaggggcgagacgccgggggcagggacggcgagcgacggcggggggaggacggcgcgagacggcggcggccgacagcgccaggggcagcggcgccgcgccggtcggccacccggaagctcaggcagccgtgtgctgccgccagcggggaggacggactggaacacagtgctaccgccgtccgccggcgaggtcgagggcgaggactccgcaccgcctcgatcgattccaatccaacctcgccggcgatggttccgagaaacagcagttgctgggcgatgggaccaacagcagacaccgaggcggtgcggagtcctcgccctcgacctcgccggcggacggcggtagcactgcgttccagtccgacctccccgccggcggcagcgcacggctgcctgagcttccgggtggctggccggcgcggcgccgntgccgctatcaacgaatgggccngagagcaagcagagacatcgcncttgtggggtctgaggcggggacggactga

SEQ ID NO: 106 - DNA, 618 bp, Oryza sativa
gccggtcggcgaggcgaggcaggagaggaggagggcggcgctgcaccgcgccgacggacacagtggggaagcatggcggcgcgggtgggcgacggggaggcgcgggcatgcgctagcgtcgcaggcgcccagttggtggtggcggcaaccgtcgttgacacatggagattaggatgccacgaccttaaaaaatcgtggtgtaaagttgagggatggccggacaacagccaaaacgaactgttccaggaaaaccaaaggcaaaaacgagagaaaaatagccaccacgaacccttcctcccccactgtctcccactttttcacgttttccggcgagcgcggcggctagccatggatggcgtcggcggcggcggcggcggcatcctgtcgtacgagaagctggaggggtacgcgatctgggtcggggccagcgtggcgtcggccttcttcgcgtccatggagagctgctcctgcatccacgtccacaccgccgacgacgagggcgacgactacgaccccgaggaggccaaggaccgccccctcatgctctcccgcccccaggccctccccgagtactactacgaccgatccgcctcctccgcctccttcgccaagatgtga

SEQ ID NO: 107 - DNA, 618 bp, Oryza sativa
atgaccggcagcgtggccgtggaggcatccatccatccgttccgggggcgatcgggcaaaaggtgcgtcaatgggagggagtggtgtgtgggaaggggagggggttccagggaggggatctgctatggaggtggagcgacgacgagggatcgacagtgggcggcagaagatgggcacctggggatgtggcggcgtcgcgggacggaggtcgtggcgcttggcgaggcggcgctagtgtggcgtgcgttggtcgtgatggaggtgcaagagggcgaggggattggggatggaggcgaggagggactggccgacgtccgatcccgatcgatggtgaggagacgcgacgatgacggcggcagcgacggcaatgcaagagggaaagggaggagaggagatagggcgacgagagggatgatgggttgcgggggcgcggtgctgcgtgatgcggagcaacgggggctaacggaggagcagcgtcggcgggttcgcgagcgcgagctgccttgtggggagaaaagcgagtcgagggggaggaccgtgaggggatccctcagggaggggatgcatcgcaggcggaggggaggagcgcgtgcgatgggatccctcagcaccgtctga

SEQ ID NO: 108 - DNA, 591 bp, Oryza sativa
atgacgctgcctcgaggtgacgctacatcagcctcccctccagccagcgccaccgccgctgctcatcttcgtgttggggagaggggagaggcgacggcaaagcaaaagcagcgctcatcgatgtcgtcgaggttagggccgaggtcgttgagagaggcaatgcgaacatcccaaggtggagaggtcggctcctccctgttgagcgacggaaacagaggggtggtccggtggagcgaagaggagctggtcggcggtggcccaaaccgacggacggggacagggtcagcttggagcagagatccaagaggcgctcctcctgttgtgtcgagatcgataggggtggatcgcggtggaggtcgcggaagccggcgggggcggcacacgtcctttcttctctcaccgcaagcatcttcccccttccattctatccccgtgtcccgttgcccatgtcggcgaggtgctaggagctcgagcttcgactcgctgacaatggcatgcaacagcactatcgtagctccggcggtgggcctcgagggagggcggtggtggcatgctctcctcttcaccagctcggtgacaacggggacatga

SEQ ID NO: 109 - DNA, 573 bp, Oryza sativa
atgcctcctcgaccgcgacgactcctcgcgccgccgcgcccgctccttctccttgtcgcgctcccgcgccttgcgctcctcgcgatcgcgctccttctccctgtggtggcgatcgcggtcgcggtcacgctcgccgtccttgtcgtcgcggtggtggtggtggtggtggtggcgagaggaggaggggcgctcgcggtcggggtccttgtccttgtcgcggcggtggtgcttggagccactaagtggtgggacctgaggagtatgtgtcgcgtgtgtgagggggataccgcgtccaaaactatcgaagaaaaaagaaaagattcccctcctctgcttctcgtgttctcttcttcctcccgtctctactcctattctatcggatctccggcgagcagcgccgccggcgatcggggtcgtaacatggccttgtcgccggagcccatgttcacggcggcggccggcggcgagcgcgaggaagccctagacgcggcggatgtgttggggtttggattgaatctaattgggagtacccggtactggatcttatcgtgcactaagggaggagtatcctga

SEQ ID NO: 110 - DNA, 546 bp, Oryza sativa
aggcggccggaggcggagaagtggtggcgacgccactgggacaccggcgaggacgcgtctccggtgatttccccgcgaaacggaggcgaagccgggaaagaggaggcagctgcgaggccgagggagaagacggcgcggccgggcggcgctcgggcgaggagaggaaggcggctggaggtggccggcgcgaaggaaagaggagggcgacggcgggaacgtagttccgggggtctcctcgcgaaacggagggcaggccggcgtggaggaggtggcggcgacgctgtaggaggcgatggcgcggccggacgacatctccggcgaggcgggagaggcggctggaggccggccggcaacgggggaagggtgctagggttcacgggagagggagagaggacggccgggcgggaggaaggggacgacgcccgcctggacgcgcgggccccacgcggtcgggcggcggcgtcagcgcgcgcacgcgcgcggcacctgacttcgactgggttgcggcacttgaagatggggcttcagttccagaactttgcatag

SEQ ID NO: 111 - DNA, 488 bp, Oryza sativa
atggcttggattgacacacggcagcggcacaacagcggttgcggtggcacacatacagtagcagcacgacggcgacgtacagcggctaaacagcgacgcggcggcaacaaggcgccggcggcagcagctagcgacacagcaacggctgcgctagcgttagagcaacagcggcgaaacgatgacgacgcggagaagacgacggcgacgcccaagacgacgacggtgagggggaggcacggcaaagggggagagggagggactcggaggggagagggcaggggaggcgcacagctgggagaggggagaggaaaaaggtacgggaggaggggttgcctagaaaggaaaggtgggggaaacagatgcggtgcccgttttgggaaaggaagaggaaacggaacccagaaagagaatacgactcggctcatcatacaaaacgaaagcgcggtggcaaaagggtttgcggatacgacaaatggtggagagggagg

SEQ ID NO: 112 - DNA, 471 bp, Oryza sativa
  misc_feature (238)..(238): n = any nucleotide
atgtcaagggcgcgtgacgctgggcggtggtggctgaaggcggcggggatggcgatggcggcggggatggagttggccgatggcacggaggcggcggcctggtgctctcgtggcggcgacggcacgttaacttggtggcgacggcggcggtaccccccagatccgcgcctctcggccggagctgcagggtggcggcagttggcgacggcggcggcagtttggccagcggcagtttgtnggcgacgacgacgacgacggccggcggcagttggcgacgacgatgacgacggccggcgggcgacggtgcagcaaaggttttgcggaggcggtggtgacgtcggcggcggggaaaggagtcgggtgcgaggtggggatgatgacggcgaggtggttgggtgttcggcagcagcggctgtggtggtggtgaccgtgttcgcagtcaccggaggcatggcggcctcggttgactag

SEQ ID NO: 113 - DNA, 441 bp, Oryza sativa
atgcatggagaattttggtgtctagagagagaggggtacctagagaggagacgacgagcagaggaggcggcgcacgacgacgacgagtcccggtcagcgcacggcacacggcttctcggcacggcggcgcggcggcggcttcttggcacggcggcgctgaggaggaggtggagaggagatcccggtggcggcgacgacgtcctggcgtggcgactgagaggaggtcccggtggccatcgagagagggcggcggcggtggagagggcggagatggcggcagagagggcggcggagatggacggcggcggtcgagagagtgatggagagggcggcggcgaggagggcggtggagagttcgaggcggcggtggggagggcggcggagatggcggcggtgaagaggtcgaggcggtggtggagaggcgaggtggcggtcgagaga

SEQ ID NO: 114 - DNA, 441 bp, Oryza sativa
atggcatggggcaagacagatcgagaaggctgcaagtggcggcgtcccacgctgattcccgtctaccgcttgcctgccgcgtgccgattcctgtcgtcggccaccccgtcgttgtgcggaaagaaaaacaaccaactgcagtgctgccggctcaagaaggagagtgagaagagccgggcgcggtcgctggagcggcaaagctttgccgctccgtctgccatgcctattgactacctctctctttctccggcgttggccgcctcacctacatcgtcgccttcgacagcctccccctccggcgctggccactccgccatcatcttagcgctgccagtggtgaaccatggtccgtggatagagattatggagtggagaggttgtggagagaaggggaggaagaaggaaagatttggatggaagaaaaaaacatataaagattga

SEQ ID NO: 115 - DNA, 423 bp, Oryza sativa
atgcaaagttctggaactgaagccccatcttcaagtgccgcaacccagtcgaagtcagctaaaggttcaaccagggacaagtcagaagacggagcggaagaagtcagacaagaagagaagaccgcccaacctatcttcttgctagcctcctcgaatctcggggacgagattcttgccgcctcccctcctctcctcttgggccggccaatcggcccaagccgcgccaagcccgagccgcctccctgccgcgcatgtgcgccgcgcgtgtgctgggcgcgcgcctggccgcgcggggcccacgcgtcaggccgccgtcgccttcttcctcctcccagccggcctcctctctctctccccgaaaacctagcttcgttcctccctcaaatccgcgcgaatcaagcatgggattcccaaattaaatag

SEQ ID NO: 116 - DNA, 387 bp, Oryza sativa
atggaggactcacctgggggtcggcaccgggctcggtggaggcggtggcctcgggctcggcgagggaggacgacggcggcgaaggaggagttggcggcggcctcgatggcggcggcgctgggctccgtagagggtgtcaccggggtcggtggcggctgcgccgagctcggtgaaggtggcggcaggctcggtgaaggcggtgtcgggcgtcggagaggaggatgcgacgacaacgaggaaggacgtcgccgggctcggtgggggtcggcggcggcggtccgaatggaggacgaaggaggagaggcgggcagcgacaacgaggaaggccgacgccggttggtgtggaggctcggtggcggcgacggcgggcttggcgagggaggatga

SEQ ID NO: 117 - DNA, 384 bp, Oryza sativa
  misc_feature (272)..(272): n = any nucleotide
  misc_feature (315)..(315): n = any nucleotide
atgggtggtggcgacgggtggagacagtgcggcccagcggcggcgatcgcatgcggcgggaggagcggcggccgcccggaggtgaggtccggccggccgcctccctgccgtccgggacgcagccgcctccacgctgccggatctggcggtggcgaggtccggccggccgcctccacgctgtccgggccaccgcccctcctacccctgccggttagcagccgcctccactccaccggatctggcggaggcgaggtccggccggtcgcccccangccatacgggccgccgccttgctgccgcgcgcccgcgcccctngccctcggccacgccacgctagcgccggagagtggagaagcggagtcggagggagacgcagaccggtag

SEQ ID NO: 118 - DNA, 381 bp, Oryza sativa
atggccgggacggcgcgagacgagctgacggcggtggcacgagacggcgacggcgtgaggggacggcggccggcagcgccagatctggcgcgtgggttcatcgccagagacggcgaggaagcggcggccagggcgtcggcgaggaaaccacgaccacggccatcctcacgccgcgccccgacgagccgcaccgttgtccacgtcgccgcagtgaaggatgagatggcgcaacaaaagctccggcatagggccattgtgcatgccattctgcattattggatgaggcctttcatcaccaccctgaaacccatcgtttccaactttttggacagcttgatcaggtgcagggttgctgtcaatgacaatatgaagtggccttga

SEQ ID NO: 119 - DNA, 323 bp, Oryza sativa
atggcggtcgaagaggttcaaaacctttccggatgctatgccaagaaagcaaaagcttcgcaaaatgtcagtcaatctccaagaggccgcaaagctgaagtgcgcaagctgctcaagatcggtgtgatcaaagaaattgaccaccctgaacggctggcgaatcctgtgctggttgcggcgaacccgaagaaggcgacgccgaagcgggagaaggtccggggcgacgacggcggcggaccggagctcggcggcgacggcggagagagaggggcgacagcgcgagctcgattccgacgggagagagagcggcgagtggcggaaac

SEQ ID NO: 120 - DNA, 304 bp, Oryza sativa
gtccttacaaaagatagctttgtctgcaaagagtatgagcccgaggcttcatcaagctgcctccgtctcggcgctgcctccgctgcggccccgacgagcgccaccgtccacagtgcgcctggtgagcggcggtgtggatttcgccgctgcagcggccgtagccgcaacctcgccaccaacgcttgctgcgctggctgccgagccggcgaacacgctctcgctgcccacttgggtagtccatgtctccagcgtcaccgagtggtactacctacctacctcttgctttcgcggctgcgaaagataa

SEQ ID NO: 121 - DNA, 1260 bp, Oryza sativa
atgcccgcggtctcctcctccggtgatgccgacgccggtgactggttgaaggggtcggccacgagcggcgtgacagggttgagagcggcggccgacgaggcagcgatggcagccgcgacgcgtgatcaggccgccgcgtcggggtcgccgccaacgacccccgccccatctccgcgccgccctcgccgttctcgagttgcgccacccagcgcccgcccacgacgccgcgccgtcctcgccatccttgagctccgccataccgcgccgccgccggggagggcaggagggaggcatgaggggaagagggcccagaggaagccggcggcggcgaggggtggaacttggcgccggcggcagctgccggggaggagctgggcagcgaccgtggggggcggagcagtgcgcggccgtcgggggcggagaagtgcgcggccggcgggatggagcttggcgcgggcggcagccgccgggggaggagctgggcggcggcgtcgccgtgcgggcgagctcgagggcgttgatggcgatgtcgtggctgtggttgagcttgacgcagccgccggcgtagctctggcagaagctgtagaggccgtcgaagacggggtagtcctcgccgacgttgaagtgcttgagcgcccggatctggtcctgctgggtcgtcggcgtggaagcggcagaggtcgtggtcgcgcgctagaagtagcacacccgccgcttcaccccgtcggcgccgggagttcccccgccgccggcggaggcgtccatggtggcgatggcggtggtcgcggcgccagaggatgggtccgcgccagccgtggcgaactgggcggagacggcgcggccggcgacgacgacgacgccgtcacggcccacctcacagagcatgcggcgggcggcggagcgagccgcgcggggagtccgggtcgaggcgggcggcacggctcagaggtggccggcgtcgaggtcggcctcggccagggagagaagacgcgagagttcgtcgtcgtcgtccgcaacggcggcacgcgagggaccgccaggcatctgcagcgcgtgctgggtggttgcgggtgtgtggggccgccgacgtcctcctctcccacctcgcccctccattgcctcgccgccgacaaggtctccctcaccgcccttgactcgctcccctccccttcccccgctgttctcatccccatccccgtcgccgccaccgcccacctcgccgtcgccccctggcggccgcgcgcgccctgcagcgagtga

SEQ ID NO: 122 - DNA, 1149 bp, Oryza sativa
  misc_feature (640)..(640): n = any nucleotide
  misc_feature (642)..(642): n = any nucleotide
  misc_feature (688)..(688): n = any nucleotide
  misc_feature (697)..(697): n = any nucleotide
atgggccgacggtccgaaggagtcggcccacagccgagtggcgcggcctggtccggcctcccgagtgactcggggccgtccggcctcccgagtgactcggggccgactgggccggaccgagccgagtgggccaaggaggggtgggaggccgagtggcccgaggccaactgggccgagcgggaaagaggccgagtggccgagtggagaggagggggccgatgggccgcggcaggccgcgacctacgcgggcggctggtccggtggaccgtgtccaccgcgcgggcgctagggcggggcccgcccggtagcggcacagtctacgcggaccgagcgcacggaggggaaaagagggattttgccggctggcgcttgcgtggcgcctgcgtggcggccacgtgggccggccgggcgaatgaggggagaaggcgccgggcgacggcggcgacggcagaggggctcgggcgacacggtgcgaggccggagaggggaggggagcgcaccgggatggagaggagagatagagggaggggcggaggagagggagtcggccacggcggcgcccgggagagagttctacatgctgccggcaagcttaaaccgaggagaaagagggagacgggttggaggaggcgggcgggcnanacggcgcccggagctccttcgggcgccctcggctgcgacggcggcnacgggggtngcggcggcagcgggaagggggcgctaggtcagttcggccggggggagagagaggtggtgcggcagagaggcggtggagcgcggcgaggggaccgcgctggcgctccggcgctagcggccaagcgcggcagcggtgacgccggccaggaggcgcgcgctcggctcctaggcggcacgcgggcgcgcgagcgtcagggccgggaacggcggcaggacggaacggcgccgacgggaaccgttggggagaagagagagagagaaggacgggcaagggggactgggccgaggcggcccgagaagggagagagagagaaaaaggaggccgaagggggaaaaggtggccgcgcgggcggctgggccgagggggggaacgacttgggccgaaaggggaccggcccgagggggagagggaaaaggccgggaagaagtcgccccgagagcagagggaggtaa

SEQ ID NO: 123 - DNA, 1078 bp, Oryza sativa
  misc_feature (938)..(938): n = any nucleotide
ggtggttttcgctgacgtggcgtacatatggcagcctagtcatcctctccctctaacatctctctcctcctttcttcttctcggtgctagcgacggcggcgttcggcggcaagggcgcggcggcgagggcccgatgacgagggcgttgcttgcagctgctgggcccgacgacgacagcgttggctcccggacccgcctcctcagtcgtcgtcctcctcgtcgaccaccccgccatcgccgccaacatctcggccccaccgcgcgccgtccgctcggccccgtcgtgcgccgtctgctcgcgtctgcgccggaggatttcgcccccgccgccgatggtgctgggctggtagcacgctccggactgcatgatctgggtgcagtcggcgctgcgccaacacgcgtagtcaattgccttctgcatcgccgccggactctgaggatgcaggtctgggttggggcctcacctgagccagtggacatggccaacaagagcagcagcgcagcagcagcggaatcaccatggtggcagcagcagcaagagctcgagccctctcccaacgccggaccccgtcgcctcctccaccaccggggggacgtgccgcgcagtgctccccctcgccgtccatggccgccgggagagagagggggccgacaagcctcttccaacgtgctgctcacgtcgtcgctgcgcgccaaggtgggcgatttcgggttcgcgagatgggcgtcgggaagagtgacgccatcgtcgtcgtcgacggcgtcaagacgaagcgtcagctacgatacgctcgtggggttgtttcgtccgccggcgagcggaggcgatgaggcggcgtccacggcggccggcggcgggagcctgcggtcctgtactgccgaagcgccgccgccgtccgagaagggagaggagagaggcggcgtagcgaaaggggggnaaggggacacagacgacgacgatgacatggagatggcgcggagctggaggtggtcgcctgcacgccgccgctgccgatccggtggggaagagaaaagggggagagaagagagagaagggagagagagggaggaggaataa

SEQ ID NO: 124 - DNA, 1014 bp, Oryza sativa
  misc_feature (346)..(346): n = any nucleotide
  misc_feature (367)..(367): n = any nucleotide
  misc_feature (369)..(369): n = any nucleotide
  misc_feature (439)..(439): n = any nucleotide
  misc_feature (502)..(502): n = any nucleotide
atgccgtcgcttgggatcgcgccgctgctcgacgcctacttccgccgccgcttcgccgcggcgggcctcgtccaggcgtccgttccgctggacggcggcgccacgacggtgcaatgctggcgcttcccgccgggggcgagcgaggagctccccgtgctcgtcctcctccacggcttcgggccaccggcgacgtggcagtggcggcggcaggtgggcccgctctcccgccggttccgcctcgtcgtgcctgacctcctcttcttcggcggctccggcacagcggccgccgacgcgcgctcggaggcgcaccaggccgaggcggtggcgaagctcgtcgccgcggtcntgggggcggcggcggcgcgcntntccgtggcgggcaccagctacggcggcttcgtggcgtaccacgtggcgaggctgcttggccccgcggccntggcgcgggtggtgatcgcgagctccgacctgctcaaggccgacgccgacgaccgggccctgntccgccgtggcggcgccgagcgcgtcgaggacgtgatgctcccgcgcacgccggagcggatgcgccggctgctcggcctcgcctaccaccgtccccgccgcttcagcttcaccccggccttcgtgctccgggacctcgcccagttgacaagcacagaggcactcacactgtgtgaatgtaattgccatctttgccaggctaataatcttccaatcaagtatctctacaccgacaaaatagaagaaaagaaagagctgatcaaggggataacactgggggacaaagaaaaattccagctcactccacttcctcaggaagttcttgtattatggggagagcatgatcagatatttcccatagagaaggcatttgaagtagcaaggcaacttggtgcaaatgctaggttggaaatcataaagaacaccggccatatgccacaggaggaggacccgaaacggttcaatgaggccctcctgaacttcttgttaccagctccaaattcgtcgttgtga

SEQ ID NO: 125 - DNA, 906 bp, Oryza sativa
atgggagggtttgtcaagacccagaagacccatgcctacttcaagcgattccaagtcaagttcaagagacggaggcagggcaagactgactacagggccaggattaggctcaccaaccaagataagaacaagtacaacacaccgaagtaccgcttcgttacaaacaaagatatcacagctcaaattgtctatgctaccattgcgggtgatatcgtgatggctgctgcctactcccatgagctgcctcgttatggtcttgaagttggtctcaccaactatgcggcagcttactgcactggcttgcttctggctcgtcgtgtgctcacgctccgtggtttggaccaggagtacgagggcaatgttgaggccactggggaggactactatgttgaaccagctgatgaaaggaggcctttccgtgctctcttggatgttggcctcattaggacaaccactggaaaccgtgtctttggtgccctcaagggagctttggatggtggtcttgacattcctcacagtgacaagaggtttgctgggttcaagaaggacgagaagcagcttgattctgatattcaccgcaagtacatctacggtgggcacgtggctgactacatgaggtctatggctgaggaggaacctgagaaattccaagcccactttagtgagtacctcaagaagggaattgacgctgatggcatggaatcactgtacaagaaggtccatgctgccatccgcgccgatcctaccatggccaaatcgaccaagaaggaaccggctacccacaagagatacaacctcaagaagctgacctacgagcagaggaaggccagtctcgtcgaaagattgaatgctctcaactcctccgctggtgctgatgatgatgacgaggaagaggatgacgagtga

SEQ ID NO: 126 - DNA, 834 bp, Oryza sativa
  misc_feature (33)..(33): n = any nucleotide
  misc_feature (510)..(510): n = any nucleotide
atgcagggaggcggcggcggggatagctccggnggcggcggcggcgaggcgccgcggccgagcaggtacgagtcgcagaagcggcgggactggcacacgttcgggcagtacctgcgcaaccaccggccgccgctggagctgtcgcggtgcagcggcgcgcacgtgctggagttcctccggtacctggaccagttcgggaagacgaaggtgcacgccgcggggtgccccttcttcggccacccctcgccgccggcgccgtgcccgtgcccgctccgccaggcgtggggcagcctcgacgcgctcgtcggccgcctccgcgccgccttcgaggagcacggcggccgccccgaggccaaccccttcggcgcccgcgccgtccgcctctacctccgcgaggtccgcgacagccaggccaaggcccgcggcatcgcctacgagaagaagcgccgcaagcgcccgcccacctcctcgtcttcgtctcaggccgccgccgccgccgcggcggcaacntccccggcgagcccagccgctagcccgacgccgcaaccgccaccgccgacggagagatcagccgacgtgcggccgatgccaccggagggccacttcttcatcccgcacccacacttcatgcacggacacttcctcgtaccgggcggcgacgccgaccaccaccaccaggtctccaacgccggcaatggcggcaacaccaacaccaacaccaacaccaacaccggcggcggcggcggcaacggcgacgagatggcggtggcgatggcggcggtggcggaggcgcacgcggcggggtgcatgctgccgctgtccgtgtttaactag

SEQ ID NO: 127 - DNA, 774 bp, Oryza sativa
atgccgttgctggcccggaagccgcggaacggcgttccgacgacgcccgaccacaacgaagccacggccgagggccgacaagaccttgactttggaaaagcggctccctggaggtggaatttcggtgcgagattggggaaaagaggtgtaggacggggtggagctcggcgcggcgatgccgacggtggcgacggcacggcacggcggtggctgaagcggcgagaagcggcggctggagccggtggcggcggcggagagaggtggtgcgcgtggctgcggcgcttcgaaggtggagaggggaaatggagcggtggacggggcgcgcacggcggctgcggtgtcggggagggtgacggcgcagtgcggggtgaacgggagcggtggcgcagcgtggctggagttcggcggggagcggcggcgcgtgggctccggggaggatgtggtttcgggcacggggaagctcggggaggagggggaaacggaataggagagcacgagggtgctttatattgggctcggggatggagatcgtggccgggagaggcgggaacggccggcaaagttgggaggcatcgttggaagatggggcatgaaacggcgccgaaaattggggaaaagtgggggaagaggtggaggaggtggtggggaaccgattttactcggtttgggcgcgagggcgcgagcgggagggcgccggatttggcaggacgtgggcggcaaccgccggccatggcggcttcggcctgggaagccgaaggtaggaggagggcctga

SEQ ID NO: 128 - DNA, 762 bp, Oryza sativa
  misc_feature (582)..(582): n = any nucleotide
atgccggagctggaggtgtgtagccctgcgtcgtcgggtggggcgtcgccgccggagtcgccggtggaggggaggaggggaggaggaggaggggagaagagggggagatcaggggatggcgggaggcacccgtcgtaccgcggcgtgcggatgcgggcgtgggggaagtgggtgtcggagatcagggagccccggaagaagtcgcgcatctggctcggcacgttcccgacgccggagatggccgcgcgcgcccacgacgccgccgcactcgtcgtcaagggccccgccgccgtcctcaacttcccggacatggccgcctcgctcccgcgcccggcctccgcctccccgcgcgacgtccaggccgccgccgcccgcgccgccgccatggagcccccccagccgccgccgtcgtcgctcaccgtgcaggccgactccgccgccgccgcattcctgacgcccaagaacggcggtttcagcggcgccggcgcggcggacgacgagctcgaggcgatcgtcgagctgccgcggcttcgacgagctggaagccgccgagctcgtgtttcggcgccgcgtttccagganacggcggcggaaaaacccgttgtgtgcgacccgttctggaatcgacggcggctaagcggcggccgccgcggcggcggcggcggccgcggcgcacgacgacctgttcggcctcgacgccgaccaccatggatgggcccagtcggttggtgccctcttatggaacctgtgattcgatcataa

SEQ ID NO: 129 - DNA, 696 bp, Oryza sativa
atggccgccggaggaggaggagatgcagccatgcggggaggtgtggcggtggcagccggaggaggaggacgtccgccgtgcgctgctccacccggtagtagcggcggtgcgggggccctgggagtcgccgaggatgccgaggtcgacgttgacgtcgtccgcgtccatggccatggcgtccccgtccgcatccggcgtgcgccacagaagcggcggcatggggagcggcgcctcagctgctgcagcggcggcgtcaatgggggaaggggaagcggaagctcctcgctccggtgggctgccgctgacgagctcggtggtggtgaaacgcggcggatcgtgcgccatcctggcggctgggggcccttctccgacctctgctccagaccgccgccttcgtcctcttcacccgtcgccggctatcgtcctccttgctccggtgggcgatcgctgacaagctcggtggtggaggcaggttgcggtggagggcggtcgccgctccctctcccgctggccaccgtcggctgtgcacctctccctccgtccgtcgccatcaagcccccacccacggcgctcggccatcgccggcctccctgcgtcctccctccctgcccgcctcgccggtctttgcgcgttgctccctcctctcctatcgccggccgcacgccgccgcatgccgttgtcttccgtggcgcctag

SEQ ID NO: 130 - DNA, 681 bp, Oryza sativa
  misc_feature (34)..(34): n = any nucleotide
  misc_feature (39)..(39): n = any nucleotide
  misc_feature (44)..(44): n = any nucleotide
  misc_feature (246)..(246): n = any nucleotide
atgagcccgagaaggcatggagggattggcgatngcgangccgngagggcagcggctagggaggggatggagtcacgggcgaagagagagagagagaggggcgagcggcgaaggtggaggacggagattcgtacgggagaagcccgtgaggaggacagccgcggcggtggggaagaagaaggacggccgcgggctgaggtcgatgttggttccggcggcggagaaggggccaaagtcggctccggncggctgatccgagtgggagaagcacgatctgggaagaaggaggtggggaagagcggggcgcggcggtggggaagaaggaggacggccgcggcggctccggctagggcgcggcgtagcggcagcagcggggagaaggaggagcgagcgaggaggatggctgcggcggcagtggggagtcgctcctgcgaggacgctgggaggagtgagcgaggaagagaagcgcgcggtctccgcggctgcgggtggaggagcgatgtcttcgcgcgtggaatcctcggctgtgaaatagtgcggtggaggaagagaagcgcgcggatggacgcgtttagtccggatgacttggcatggggaacaggagcagagtacggggaaggggcagcaggtggagcagatgccggatcagcttggcctccctggaggcggcaacctcgatga

SEQ ID NO: 131 - DNA, 648 bp, Oryza sativa
aggatggcatccggcgaccggcactcggcggagagggcggccgacgagagaggagcggcggcgcgtgccgcgccgacggagaggaggccgctcggagcgaggcgtcgcgggagaagggcagcacgcggcgagctcgtcgtggacaccatgctggtgctcaagctcaggctcaactccatcaagacgctgacgctcctcgtgccactcagcatattcgccgatgtggttgacctcggcgccgtgggcgtcattctcaggaaggacatgtccgtctggctcaccaagccaccactcgtcttcgcctgcggtggcctgagcgcgatcctgtacagcatcggcgtgtctgtgtacgctttcgagggattcggcatggtccatccgcttgaggcggaggccgccaacaagaagaagttgggcgcaccacgctcgggctatccatggggccatcccgtctccgcccccctgccccatctccgcccccctgcggaggaagagatgcgcagcgggcggcggccagcgaccgtctcggccccactcatcggccgccgcatttttccctctcgacgcgcgctcgccggccggcgaggaaggatggccgggagggagagaggaggcgccggtccatcctctcccgtcgtccgtggatag

SEQ ID NO: 132 - DNA, 645 bp, Oryza sativa
  misc_feature (52)..(52): n = any nucleotide
  misc_feature (506)..(506): n = any nucleotide
atggctagaggcggcggcgtgcatgaccaccggcggcgaccggcggcggcgnacggcgcgaaggcggcggcgcacagccggagcagcggcgcggccaaaagcaatggcgcacgcgggaaggggaaggaaaggaagggggagggattcctcaccggaggggacggcggcgaccggcggcagaaaacgagggaggcggcgaagtccggcgatgccgagcgggggcagcacgtgccgtattccgtgcaaacggtgcaagcggtggcgctggcggcgagcggcgcgagctcggtaggaagcacgggagggagcggcgagagcggaaagggaaagaggaggctcggggcagcgatttataggtgcgggatgggtggaaacggccgggaaagcctcctttttgacctgcgacgtggggtggagagagagataatggggggattcaaaatgcgaatcccgccccttgcgagcgcgcgcgcgggccgggagacgcgggggagacggcggcgacntggggaggacgcggggacggcgcggcttgggcccggcaggagcggaggaggtgggtgcggcggtttcggcggcggttgccgacctggggcgggcggccggaggaaggggacgacctcgacaggttgcttcctcctctga

SEQ ID NO: 133 - DNA, 618 bp, Oryza sativa
atggcggcgtgcatcctggcgctggtcctcgtcgtcggcttcatcgcgctcgtcgtctacctcgcgctccgcccctccaagccgtccttctacctgcaggacctccagctccgctccgtcgacctcggcgacccctccctctccgccaccgcgcaggtcaccctcgcctcccgcaaccccaatgaccacgtcggcgtccactaccgccgcctcgacgtcttcgtcacctaccgcgacgaacccgtcacggtgcccgtctccctcccgccgacctaccagggccaccgcgacgtcaccatctggtcgcccgtgctctccggcgagtccgtccccgtggcgggcttcgtcgccgacgcgctcaggcaggacgtcgccgccgggtacgtcgcgctgcaggtgaaggtcgacggccgcgtcaagtggaaggtcggcagctgggtctccggcagctaccacctctttgtcagctgccccgccatgctcgcctccgccggaccaggcggcgtcggccccatgcctctcggcggcgcctccgccgccgtcgtgaacggcaccggcgccggcgccgtcgcgtcgctcaggttcacgcagccgacagggtgcagcgtcgaggtgtga

SEQ ID NO: 134 - DNA, 591 bp, Oryza sativa
atgatcgtccaccgcgacgttaagtccaacaacatcctcctcggcgacaacttcgaggcgcacgtcgccgacttcggcctcgccaagttcctccgctccggcggcggcgccaccgcctcgtcggagtgcatgtccgccgtcgccggctcgtacggctacatcgccccagagtatgcttacactctaagggtggacgagaagagcgatgtctacagctatggagtggtcctcctggagctcatcacagggcggcggcccgtgggggatttcggggaaggggtggacatcgtgcagtggacgaagagggtcaccgatggccggcgggaaagcgtgcaccggatcatcgatcgccggattagcacggtgcctatggacgaggtggcgcacatcttcttcgtctccatgctgtgcgtccaggagaacagcgtggagcggccgacgatgagggaggtggtgcagatgctgtccgagttcccccgccacgggtcggaccagccgtcaccgtcgtcgtcggcaccggagacgggggaggagagcagccctgagaaggagcccaactgctacaagctgttcccggacttgctgacctaa

SEQ ID NO: 135 - DNA, 537 bp, Oryza sativa
  misc_feature (336)..(336): n = any nucleotide
atggagaagaagtacaagggtgtgcggcggcggaagtgggggaagtgggtgtcggagatccggctgcccaatagccgcgaccgcatctggctgggctcctacgactcgccggagaaagcggcgcgggcgttcgacgccgccttcgtcacgctccgcggccacggcgccgccggcgccgacctcaactttcccggactcgccgccgtccccgcagcagcgacccgcggcaggttcaggccgccgcgctgtttcccaagcaaacgggcccagttaacgccgcagcaagcggccgcggcgctcatgtcgccgccctcgctgtcgccgccgccgggcatngactggcgcccggtcatggcgcacccgccgccgctgtactcgccgcccggctggggcggcggccatgcctacgacttcttgcagccgccgccgccgtcgccgccgttgccgtcgtgcgacgacgacatggtcgacgtcgtagatgagagcagcgcttcgctttggagctttgacacgcgagactcctacttccgatactaa

SEQ ID NO: 136 - DNA, 504 bp, Oryza sativa
  misc_feature (217)..(217): n = any nucleotide
atggagcatggtcgacaggttgccggcggcggggtgaacaaggctgctcagcacggcgctctcgatgcgatgcctgttggcggcaccgcctgctcatcgatccgctccaccggccgccatcgcgacggcggggaggagctcggcggccttgaagaggaggagggcgagccagtctctggggtcggcgacggcgacgactggagggagagaggggagnaggaggagggcgaccgggcgctgacctcgccgggcaagccgccgccgtcgctgcccgaggccagatccggcaagcccaggccggatctgggccaccccaccgccagtccgacggcgaccctcgatgccaccccgcgcgcccgtcgccgtcggccaccccgcgcgcccgtcgccgtcggccacctcgcgcggcgctcgccgttcgccaccgtgcctcgttcgaccgagagagagagggggagatcggaagaggaggagacggtgggtggaggagacgagaaaatgtga

SEQ ID NO: 137 - DNA, 462 bp, Oryza sativa
  misc_feature (349)..(349): n = any nucleotide
  misc_feature (372)..(372): n = any nucleotide
  misc_feature (382)..(383): n = any nucleotide
aaggcgacggcaagcggcggcgctagcaacaagcggcgcgagctcggtaggaggcacgggaggggacgggaaatgggtgaacgagagaggggactcggggaagggtttttatggggcgagggaggggcggacgtggccggggatggcccctatttggccggcgatgtggggagtggagggagagtgagagagcgcgcgcgcgggccgggagatgcgggggaagaggcggcgacgtggggcgggtggctggaggaaggggacgacctgacaggtgggccccacctgtcagcgtcctgggagaagggggaaggagaacgggccgggccccaacgaaggggaggccgagcgngggccgagcgggtggactgggcngagccgcccnncaagcaggaaaaaaaggaggaaaaagaaaagaaaaagaggagaaggattttcctgggattaaatattgcactttggtga

SEQ ID NO: 138 - DNA, 450 bp, Oryza sativa
atggcgaagcccttcaccgcccggtcaagccgcaccaaatacgccacgcttggtggaggcagggtggcggcggcgggatctcgcagccaggcggcgtccccacgggcggcgcgtggtgaggcggcggatccggtgggtctttggccggatctggcctcccctccaccagatccggcggcccggcgtgcggcggcgggaggggaggcagcagcgacgtgcggcggcggcgggaagggaggtggaggcggcagcggcgtgcgggggcggcgggagaagaggcggaggcggccgcgatctcccctctgccagatccggctgcccgccgtgcggcggtgggaggggaggcagcggccggcgtgcggcgacggcgggaggggaggcggcaacggcggccacgacctctgccagatctggccgcccggcatgcagcgacgggacaggaggctgtag

SEQ ID NO: 139 - DNA, 399 bp, Oryza sativa
atgaagcaaaagatggtgatcaaggtgagcatgccgtgcgggaagtgccggtccaaggccatggcgctggtggcgggggcgaccggcgtgagctcggtggaggtcaccggcgacggcaaggaccggctgcaggtggtcggcgacggcgtcgacccggtctgcgtcgtcaaccgcctccgcaagaagatcggccacgcggagatcgtgcaggtggaggaggtgaaggagaagaagccggatctgcccaagaagccggatccgcccaagccggagccgcccaagccgccggtggtgtgctaccctcctactccctactaccaccaccactacggcgggccgccgccgccggtggtcttctgcgaccagccgagcccgaatggcacatgttccatcatgtaa

SEQ ID NO: 140 - DNA, 375 bp, Oryza sativa
atgggaggtgcggcgggggtggacggcgtggaggcggcaggtgggcctccgccagatccgatggcgtggaggcagctgtggcccggcgggggtgggaggggcggccggccgggcgcggcgccctcccgtctgccagatctggcggcgggaagggaggcggcgcgccccgacggcgggacgagaggcagcgacgccctccctccatctggagggggggcatgcggcggcggtccagcggcaggaggtggtggtggcccgacggcggcgctggtgactggtagtggtggcgccctccctccgtcggatctggaggtggtgcatgcggcagtggtccggcagcaggaggtggtggtgacccggcggcggcagtggtga

SEQ ID NO: 141 - DNA, 354 bp, Oryza sativa
  misc_feature (211)..(211): n = any nucleotide
  misc_feature (238)..(238): n = any nucleotide
  misc_feature (254)..(254): n = any nucleotide
  misc_feature (256)..(256): n = any nucleotide
  misc_feature (260)..(261): n = any nucleotide
  misc_feature (287)..(287): n = any nucleotide
  misc_feature (300)..(300): n = any nucleotide
  misc_feature (302)..(302): n = any nucleotide
  misc_feature (308)..(308): n = any nucleotide
atggccggcgacgagagggacgacggcggcggctcggtcggtcggcgacggcgaactacggcggtcggcggcgaaagaggaggtgcggccgggcttcctcacctccgtgcgcacctaacggcggcgacggcaagcggcggcgacggcggagacggtggcgcggcgcagccgaagacggccggcggcggcggcggactaaacggcggcggcncggcaactaggaggcacgggaaaaccngggaaaaggggccaancnaaannggccaacaaggggatgctatttatanccttggattgaanantcggantccaacgagaggaatcgactcgggaaaatccaaactcggtttttag

SEQ ID NO: 142 - DNA, 342 bp, Oryza sativa
atggtacgcctcgtttgtctctcccaccatttttgctcgatcgccggctgcgtgctgaccctctcgcttgcttgctgtctcaggccccgaagaaggacaaggccccgcccgccgtcgtccaagcccgccaagtccggcggtggcaagcagaagaagaagaagtggagcaagggaaagcaaaaggagaaggtgaacaactcggtgctgttcgaccaggccacctacgacaagctgctctccgaggtgcccaagtacaagcagatcaccccctccgtcctctccgagcgcctcaggattaatgggtccctggctaggagggctatgaaaggatctgatggataa

SEQ ID NO: 143 - DNA, 3309 bp, Oryza sativa
atgggggaggcggcggcggtggtggcggtgaacggggagaggtacgaggcggtgggggtggacccgtcgatgacgctgctcgagttcctccgcacgcggacgccattcagaggccccaagctcggctgcggcgaagggaggatgcggggcgtgcgcggtggtggtgtccaagtacgacgccgccgccgacgaggtgacgtcgttctcggcgagctcgtgcctgacgctgctgggcagcctccaccactgcgcggtgaccaccagcgagggcatcggcaactccagggatggcttccaccccgtgcagcgccgcctcgccggcttccacgcctcccagtgcggcttctgcaccccgggcatccgccggggttctccaggctcaccgccgccgacgccgagcgggccgtctccggcaacctctgccgctgcaccggctaccggcccatcctcgacgcctgcaagagcttcgccgccgacgtcgacctcgaggatctgggtctcaactccttctggaagaaaggcgagcgcgctgacatcaccaagcttccggcctactcctgtactgccgatgttgccaccttcccggagttcctcaagtccgagattagaacaccggctccggggtgtacaaggatcaggacctccatgacaagtacatcaacatctcgcagattcctgagctctcggccatcaacagaagcagcaatggcatcgagatcggagcagccgtgtctatctccaaagccatcgagatactacgaagattgcttatcacctgggcaaggtggcctcaccgttcgtccggaacacggccaccataggaggcaacatcatcatggcgcagaggatgtcgttcccgtcagacatcgcaactgttcttctcgctgcaggatcaactgtcaccatccagcagctcactctggaggaattcttgaagcagcctccatgtgattccaggacattgctaatcagcatctccatcccatttgagacatttcgtgcggctcctcgtccatttggcaatgctgtctcatatcgcttggcattcggcgcttttgggtctgaacatgccatcagagctaggcaccacacatcctgaatacagagtcagtctagccgtcagttacctgttcagtctgatgaatacaaaccagtcggaaaaccaatcaagaaagtcggggcagagctccaagcttctgggggaggcagtgtatgttgatgacatccctgctccaaaggattgcctctatggagcatttatctacagcacacaccctcacgctcacataaaaggtgtaaactttagatcatctttggcttcacagaaggttatcacagttatcactgcaaaggacattccgaccggtggagaaaatgttggatcctgcttcccaatgttaggagatgaagcactttttgctgatccagttgctgaattcgctggtcaaaatatcggcgttgtggcagcaaggcaagctgtgattgaatataatactgaaaatcttcagccaccaattctaacagtagaagacgctgtccagcataacagctacttccaagttcccccatttttacaacctaagccaattggtgacttcaaccaagccatgtctgaagccgatcacaagatcatagatggggagcaaactgctttagctttccctgatgaagataactgtataaccgtctactgctcagcgcaaatgcctgaggttactcaagatattgttgcaaggtgcctcggcgttccatttcataatgtccgtattatcacgagaagagttggaggaggtttcggtggaaaggcaatgaaagcaacacatgttgcaactgcttgcgctgtggcagcattcaagctgcggcgcccagttcgaatgtacctcgatcgcaagacggacatgataatggcgggagggcggcatccgatgaaggccaagtactccgtcgggttcaagtccgacggcaagatcacggccctgcacctcgatctcaagatcaacgccgggatatcaccggaattcagcccggcgatcccgtacgccattgtcggggccctgaagaagtacagctggggcgctctcgcgttcgacatcaaggtctgcaagacgaacgtctcgtccaagtcggccatgcgtgctccgggcgacgcgcagggctcgttcatcgccgaggccatcgtcgagcacgttgcgtccacgctctccgtggccacgaacaccatcaggaggaagaacctccatgacttggagagcctcaaggtgttcttcggggacagcgccgccggcgaggcctcgacgtcgtcgtacagcctcgtcatcatcttcgacaggctggcctcgacgccggagtaccagcggagggccgccatggtggagcaattcaacggcagcagcaggtggaagaagcgtggcatttcttgcgtgccgatcacctactcggtgacgctccggccgtctccggggaaggtctccatcttgaacgacggctccatcgccgtcgaggtcggcggcgtcgagatcgggcagggcctgtggaccaaggtgaagcagatgaccgccttcgcgctgggccagctgtgcgatgacggcggcgagggcctcctcgacaatgtccgtgttatccaggctgaaaccctgagcatgatccagggaagatgaaccgccggaagcacgacctccgagaccagctgcgaggctgttcggaagtcgtgcgccgcgctcgtcgagcggctcaagcccatcaaggagaaggctggcaccctaccatggaaatcctttattgcgcaggtggaagtcgatgtgctgacaggggcaaccaccatcctgaggagcgacctcgtgtatgactgtgggcagagcctgaatcctgctgtcgacttaggccagcaggtggaaggcgcgttcgtgcaaggtgtgggcttcttcacgaacgaggagtacgcgaccaacgccgatgggctggtcatccacgacggcacatggacgtacaagatccccaccgtagacaccatccccaagcagttcaacgtcgagctcatcaacaccgctcgccatcacagccgcgtcctctcctcaaaaggcgtccggtgagccgccgctgctgctggcgtcgtccgtgcactgcgcgatgagggaggcgatcagggcggcgcggagagagttcgccgctgtcggcggcggcaccggcggctcagatcaggtgacgtcgttccagatggacgtgccggcgacgatgccggccgtcaaggagctctgcggcctcgacgtcgtggagaggtatctcgagagcttttctgcaaccaccgcctag

SEQ ID NO: 144 - DNA, 2916 bp, Oryza sativa
atgcccaacaacgcagccatcggaagcatcgtcgccgccgtcggcgtcgtcgccgtggtctgcgcgatcgccgcggtcacgagctccaagaaggatcgcaatggcgagctcaccgccaacgtcaggctctccaccgtgtgctccgtgacgcggtaccctggcaggtgcgagcagagcctcggccccgtcgtgaacgacaccatcgaccccgagagcgtcctccgcgccgcgctgcaggtggcgctcgaagaggtcaccagcgcgttcaaccgctccatggacgtcggcaaggacgacgacgccaagatcaccaagagcgccatcgagatgtgcaagaagctcctcgacgacgccatcgaagatctcaggggcatggcgagcctcaaacccgaggaggtcacgaagcacgtcaacgacctccggtgttggctgtccagcgtcatgacgtacatctacacctgcgccgacggcttcgacaagccggagctgaaggaggccatggacaagctcctgcagaactccaccgagctgagcagcaacgcgctcgccatcatcaccagcctcggcgaactcatgccggctgccaagtcgaacggatccaccggcgcgcaccgccggcttctcgggttgcagggcagtgaggcggcagagggggtaagcttgcgcgagcttcttgccgtccacgacaaggtacaggagctcacagatgtgaaagacgtcagccgccatctcttgtccgagacgctggacgcgatcaccgagatgtcccacgacgcaggccgccgccttcttggcgtcacgctcagcgaagccacagacgacagcgacgacagtggcctccccggccgccggctgctgagtatgtctttccacgacgccgaccacggggtgcacggcggcgatcatcggcggctgagtatgtctttccacgatgctgaccacgaggtgcacggcggcgagcatcggcgtttgagtatgtctttgaacgacgccgaccccgaggagcaaggcggcgagcatcggcgtctgagtatgtctttaaacgacgccgaccccgaggtgcaaggcggcgagcatcggcggctgagtatatctttgaacgacgccgaccccgaggtgcacggcgacgagcatcggcggctgagtatgtctttgaacgacgccgacaccgaggtgcacggcggcgagcatcggcagctgagcatgtctttgaacgacgccgacaccgaggtgcacggcggcgagcatcggcggctgagtatgtctttgaacgaggccggcaccgaacagcccagcggcgagcatcggcagctgagtgtgtcttccagtgacgctggctcctccacggactccacctccgactccgatacgcccggcggcgaccccaaggagcccgcggccgttgatgactccaaaaacgccgtccccggggagcccgccgccgccgccgccgccgagcatcggcagctgggcacgcttttcaacgctatccacaacatgacgagcaaggccgacaccgtcaagcgccggctgctgagcatgccacaagacggctccgacgccaccgagcacgagggcggcgggcgcgcgcttctgtccatccagctccagagcatcgccgacatgtccgccgagatgaaccgccacctcctcgcggcggagctccccgacgagctcgccggcaagcggcagctcctgtccacgacgctcagggagctcaacgaagcaaccacggcggcgaagggccagctcgacaagatcgagaacggcacggtgcactccgacgccatcccggagcgaattctcggagatgagtacagggccaccccccaccaccggctgctcaccacggacgtcgtcggcacgatcgaagacatcgaacacgagcgccacaaccagcccaagcccggcgagttcccgtcgtgggtgtccgcccaccagcggcgtctcctgcaggccggcacgcagaagcccgacaaggtggtcgccaaggacgggagcggcgacttcaagacgatcaccgaggccgtcaacgccgtgcccaagaactccccgacccgcttcgtcatctacgtgaaggccggcgagtacaacgagtacgtcaccatccccagctcgttgcccaacatcttcatgtacggcgacggcccgaccaagacgcgcgtcctcggcaacaagagcaacaaggacggcgtcgccaccatggccacccgcaccttctcggcggaggggaatggattcgtgtgcaagtcgatggggttcgtgaacacggcggggccggaggggcaccaggcggtggcgctgcacgtgcagggggacatgtcggtgttcttcaactgcaagttcgaggggtaccaggacacgctgtacgtgcacgccaacaggcagttcttccggaactgcgaggtgacggggaccatcgactacatcttcggcaactcggcggcggtgttccagagctgcctcatgacggtgcggaagccgatggacaaccaggcgaacatggtgacggcgcacgggcgcaccgaccccaacatgcccaccggcatcgtgctccaggattgccgcatcgtgccggagcaggcgctcttccccgtccgcctccagatcgccagctacctcggccggccatggaaggagtacgcgaggacggtggtgatggagagcgtcatcggcgacttcatcaagccggaggggtggtcggagtggatgggcgacgtggggctcaagacgctctactacgccgagtacgccaacaccgggccaggcgccggcacaagcaagagggtgacgtggccgggataccgcgtcatcggccaggccgaggccacgcagttcaccgccggcgtcttcatcgacggcttgacgtggctcaagaacaccgccacgcccaacgtcatgggcttcgtcaaatga

SEQ ID NO: 145 - DNA, 2153 bp, Oryza sativa
  misc_feature (760)..(760): n = any nucleotide
atgggcgaagtggccaccaccaccctgctgctgacgagccatgaagcaaaaccggccaaggcaccgtctatccacgacgccatcgaggtgtacatcggcgccaccggcgcccgccaacttctcaaggccatgctgctggccttcgcttgggctttcgacgcgcagcaggtgttcatgtccgtgttcacggacgcggagccgccatggcactgcaccggcgtcgtcgatgcggttgaggcggcggcgggcgactccggctcgtcctgctcttcgccggccacttcggcttcgccgtgcgcgctcccgctcggcacgtgggagtgggaccgcctggccaagacgtcggtggtgtcggactgggcgctcaactgcagcggcggcggcccagcgctcgtctccctcccggcgtcgtcgttcttcacaggaaacctcgatggccgaagcggccaccaccaccccgctgctgacgagccatgaagcagagccgtccatcgacgacgtcatcgaggcgtacatcggcgccaccggcgcccgccagcttctcaaggccatgctgctggccttcgcttgggctttcgacgcgcagcaggtgttcatgtccgtgttcacggacgcggagccgccatggcactgcaccggcgtcgtcgacgcggctgcggcggcggcggccgactccggctcgtcctgctcgccgccggccgcttccgcttcgccgtgcgcgctcccgcctggcacgtgggattgggaccgcccggccganacgtcggtggtgtcggactgggcactcaactgcggcccggcgctcgtctccctcccggcgtcgtcgttcttcgccggcaacctcgccggcggcttcctactcgcaacgctcgccgacactcacctgggccgcaggaagatgctcctcctgtcactggtgaccatgtccgtcgccgccgcgctcacggcgttctcgccgaacgtgtgggtgtactccgccctgcggttcgtgtccgggttcggcaggtccatggtgggcacgtcagcgatggtcctgtccacggagctcgacgggaagcggtggcgcaacacggtgagcgccgcgggattcgtcttcttctccgtcgggttcgtgtcgctcccggcgctcgcgtacacgttccgcgaggcgtcgtggcggaacatgtacgtgtggacgtcgctcccgtccctctgctacgccgtcctgctctacctgctcgtccaggagtcgccgcggtggctgctggtgcgcggccggaagcaggaggccatcgaggcggtgcgccagatcgcgtcgctcaacggcggcggcggaggcatcacgacgtcgagcttctccatgctggacgcgtgcgccgtggagctcggggacggcggcgagggcatgttcgccacgctgcactcgatatgggagcggcggcgggcgctccggaggctggcggcgatcactgcggcgagcttcggcgtgggcatggtctactacgggatgccgctcaacgtgggcagcctgagcccctccaaacctctacctgagcgttggcgtacaacgcggtggccgagctcccgtcgtccatcctcgcgtggctcctcatgggcaggtggttcaaccggcgcggctcggtggtcgcgctcaccacggcgtccgggctgtgcagcctcgccgcgtgcgtccccgccgtcgtcctcccggacggcgcgcggatggccgccgaggtggcctcgttcttcgcgtcgtgcacggcgtacgacatgatgctcatgtacaccatcgagctgttcccgacgtcggtgcgcaactcggcggtggggctggtgcggcaggcggtggcgctgggcggcgtggtggctcccgtgctcgtcgcgctcggccgcgagacgacgagctactggtcgtcgtcgttcggcgtgttcgggctcgccgtcggctgcctcgggctgttagtcacctgcctgccggagacgagggggaggaggttgtcggacaccatggaggaggaggaggccgccgtcttgtccagctctggcgcgagcgacatggataacaacggcgagctcgtgtaaacgacgttcaggtttgttctgtacatctttggtgctggatattttcgtgcaggtcggagacgaaactactgtcattcgtcagtcatgtatag

SEQ ID NO: 146 - DNA, 1609 bp, Oryza sativa
  misc_feature (295)..(295): n = any nucleotide
atgaagacggcatcaatggcggcgtcgctgctcatcccgctctgcctctgcatcctcctcctgcgcggcgcctccgccgtgagcgaccagcaagaagccggccgtcgcgatagctgcgaccgcatcgaccgccgcatccgcgcgctggagccgacgcgccgcgtcgactccgaggccggccacaccgagctctacgacgaccgcgacggccagctcccctgcgccggcgtcgccgccgcgcgcatcaccatccagcgcaacggcctcctcctcccttcctattccaactcccccngcctcgcctacatcgtccacggccgtggcatcgtcggcgtcgtcatccccggctgccccgagacgtaccaggagacctcgtcgtcgtcgtcgcaggagcaggaggacgacgagcgccgccgccgtggccgccgtggtgatgaggagagacggcgatcgagcgagggagaggaggaggaggaagaggagaccagccgccgcagcttcgagcagtccatccgcgacgagcaccagaggatcaccaccgtccgccagggcgacgtcgtggccatccccgccggcgcgccgttctgggtccacaacgacggcgactccccgctcgtcgccatctccgttcacgacgtcagcaacaacgccaaccagctcgaccaaacctccagggtacttccggctagccggcgggcaggcgaggagcgaggggaggcagaggtacggtgagggcgagtcgtcggagtcggagacggaacgcggcggcgaggagtcgtacaacatcctgagcggcttcgacaccgagctgctcgccgagtcgatgcgcgtcagcccggacatcgcgcgcaagctgcagggccgcagcgacaagcgcggcaacatcgtgcgcgtccgccgcggcggcctccgcatgctccgcccggcgacggagcgggtgaccgacgaggagatgatgaggggcgccaacgccgccgccgccgccgggaacgggatcgacgaggccgtctgcttgatgaagctccgcgagaacgtcgccgacccgatgaaggccgacctctacacccccaatggcggccgcatcaccgtcctcaacagccagaagctccccgtcctcaagctcatcaagatgagcgtcaaccgcggcgtcatgcgccgggaacgcgatcctggcgccgcactggaacatcaacgcgcacgcggcggtgtacgcgacgagcgggagcgcgaggctgcaggtggtgagcagcgaggggcggcgggtgttcgacggcgagctccggcgcgggcagatggtggtggtgccgcagagcttcgcggtggcggggcgcgccggcgacgaggggttcgcgtgggtgtcgttccagacgagcgacggcgccatgaacgcgccggtggttggcaagtcgtcggcgctgcgcgggatgccggcggacgtgctggacaacgcgttcggcgtgtcgagggaggaggcgcgcatggtcaagttcgggagggggcaggagctcgccatcttctcccccaagtccggcgccgccgcccgccgccgccgctttcccggccacagggacgacggcgtgctcgccgccccggcctgaggcgtacgtag

SEQ ID NO: 147 - DNA, 1582 bp, Oryza sativa
atggcggtcaccgccgacgtgaagctcgagggcctccgcgccgccaccgacaagctcgaccagatcaggtgcgagttcatcccactccacttccactggatctacccgcgcgatcgtttcgtccccattttttttgtgctgattttttctgtgtgtgtgttttttttgctgttgtttttgttgcagcgagaacgagaagtccgggttcatcagcctcgtttcgcgctacctcaggagtggagtaagatccagaccccgaccgacgaggtggtggttccctacgacacgctctcggctgctcccgaaggagacgaagaagctgctcgacaaactcgtcgtgctcaagctcaatggaggcctcgggacgaccatgggctgcactggtcccaatctgtcattgaagtccgcaatggctttacgtttctagaccttattgtgattcaaattgagctgaacaagaagtatggatgcaatgtccctttgcttctaatgaactcattcaacactcatgatgacacacagaagaagattgttgagaagtactccaactccaacattgaaattcacactttcaaccagttcatgcagagccaatatcctcgcattgttactgaagacttcttgccacttccaagcaaggggaagactggcaaggatggctgggtatcccccaggccatggtgatgtgttcccctccttgaataacagtggaaaacttgataccttgttggcacagtctcagggcaaggagtatgtctttgtcgcgaactcggacaacttgggtgctattgttgacatcagtatcctaatcttaaaccacctgatccataaccagaacgagtactgtatggaggttactcctaaaacattggctgatgttaaaggtggtaccctcatctcttacgaagggagagttcaggtgcagctgttggagattgctcaagtccctgatgagcatgtgaatgaattcaagtcaattgagaagttcaagatcttcaataccaacaacctgtaaaacaggtgggtgaacttgaaggccatcaagaggctggtagaagctgaagcacttaagatggaaatcattcctaaccctaaggaagttgatggtgtgaaagttctgcaactcgaaactgcagctggagcagccattcggttctttgaaaaagcaattggcattaatgttccccgctcgagatttctgccagtcaaggctacatctgatttgttgcttgtacagcagtctgatttgtacaccttggtcgatggctttgtcatccgcaacccagccagaacaaacccatcaaacccttcgattgagcttggacctgagttcaagaagctggcccggtttaagtcaatccccagcattgtcgagcttgacaccttgaaggtctctggtgatgtctggttcggctctggagttacactcaagctacagggtaaggtgaccatcaccgccaagtcagggaagttggagatcccagatggagccgtgcttgagaacaaggacatcaacggtccggaggatctttgaggctgctcacggaaaccttccagatatatttagctgagcgttttgtaa

SEQ ID NO: 148 - DNA, 1457 bp, Oryza sativa
atgggcctcagtactgtcattgtgctcgccgccgtcgtcttcctcctcgccaccattctccgccatggccgacgcgcgtataggctcccaccagggcctaacccgtggccgatcatcggcaacctcaacctcattggcgcgctgccacaccgctccatccacgagctctccaagcgctacggcccgctgatgcagctccggttcgggtcattccccgtcgtcgtcggctcgtcggcggagatggccaggttcttcctcaagtcccacgacattgtgttcaccgaccggccgaggaccgccgccggcaagcacaccacgtacaactacaccgacatcctctggtccccctacggcgcctactggcgccaggcgcgcaagatgtgcgtcaccgagctcttcagcgcgaggcggctcgagtcgttcgagcacatccgcggcgaggaggtgcgcgcgctgctgcgcgacctgcacggcgcggcggcgcccgtgctgctcagggactacctgtccacggcgacgctcggcgtgatatcgcgccatgtgctgggcaagaaccggaggagttcaagatgatgatggacgagctgctgctgagcggcgtgctcaacatcggcgacttcatcccgtggctagactggctcgacctgcaggggtacatcaggaggatgaagagagtaggcaagaaactggatcggttcatggagcacgtcctggacgagcacgacaaggcgagggacttggtcgacgtgctcttgcagctcgccgatgaccctaacctcgaggtccaactccggcgtgataatgtcaaggcacttactcagcaggacctgatcgccggcggcacggacacctccgccatcaccgtggagtgggccatttcggagctcctgaggaagccggagatcctcgccaaggcgaccgaggagctggaccgcgtcgtcggccgcggccgcttggtcaccgagacggacatgaccagcctcccctacgtggaggccatcgtgaaggagacgatgcgcgtgcacccggtggcgcccctgctggcgccgcacgtagcccgcgaggacgcctccgtcggcggctacgacatccccgccggaacgcgggtgctcgtcaacgtgtggaccatcgcccgcgacccggcgctgtgggactcgccggaggagttcatgccggagaggttcatcggcagcaagatcgacgtgaagggacaggacttccagctgctgccgttcgggtccggccgccggttgtgccccggccacagcctcgggctgaaggtgatacagctgagcctcgccagcctgctgcacggcttcgagtggaggctccccgacggcgtgtcggccggcgagctgagcatggaggaggtcttcggcctgtccacgccgaggaaggttccgctcgaggtcgtcgttaagcccaagctgccggcccacctctataccgggccctga

SEQ ID NO: 149 - DNA, 1399 bp, Oryza sativa
  misc_feature (229)..(229): n = any nucleotide
atgccgacgccgccctccgccgcggtgttcgacgtcgaggccgcgtccggcgctcgccgccttggcatcaagcccgccgccgacgccggcgccgccttcgtgctcgagtccaaaggggaattggtggcacgccgggttccacctgacgacggcgatcgtggggccgacggtgctgacgctcccgtacgcgctgcgggggatggggtgggcgctcggcctggtggcgctnaccgccgtcgccgccgtcaccttctacgcctactacctcatgtccagggtcctcgaccactgcgaggcccacggccgccgccacatccgcttccgcgagctcgccgccgacgtcctcggttctggatgggtgttctacttggtggtcaccgtgcaaactgccatcaacgccggtattaccatcgggagcatccttcttgcggctgactgcttacaaataatgtactcggaccttgcaccaaatggacccctgaaactgtaccatttcatcatcgtcgtcgctgtggttctgtccttgctctcccagctgccgtcgttccactccctgcgttacatcaacctcggctcgctcctcctcagcttcggctacaccatccttgtctcagctgcctgcatccgagcagttgagcgatgtcccggagaaggattactccctgagctcatccaattcggagaagaccttcaatgcgttcctctccatttccatcctcgcctccgtcttcggcaatggcattctgcctgaaatccagcaggcgacgctggcgccgccggcggccgggaagatgatgaaggcgctggtgctgtgctacacggtggtgttgttcaccttctacttgccggcgatcaccggctactgggcgttcggcagccaggtgcagtccaacgtcctgcagagcctcatgccggacaagggcccttccctggcgccgacgtggctgctcggcctcgccgtcgtgctcgtcctcctccagctgctcgccatcgcgctcgtctactcccaggtggcgtacgagatcatggagaagagctcggccgacgcggcgcgcggccggttctcgcggcggaacgtggcgccccgggtggcgctccggacggcgtacgtcgcggcgtgcgcgttcgtggccgcgatgctgcccttcttcggcgacatcgtcggcgtcgtcggcgccgtcggcttcatcccgctcgacttcgtgctccccgtcgtcatgtacaacatggcgctcgcaccgccgaggcggtcgccggtgtacctcgccaacgtcgccatcatggtcgtcttcaccggcgtcggcctcatcggcgccgtcgcctccgtacggaagctcgtgctcgacgccggccagttcaagctcttcagcggcaacgtcgtggactgaaatggacctaa

SEQ ID NO: 150 - DNA, 1350 bp, Oryza sativa
atggaacaaaacaagaagccatcggcaccaagaccaggtagccgcagcgagaggagagcgcgagcagagcaagcaaccaagcagcagcagcgatggccgccgcagccacgacatcctcccacctgctcctgctctcccgccagcaggcggcggcctcgctccaatgcggcctctccttccggaggcagcccggcaggctcgccgtcggccccgagcgtgcggtgcatggcggccgtcgacacggcctcggcgcccgccgcgacggaggctagcaagaagagcagctacgagatcaccacgctgacgacgtggctgctgaagcaggagcaggccgggaccatcgacggcgagatgaccatcgtgctggccagcatctccacggcgtgcaagcagatcgcctcgctggtgcagcgcgcgcccatctccaacctcaccggcgtccagggcgccgtcaacgtgcagggcgaggaccagaaaaaactcgacgtcgtctccaacgagaggtgttctccaactgcctcaaatcgagcgggcgcaccggcgtgatcgcgtcggaggaggaggacgtgccggtggccgtggaggagagctactcgggcaactacatcgtggtgttcgacccgctcgacggctcctccaacatcgacgccgccgtctccaccggctccatcttcggcatctacagccccaacgacgagtgcctagccgacatcgccgacgaccaaaatcttgaccaggtggagcagaggtgcatcgtgagcgtgtgccagccggggagcaacctgctcgccgccggctactgcatgtactcgagctcggtcatcttcgtgctcaccatcgggacaggggtgtacgtgttcacgctggacccgatgtacggcgagttcgtgctgacgcaggagaaggtgcagatccccaaggcaggcaagatctatgccttcaacgagggcaactacgcgctctgggacgacaagctcaagagctacatggacagcctcaaggagcccgggccgtccgggaagccatactccgcgcgctacatcggcagcctcgtcggcgacttccaccgcacgctgctctacggcggcatctacggctaccccagggaccagaagagcaagaacggcaagctgcggctgctgtacgagtgcgcgccgatgagcttcatcgtcgagcaggccggcggcaagggctccgatggccaccagaggatacttgacatcatgcctacggagtccatcagagagtgccgctgtacatcgggagcgtggaggaagtggagaaggtcgagaagttcttggcttgactgcaagtttcatatacgggggtgtttctaaaaaaaaaagtatt

SEQ ID NO: 151 - DNA, 1317 bp, Oryza sativa
  misc_feature (574)..(574): n = any nucleotide
atgccgccgttcgactacacgccgccgccgtacgacgggccgcgggcggaggagatctcccggaagcgggccgagttcctcagcccctccctcttccacttctacgaccgccctttgaacatagtcgatgggaaaatgcagtacctgttcgacgaggatggccgccgttacctggatgcttttggtggcattgcaaccgtttgttgcgggcactgccatccggatgttgttgaggcgatggtcaaccaagcaaagaggatacaacactccacagttctttacctgaatcatgctattgcagattttgccgaggcattggcagccaaaatgcctggtgatctgaaggttgttttcttcacaaattctggcacggaggcgaacgagcttgcactgatgattgcccggctttacactggttgccatgacattatttcactcaggaatggataccacgggaatgcggctggaacaatgggtgctaccgctcaatgcaactggaaatttaatgttgttcagaatccagacccatttagaggtgctttcggttctgatggcgaaaagtatccccgaaatnttcaggaaatcattgattttggaactacaggaagggtcggtggtttcatttcggaagccatacagcagggagtgggtggaatagtggaactggcaccaggatacttgcctgctgtgtacaatatggtaaggaaagctggcggcctctgcatcgccgacgaagttcaggcgggagtcgcacgaactggaagccacttctggggatttgaatcgcacggcgtcatcccagacatagttacaatggcaaagggtataggcaatggcataccgatcggagcagtcgtcacaacccctgagatcgctcaggtgttaacccgcaggagctacttcaacaccttcggtggcaaccctgtcagcacagccggtggccatgctgttctcaaggttctggagaaggagaagctccaggagaacgcatttgtggttggctcctacctgaaggaacggctcaacaagctgaaagagaagcatgacagtgagtatcaattggtgatgttagagggaaaggcttccttcttggggttgagctggtgaccgatcgccagaagaagacaccggccaaagttgagatcggtcatgtcatgaaccacatgaaagggtgtgctggttgggaaaggtggtttctacgggaacgtgttcagagtaacacctccactatgcttcaccaaagaggactccggtaagacctgctactctgctgctgataaattgtcaatacatgtttcagtaatttctgatccatga

SEQ ID NO: 152 - DNA, 1290 bp, Oryza sativa
atgacgatgtgcccgtggccaagcggcggcggcggctgtccaacccgccggcgccggcgccgcggcggctggcatcccggaagacattgtggaggaaatcctcctccgcctccctgtcaagtccgtcctgcggttcaggtccgtgtgcaagtcgtggcgcgccatggtcgccgacccgtgcttcgcgcgcctccagctgcgccattccacggcggcggagcggcgccgccatccgccgtccatgctcgtcctgccgtggtggggctggaggccgcagcggcaacagatgcaggggaccatcggcttctttcgctacccggggcatggcgccgccgcggagctcgcgcacgtgagggcatggtggtccccgacctcgcacgccgccgccgccgactgggacgacggcgccgactgggagctgcccctgcaatgcaacgggctcgtgctggtgttctccatggagaagagcctctcctcctctctgatgttcgtctgcaacccggcgaccaagaagctcgccgtggtgccgcccggtacgccggacgcgcacgggaaccaaagcgtgggcttcggcgccgacaaatctacgggcaagatcgacatgaaggtggttcgctgcttcgcccgctcagacgagagcgtcgggtgcgaggtcttctccctcggatcgccggcgtggaggccggtcgccgactcgccatgccccgtcagggccggcgccgcgtcgccgtgcatcctcggcgccatctactggatcaccaccgcagcgccaaccccagggatgctacgcttcgacgtgcgccgcgaggtgttcgacgatttcccgagcccgccgtgcgtgcatcacgacggcacttcgccggcgaccgcgaccctgacggagctgtccggcaacaagctgtgctacgcgcacgtcgtcgccggccataccgttgagctctggacgatggcggctgcttccgccgccgacgacgggccgcggtggtcgcggcatttgcgccgtcgagctatggcgccccactcagctcgtcgtcccgtttgccgacgatcgccatggcggcatcttcttcaacttggatctcgccgtgattgacaggcatgacacccaacgccaagttgttgaacgtgtggtcgacatgaacaaggagatgacctacttccattcaagggacaagcagtactacataaatcgtggatttaggtggatgcaccatgtcattcagtacagggagagcctagtatccgtaaaagcgaattaattaagggattgtatcagccaaaggaaattaa

SEQ ID NO: 153 - DNA, 1267 bp, Oryza sativa
  misc_feature (78)..(78): n = any nucleotide
  misc_feature (230)..(230): n = any nucleotide
  misc_feature (752)..(752): n = any nucleotide
atggcggcggtggagcaggatcaggaggaggaggtgatcatcgtcggggcggggccgtcggggctcgcggcggcggcncctgcctgtcggtgcgcggcgtgacgggctgcctcgtcctggagcgcgacgactgcgtggcgtcgctgtggcgccaccgcacctacgaccgcgtccgcctccacctcgccaagcgctactgcgcgctcccgcacgcgccgcacggcgaggcntcgccgacctacctcccccgcgacgacttcctccgctactcgaacgcctacgcctcccgcttcggcgtccgcgcccgcctccgccgcgaggtccgctcggcgcgctacgacgccgcccgcgcccggtggctcgtcgacgccgtcgacctcgccacggggacgcgcggagcggtacgcggcgaggcacctggtcgccgccgcgggcgagaacgacgagagggtggtgcccgaggtgcccgggatggagacgttccccgggaaggtggtgcacgccgccgactaccggagcgcggaggggttcaaggggaagtccgtgctcgtcgtcggcggcggcaactccggcatggagatcgcctacgacctcgccgtcggcggcgccgcaacctccatcgtcatccgcagcgagagctgcacctggtgagcaaggagatatggaacttggcgatgacgctgtacaggtacctgccggtgtgggtgatcgacaaggtggtgctgctcatgtgcgccgccgtgttcggcganaccgcccgctacggcctccggcggccggccgtcgggcccttcaccatgaaggccaccaccacgatgtacccggtcgtggacgtcggcaccttcgccaagatcaggtccggcgagatccgcgtcctcccggccgccatcaagggcgtccgcggccgcgacgtcgagttcgccgacggccagcgccacgccttcgacgccgtcgtcttcgccaccggctaccggagcaccaccaagcactggctcaagagagtgatgacgggctgatcggcgacgacgggatggcggggcggagctacccggatcactggaagggggagaacgggctgtactgcgccgggatggtgaggaggggaatctacggcagctacgaggacgcggagcacatcgccgacgacatcagcaagcaactccggagcagcagcaagcctacccacaacaatggctcggcctagaaagaaattaaatcaagctgatgaggctctcccccttggaccttgtcttggttattatattag

SEQ ID NO: 154 - DNA, 1261 bp, Oryza sativa
  misc_feature (939)..(939): n = any nucleotide
atggggtcggtggcggcggaggaggtggtggtgttccggtcgaagctgccggacatcgagatcgacaacagcatgacgctgcaggagtactgcttcgcgaggatggcggaggtcggggcgcggccgtgcctgatcgacgggcagaccggggagtcgtacacgtacgcggaggtggagtccgcgtcgcggcgcgccgcggcggggctccggcggatgggggtgggcaagggcgacgtggtgatgagcctcctccgcaactgccccgagttcgccttctccttcctcggcgcggccaggctgggcgccgccaccacgacggcgaacccgttctacacgccgcacgaggtccaccgccaggcggaggccgcgggcgccagggtgatcgtcaccgaggcgtgcgccgtcgagaagcccaaccgcagcctcatcaccagcgtcgcccagcaggtggatggagagaaccctaacctgtacttcagcaaggatgatgttatactatgcctgctgccactgttccacatctactcgctcaactccgtgctgctggctggcctgcgtgccgggtcgaccatcgtgatcatgcggaagtttgatcttggcgcgctcgtcgaccttgtgcgcaagcacaacatcaccatcgcccccttcgtgccccccatcgtggtggagatcgccaagagcccccgcgtcaccgcggaggacctcgcctccatccgcatggtcatgtccggtgccgcgcccatggggaaggaccttcaggatgcattcatggccaagatccccaatgccgtcctcggacagggttacggtatgactgaggctgggccagtgctggcaatgtgcctggcgtttgccaaggagcccttcaaggttaagtccgggtcgtgcggtacagtggtgcgcaacgcggagctgaagatcgtcgaccccgacaccggnacctccctcggccggaaccagtccggcgagatctgcatccgcggagaacagatcatgaaagatgaaggatgatcttgccggtgaagtgccagtcgccttcattgtccggacagaaggctcagaaatcaccgaggatgagatcaagaaattcgttgcaaaagaggtggtgttctacaagaggatcaacaaggtgttcttcaccgattccatccccaagaacccttccggcaagatcctcaggaaggacttgagagccaggctcgccgccggcatccccgacgccgtcgccgccgccgccgccgatgcgcccaaaagcagctaa

SEQ ID NO: 155 - DNA, 1249 bp, Oryza sativa
  misc_feature (686)..(686): n = any nucleotide
  misc_feature (693)..(693): n = any nucleotide
atgaattttagaagttttgagccatttaaatggatttctataattattaatgatttattgcgcaattatcaattattttctcaaaggaaaaggcattcgctgacgtcagcaaggggccggcgccgacaggtgggccccactcgtcagcggcacaaggggcaagcacacggtggactcgatccaccgcggccgaggcggcaccgtggacccggaccacggtccacgggaccgacggcctggatcggcccaaagccgatccaacggccacgggttggcgcggctggggcaaggcacggctctaagccggctgggcaagggggaggcggcagacgggcatcgctcgggatggggcggacgggctcggcctcgatcggcgaccgaggaaggaggagctccggcggatttctggcaaagaggggcggcggccaaggtcctcctcgtccttgcggagctgagggaggcaacggcgcgggtcggcgtcgaccgaagtggcggcgcgacgcggctggagtcggcggcgacggcggagagaggtggttcgcgtggctacggcgctacggaggtggagaggggaaatggagcggtggccgagcttgcccgagcggcggcaacgctggcggtggcggcggcgcagcgcggagacggcggcggcggctgaggcacgcggctggagaacgccggcgagnggcggcnatggggaccggcgtggggagagcggggaaaagcgcagggagctcggggtggagtgggaaacgaaagaggggagcacgagggtgctttatatagggctcggggatggagatcgtgcccgggagaggtgggatcggccggcgacgtggggaggcgaagtggagctcgggatggcaacggttttcacggggcatgggggaaacggcgcggacgtgggcggcgaccgcgcccacgcacgcacgggagagggaaccgcgagaggaaggcggcgacgtggggagcacggggcggctatggcggcggttggggcgacgggaggttggggaagaagatgacaggtggggcctcgggtcccacctgtcggggagagagagaggggaaaacgggcgagggaggtaaagcagacttgagggagagagagccaagcgggccgagggaggtggccggcccgagagggagagaaagggggcgcgcgggccgcgggaaagaaaggagggattgggccgaaaggggcccaaagaaaggaaggaggattttatttgttttcttttttatttaa

SEQ ID NO: 156 - DNA, 1247 bp, Oryza sativa
  misc_feature (45)..(45): n = any nucleotide
  misc_feature (77)..(77): n = any nucleotide
  misc_feature (98)..(98): n = any nucleotide
  misc_feature (173)..(173): n = any nucleotide
atggcggcgccgcgccaccaccacctcgccctcgccgtcgccctngccctcctcgtcgtcatcgccgcggcggcggncgaggggggaccgcgggggangcgggtgctggtgctcgtggacgacctggcggtgcggtcgtcgcactcggccttcttcgcgtcgctccaggggcnagggttcgatctcgacttccgcctcgccgacgaccccaagctctcactccaccgctacggccagtacctctacgacggcctcgtcctcttcgccccctccaccccgctttggaggatcagtggaccaaaattcaattctggaattcatcgatgctggtcatgatatgatcctggcagcagactcttcggcctctgatcttatccgaggcattgcaacagagtgtggggttgattttgatgaggcaatggttattgatcacattaattatgctgccactgatgctgaaggtgatcatactttgattgctggtgatgacctcatccagtcagatgtgatactggggtcaaagaaaattgaggcccctgtattatttcggggaattggacatgcggttaatccatctaacagcttggtcctgaaagtcttatccgcctctccgtcagcatactcagcaaacccaaagtctaagttggcttcccctccatctctcacagggtcggctatatcactggtttctgttatgcaggcaagaaacaatgctcgggtcttgatatctggatcactcgatctgtttagcaacagtctggtgttcagaaggccggtagcaagataaggagaaagctggaaatgaacaatttgtgacagaaacaagcaaatgggtcttccatgagaggggccatctaaaggttggggagacaaatgagcctggcatgtaccgcatcaatgatgacttgctgaaggaatactctgttgagatctacgaatggtctgggaccagctggaagccgtatgttgctgatgatgttcaagttcagttttacatgatgagcccttatgttctgaagacactgtcgactgacaagaagggtgtattttcaacatccttcaaagttccagatgtttatggagttttccagttcaaagttgagtaccagaggcttggatatactggtctctctctttctaagcagcagattccagtgcgcccttacaggcataatgagtatgaaagattcataacttcggcatatccgtactatgctgcgtcgttttcaacagtaagatatacttga

SEQ ID NO: 157 - DNA, 1207 bp, Oryza sativa
  misc_feature (408)..(408): n = any nucleotide
  misc_feature (412)..(412): n = any nucleotide
  misc_feature (421)..(421): n = any nucleotide
  misc_feature (461)..(461): n = any nucleotide
  misc_feature (503)..(503): n = any nucleotide
  misc_feature (516)..(516): n = any nucleotide
  misc_feature (528)..(528): n = any nucleotide
  misc_feature (553)..(553): n = any nucleotide
  misc_feature (564)..(564): n = any nucleotide
atgggtcaagatgaggtggaggtaggtgcggagaagaaggatcaagaactaccggaggtggaggtggtcgaggaggaggaggaggagggatccaagaaggcggcggcgggctgcgactactgcggcgacgcggcggcggtggtgtattgcagggccgacgcggcgaggctctgcctgccatgcgaccgccacgtgcacggcgccaacggggtgtgctcccgccacgcgcgcgcgccgctctgcgccgcgtgcgccgccgcgggggccgtcttccgccggggcccgggcggcttcctctgctccaactgcgacttctccaggcaccgccacggcgggaaccgcgacccggcggcgcggttccaggacggctccacggtgcacccgtacaccgggtgcccttcggcgctngacntcgccgggntcctcgggatctcctactccgacaaggcggcggcggcgancgcggcggccgggggcgacgacggtgggttgttgggccatcngggaggagccccnaggtgctcagcntcgaggatctcatcgtcccgaccanctcctgccatnggattcgagcctctcctcacgccatcttcccccaagaagattcagaactcgccggatgggaaggtgaatgaggaggtcatacgacagctaaccgagctcgccaattcagacggcggcggcgcgcagatttgggctcatcgcgaggcggcgcaggccggcgatcatcagttaccttcatggggaacaacaacacaacacaacactggacatggcaatttcggtactgcaaacagcaatgaggttgcaaccatgccgacgcctggttatgagagaatggtggatgggataacagcgattaccctgcgctaaatgatccgtgcaaggtcgagttcacatatgagcaacctccagccagctcagctgaagcatgtatttcatcatttgttcagatgtctgaactttgccccagcatgagcaatggtagcagcatggaggaaacccaccagacaaaccctggaaatggcacgccaatgcaagttctacccaaaatgccagaatttgttccttgccccgacaggaacttggtcatttctcgctataaagagaagaggaagacaagaagagattcgacaggcaggtccggtatgagtcccgcaaagctcgtgctgatagcaggctgaggattaagggccgttttgctaaa

SEQ ID NO: 158 - DNA, 1178 bp, Oryza sativa
agccggaggaggcggccgagccaaagggcgccgcggcggcgtccccggcccccgtggtggccggggcgaaggtcgcggcggccgcggtgaaggaggcggagctggcgaggacggacagcttcgacgagcaatgcaggtaggccgtgggtgggggtcttgtgctcgtctgctgcgaaatgttggggccttggtaggatctcgcgcgatgcttctggttatttttagcggagcttcacgaatcgaggagacgatgggggaaaagagggtatgtcaacagaagacagaagaacctttggtagaccttgggtgcagatgtcgagaagctgtttgctacacaggcaggttgctgtcaatattccccctccagagacgcaagctagtacaagttattgggtttggagggttgattcagcttatggaaggggccgaggaggacatgaaagggtatttttgggatggtttagccctctgtgggttgcatttgcaattcttattggcggactcttgttggatgttctgatatctgtttctcttggcgtctccgcacttcctgtacgtatgatattttgaggtgttcttatagttctcggcctcggcaccgccctgcggctagctctagagtgctgccaggaatggggctccaggagaagcatgccgaggctgccgatggacggcagcatggcgcccagtggataccaccctggtgtataatagtgagaactaggcgtgatttcggcccagcccatcacgcgcgcgtaggctacacacctcaccagccaccgcgcatcgctcagggccgcggaaaccgtggaagaagaagcggaggacacctacccccacaaatctcgtcgtctcgctcgccggcggccgccgccaccgccaccaccgccgccgcgatgatcagcatcctcgcgcagatctgcgcgcaggagcgcctcctcgggttcgccctgggctccgtctccatgggagggttcgtcctccaccagcggcgcgccatctaccgctccctcgccgacgccgacgctgccgctgccccgtcgcccttctcctcctaccagcagcctagtgaaaccagaagtagaacaagctcaactgaattggctcacgtatggaacaagggagtggatgagactctcggacgacttgttgcatacctcagctctcgtggatggtaa

SEQ ID NO: 159 - DNA, 1149 bp, Oryza sativa
atggtccacgggtcgacggaagcggatcccgtgtgtcaaccgaggcaagtggtcgacaaacggactccactagacaccacacgggctgcacacgtggaaaccacgaggctaccgagcgggcacactaacacggtcaccacacgcacaagcgaacgactaccgacaccagtacacgggtactggggtcgacaaccgcacaacgggcacgggcgataccaaaaggacgaggacgagggcgacgagggagagatccttaccaccacgcgacgaggcgtgggaacgacaacgacgaacgagcgcggcggagacggctcggggacgacggaggcgaacggcgagggaacgacttcggcggcgatccttgcacgaaggcgagacgcggccggcgcaacgcttggtgacgcggaggcgaggacgaagacgatgacggggctgcggcactacgcggaggcgaggacgacgaacgagaacggcttgacggagggacgaacgccacgacgagcgaaaccgggaacgacgagaggacgacgacgacgacgaccggggccgatgaggagacgacgatggcagccggcagcagctgcacagaggcgaggacggcgtggaacacgctgctgtgaatccgacgacggaggcggcgccgtgagacgacgagccgggcgaacgatgggacgtcgatcggcgaggacgaacggtggagacggcgacgtcggccggtggactggcacggcggaaggggctgccggagtgggtgtcgacgagaccgagggagaggcggtgcgggcgacagcgttccggcgaaacagaggagcagccggaggagaggacgacgctgcgacatcgacggaggagacggcgacgtcggtcggcgcacaggagacgcggcagaggcggccggaggcagaacagtggcgacaacgccactgttgccggcgggggcgcacctccgggggtctccgcgcgaaacggagggcaggccgggggagaggaggctgctgcgatgccgagggaggcgacggcacagccgactggcgcgcgggcgaggcggtagaggcggctggaggcggtcggcgcgggggaaagagaagggtgacggcggggaggggtgatacgaccacggggaggctcgggatgaggctaaaacgatag

SEQ ID NO: 160 - DNA, 1145 bp, Oryza sativa
ttggcggaggttaagggcgcccgcggcggttgggccgcggtggtggcggcgaaggtgatggacaggaaggagctggccgggaggaacaaggaagggcgggcgagaaccgagagggagatcctcgaggccgtcgaccaccccttcctcccgcgcctctacggcgtggccgagggggatcgctggtcctgcctcctcaccgagttctgccccggcggcgacctccacgtcctccgccagcggcagccgcaccgccgcttcaccgagtccgccgtcagaggttctacgcggcggaggtggtggcggcgctggagtacatccacatgatggacatcgtgtaccgtgacctgaagccggagaacgtgctcgtccgcgccgatggccacatcatgctcaccgacttcgacctctcgctcaagtgcgacccgacggcgccgacgccggcgcacgtcatctcggaccccatcgccctcgccggcagccactactcggcgtcgtcgtcgtgcatcatcccgtcctgcattgtccccgccgtgtcgtgcttccagctcttccccggacgcgggcgacgccggcgccatcgccgcaagaagaagacagcgagtggtggcggcggcggcatcagcggcagcagcttcccggccggtgggctggagctggagttcgtggcggagccggtggagctccggtccatgtcgttcgtcggcacgcacgagtacctcgcgccggagatcgtctccggcgaggggcacggcagctccgtcgactggtggacgctgggggtgttcgtgttcgagctcctctacggcgtgacgccgttcaaggggtacgacaacgagatgaccctggcgaacatcgtggcgcgcgcgctcgagttccccagggacccgcccgtctcctccgccgccaaggacctcgtcacgtcgctcctcgccaaggacccgacgcggcgcctcggcgccacggtcggcgccgcggccatcaagcggcacccgttcttcagcggcgtgaactgggcgctgctccggtgcgccacgccgccgtacgttcccccgccgttcagcgtcgcggccgccaccgccgccgccgccgccgccgacatgtcggacgatgacagctgccccggcacgcccgtggagtactactag

SEQ ID NO: 161 - DNA, 1120 bp, Oryza sativa
atggcggcgaagctctccttgctacttcccgtcacctgcttcatcctcttcgttctgcatggctgttcatgtggaggcgcgtcccgatcctgccgctttcggcgactccgacaacgggttctacacgctgttcgtgttcggcgattcgttcgccgacaccggcaatctccccaagcgccgactgagcgagcagtcgcgcgaatggtactacccctacggccgtgaccgtggcaacaaccgcccaaccggccgcttctccaacgccatggtccagtccgatctcatcggcacggatgctggggcgtcatgaggcgcctccgacgtacaggagggtggacaactacgtgcacccgcacggcatgaacttcgccgccggcggctccggcgtgttcaagctgccgagcggcgcgccgacgctcgacaagcaggtcgaccacttcagggacctggtgcaggacggcaccatcacccgccggaacctccgtaactccatcgccctcgtcgccgtctccggcaacgactacgcccgcctcgccaacgtcaacgacactagcaagagatgatcaagtttgtcgatgaggtgacgagcgagtatcgcgaagcaggtgcacaggctgaagaacaacggggcgaggaagatcctggtgaacaacctgcaccccgtcggctgcacgccgtgggtaaccaggccgggcaactactccggctgcagctccaccggcaacatgggcgcctacctccacggcagcaacctccaacagaagctctcgcacctcgactacgtccaccatgtcgacctcaacactgccttctccaacatcgtcaatcccgaccaagaggttcgaagcacaaggtgtcgagccagttcgagcacaagatgcagccgtgctgcgagagcttggacccgaacggcttctgcgggcagaagggacacgatggcaaggacctgttcagcgtgtgcaacgatccggagaagtacttctactgggacgatgtgcaccccacggaggctggatggaaggccgtcatgcagcagctggaaggtccaatcaagaaattccttcgaatcaactagaaattgagatgggcgttaattaggtttagagtgttttggtttagg

SEQ ID NO: 162 - DNA, 1119 bp, Oryza sativa
atggatgatccaatgctgaatgcggtgaaggaggaggagagccacggggacggaggagggttggaggtggtggcgggagaggatggggcggcggcggtggcggcgggggtggcgccgaggccgatggaggggctgcacgacgccgggccgccgccgttcctgaccaagacgtacgacatggtggacgacgccggcaccgacgccgccgtgtcgtggagcgcgacgagcaacagcttcgtggtgtgggatccccacgccttcgccaccgtcttgctccccaggttcttcaagcacaacaacttctccagcttcgtcaggcagctcaacacctatggtttcagaaaggtggatcctgatcggtgggaatttgcaaatgagaattttctgcggggacagagacatcttctcaagaacatcaagcgtagaaaaccaccttcccatactgcttcaaaccagcaatcccttgggccataccttgaggtgggccactttggatatgatgctgagatagaccggctgaagagagacaagcaattattgatggctgaggtggtgaagctaaggcaggagcagcagaatacaaaggcaaatctgaaagccatggaggataggctgcaaggaaccgagcagaggcaacagcagatgatggcattcttggcgcgtgtcatgaaaaatcctgagttcttaaaacaacttatgtcccagaatgagatgagaaaggagctccaagatgccatttcaaagaaaagaaggcgtcgcatagatcagggacctgaagttgacgacgtcggcactagcagtagcatagagcaagagtcaccggccttgtttgatccccaggagtcggtggaattcctcatcgatgggattccctccgatcttgaaaactcagctatggatgctggaggtctggtggagccacaggatttcgatgtcggcgcctccgaacagcagcagatcgggccccagggggagttgaacgacaatttctgggaggagctgctgaacgaagggcttgttggtgaggagaacgacaacccggtcgtcgaggacgacatgaatgtgttgtcggagaagatgggttacctcaactcaaatggcccaacggctggggaatag

SEQ ID NO: 163 - DNA, 1105 bp, Oryza sativa
  misc_feature (136)..(137): n = any nucleotide
  misc_feature (141)..(141): n = any nucleotide
  misc_feature (167)..(167): n = any nucleotide
  misc_feature (174)..(174): n = any nucleotide
  misc_feature (190)..(190): n = any nucleotide
  misc_feature (299)..(299): n = any nucleotide
  misc_feature (427)..(427): n = any nucleotide
  misc_feature (444)..(444): n = any nucleotide
  misc_feature (548)..(548): n = any nucleotide
  misc_feature (644)..(644): n = any nucleotide
  misc_feature (651)..(651): n = any nucleotide
  misc_feature (663)..(663): n = any nucleotide
  misc_feature (692)..(692): n = any nucleotide
  misc_feature (695)..(695): n = any nucleotide
  misc_feature (965)..(965): n = any nucleotide
  misc_feature (971)..(971): n = any nucleotide
  misc_feature (1036)..(1036): n = any nucleotide
ccagccgttgcgccgcggcctcggcctcctcgagagctcgctcccgctcggtgagcgcgtcctcgcggaggcggagtgcggactcctcttcggcgcagacggcctcgtgcgccgccagcgttgcctcccggatggnnacgncggcctcgcggtccgccaggtccctntccacgncgcaggcacgctcttncagcgccatggcacgggcctcaagggcttcttcgcgccgccgggatgccacttcggtctccgccgcccgccgttctcgggcagcggcagcgtcaaggaccccccgggcngcgtcgagcttcttccctagctccgcctcccagctcccgtattgaaggcggagggtgtcctgcgcctcgttcatcacggtggtggcgatgagggcagccccccgctcctcctccacctccttggcganctcccccagcaccttcngacgggcttcgagctctgaggcgtgccggcggtgtgccttgcggcccacctccaccatggcctccaccgagcgtcgcccctcttcgacacgcgcccatgcggcntcgagctccgcccgctctgcttgcagggcctccatctgggcacttaacccgtccaacaccgtggtgtttgcgacggccaaggcctgcagaaggggntctgcgntcagtggggcancggaaggcgtgggggagagccgcctcggngangatgccgcgcggctcggcccgccaatggacgcgccggactcggggatgtcccccggacctggttggtcccgagcgtcgcccgagggagtgggccccagcgatgcgcccgcgacctcgtcgcgagctgcctcggaagtcgtcgccgcctcgtcctggtgaaatctgacctcctcccgagcggcttcttcagcttggcgagctcggacggccacctgggcagcttcctcggcttcccgaaggcgatccgcggcctcttgccggtcagtttcncgggtngcctcggaggatgtcgtcgcctcggcctggcggagtccggcctcctcccgagcggcttcctcggnctggcgagcccgggcggcctcccgagcggcctcctcggcttcccgtaggcgatccgcggcttctcgccg

SEQ ID NO: 164 - DNA, 1089 bp, Oryza sativa
  misc_feature (260)..(260): n = any nucleotide
atggccgccgggcgccttttccgccgccgttccccgctccttcccgttggccggctccctccccacgcctataaaatggaatccccatccttcgttctatcgttttagccccttcccgagcctccccgtggtcgtatcacctctccccgccttctccttctctctctccgacgccggccggcctccagccgcctctccctcctcgcccgagcgccgtccggtcgcgccatcgccgccctcggcctcgcagccgcctcctntcccccggtcagccctccgtttcgcggggaaatcaccggagacgtgtcctcgccggcaaaacagtggcgttgccgccactgtactgcctccagccgcccctgccgcgccgctcaggtgcgggccggctgcgccgtctcctccctcggcgtcgccgcgtcgacctccaccccggcctgccctcggtttcaccggaacgccgtcgtccgcgtcggtctcgccctccgcctcgccggagttcctccggcagccccgtccgccgtgcctgtgcgccggccgacgtcgccatctccacccccggcattgcagcagcaaggtcgccctcgccctcgccctcgccctcgcctcccctccacccgaacgccgccggtgtccgtcgtcgtcttcaccgttcatcctcgccggctcgtcgtctcgcggcgccgcctccgtcgtcggcatcgcagcggcgtgttcctcgccatcctcgcctccgtgcagccgctgccggctgccctcgtcgtctcctcgccggccccggtcgtcgtcgtcgtcgtcctcccgtcgttcccggtcgtcgtggcgttcgtccctccgtcaagccgttctcgtccgtcgtccgcgttcgtcaagtgtgccgctgcagccccgtcgtcgtcttcgtcctcggctccgcgtcgtcaagcctcgtgccggccgcgtctcgcctttgtccaaggatcgccgccgaagtcatcccctcgccgttcgtccccgtagttcccggccgcctccgccgcgcccgttcgtcgttgtcgttcccacgcctcgtcgcgtggtggtaaggatccctctccctctgtcacgtcctga

SEQ ID NO: 165 - DNA, 1078 bp, Oryza sativa
atgtcggcctactgcggcaagtacaagggacgagctcatcaagaacgctgcctacattggcactcctggcaagggtatccttgctgcggatgagtccactggcaccattggcaagcgcttcgccagcatcaacgtcgagaacgttgaggagaaccgccgctccctccgcgagctcctcttctgcacccctggcgccctccagtacctcagcggcgtgatcctcttcgaggagaccctgtaccagaagaccaaggatggcaagcccttcgtcgatgtcctcaaggagggtggtgtcctcccgggcatcaaggtggacaagggcacaatcgaggttgccggcaccgagaaggagaccaccacccagggccatgatgaccttggcaagagatgcgccaagtactacgaggctggtgcccgcttcgccaagtggcgcgccgtcctcaagatcggccccaacgagccgtcgcagctcgccattgatctgaatgcgcagggcctcgctcgctacgccatcatctgccaggagaacgggctggtgccgatcgtcgagcccgagatccttgttgatggccctcacgacatcgaccgctgcgcctacgtctcggaggtggtcctcgctgcgtgctacaaggccctcaacgagcaccatgtcctcctcgagggtaccctcctcaagcccaacatggtcaccccaggctctgacgccaagaaggtgtctcccgaggtcatcgctgagtacaccgtccgcaccctccagaggaccgtccccgctgccgtgcccgccatcgtcttcctgtccggtgggcagagcgaggaggaggcgaccctgaacctcaacgccatgaacaagctcagcaccaagaagccgtggtcgctgtccttctccttcggccgtgccctccagcagagcacgctcaaggcctggtccggcaaggcggagaacattgagaaggccagggcggccttccttaccaggtgcaaggccaactccgaggctaccctcggtacatacaagggtgacgctgtcctcggcgagggcgcctccgagagccttcacgtcaaggactacaagtactga

SEQ ID NO: 166 - DNA, 1009 bp, Oryza sativa
  misc_feature (79)..(79): n = any nucleotide
  misc_feature (554)..(554): n = any nucleotide
atggggatggggccactagagaacgccgtggtggacgcggcggcggaggccgtggcggcgaaggccgcggtcggcggcntgggcgtggggggttcgtacgcggtgctgcagtgcggggaggactcggagtacgtgaggaaggcgtacgggggctacttcgaggtgttcagggcgctgctggcggaggacggcgagcggtggcgggtgtaccgcgccgtgcgcggggagctccccggggaggaggaggccgcggggatcgacgggttcgtcatctccgggagctgcagcgacgcccacgccgacgacccgtggatcgtcgccctcgtcgacctcatccgccgccagaacgccgccggcaagcgcatcctcggcgtctgcttcggccaccagcaggtcctgtgccgagcgctgggcggcaagacgggccgatcgaagaagggctgggacatcggcgtgaactgcatccaccccaccgcggccatggcgaggctcttttcgccgatcaagctccccgtccacatgcccatcatcgagttccaccaagatgagaggtntgggagctgcctcctcaggccgaggtgctggcgcggtcggacatgaccggcgtcgagatgttccgtctcggcgaccgcgccatgggcgtccagggccacccggagtacagcaaggacatcctcatgagcatcgccgaccgtctcctccggaacgatctcatcctgggatcaccaggtggataaggcgaaggcgagcttcgacttgcggcaaccagacaaggatctgtggaagaaggtgtgcaggggttttctgaaggggaggcttcagtcatcgcagcagccgcagcagcagcaacatcagaagcagcagaaggcggcgcagctggtgctatagtaaacaagattagtgagtgagatcagatgggggcattggggagcctagattaatccttattttctgcttcagatttgtacaggaaaaaaactatttattcggagcaataataagagagtaa

SEQ ID NO: 167 - DNA, 1007 bp, Oryza sativa
  misc_feature (351)..(351): n = any nucleotide
  misc_feature (623)..(623): n = any nucleotide
  misc_feature (646)..(646): n = any nucleotide
  misc_feature (792)..(792): n = any nucleotide
atggcgaggtgggccattgcgatccacggcggcgccggggtggacccgaacctgccggagcacaggcaggaggaggcgaagcgcgtgctggcgcggtgcctgcaggtgggcgtggacgcgctgcgctccggcgcggcggcgctggacgtcgtggaggccgtggtgcgggagctggagagcgaccccttcttcaactccgggaggggctccgcgctcacccgcctcggcaccgtcgagatggaggccagcatcatggacggccgcggccgccgctgcggcgccgtctccggcgtctccaccgtcaagaaccccgtctccctcgcccgcctcgtcatggacaagtccccccantcctacctcgccttcgacggcgccgagcagttcgcgcgcgaccaggcagggtctagaggtcgtcgacaacagctacttcatcaccgaggacaacgtcggcatgctgaagctcgccaaggaggccaacagcatcttgtttgactaccgtatcccgctgtccgggtcggagacgtgcggcgcacaggccgtgtcgtcggacaacagccacggcaacggcatggtgatgaacggcctccccatcagcatctacgcgccagagacggtggggtgcncggtggtggactccagcggccanaccgcggcggccacgtccacgggcgggctgatgaataagatgacggggcgcatcggcgactcgccgctgatcgggtcggggacctacgcgtgcggcgcgtgcgcggtgtcgtgcacgggggaaggcgaggccatcatccgctccangctcgcgcgcgacgtcgccgccgtgatggagtacaggggcgccgggctgcaggaggccgtcgactactgcgtcaagaagcggctcgacgaagggttcgcggggctcatcgccgtgtccagcacgggcgaggtggcgtacgggttcaactgcaccggcatgttcagagggtgcgccaccgaggacggattcatggaggtcggcatctgggagtgag

SEQ ID NO: 168 - DNA, 999 bp, Oryza sativa
  misc_feature (625)..(625): n = any nucleotide
atggcgtcgcatcgccgcctccgcctccttttgctcgcggcgacgctcgccgccgccgccgctgccgtagccggtgtggaagaagaagaggcgttctgcggagtggagtccatgccggacgcggccacgctgaggccggaccggctcacggtgctcctgagcggctactcggagcggcggctcccgctgctccgcgccatcgccggagcgtacgccgcccacccgctcgtcctcgccgtcgtcgtgctctggtccaacccctccacaccggacagcctcctgtcaagcttcccgccggccgtcaccctccaccgcaccgcctccgcctccctcaactcccgcttcctcccgcacccgtccatccgcaccgccgccgtggccgtcgccgacgacgacgtgctcccggacgccgccgcgctctccttcgcgttcgccgcctggcagcagcgcgcccgcccgggcaccctcgtcgggttcttcccgaggtcccaccacctcgacctggcccgcgggaagtgggcgtacggcgcggcggcgcggcagcaggcgcgctactccatggtgctcaccaagctcctcgtcctcggcgcgggcctcctccgcgagtactcctgctcgccggagntcgccgcggcgcgcgccgtggtggaccgggagcgcaactgcgaggacatcctgatgaacttcgtcgccgccgaggagtccggcgaggggccggtgctggtggaggccggcagcatcagagactggggcgacccgaggaacgacgatgccgacgccggcgccggcgccggtggcgaggagatgaaggccgtcggcctgagctcgacggggggcgcggcgcactgggagaagagaggggattgcatcacggagttccaccggctgctgggaaggatgccgctccggtacagctacgggaaggtggtggcggcggccggcggcgagcaggcgctgtgcagcaaacgcggccgcctcgtccggtgtgaccaggagtag

SEQ ID NO: 169 - DNA, 993 bp, Oryza sativa
  misc_feature (438)..(438): n = any nucleotide
  misc_feature (468)..(468): n = any nucleotide
  misc_feature (470)..(470): n = any nucleotide
  misc_feature (474)..(474): n = any nucleotide
  misc_feature (708)..(708): n = any nucleotide
  misc_feature (717)..(717): n = any nucleotide
atggcggcggcggcggcggtgctggtggtgtgcgcggcggcgttggcgtccgccgcgactccgccgaagccgagcagcatggtggtgatcactccgacgaagcagggaggagtggggaagcgaaacagcgcgttcacgtgcgaggacacccggcggcggcggcccaagtgcatggcgacgtgccccgaccggtgccggaccaagtgcctggtcctctgccccacctgcaagaccttctgcctctgcgacttctacccgggcgtctcctgcggcgacccccgcttcaccggcggcgacggcaacaacttctacttccacggcaagaaggaccgcgacttctgcctcctctccgacgccgccctccacgtcaacgcccacttcatcggcaagcgcaacgccgccatgtcccgcgacttcacctggatccaggcgctcggngtcctcttcggcgcccgccaccaccgcctngncctngccgccgcccgcgccgcgcgctgggaccccgccgccgaccacctcgagctcaccttcgacgacgaccgcgtcgacctgcctcgccacgacggcgcgcgctggtcgccgccgggagccccggcgctgtccgtgacgcgcaccgcgccggccaatggcgtggtggtggagctccggggcgtgttccgcatcgtggccagcgcggtgcccatcacgcgggaggagtcgcgcgcccanaactacggngtcgccgacgacgactgcctcgtccacctcgacctcggcttcaagttcgaggcgctcaccgacgacgtccatggcgtgctcggccagacctaccgctccgactacgtcaacaccctcaacgtcacctccaacatgcccgtcatgggcggcgccgccaacttcctcaccaccgggctcttcgccaccgactgcgccgtcgctcgctttgccaaacctgccacggccgccgccgccggcgccggcatctccttggtcaccgacgccaagtacgtgtag

SEQ ID NO: 170 - DNA, 940 bp, Oryza sativa
atggccggcacgtgcgcgcacgccgagttcttccgcgcgcagccggcgtgggcgctggcgcttgcgggcgtcggcctcctcgccgccgcccgcgccgcgctccgcctcgcgctctggctctacgccgcgttcctccgcccggggaagcccctgcgccgccgctacggcgcctgggcggtcgtcacgggcgccaccgacggcatcggccgcgccatggcgttccgcctcgccgcctcggggctcggcctcgtcctcgtcggccggagccccgacaagctggcctcggtctccgaggagatcagggggaggtaccccagggtggaggtgcggacgttcgtgctcgacttcgccgccgacggcctcgccgccggggtggaggggctcagggaggccatccgtgggctcgaggtgggcgtgctcgtcaacaacgccggtgtctcgtacccgtacgcccgctacctccacgaggtggacgaggagctcatgcgcaccctgatccgggtcaacgtcgagggcctcacgcgggtcacgcacgccgtgctcccggccatggtggagaggaagcgcggcgccatcgtcaacatcggctccggctcctcctccgtcatgccgtccgatccgctctactccgtctacgccgccaccaaagcgtcaggtgcccttgtatgtggcaacaaagatggcctctatcaggaaatcctcgttctttgtcccatccgcggacacctacgcccgtgctgccattcgtcacataggctatgagccgaggtgcacaccgtactggccacactctgtaatgtggttcctgatctccattctccccgagtcactcattgacagcattcgcctgggaatgtgcatcaagatccgcaagaaggggcaagccaaagatgctaagaagaaagcgcagtgatgcttcagattagtcattcttgtttga

SEQ ID NO: 171 - DNA, 931 bp, Oryza sativa
  misc_feature (21)..(21): n = any nucleotide
  misc_feature (38)..(38): n = any nucleotide
  misc_feature (44)..(44): n = any nucleotide
  misc_feature (146)..(146): n = any nucleotide
  misc_feature (218)..(218): n = any nucleotide
  misc_feature (714)..(714): n = any nucleotide
  misc_feature (725)..(725): n = any nucleotide
  misc_feature (754)..(755): n = any nucleotide
  misc_feature (760)..(760): n = any nucleotide
  misc_feature (789)..(789): n = any nucleotide
  misc_feature (802)..(802): n = any nucleotide
  misc_feature (806)..(806): n = any nucleotide
  misc_feature (905)..(905): n = any nucleotide
atgggccggccggcccaaaangcggcccagagcgcgcntgggangggaggagagagggagccggtggaccgggctcacctcgcgtggtcccgggtgggacccgcttgtcagcggctcggctcaccatgcggagggagtatgcggcntgcgctagggtttggggaagagacgcggtgcacgcgcgcggttcgcggaggacgcggatgcggcgggcccangcgcagcctcacggctcgcggtggatcgcgcccgcgagcggggccggagggagtggctgaccggggtcggctcgacccggtcttggccgagctggcgccgacgtggcgcctacgtggctgccacgcgggccggcgggagacaggcgaaagcgagcacaccgggtggttgcacgagacgaggggagacgagccaacggctcggattcgccggaggaagcttgacggcggtgaattgcggcggcggcaaccggtggcggaagaagggggaaacggcgacgaggtcacgaggggccgattcccggcagcgagagcatctacgcggctacgggaatccgtccctagcgtcggattaggaggaaacgcatcgagggaggccagcgacgagaggcgctttcgagctcgggcggcgacggcggcgagcacgtggcgagcggcggcaacggtcggggcggcgccggctagctacggggaggctactcgtgctactacccgacantaccgtgcggncgggcgcagtgacgaggccgacggcgcgnnacgtnatcgtcggcctcgggccgaggaagaggangaagagggcgcgnccgnagtccccttccgcgtccttgctcgtgccggctcctccgacacgcgcaacgacgaacggcgacggcgaacagagcacgggaggcggcggcaatggcgtgnagagggcggcaatgtcggtttgaaac

SEQ ID NO: 172 - DNA, 900 bp, Oryza sativa
  misc_feature (367)..(367): n = any nucleotide
  misc_feature (400)..(400): n = any nucleotide
  misc_feature (541)..(541): n = any nucleotide
  misc_feature (550)..(550): n = any nucleotide
  misc_feature (633)..(633): n = any nucleotide
  misc_feature (658)..(658): n = any nucleotide
atggccggcgtggcgtgcgtgttggtggtgggcgtgctgtggctgagcgccgggcagtcggcggcgtgcgacgggcacccatgcccgacgccggcggggaagtgcccgataaacacggtgaagctgggggtgtgcgccgacgtgctggacgggctcatccacgcgtccacgccgcccaaggagccctgctgcccgctcatcgccggccttgccgacctggacgccgccgtctgcgtctgcctcgccatcaacgccaaccttctcggcctcaacctcgacgtccccgtcgacctctccctcctcctcaactactgcggctgcaagctccctgctggcttcacgcgtggcggttgctggaggggaggcngcgggcaacgggctgcggcggcgccctcccctncgccggatccggcgggaggggaggcgcggcaggcggtggcgcaagaggggaggcggcgggcgaagggttgcggcagcggctggcgcatctctctcccacagctggtggctgcctggcggaggcagcggcggcgacggccgngccttcccntccgccagatccggtgggaggggaggcggcgagctcccgcggccggcgcgctgcctaaggcagcggcggcggcggctgtgccntcccatccgccagatctggcgggangggaaacgccgagctcccgcggcgggcagctgcctgggacagcggcggcggcggctgcgccctcccctccactagatcctgcggaaggggaggcggtggggaggcggcgagctcccgcggccggcggctgcctggaggaggcagctgcggcgcaccacagcggcggcggccgtgccatagcggcagatctcaaggggaagaaggccggaggcaacccaagggagaaggacgaaggttcttga

SEQ ID NO: 173 - DNA, 884 bp, Oryza sativa
  misc_feature (183)..(183): n = any nucleotide
  misc_feature (192)..(192): n = any nucleotide
atggactgggcggcgcgccgctcgctgctcctcctcgccgtcttcgtgccgccctacctcgcctacaggctcgcctcctcggcgctaaccgccgcgtcgccggaagacttcgccggcaaggtcgtcctcgtcacgggcgcctcgtcggggatcggcgagcaggtcgcgtaccggtacgcgcgnaggggcgcncggctggcgctggtggcgaggagggaggcgagcctgggggaggtggcggcgagggcgagggcgctcggctcgcccgacgtgctcgccgtccccggcgacgtcgcgaggcccgacgactgccggcgcttcgtccaggccaccgtcgaacacttcggccgccgtggatcatcttgtgaacaatgctggcttggccaacgtgtgctggtttgaggaggtgccagatctgcaggatgtgaacttctggggtacggttcacccgacgcacgccgctctcccccatctcaaggcgagccgcgggaagatcttcgtcaactcctcggcatcggctgtgctcgccatgccaaggatgagtttctacgctagcaaggccgcggtgcacaacttcgccgagacgctgcggatggagctccacggcgaggtcggcgtgacggtggcgacgccggggtgggtggactcggagatgaccaaggggaagcacctgtccagccatggcgcaataaggtcgtcctcatcaccggcgcctcctccggcatcggcgaggcttacgagtacgcgaggaggggggcgtacctggcgctggtggcgaggagggaggagagcctccgggaggtcggcgacgcggcgctggcggccggctcgccgggcgtcctcgtcgtcgccggcgacgtctccagccccgacgactgccgcaa

SEQ ID NO: 174 - DNA, 864 bp, Oryza sativa
atgggagcctgcttttcctacgtggacccacaggggcatcagcgcagcctcgcgtacggacaaaccggccttttaactacatcctgctccacccaaaccctcacaggcaggtgggccatcactcacgtgggacccaatatccagtggcaccgacgtggaagagcaaagccgtccacgcaagctatagcttttgtcgctggcggttgggccccgccggtcagtgacccaggggtggccgcggccgtgtggttaaatcgtttcccttttccgcaccggccgcctctccctctcctcctcacctggcgcgccgaagcttctctcctctctctcaactccggcgagaggaggaggcggcggtggggcgttcgtcgggagagagaccagggccggggggctagggttcggccgttcagagaggcggcggctgaggaggaggaggaggaggaggagggggtgaggagagatgtcgacgccggcgaggaagcggctgatgcgggacttcaagcggctgcagcaggacccgcccgccggaatcagcggcgcgccgcacgacaacaacatcatgctctggaacgccgtcatattcgggtcccaacaaaccaccagttgttcggtttgtctcaaggatgtttcacccaaatagtttatgcagatggaagtatctgcttggatatcctacaaaatcaatggagccctatatatgatgttgctgcgatattgacctctatccagcagtccctgctctgtgatccaaacccaaactcccctgcaaactccgaagcagccagactgttcagcgagaacaagcgcgagtacaaccgcaaagtccgcgagattgtggagcagagctggacggccgactaa

SEQ ID NO: 175 - DNA, 841 bp, Oryza sativa
atgggcctcctgagcttgctgctcgtcgtcgtgtcctgcctcgccgcgccggcgacggccgactggtacggcccgctcgccgtctactggggtcgccacaaggactacgagggctccctgagagaggcctgcgacaccgggccgctacaacaccgtcatcatcaccttctacagcgtcttcggctacgtcaagggcaggtacggcctcgacatctccggccacccggtcgccgccgtcggcgccgacatcaagcactgccagtccaagggcgtccaggtcctcctctccatcggcggccagggcggcgggtactcgctcccgtcatcccagtcggccgccgacgtcgccgacaacctctggaacgcctacctcggcggccgccgcgccggcgtgccacggcccttcggcgacgcggcggtggacggcatcgacttcttcatcgaccagggcggcgccgaccactacgacgagctcgcccggcagctgcacggccgcggcgtggcgctgacggcgacggtgaggtgctcgtacccggacagccggctgcagaaggcgctggcgacggggctgttggggcggatccatgtccggatcttcggcgacaaccagtgcaccatgttgccgttggacgcgtgggagaagtgggcggcggcgtacccgcggagcaaggtgtggctggcgctggtggcgtcgtgggagcaggacgaggtcgggtacatgttccaaaaggacctctactacggcgtgctgcagttcatcctcaacaagcccaactatggagggatcgccatctgggacaggtactacgacaagaaggccaattacagtggtgagggctaa

SEQ ID NO: 176 - DNA, 771 bp, Oryza sativa
  misc_feature (295)..(296): n = any nucleotide
atggctgccgccgccgccgcagcagcagtacccggcgacgccaagctagactccttcctccaatggctccagaacggcgccgacctccgcggctgcacgatcgaggtggtgatggtggtgccgctcgatctcgccatcactccgatgcgggtgctgcaggacccgctcgtcgggccgcggtgccgcgcgctcttcgaggaaggtggcgtcgacgaccgcctcctcgtcatgctcttcctcatggtcgagcgactccgccctagctccctctggaagccgtatgtatttggatatnnttccaagcaccttcggaagctccatttggttcaccgaagatgagcaaactcaatattctggactcgagcattgaatataccattgcctcgtttttatgtttttccggaatcactagacgaaaagcgggccaacattggtgatgattgtgatttgggttgagggccttgtccctggaatcgacttttgtaatcatagcaacatgggaagttgattccatgggacatgttactggatgtccttcttcaatgtaccttgtactaggaactactatacctctatggatttgtaattgacaacaatcctgacgattatctcatggtaacactcacagattcattatccagtagaagctcttcgacaggttcaatctgctgatattaagatgaagctactggagatacagcggagtgctatatgggaggtcagtggtgataatggagcactgagtttgcttgtggatcttcttagagtcaa

SEQ ID NO: 177 - DNA, 767 bp, Oryza sativa
  misc_feature (215)..(215): n = any nucleotide
  misc_feature (223)..(224): n = any nucleotide
  misc_feature (232)..(232): n = any nucleotide
  misc_feature (240)..(240): n = any nucleotide
  misc_feature (245)..(245): n = any nucleotide
  misc_feature (262)..(262): n = any nucleotide
atgggcagcagccacgccggcggcgagatgtgcatggaaggcggcggcggcggcagggcgaggcgcgcgggggggaagaaggcggcggcggcggcggcggcggagcagcagcacaaggtcgccaagcaggccgcagcgcggggttcggcgttgcgcagctggagaagatccgccttcaaaaaccagatggttggccgccctacggttcgccgccngcggcgannagccgtantatccgcngaagnagcagccacagccgttngcctcgccgcccttccacttgccgccgttgcagcaggattgctacgaggcggcggatcaccggaggattgccgccggcggcggcgtgcagccgtactacgagggcatgctgccgtacggctccggccggctggcggcggcgtcgccggcgttcgtggcgtatgaagtgaagggtgatcatcaccacggccagtatggctcgtcggagcagcagaggcagccgcagtactactcctggatgagctccagctacgacggctactccggcggccggagcagcgccgggagctcgtcggaggagctggatttggagctgagattgtagtagctgatggattaacctatagtttattacagcaattttttactactgcatccaccccacaccatctcctccaatgcggcgaaggtggacggcgggcacgcgaggcgacgacgggcaggcggagaacagcgagcggcggcggcggcgccgagccttgccacgcgagccggcggccgcggcg

SEQ ID NO: 178 - DNA, 756 bp, Oryza sativa
atgtccgagacggattcatcggcggcggcggcggagggtcggaagccgaggcggctgcgggggcacaagaagggcgccgtcacctgctgcgtcgcctcctcctcccgcccgggcgtcgtcgcctcctccggcgaggatggatgtctttgctggtttgatttgcgtacgaaggatgtgcttttcaccatggaggcgacaaatcaaccaatttcttctgtgtgtttcaaagcagtatgcctctgctggaaatgaaattttatctttcgatgttcgaatgaagccattggacacttataactacaatagagatgaaatcaatcagcaaaaaagcctgtacaaaagattgagtataagatttgcagcagtgtacaattcattccttggagaccttggacagattactggaggccttgattcaaagcttgctgtgtgggatttctccaaaagggcgaacactgttttctatagattatggggcaatgtttcaatcctccttttgttcactcaatagcagtttctgaagagggcatcttgggagggtcgtacaaagagaaggggaagtttcttgtttctggtggcaatgattcatcaattaaattatgggattggtccaaagggttctcctctgaaacaaacaacagtgctgaattggtgttggatataaaggtgaactggttgtgtactactccgactgattcagataacctgattgtgtgtgacacatccaaggtggtcaaagtttacaatctaccttag

SEQ ID NO: 179 - DNA, 708 bp, Oryza sativa
  misc_feature (364)..(364): n = any nucleotide
atggacgactcccacgacctggcctccccgacctcccctgacacggcgtcctcgtcgtcttcgtctacgtcgacatcatcgtcctccgccaccgtcgccccgaagaagcggccgcgcaacgacggccggcacccgacgtaccgcggcgtgcgcatgcggagctgggggaagtgggtgtccgagatcagggagccccgcaagaagtcgcgcatctggctgggcacgttcgccaccgcggagatggccgcgcgcgcgcacgacgtggccgcgctcgccatcaagggccgcaccgcgcacctcaacttcccggacctcgcgcacctgctcccgcgcccggccaccgcggcgcccaaggacgtgcagnctcgcgctgctcgctgttcgacctcccggacctgctcctggacctgagatacgagacgtcctcgagcctctcgtgcggggcgtcgtgggccgtcgatgacgacgtggccggcggcgtcgtgttccgcctcgaggagcccatgctgtgggattactgatcaatgtggctgctcatgggagccagtcatgcttccgtgtattagatcgatcagtggcttgtacatggcggtgcttctttctcttcttctttactctgcttctgctctgtgttctctttcttcttttctccctttgtattttgttttttttccttccattttttcttcttttctttgccaaatctag

SEQ ID NO: 180 - DNA, 699 bp, Oryza sativa
aaatcgaaacccctctctttgatctcgtcgccgaggaattaggaggagagagagcaatggccgccgaggagggagtcgtgatcgcctgccacaacaaggacgagttcgacgcccagatgaccaaggccaaggaggccggcaaagtgggtcataattgacttcactgcttcctggtgtggcccttgccgcttcatcgccccagtgttcgctgaatacgccaaaaagttccctggtgctgtcttcctgaaggttgatgttgatgagctgaagaggaagttgctgaaaagtacaatgtcgaggcaatgccgaccttcctattcatcaaggatggtgctgaggctgacaaggtcgttggcgccaggaaggatgacctccagaacaccatcgtgaagcacgtcggtgccactgctgcatctgcttctgcctaagaattctcgcaggcgcaagttatcaaataagggccagcacctggtgttgtagtaggtattagcgttagtcatcgttatcgtcagtttggcttgggtgtcctcgaatatcatgcgaaatcgattccgagttctctttttaaaattcctgatgatgatatatagtttgtggaaatttggatctggctattctgtacgagtttgctgactattaaagcaattattataatatgatgatgctggcaagcttgtagatagcttgaatttgtcctga

SEQ ID NO: 181 - DNA, 690 bp, Oryza sativa
  misc_feature (93)..(93): n = any nucleotide
  misc_feature (229)..(230): n = any nucleotide
  misc_feature (363)..(363): n = any nucleotide
gtctactacaccacggtgttcgtcgccgtggcccggtggctggggctcgccacggcggccggggccgcgaacgccgcggcgatcaccgccctngccgccgcctgcgtcgccacctacgccgtcgccgtgtgccgggacccgggccgcgtcccgccctccttcgcgcccgacgtcgaggacgccgagagccccctccacgagatcaagcgcaaggggaacttgagatatnnccagaaatgtggccactataaaccccctcgtgcacaccattgccatgcttgcaaaagatgtgttctaaaaatggaccatcactgtatatggattaataactgtgttggacatgagaactacaaaatatttttnatctttgtattgtatgctgtaactgcatgcttctatgctatggtatacccgctgactttggctttgacagtgctctttggttggcatatctacctcatattacagaataaaactacaattgagtatcatgaaggtgtgagagcaatgtggttagcagaaaagggtggaaatctttatcatcatccgtatcatcttggtgtctacgagaatcttatttcactgggacctaacatattctgctggctttgtccagtatcgactaatacgggaaatggcctccgtttccgtacatcacatgatattccattatctacaccatcgatgtga

SEQ ID NO: 182 - DNA, 679 bp, Oryza sativa
  misc_feature (353)..(353): n = any nucleotide
  misc_feature (368)..(368): n = any nucleotide
  misc_feature (371)..(371): n = any nucleotide
  misc_feature (384)..(384): n = any nucleotide
  misc_feature (392)..(392): n = any nucleotide
gcaggtgcaacggtgcgccgaggacaagaccgtgctgatcaccacctacgagggcaaccacaaccaccagctgccgccggcggccaccaccatggccaacaccacctccgccgccgcggccatgctcctctccggcccggctgccagccgcgacggcgccgccgccgccctgctcggccaccaccaccaccaccacccggcggcgatgttccaccagtccttcccctacgcctccaccatggccaggctttccgcctcgcgccgttccccaccatcaccctggacctcacgcagacgcctgccggaagggcgcggcgccgccagcgtgctgcacgcgctccaccaggcagccntcggtgatggagacngtnaacgccggggttnccgccganccaaaatttacgacggcgtttgcggccgccatttcgtccgtcgttgccggaaggggtcatcatcagggtctgtccaacaaaacccgtggcaacgccgccggcgccggagacggcaacggaaacgggagctccgccgcggccgttgccaccggggccgcctcgccggcggcgacggccgaggcacctgcggcgtccggatcacctcctcggctcgcgacgcagtcctgcaccacgtcgaattgatcgatcacagagacatacgtgacatatatcatatactagtatga

SEQ ID NO: 183 - DNA, 676 bp, Oryza sativa
ttcgtgagcgatggcgtgttctacgcggagctgaacgagatgctgacgcgggagctggccgaggacggctactccggcgtggaggtgcgcgtgacgccgatgcgcacggagatcatcatccgggccacgaggacgcagaacgtgctcggcgagaaggggcgcaggatcagggagctcacctccgtcgtgcagaagcgcttcaacttccccgagaacggcgtcgagctctacgccgagaaggtcgtcaaccgcggcctctgcgccatcgcccaggccgagtccctccgctacaagcttcttggaggcctcgccgtccgcagagggcttgctatggtgttcttcgctttgttatggagagtggtgccaagggttgcgagaggtcattgtaagtggaaagctcagggcccaaagagccaagtccatgaagttcaaggatggttacatgatctcatctggtcagccagtcaatgagtacattgactcggctgtgagacacgtgctcctgagacagcattatcttttgcagggtgttcttggcatcaaggtgaagatcatgctcgactgggaccccaagggcaaggttggcccgaccacccctctgccggatcttgtaaccatccatgctcccaaggaggaggaggagctgcgccctccggtgttgatcgctgaggcttaa

SEQ ID NO: 184 - DNA, 672 bp, Oryza sativa
atggccaagctgatcctcgccaccttcgccgtcgtgttcatggcgctcgccgccacctccctcgccggcgacccggacatgctccaggacgtctgcgtcgccgactacaagtccctcaaaggcccgctgcggctgaacgggttcccgtgcaagaggatagagaacgtgacggcgaacgacttcttcttcgatgggctgatgaaggccgggaacacggggaacgcggtggggtcggtggtgacggcggcgagcgtggagagcctgccggggctgaacacgatgggggtgtccatggcgcgtatcgactacgcgccatgggggctgaacccaccgcacacgcatccccgtgccaccgagatcatcttcgtcgtcgagggctccctcgacgtcggcttcgtcaccaccgccaacaagctcttcacccgcaccgtctgcaagggggaggtgttcgtcttcccgcgggggctcgtccacttccagaagaacaacggcaacacgccggcgttcgccatcgccgccttgaacagccagctccccgggacgcagtccatcgccgccgcgctcttcggcgccgcgccgccgctgccgtcggacacgctggccagggcgttccaggtcgacggcggcatggtcgagttcatcaagtccaagttcgtcccgcccaaatactag

SEQ ID NO: 185 - DNA, 658 bp, Oryza sativa
cgggtcctcgtctcctcgcgccgccgccgccgccgcggacgccgccatgtcgaagcgagagggaggggtgggtcggcggggaacaagttccggatgtcgctgggtctgccggtggcggcgacggtgaactgcgccgacaacaccggcgccaagaacctctacatcatctccgtgaagggcatcaaggggaggctcaaccggctgccgtcggcctgcgtcggcgacatggtcatggccaccgtcaagaaggggaagcccgacctccggaagaaggtcatgcccgccgtcatcgtccgccagcgcaagccgtggcgccgcaaggacggcgtctacatgtacttcgaagcagacaatgctggggtgattgtgaatcccaagggtgagatgaaagaggttctgctatcactggacccattggtaaggagtgcgccgacctctggccaaggattgctagcgcagcaaatgccattgtctagagcttgtttggagtagtagttttcagttctgtgccggatgtgataatgtgctccagttcttttttgtttccaaccaagtttaacctgaacttgaagcaaaccttcagttaaattttcagtgcggattgtgtccttgatgaatggaaaatggcatgtttgcttgtttaccttgctccttttaa

SEQ ID NO: 186 - DNA, 646 bp, Oryza sativa
atgtcagcgacgacgtcacctctggcggcggcggctcagcggctcgggctcgcatgctcgccggcgaacgacggcacggcgacgcgaacggagagcaccaggacgaagaggatgacgcggcgaactcaccggggaagaagcggcggcggagatcgggtcgacgacggcgacggtgctccggcggtcttcggcggcggcgaagcggtggacggggacggcggcgaccttgcgaacccgatggtggcgacggcgaccgacgacggcggctgcaacggcggcgcgacgcggctgaaccgacagcaacgacggcggcgactagggctacgcggaggcggcgctagacacgacggcaggctaaggcaaaggaggcgacggggggttcgggcggcggcggcggcgcgaggaggaagacaggcctgacagacgggccccacctgtcagcggctcagagagagaggagagcggcggctcggcggattgggccggactgggccgagggaaagagagagagagggttttgggccggctttcggcccaaagccaaaagagaacttttaaaacctttttcaatttaaattatttcttaaatgcaattccatttattaaaaatacttccttagctcaaataaatcccagaaaaatctag

SEQ ID NO: 187 - DNA, 621 bp, Oryza sativa
atgacgacgtcggagagggagccgtgcccggaccgcatcctggacgacgtgggcggcgcgttcgcgatgggggcggttgggggcaccgccttccacttcctcaggggcgcgtacaactcccccaacggccaccgcctctccggcggctcccaggccgtccgcatgagcgtcccgcgcaccggcggcaacttcgccgcctggggcggcctcttctccgccttcgactgcgccatggtccacgcccgccagaaggaggacccctggaactccatcctcgccggcgccgccaccggcgccgtcctctccctgcgccagggcccgcgcgccaccgcgacgtccgccctcgtcggcgcctccctcctcgcgctcgtcgagggcgccggcatcttgctcacccgcaccatggccacccttccccaggaggaccacgcctacccgttcccggtggtgccgccgcctgaggaggtctcggcccatgaatcgagccctatcgcatgggttaggggaattttcgggaggaaggaggagaagcctgctgctgctggtggtgaccgcaagtcggacgtgttggagtccttcgagacgcccagccctccaattccatccttcgactacaggtga

SEQ ID NO: 188 - DNA, 608 bp, Oryza sativa
atgccgctgctccctgctgcgaagcggagcgaggtcgtcgcggcagaagaggagcgcgcgggcctgcgcggcggcggcggcagcgacgaggaggacggtggctgcggcatcgacggctcacgcaagaagctccggctttccaaggaccagtccgccgtgctcgaggacagcttccgggagcaccagaaggcaactttggcgcagcagctcgggcttcggcctcggcaggtcgaggtgtggtttcagaacagacgcgcaagaggacgaagctgaagcagacggaggtggactgcgagttcctgaagcgctgctgcgagacgctcacggaggagaaccggaggctgcagaaggaggtgcaggagctgcgagcgctcaagctcgtctcgccgcacctctacatgaacatgtccccgcccaccacgctcaccatgtgcccctcctgcgagcgcgtctccaacaccaataacaactccagcgccgccgccgccgccgaccgccgcggcatcaggactactactgccgcaggcggcggcagcgtcgtcgacaccgccgccgacgggggcatcctctgccaccgcccgatcgccgtccggccgcagcagtcatga

SEQ ID NO: 189 - DNA, 607 bp, Oryza sativa
  misc_feature (19)..(19): n = any nucleotide
  misc_feature (25)..(25): n = any nucleotide
  misc_feature (79)..(79): n = any nucleotide
  misc_feature (94)..(94): n = any nucleotide
  misc_feature (448)..(448): n = any nucleotide
  misc_feature (453)..(453): n = any nucleotide
  misc_feature (456)..(456): n = any nucleotide
  misc_feature (460)..(460): n = any nucleotide
ggccgccttggacgtgctntgcaanaaagccggggtgctgggccgccagaagcgcggcgccaagagcatcgcgtccctngaagccgccgagttngcccgcgtgctgcgcgtcaaagcgctgggcgccgccctcggaatgaagcacgcggcgcgtgccatggtgccccgccgctccgggagcatcgtgtcggtggcgagcgtggcgggcgtgctgggcggcctcggcccgcacgcgtacacggcctccaagcacgccctagtggggctcaccaagaacgccgcctgcgagctcggggagcacggcatccgcgtcaactgcatctcccccttcggcgtggcgacgccgatgctggtgaacgcgtggcggcaggggcagggaggagatcacgcggatgaggatcaggcggcggcgagcgaggaggaggaggtggagaagatggaggagatngtgcngangctngcgacgctcaaggggccgacgctgcgggcaggcgacatcgcggaggcggcggtgttcctggccagcgacgagtccaggtacgtgtccggccacaacctcgtcgtcgacggcggcgtcaccacctccagaaacgtcatcggcctctga

SEQ ID NO: 190 - DNA, 602 bp, Oryza sativa
cgccggtacggcgcgtgggccgtcatcaccgggccgacgtccggcatcggctgcgccatggcgctggagctcgcgcgccgcggcctcaacctcgtgctcgtcggccgtgggctggacgtcggggtggtggtgaacaacgccagcgaggggaggcccggcgcggtgtacctccacgaggcggacgtggaggagtgggtgaggatggcgcgggtgaacgtgtcggcggtgacagaggtgacggcggcggtgctgcccgggatggtggagcggggcaggggcggcgccgtcgtcaacctcggctcagcggcgtcggaggccatcccgtccttccccctctacaccatgtacgcctccaccaaacgtacgtggctcagttctcccggagccttcacgtcgagtatgcgaacaaagggatccatgtgcaatgccagagcacggacacctacgcgcgcgcggcggtggcgtggatcggacgcggcgggccgctctgcacgccgggtggactgctgcaccagctgatgtggtgcatcaccgccgccgtgccggagtccgtcctcgactggatcgtcctgcgcttcaccacctggaacagaggacggtag

SEQ ID NO: 191 - DNA, 594 bp, Oryza sativa
atgtcctcctcatcctcttcgctgctctcctcgctcgccacgctcggcctcgggtactcgatcgccatcgcgctgggattcctcgtcctgctcgcgtcgctcctcctcgcgtcatacttctgcttccgccgcgggggcggcggcgggcacttctccggcgtgctcaccccgagctccagctccagccacctctccatcaccgtcccgcgcgtgctcttcgtcgcggaggggtccgagtcccccgacgcctactcctcgggcgtcgcggccgcgtcgtcccccgtggggctcgaccccgcggccatcgcgtcgtacccgaaggtccccttctacagcggcgccggcgcggacgccgacgccatgtgctcgatctgcctcagcgagtacgcggacggggagatgctgcgcgtgatgcccgactgcaggcacaggttccacgtctgctgcctcgacgcctggctgcgccggaacgcgtcgtgccccgtgtgcaggtcctcgcccatccccacgccggtggccacgccgctggcgacgccgctgtcggagctcgtcccgctctcgcagtacgccgccgatcggaggcgcagcaggtga

SEQ ID NO: 192 - DNA, 582 bp, Oryza sativa
atgacgtcagcgatgacgtcagcaccgacggcggctcggcaacgcatgctcgccggcgaacgacggcgcgaggacgcgaacggagggcaccaacgggtagagggcgacgcggcgaactcaccgagcaacggacggcggcggcgacgaggaagaagcggcggcagtcttcgggtcgacgacgacggcggtgctccggcggtcttcggcggcagcgaagcggtggacggggacggcgacgaccacgcgaacccgatggtggcgacggcgaccgacgacggctgctgcaacggcggcgcggcgcggctgaaccgacggcaacaacggcgacggctagggctacgcggaggcggcgctagacgcgacggcgggctaaggcaaaggtggcggcggatagaggagagctcgggggtgcttataaaggggctagcgagcggcgacgaaggcccacggcgaccggcggcgagaaggaaaggggcgagcgaattggaaagcggcggcggcgcggctcggctagggttcggccggcggcggcgcaaggaggaagacaagactgacaggtggggtccacctgtcagcgactga

SEQ ID NO: 193 - DNA, 561 bp, Oryza sativa
atggcgaagcctagcggcggcggcctcctcgacctggagcaccacttcgccttctacggcgcgtaccacagcaacgccgtcaacgtcttcatccacacgctcttcgtctggcccatcttcctcaccgcgctcctcctcctccacctcgccgccccctccgcgcacgccgcggccgccggcgccgccgtctacggggccttctacctcctcctcgaccgccgcgccggcgccctcgccgcgctcctctgcttcctctgctgggccgccagcgccgccctcgccgcccgcctcggcttctccgccggatggaaggtggtattggtagctcagctgttctgttggactatgcagttcattggccatggtgtttttgagaagcgagcgcctgccctccttgacagtcttgtccaagctttcttgatggctccattcttcgtgctactagagcttcacaagtttgttgggtacgaaccgtatcctggctttcacgccaaagtgcagaagctgattgacgaggcccgcaaggaatgggaggacaagaaagcgaagaagatgacgtga

SEQ ID NO: 194 - DNA, 546 bp, Oryza sativa
  misc_feature (187)..(187): n = any nucleotide
  misc_feature (205)..(205): n = any nucleotide
  misc_feature (211)..(211): n = any nucleotide
  misc_feature (308)..(308): n = any nucleotide
atggaggtgtcccacatggccaattgcagcaacgtctcctcaccggagcagcagccgatgccgccgtcttcggcagcggcgtcgtcgccgtcgccgccgcagcttgactacgacgtggtggtgatcctggcggcgatgctgtgcgcgctggtgtgcgcgctggggctcaactcgatgctccagtgcntggtgcggtgcacccggngcgccntggcggaccccgtcggctgggtggagcaccgccgcgccggcgcggggctcaagcgcgaggacgtcgtggcgctgcccgtcgccacgtacgtcgcctngccggcgccctccgtcgccggctgcgccatctgcctgtcggacttcgccgacggggagagggtccggctgctcccggcgtgcggccaccggttccacgtcgtgtgcatcgacaggtggctcctggcgcactgctcctgcccgacgtgccgccgccgcccctcgccagaggccgacggccacggcgccgtcgtcggagaagaccaccaccatcgcctgcaagttttgactgctgcttaa

SEQ ID NO: 195 - DNA, 538 bp, Oryza sativa
atggccgccgcgccgtccgccacctccgtccacgacttcaccgtcaagaggatgcaagcggaaaagacgtgaacctgagcacctacaaggggaaggttctcctcatcgttaacgtcgcatcccaatggtggcttaactaactccaactacactgagctgagccagctgtatgagaagtacaaggtccaagaggctttgagatattggctttcccgtgcaatcagtttggagggcaggaacccggctccaatgaggagattgtccagtttgcttgcactcgcttcaaggctgagtatcccatttttgacaagaggttgatgtcaacggtaacaatgctgcacccctgtacaagtatctgaagtctaacaaaggtgggcttttcggtgatagcatcaagtggaacttctccaaattcttggttgacaaggagggtcgcgtggtggatcgctatgcgcccaccacctcccctcttagtattgatggtaatgtcctgcactaccacttgcaatctccttttctaacagggctgaattgttag

SEQ ID NO: 196 - DNA, 522 bp, Oryza sativa
  misc_feature (402)..(402): n = any nucleotide
atggcgggcggcggtcctcgtgctcgtcgtcgccgtcctcggagcggtcatggcgggcggcggcggcacatcctcgccccgctctcctcaccgcctgccccaacgccaagcggcggcggcatcctcgggacctggcggcgcggatctggagcgtcctcgccgtcctcctcaacgacggcggcggtggtggcgcgtcctcgcccgccctcaccggtgacagtggcgcggattggagctggagccggagtcgtcggagtggaaggagttcctgctcgggaatcaaggtcggccttctgcacggcgcgcgttctcgtcctcgcatctctgatcgcggctaaaaacgcagttagcgagcggagcgtaaaggtgggtgtgcctcgcttccgtgcagcgagcgccgtncgccgccgaggcgtcggctgcgcggttgcgtggcgccgtcgcgcctcgcgttctggaagacgtgagctgtggcatgctggcaatcgcccgctatccgtggtaaccccatttcattggtaa

SEQ ID NO: 197 - DNA, 518 bp, Oryza sativa
  misc_feature (334)..(334): n = any nucleotide
  misc_feature (358)..(358): n = any nucleotide
atgcggacgccgcctacgagttcgagggggcgaggctgccccagtggcgagttgggggcggcagcatcctccgcttgcgccctggggccccgcaagccgccgacgcccccatcctccgtgcggcgggggccagcgcaggtcaggggaaccacgcggcgccggcgatgtcctcctcatcgtcctcccccttggcatcgcccttccccgttgcgccgtcgccgccgccaggctggtttcggcagatcgcggaacggccgcctccactttcccgccctgctgatcgaggtgccggcgaggatcagccgccgcccgacccacttcgcccctcggatcngcccggcgttgcccgcttcgaatngcggttcaacctgccgttgttcgcttcggccggcgcccatgccgctccgccagtttggagagcgagagaagagggagggagaggatagagagggatagagaaatgggaggatggcgtgtgggtcctcatgggcccaccattttttattgtttgtgtgtga

SEQ ID NO: 198 - DNA, 516 bp, Oryza sativa
  misc_feature (363)..(363): n = any nucleotide
  misc_feature (366)..(366): n = any nucleotide
atgggagggagcaaggatgagcagcaagacagggggctcttctccaacctgatgcacggcgtcgccggcggcggcggcggccatggctatccgtaccctcctcagcaggggtactacccgccgccgcccaccgcgtatcctcctcctcctccggcgggacaaagaacggtggaattctgttcgtacaattttaatcgttttgaggactccctgaatggttttgcaggtaaccatggcggaggaaacatggggatgctagctgcaggtgcagccgctgccgcggcggcgtacggcgcgcacaagctttcccacggtcatggccatggaggctacggctacggtggccaccacggcggcctcttnggnggtcaccatggccaccacggcggcttgtttggaggccatcacggacaccacggcggcggcctcttcggcggccaccacggccaccatggcggcttgtttggcggtcaccacggcttcggtggccaccacggacaccatggccaccattga

SEQ ID NO: 199 - DNA, 506 bp, Oryza sativa
  misc_feature (369)..(369): n = any nucleotide
atgtcttccacgttcaacggcgacgagttcgccccgttcttgggcttcatcggcgccgccctcgccctcgtcttctcattttgcaggcatgggggcggcgtacgggacggctcggagcggcgtcggggtggcgcacatgggggtgatgcggccggagctggtgatgaagtcgatcgtgccggtggtgatggccggagtgctggggatctacggcctcatcatcgctgtcatcatcaccaccggcatcaacccgacggcgatgccgtactaccacttcgacggctccgtccacctcgccgcggggctcgccacggggctctgcgccctcgccgccggcctcgccatcggcgtcgtcggcgacgcccggcntcagggccaacgcgcagcagcccaagctgttcgtcggcatgatcctcatcctcatcttcgccgaggcgcttggcctctacggcctcatcgtcggcatcatcctctcctcccgcgccggccagtcgcgcgcccactaa

SEQ ID NO: 200 - DNA, 504 bp, Oryza sativa
atggactggagcgcggtgacggcggaggacctggtggacgcgctgcgggaggtggactggtcgacgccgccgcgccccgtgccggagttcttctcccgcttcaccgtcccccgctcctactccaagtggaccagccgcctcaagtgcaacctctactagtacccggttgctatacttgcagcctttatgactggaatcagcattgcatttcttaatgacagagctttgcagtcactttcaatgagaaagtcacgaggactgtcagacaattttcaccacatttagctgcaaaaatgaggccaccaataaccctgttcttcgtggtagaccaagttcaaagaggtcgattcatatttgtgggcgacctcgctggctatttgtgctgttattttctgcaggcaactctgcttcatgctagcttcagaacacctaatctgaaagcacgtctgaatacattcagagaagaattccgagctgtttggaggaattatagtgagctttaag

SEQ ID NO: 201 - DNA, 501 bp, Oryza sativa
  misc_feature (1)..(1): n = any nucleotide
  misc_feature (67)..(67): n = any nucleotide
  misc_feature (445)..(445): n = any nucleotide
ngtgtacccggcgctcggcatcgtgaagcgcgagggcgggggcgaggccgccgggaggatcgggctnaacctcggccgccggacctacttctcccccggcgacatgctcgccgtcgaccgcctcctcatgcgctcccgcctcggcggcgtgttcggcctcggcttcggcggcgcccaccaccagccacctcgctgccaggccgagggctgcaaggccgacctctccggcgccaagcactaccaccgccgccacaaggtctgcgagtaccacgccaaggcctccgtcgtcgccgcctccggcaagcagcagcgcttctgccagcaatgcagcagaggtttcacgtgctcacggagtttgatgaggccaagaggagctgccggaagcggctggcggagcacaaccgtcgccggcggaagccgaaggacgcggcggcggcgccggtanccgccgggaagaagcctagcggcggcgccgccaggtcttacaccggtgacaacaga

SEQ ID NO: 202 - DNA, 491 bp, Oryza sativa
atgtcggactctgaggagcaccatttcgagtcgaaggccgacgctggggcgtccaagacctatccccagcaggccggaaccatccgcaagaatgggtatattgttatcaagaaccgcccctgcaagaggtggtggcaggtttctacctcgaagactggtaagcacggtcatgccaagtgtcactttgttgccatagatatattcaatggtaaaaagcttgaggatattgttccttcgtcccacaactgtgatggttccacatgtgaaccgcacagagtaccagctgattgacatatcagaggatggattcgtgagccttcttactgagagtggtaacactaaggatgatcttagactcccaactgatgacagtctcctgggtcagtcagatcaagactggatttggtgaaggcaaggatcttgttgtgactgtcatgtccgccatgggggaggagcagatctgtgcgctgaaggacattggccccaagtaa

SEQ ID NO: 203 - DNA, 486 bp, Oryza sativa
atgtcgctgatccgccgcagcaacgtgttcgaccccttctccctcgacctctgggaccccttcgacggcttccccttcggctccggcggcagcagcagcggcagcatcttcccgtccttcccgcgcggcgcctcctccgagaccgcggccttcgccggcgcgcggatcgactggaaggagacgcccgaggcgcacgtgttcaaggcggacgtgccggggctgaagaaggaggaggtcaaggtggaggtggacgacggcaacatcctgcagatcagcggcgagcgcaacaaggagcaggaggagaagacggaccagtggcaccgcgtggagcgcagcagcggcaagttcctccgcaggttccgcctccccgacaacgccaagccggagcagatcaaggcgtccatggagaacggcgtgctcaccgtcacggttcccaaggaggaggccaagaagcccgacgtcaagtccatccagatctccggctag

SEQ ID NO: 204 - DNA, 469 bp, Oryza sativa
cccccaatcgccgggaacgcccgcccatggccgccggccgcctttatcgccgccgttccgacctcccccgtggctggctccctctcctctcctataaaatgcaaccctctcgctccgttctatcgctttagccccctcccgcggtctcccgtggtccctagccacctccccaccgtcgccctctctctcccgtgccgctggacgcctccagccgcccctaccgccttgcccgtgcgccggccggccgcgccgttgcctcctccagcgtcgccgccacctcctccaccccggcctgccctccatttcccgcggagacccccggagctgcctttccgccgtcgcccttctctttcctccgtgccggccacctccagccgcacctcccgcctcgcccgtgcaccctccggctgcgccgccacctctcccggcgtcgcagctgccccctctttcccggcttcgcctccgtttc

SEQ ID NO: 205 - DNA, 467 bp, Oryza sativa
agggcgccggcgggttgggaggaggccggcggggagctcctcctgcgtggccgcgagctccgcgtcaaagggtggtgggtgctgccggtcaaggcgcaccacgccgcggggcggctgacgggcgccgcgtccgccatgcttgccatcgcagcctgcgggaagcctctgcagcatggcgccgttgcgcggggccaagcgccggagaagaaggctacaatggcggcggccgctgcggcgggagcagattgcgaggcggatcgacgccgacggcgcgccgggggagagcacagcgctgcgggcgcgctcctacggctgcatccgggtgttcctcgtcctatccctgctgctgctcgccgtcgaggtcgccgcctacctctaggggccttgctcccccggccgccgcctacctcggccaggaggacgggggagctccgttttcgtacccagccaccgcgaccccatcttga

SEQ ID NO: 206 - DNA, 462 bp, Oryza sativa
atggcgcccaaggcggagaagaagccggcggcgaagaagcccgcggaggaggagcccgcggcggagaaggccgagaaggccctggcggggaagaagcccaaggcggagaagcgtctccccgccggcaaggccgagaagagcagcggcgaggggaagaaggcggggcggaagaaggcgaagaagagcgtcgagacctacaagatctacatcttcaaggtgctcaagcaggtccaccccgacatcggcatctcctccaaggccatgtccatcatgaactccttcatcaacgacatcttcgagaagctcgccggggagtccgccaagctcgcgcgctacaacaagaagcccaccatcacctcacgggagatccagacctccgtccgcctcgtcctccccggcgagctcgccaagcacgccgtctccgagggcaccaaggctgtgaccaagttcacctccgcttag

SEQ ID NO: 207 - DNA, 441 bp, Oryza sativa
gggaggggagggtcggcggggaacaagttccggatgtcgctgggtctgcctgtggcggcgacggtgaactgcgcggacaacaccggggccaagaacctctacatcatctccgtgaagggcatcaagggccgcctcaaccgcctcccgtccgcctgcgtcggcgacatggtcatggccaccgtcaagaagggcaagcccgatctccgtaagaaggtcatgcccgccgtcatcgtccgccagcgcaagccgtggcgccgcaaggacggtgtctacatgtacttcgaagtttgcagataatgctggagtgattgtgaatcctaagggtgagatgaaagaggttctgctatcactggacccatcgggaaggagtgtgctgacctttggcctaggatagctagtgcagcaaatgctattgtctgagcttgtttgaatgaattgtaa

SEQ ID NO: 208 - DNA, 423 bp, Oryza sativa
atggcggcgatgctggtgggcatggcgtcggcggcgacctacaacgtgggcgagccgggcggcgcatgggatctcgtgttcaagtactctgctcagcggcacgacgtggtggaggtgaacaaggcgggttacgactcgtgctccacctccacctccatcgccacccacaccaccggcaacgacgtcatccccctcacctccaccggcacccgctacttcatctgtggcttccccggtcactgcaccaccaccggcaccggcaacatgaagatccagatcgacgtcgtgcaggcagattcctcctccgccccggcgcctgtggccaccactactcccccttcgccgccctcctccgccgccacctccctcaaggccaccgccgcagctgccgtcctactcgccgccctcctcatcatggcttaa

SEQ ID NO: 209 - DNA, 415 bp, Oryza sativa
  misc_feature (247)..(247): n = any nucleotide
atgaggcggggcgctgtgacgagaggccgacggcacgggagtgatctctccggcctcgggccggggaagaggaagaagcttgccactttgggaaaaggaggagggggccgggtcgatgacgacggcgatgacggcggggcggtttggagcggagcggcgacacggacggcaggcgtgggcaggtgcggcagaggctgacggcggcggcgaccaggcggtcggccaccacggcacgcgcgcgcgggcnacagcaacgggcggcgcggcgatttgggcggcatcggcgggggaacggcaggagggctcggcgcggctcacgggcagagcggggagagagagagagagagagccggggagggagggggagatgggccgagagggattcggcccatcgaacccgagggaggcaaaatag

SEQ ID NO: 210 - DNA, 402 bp, Oryza sativa
atggcgtccaaggcgttcgctctgttcctggccgtgaacctcgtcgtgctcggggtggcaagcgcctgcggcggcagcccgtcgtgcccgacgccgacgccgtcgaccccgaaaccgtcaacgccgaagccgacgccgtcggctttcgggaggtgcccccgcgacgcgctgaagctgggcgtgtgcgccaacgtgctgggcctgatcaaggccaaggtgggcgtgcctccggcggagccgtgctgcccgctgctggaggggctcgtcgacctcgaggcggcggtgtgcctctgcacggccatcaggggcaacatcctcggaatcaacctcaacctccccatcgacctcagcctcatcctcaactactgcggcaagaccgtccccaccggcttcaagtgctaa

SEQ ID NO: 211 - DNA, 390 bp, Oryza sativa
atgggtcgcgtgcggaccaagacggtgaagaagacctcgaggcagttccaaaccaacaagaaggtgctcgaagaagtgtccatcctgccgtcgaagcggctgcgcaacaaggtggccgggttcaccacccacctgatgcgccgcatccagcgcgggcccgtgcggggcatctcgctgaagctgcaggaggaggagcgcgagcgccgcatggacttcgtcccggagaagtcggcgctcgaggtggaggagatccgcgtcgacaaggagaccatggagatgctcgccgcgctcggcatggccgacctccccggcgtcgagcgccagcaagaggtctccgcgccgacctactcccgcccgccgtacggtggcccccgccgcgaccgcgtctag

SEQ ID NO: 212 - DNA, 359 bp, Oryza sativa
atgaagggcgggaagctcggcatggaggaggcgcgggagctgcagctcaaccgcatccgcatcaccctctcctccaagaacgtcaagaacctcgagaagggtttgcgctgatctggtgaagggcgccaaggacaagcagctgcgcgtcaagggccccgtcaggatccccaccaaggtgctccacatcaccacccgcaagtcgccgtgcggtgaagggaacaaacacatgggatcgtttcgagttccgcatccacaagcgggtgatcgatctcatcagctccccagatgttgtgaagcagatcacctccatcaccatcgagcctggtgtcgaggtcgaggtgacgatcgctgatgtgtaa

SEQ ID NO: 213 - DNA, 357 bp, Oryza sativa
  misc_feature (63)..(63): n = any nucleotide
  misc_feature (122)..(122): n = any nucleotide
  misc_feature (167)..(167): n = any nucleotide
  misc_feature (170)..(170): n = any nucleotide
  misc_feature (175)..(175): n = any nucleotide
  misc_feature (182)..(182): n = any nucleotide
  misc_feature (195)..(195): n = any nucleotide
  misc_feature (201)..(202): n = any nucleotide
  misc_feature (295)..(295): n = any nucleotide
  misc_feature (321)..(321): n = any nucleotide
cggccaccgccaccgccaccgccaccgccgacggatccatcgtcgccggatctagggcggganggaggtgacaggggaggagggagccgccgccgccaccgccgacggacccacgcgccgangccgccgacaccaccattgccgccggatctggggcaggagggagncanagggnagaaggnagccgcgcgccgncgccgnntccgcccgcagccgccgccaccatcgccggatccacccgcggctaccgccgcaaccgccaccaccggcggatctgccgcgggagggaggctanagggggttgagggagccgccgccganaccgcccccaccctcggatccactgcggccgcaaca

SEQ ID NO: 214 - DNA, 336 bp, Oryza sativa
gtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggcaaaaaccaccaagaagattgtgctgaagctgcaatgccaaagctgcaagcattactcccagcaccccatcaagagaggtgcaagcatttcgagattggtggagacaagaagggcaagggaacatctcttttctaaactacctactggatactga

SEQ ID NO: 215 - DNA, 316 bp, Oryza sativa
atgtcggccgccggggaggaggacaagaagccggcggggggagagggcggcggcgcccacatcaacctcaaggtcaagggacagaggatgggaacgaggtattcttccgcatcaagagatctacgcagctgaagaagctgatgaacgcctattgtgaccgtcagtctgtggatatgaatgctattgcattcctatttgatggtcgtaggctccgtggcgagcagacccctgacgagcagctcgagatggaagacggggacgagatcgacgccatgctccaccagactggaggctgcctgcctgcctagaagcttag

SEQ ID NO: 216 - DNA, 311 bp, Oryza sativa
atgtcctcccacgacgcccacctcacccgcgacgaggtcgtcgaccgcctcctcgacgtcctcaagtgccaccccaaggttgacccctccaaggatctggggctggacagcctggacacggtggaggtggtgatggcgatcgaggaggagttcaagctcgagatccccgaccaggaggccgacaagatcgactccctcccgctcgccatcgagtacgtcgccaaaccaccccatggccgcctgacctcaccgatccgtcgtgccgtggtgaggcttttcttgatttactatttttgttctgcgggggatga

SEQ ID NO: 217 - DNA, 311 bp, Oryza sativa
atgaggccgactggtcgtcgttcttctccgccggtggctgctgctcttgccctgcttctcctcctcgtcctcttcttcttctcccactgcgcctcagctgctcgcccactgccagcatcagcagcagcagagctagtgcttcaggatggcgccaccggcaatggcgacgaggtttccgagagttgatgggagcagctgaggaggaagcagcaggattatgcgaggaggggaacgaggagtgcgtggagaggaggatgcttcgcgacgcccacctcgactacatctacacgcagaagaggaacaggccttga

SEQ ID NO: 218 - DNA, 308 bp, Oryza sativa
  misc_feature (8)..(9): n = any nucleotide
  misc_feature (67)..(67): n = any nucleotide
  misc_feature (84)..(84): n = any nucleotide
  misc_feature (105)..(105): n = any nucleotide
  misc_feature (107)..(107): n = any nucleotide
  misc_feature (110)..(110): n = any nucleotide
  misc_feature (117)..(117): n = any nucleotide
  misc_feature (125)..(125): n = any nucleotide
  misc_feature (128)..(128): n = any nucleotide
  misc_feature (164)..(164): n = any nucleotide
  misc_feature (176)..(176): n = any nucleotide
  misc_feature (256)..(256): n = any nucleotide
ggggaaannccccccaggaggaaggagaagcccgcgcgggcgacggtgttccggcgaagttcgggcnaggaggaggtgatgccngggatgagagcggcgtcttgnanccnaggaagntggtggcnacntcggccggcgctccggggacgtggcagaggcggccngaggcggagaantggtggcgacgccactggacgccggcgaggacgcgtctccggtgctttccccgcgaaacggagggctgaccgagggaganggggcagctgcgacgccgggagaggtggcggcgcagcccggagggtgcacgg

SEQ ID NO: 219 - DNA, 1992 bp, Oryza sativa
  misc_feature (56)..(56): n = any nucleotide
atgggtactacaaggctgcgctcggccggctcccggtggaggagacgccggcgctnatcccggcccttccttgacgccggcgtctgcttcggcctcatggatcccatctccaacatcatcgtcaacaccgtctccgaacccctcctgcccgactgcacggcgtcggaggaggaagaggaggatgggaagtcgaggaagaggaagagggggagagacgaggcaattttgtccgagatcgccgcggatgccagctgcatccgctgctttcctccgaggatggggcggtgcgagacctcgccggagcggaggaggaacgtccccgtcgcgcagcgctcgctcgagggcctcgtcaccttcctcatctgctacttccgccacctccccgtctcggaggccttgcactacctcctgctcaccaaggccgacctgctcgccgccgtccacctcatcgagtacactcggggaattggaggcaggctgttcccgatctcctccccaaccacagaggaacctctcaaggagccacccgacttcccgaaacctgtccggcaggcggctcttcgcttgaatcactacatcaaaggaatcagcagcttgaacaagttcccccatgaattcacagatactctgagaactcttctcctggagaaaatccatgtgttgtacctcaaagcgatcgcgcggcttcccagggatgatttgcgcagacgctatcaccatagcctcctcaaggcaggccattgctttggtcctgctaatgaccgtgtctccaacatcatcctcaacaccatctggtacgacaccacattccctccacatgaggagcttaagctggacatgatctgcaccaacagtctcgtgcgcattgagtgccgctccctcaacggccttcttgctttcctccacaacctcttccctgcattatctgaacacgatgccatgatgtaccttttccactccaatgctaaccttgaacaagtcacttttagagcaatgtgcgatcatgatatatcctgctctcatgaggatgcttacaaggcagcagcagacgcggcatggcatcctcatcctgatgctcaagctgaattcgctgtgtcaacccatccaatgctgttgcccattgacaagccatcgctagcggttagccgcacactcacttccaatgaggtggagctcatttcaagatatttttcacagaaatcataccctgccaaatctgtgccatcagttcctgaattggttcccagagctgacgagttggtcaaacgcagccagcaaaatttcatggctaatcaatatttcatctgcagaaaggtgaaagctgcattgaagagatatgcaaaagaaaagggaaccgagtatgaacttcatgtcatctgcggtacaaattttgatgtacctgagaatggcagatatggttactttcggaatcgcaaaggatttccatatgctcatgtgaattttctggcaagaccaaagggttcacagcgtgataacactgctcctagtcttttcttcctggagtgcagcaatggtgaagaagatattggtacactattttcatgctgcgctgaactagagtcgcctacagattctggtaggtgctttcattgtgagtgcaaaggaactaagattgtgcatccagctattggaacataccgagggcgtgaaacagacttcgaggaaatgtcttgtgggaaacaggaaattgacagtaaaggacttattatctctgagaagatggctattgagtttgtgggtttatgtgaggatgacagtatctattttgatccttctaaggactatgacttcgctcttggcttgaacaacttagttagggaggatgatgaagctcttgaagagcttcacagagacattgccgagtgcgagagaatgaaagtctgtgacatgtcctgtgagccagatctgttggcggaaatcacagaggatgttttgcaagattgtcaagggcatcttgttccccagtgctaa

SEQ ID NO: 220 - DNA, 1605 bp, Oryza sativa
  misc_feature (204)..(204): n = any nucleotide
  misc_feature (376)..(376): n = any nucleotide
  misc_feature (415)..(415): n = any nucleotide
atgaccacaagaaaccaacgtccctactcgatcgatgcgcgtctcctcgtcggcggcggcggtcaagtggaggaggaatcgtcggaggtgacggtggaggaggagccggcggtcatggggggaggcctggaagtcgacgtagaacatgtactcgaagtgcttggcggtgccgacgttggcgtcgtcgacgaggcggattgggcngtggcggtgcgggcggctctcgatcttggtgagggtgatgtcgcggaaggcgaaggcggagaggaccttgaagaggacggaggtgccctccttgtcgtgggcgaacacgatgctggtcttgaaggggcggtcggtgcggggcacgatgggctcgcgggcgagcatgacgaancgggtgacgttgccgcagtcgtcctggatgccgtcggcnagcacctccatgccgtacagctcggcggcgcgggaggaggcgatggcggccgtgtcgcggaggccgttggcggcgacgtactcggcggcgcccgcggtgtcgtcgaaggcctcgcggacgacgttgagccccatggcggtgagcgtgtgctcgcactgcgccagcgcctgcgggtggctcatcacgcgggtgaggcactccttgcggacccccgggagcgccatgaggcagtggtgcacggggagctgcacctcgccgacgatgtggagccggtgcctgagcaggaggtcgtagttgcggtggatgctgccgcccagcgagttctccacggggagcacggcgcggtcggcgatccacagctccacggccgagaacgccacctcgaactggtcgcaggggatggcatcgcagcccgggtacgccttcccggccgccttctcgctgtacgcaccggggacgccctggtacgccacgcgcagctgcgacccgtgcatcggcgccggcgacagatccgagatccgcagcggctgcggcaggttcttggcgacgcccccgccattaacgctgctcacgggcaccaaatccagcaccgccccgccgtcctccgccgccgcctgctgctccgggaccagcggcgcgacatgcccattaacgaagcttggcgccgcggcgtgcggggacgccgccccgagcgcggccaccttgctggacagcacggcgcagctgctctgccactccgcccggccgcccaccacggcgccctgcagcgagcacctgaccacccctcctcgtttgaagcttcagcgcgagaagctgaggaagggaggggggcgggggttggtggtgagacgaagcgtgggctgggggttggttgggtcagcgtcaaaacctcaaaaaaattgtatccggagccacctccacccacggccatcctcctccgcggctctcaccaacccaacccagctcgggctcgcgcgccgtggaatggggtggaacgtgcgacgcagcagtggtgcatcccccctcgcgctcgctcgcgtcgcggcctcgcgccggcgtttgctgccgccttgcttcgccttttcggcgtcgtttcttggattattgaccgggggatcacgcatctagtacgtgtggatgggatccatgccgattgtggcgggaaattgtcccgtgaatctgcttgttag

SEQ ID NO: 221 - DNA, 1287 bp, Oryza sativa
atgcgaattcgaaccccatggaatcagtacaacacaccccatcttgccataaaaccgacccgtcaccctgccgctggcggtgaccataaaagccccgaccagtcgaccccctttcgcggccgccggagcagcggccggccaccgccggtgttaacagcggcagccttttcatgcggccacaacggtcaaaagcgcagagcatccgaggctggcccaccaccacgcgcccgacgtgacgaaactgccccccatctctctctctctctttcccctcccacgcaacgacaaatccggctcgaaccactgaccatcccgtccacactgcaccgcgctagctcactccctcacttgcgtccccccttcccgtggctgatctcgccgtcgtgcggccgcgggctccggcgaccggtcatggcgtactccggcggtggcgggaagctgtccgccgtcgatgcgatcctcgccgaggcggccgacctcgtcgcgctggagcagatcgccaagctcaacacagcccacctcgccgccgacggcgactccgcgctcccttccagcctcgagtcccgcttccgcaagctcaagtccctccccgccgcgccgttgcctccgccgccgcccgccaagtccctgggccgcagcgccaccgcgccgccccaccacaccgacccgccgccatcggagacgccggaccctgctccgcctgcgccccctgcaccggcggcacaagaacgccgaccagaagacgccgccaaggaagcccaggagaaggagaactcctcgccgccgccgtcgcaggctcatcctccaccggccgtgaccgttccgacggcggcggcggcggacgacaacgaggaggacctggagaagctgttcaggccagggcgcggccggccgacgctgagggagaggaacagggggagggacgacggctcaccgtcgccgccgcgccaggcgtgctgcttcggcttctcccccaagaagacgctgcagaggactccgaccgggagcggcaggaagagccgccgcgccggcgtcgccgccgccgccgacgacgacgtccttggcatcggcgacgccggcgagtggggcgacgagaacaggaggatcgtcaccgagctcaagcagcagcagcgcaagctcaagaaggcgctcgaggagcaggtcaaggtcagcagggagacggccaagatggcgcagtgggtgaagcaggcgtccgcgcggatgacgcacaccgctgccattgacgacttgctcagcgactgcgacgatgaagacgagctcaagtga

SEQ ID NO: 222 - DNA, 1197 bp, Oryza sativa
atgcagacccgcaagggaacattggttcagaagtataaagtaaaggtagttgctgatgatcttgggaccagttcttccaaaggtgaagacgggaaacaagctccagatggctcggctcaactgagtgacaaaggtgctaccgacggttctctaggaagtcaaggtgacaactctcaagggatccatggagttcaaggcgatggagtgcatagagttcaaggtgatgctgctcaggggttgcaaaggggaaatcttaatcagaatagtgatgttgcacaagattttttcaataatttccaagaccgggtcgactatgctgtgcaccatgctttgatcaatcagtctggggttttcccccgtcgcaccatcatgtcagccgacagcgccggcatcgacccccttacctactccgtcagcattggcaccaggccagctggtgaaccctcagttgttgtacaacagattcaggtggccattgagggaggcaggattaagtttgatgattccaaaaagccgatgagggtcgatgataaccaatttcccgttaacatggtacacaaagctggccgaacagctgatccggggcgcatgaggggttatcaagtaagttcggctagaattataaacaaatgtcaaaggaaatatgacaagcaacaggaaaggcatcatgaagaagataatggtggctttgatcctcattggggctgtgagttcttcaggttctattggaatgaagctgatgaggcaaagaggttggcaaaaggaaagagtgttgtgacggcaccagttaacatggcagtgttcgagaaacctgaggggacagagaatcggcatcttaaaccattgtatataaatggctatgtcaatgggaagccgatgtctaaaatgatggttgatggtggggccgcggtgaatttaatgccttttgctacgttcagaaagttgggtagaaatgccgaggatctcatcaagacaaatatggtgctcaaggactttggtggcaatccatcggaaaccaaaggtgttctaaatgtgaagctgacagttggcagtaagactattcctaccacgttttttgtcatcgatgggaagggttcttacagcttgttgcttggaagggattggattcacgccaattggtgtattccttcaactatgcatcaatgcttgattaagtggcaaggcgacaaaatatag

SEQ ID NO: 223 - DNA, 1104 bp, Oryza sativa
atggttaggacaatatttttttttcttttactgctgttgcaacggttcattcgtgcaaaggttcagaaaatgtcaacgcagcgcattatctcattcccaggaatcctaggtttgtacattgtatatactgatgatgttgtagttgtagtggcagataagaagaaattaattataccatggccgtgggaaccatgcaagaaccagaggagagagagagaggaagaaaaaaaagtggcagagaaggaagagaagatcacaagaactccaagaattcaccgaggaagtggatggatcgaaccatggagccccataatttacgcccaattgtgctgctccggcggcggcggcgatgtgtgggtgggtagagatcatcatcagccggcgcggatccgcttcttgggcggcagcgaccggaacacggcggcgaggtcgcgctgcacggggaagaacaccagcgtcgacggcgacggcgacgacgacggaggcggcggcgacttcctcttcgccgtccgcgccggcttcctcggcgccggcgggcacacggtcggcgcacgcagcctgctctcctccgacgtcggcgtcgtcggctcctcctcctcctccttcttcagaggcgccctcgcttcgtcggacggcgccggcgaggccgttgacgacgacgtccgcgcaggcggcggcggcggcgccgtcgtcttgatcggcggcagcggcgggaggacgaggtcgccgggcggcgcggcggccggggagctcatctgggcgcgcgaattcttggctcgcgtgtgggagatcaaggcgtggttgagtgcaagggaggcgaggcgagaggaaggagaagacaagcgagggcgagaggcgaaaacgacgaggatatgtgtctggaggagaaaactttaccctccaattgtgaaaaaattacattgggatgccactggcttggatgagaagggaagtgaggaccagatctctcaattccttccatccggcccacaccaatgcagggttggttggacacaacaaaggctacaaataggtttgcgaaaagagtcgaaaccaccaaaggaatttgaaatctgtcccttcctacataatcatcgggcttga

SEQ ID NO: 224 - DNA, 984 bp, Oryza sativa
  misc_feature (347)..(347): n = any nucleotide
  misc_feature (412)..(412): n = any nucleotide
  misc_feature (535)..(535): n = any nucleotide
atgtctacctgcagcgctcgtaattccggcgacggcggtgagggcgtcgaccgcatcagccacctcccggaggagctcatccagaacatcctcgtccgcctcccgtccgtcgacgcggcggcgcgcaccagcgtcctctcccggcgatggcgccgagtctggacccgcctcccgtccctctccttccagtgtgattccgagaagccgggcgccatcgacgccgcgctcgccgcctactccgcgccggcgctgaaccgcctcgccctctccgcggcccacgccctcgaggccgccaccgtcgcgccgtggctggagttcgcgtcgcgtcgcgtcgccggcaacctcangctcaacttctcggtggccggcggcctcgagctgcccgcctgcgaacgggcgacgagcatcaacntccacgtcgggcacctccgcttcccgccggccggctcattcgcggcgctggcctccctggccatcgtcggcgcccgcatgcagggcggcgacttcgaggccgtgtgctcgccgcggtgccctngcctccggcggctcgccgtgcgcagcgtcacgctcgtcggaggcgccgccgacgtctctgtgcgctccggctcgctggagtggctggtcttcatggcgcagggcgtcggccggctggaggtcgccgccccgaggctccggtacttccgggcagaagccaaggccgccgccggcgacgtctcggatgtcagcgtcgcctccccggtgctcgaggacgtcgcttggtacggggagttcgacccgcgccgccaccggttcgcagaggccggccaccgcctgcggaagctgatggtcatggacatgccgacggcggcgctgatgcggcgcttctacatcgtcgacgagctcgtgcttagcttcggaatttcaccggtgactgaaattggagaaaatttcaatctcctagagccttggccattattgtatcaagatgcaactggcagggaatag

SEQ ID NO: 225 - DNA, 965 bp, Oryza sativa
atgaaccacacgggctatccaatttttgcgtgcgggtgggccaccacccgcacacaccagtcgtctgggaaaatcgtgattttcgcatccggtcgccggtcgccgacgtatgccgccgctccgcctgtcctccccctcccttccgccggatctgcaagggaggggaggaaagccgcgcgtcgccggccggatccgccgccccctcccccagatctgcaaggggaaggaggagagggggcgggcgccaccggatccgtcaccgtccccttcgcctaccgccgcgcctctcgcccgccgccgcccccttcgctcgctgccacgcgcggccggatccaccgccccctcccccggatctgcaagaggaagaaggggagggggagggggcgggcgccgccggatccgccgcccccaagcctcccctccaccgtatttgcacggggagggaggagagggggcgcgcgccgcgcgccgccactgtgcaccgctgccgcctgctctcctcccgccaccaccgccggatccgccgccgcccccttcgctcgccgccgtgcgcggccggacccgctgccccctcccccggatctgcaaggggaaggaggggagggggcgggtgtcgccggatccgccgccctcttcacccgccgccgcgcactaagggagagagggaggggcgcgttgtgcactgaggaagagagagaggagaggagaggagagtggggagggaggagtggagtgggagagatcgagggtgagcaggcggagggaggtgggcggctagggttacggataaggaaatccaccacggagtccacagacgtaaggagtcctgagtcctactcggacagaactgggtcgtcactgtatcgtgtaggggaccccccgggaggacctaaggcatcaaatctcatagccaagacaaccaccatagcctacgaagccggagcctacaagagccaagtcgtcgg

SEQ ID NO: 226 - DNA, 900 bp, Oryza sativa
atggttaaaaaaaagatcctttttacggttcttgtagagctacacatctggtttaaatttgtggtatctgctatcatccaggaggtcattcagattcaaggtgatcaaccgccgaccacctccagccgcctctgctgtcgagcccgtgcgccggccggccgcgccatctcctccctcagcgtcgcacctgcttcccctccaccggcgtcgcctccgtttcgcgcggagaccaccggaggcgtgttcccgctggcgtccaatggcatcgccaccactgcaccacctccccggcaaggtcgccctcagcctcgcctccccttcgaccgaaccccaccggtgttcgtcgtcgtcgtctccgtccgacatcgccatcccctcctccggttggccgttcctcctcgccggctcatcgtctcgcggcaccacctccgtcgtcggattcgcagcggcgtgttccgcgccgtcctcgcctccgtgcagctgctgccggctgcctcgtcgcctcctcgccggccccggtcgtcgttgcgtcgtcctctcgtcgttcccggtcgtagtggtgttcgtccctccgtcaagccgttcgcgttcgtcgtccgcgttacgtcaagtgagccgctgcagccccgtcgtcgtcttcgtcatcgcctccgcgttgccaagcgttgcgccggccgcgtcccgccttcgtgcaaggatcgccgccgaagtcgttccctcgccgttcgcctccgtcgtccccgagccgtctccgccgcgctcattcgtcattgtcgttcccacgcctcgtcgcgtggtggtaaggatccgtcctctcgctgcctcgtcctagtcctttcggtgtcgcccgtgcccgttgtgcggttgttgaccccggtacccgtgtactggtgtcggtag

SEQ ID NO: 227 - DNA, 882 bp, Oryza sativa
atgtatgtatatatctccgacgccgagcgacacgccgccctcgccgtccagtggcagctccccgacaacgccgggtggaggtggaggctacacgccgacaccgagcgacacgccgccctcgccgtccagtggcagctctcccactacaccgggtggatgctccactcccaagccgtgcggcatgccgcccgcgccgtcgagtggcacctctccgaccacaccgggtggaagctactacccgcccacgccgtccattggcgacgtgccaccctcgccgtccagcgacacctctccgaccacaccgggcggaggctcccgtccacgccatgcgacacgccgcccttgccgtccagtggcacgtccccgaccacgccaggtggaggctactacccgcccacgccatccgtcggcgacgtgcctccctcgccggccagtggcacctccccatccacgccaggtagtggaggctactctccgtccacgccatgcagtgcgccgccgttgccttcaagtggaacctccccaaccacgccgggtggaggctattctccttccacgccgtgcaatgcgccgccctccccttcaagtgacacctccccgacgacacctggtggcggcaactacccgcccgcgcccaccattggcaacgtcccgccatcgccatccagcggcacctccccgagcacaccgggtggtggctgctcatcctcacccacgccatgcgacgcgccgccctcgccatccagtgacacttccccgacaacaccgggtggagggtactacccgcccaagccgtccatcggcacctcgccatccacaccgggcaccggcggaggctactaccctcccttaattatgtacccaaacgataattatgtttga

SEQ ID NO: 228 - DNA, 828 bp, Oryza sativa
atgtcaccgccgccgctgccgtcctcccccggcctccctccggccggatctgggaggggaggggagccgcccatgtcaccgccgccgctgccgccctcccccggcctccctccagccggatctaggaggggaggccgggcagccgccgccgccgcaccgggagagggccaccgccggaggggagccgcccatgtcgccgccgccaccctcccccggcctccctccggccggatctgggaggggaggccggggaaccacgtcgtcgccgccgccctcccttggcctccctccggccagatctgggaagggaggccggggagccgcctccaccgcaccgggagagggccgccgccaaaggggagctgcccacgtcgccgctgccaccctcccccggcctccctccggctggatctgggaggggaggccggggaaccacgtcgtcgccgctgccgccaccctcccctggcctccctccggccggatctgggaggggaggccagggagccgccgccaccgcactgggagagggctgccgccggaggggagccgcccacgtcgccgccgccaccgccgccctccctgggcctccctccggctgggaggggaggccggggagccgccgcccccgcaccgggtcaccgctgcgtccgcgcgctccaccgccaccgccgccgcgatagtggggacggcggcggcggccggcggtcgggagtagcggcggcggcgtccggcggttgggagacggcggcgagcggcggagacgtgggcgtggcggggagcgaagacggcggcattcggcggtggctgccatggataggtggcgactag

SEQ ID NO: 229 - DNA, 789 bp, Oryza sativa
  misc_feature (141)..(141): n = any nucleotide
  misc_feature (155)..(155): n = any nucleotide
  misc_feature (219)..(219): n = any nucleotide
atggccaccggcggcggcggtgcaacgcgggcggccggcgaaggggagatagagggaaagggagggatgctcaccgagctcgcgcaacggatagagacaacggaacccgccgcaacggctccacgggagcacggcaacggntggactccggcganttcgtccgcaaaggagaacggccggggcacaacacagccctggagagagagggtggtttcggtngtggcgaggagaaaagaagcggtggccgggcttgggattgctgcggcgaagccagtggtggcggtgacacagtgcggcggaggttccagccacggggaacgacggccggagctcgcaaaggcgatggcggctcgggttgacacgtggggagagcagtacggggcgcgagaagctcaggaaaaatggagaaatggaagaggactcgcggagcatttttatagcgcggggagctcgagatcgaggccgggaggggcggaatcgccggccggagtgggggagaggcgtggggtcgtgggggccgatccggcgccagttttgcgtgggaaggagtggggtaggagagtgaggacatgggcggcgaggtcccacggccaggctggagcacgcggggtggaggaggtgggcgggggaagcggcgacgtggggcggctcgggtggccatggtggttgggagtggggagccggaggccccaaggaactgattacatcattgaatataaaaatatcattcatgttgtcccccggtttatttctattgtcaatagacccgtaggagttgaaatctcctag

SEQ ID NO: 230 - DNA, 759 bp, Oryza sativa
atggtgctgggcagcgtgcggcctccggaggcagcagccgctgtgccgaacggcggcaagcagccgaaaacggcggcgctcacgggcagtggcgatgcacgcgaaagggaaggggagcggaggaggggctcaccgagcgtgcgggccgacgaggcagagcgggaggtcgcgcggcggagagaggcggcggcgctcctcgaggaggcagcggcgacggcggttcggcggcgttccgtgagcaggaaccggcggccgatggtcggagggaccgggaggcacggggagatgagtccggcgaagaccggcgaacacggagggattgctgagccacggacgatggctgcgggcgacggcacaacacggggcggactgaagaggcggcgcggcgcggccggaggcggaaatggcgacggtggctctgtggggagggcggctcagtggtggattagaggaacgaggcggtggccggtgctcggcttggagcggcgaagccgactgtggcggtggcgcggcttggcggtggctagcgtgacgaggagaggcggccggagttcggcggcaagcgcagagagagttacacggtgggaggtggttccgatggcggttgaaggaaaccgagtggaggccggcgtgcggcgcgggatggcgaagctgatggcacacgtggtgaggcgcggcgacggcgggagcagcggcggcacgcggctggagatcgccggcgagcgacggcgatggggattggcgtggagagctcggtag

SEQ ID NO: 231 - DNA, 724 bp, Oryza sativa
  misc_feature (10)..(10): n = any nucleotide
  misc_feature (23)..(23): n = any nucleotide
  misc_feature (26)..(26): n = any nucleotide
  misc_feature (30)..(30): n = any nucleotide
  misc_feature (33)..(35): n = any nucleotide
  misc_feature (37)..(37): n = any nucleotide
  misc_feature (39)..(40): n = any nucleotide
  misc_feature (43)..(43): n = any nucleotide
  misc_feature (109)..(109): n = any nucleotide
  misc_feature (179)..(179): n = any nucleotide
  misc_feature (287)..(287): n = any nucleotide
  misc_feature (296)..(296): n = any nucleotide
  misc_feature (712)..(712): n = any nucleotide
  misc_feature (724)..(724): n = any nucleotide
aattttcttnctaaattcttccnaanttcnagnnntnannttntcttttctccgacttccaagtttggcaacttccgaccgccagtcgcctcaatttcccaagccttgncggcccccggccatcggacaccggatccggccgacagcgcttcccccatcgactgccggactcctccccngcttcccccaccggatccagcctccacgaggtcgggggacgtggatacgcatcccggccgcctcccagccgccagcgcctcccacaccgactgccggactcgtccccnacttccccnaccggatccggcctccacgagatcaggggacgtggatccgcgtcccggccaccggacgcggccgcctctcgaccgtcggacgccggatctggcctccgggaagccggatccggccgccagcgcctcccacaccgactgccggacgcctcccctgcctcccccaccagatcccgcctccacaaggttaggggatgtggatccgcgttccagccatcggacgaggccgcctcccgactatcgaacgccggctctgcttccccttcgctccggcggccggatgtgcctcccaccagagggcgctgccgcctccacctcccgaccgtccctcgccatggccgccatcctcttgaatgtgtgctatatgagattattcggtttgaatttcttgtgtgagcaaggcaactgtgacaacgagncaccatggcagn

SEQ ID NO: 232 - DNA, 723 bp, Oryza sativa
atgtcccgcttcgccactggctgggcgcggccaccggcgacacgatgcagcacggcggcgggcacgggaggtggccggtgcaagggaaaaagggagaggagatgggggctcaccgggcggtacggcggaaggaggcggctggtggcgggctcctcggggtggcacggcaacggtggtccagcggtgttccacgagcgggaaccagcggacggcggtcggaaggacctagggaacaaggaggaaagaggggtggccgagctacccacgagggctgcagtgccggggaaagcgacggcgcagggcggcggcggttggcggctgaagatcgccggcgggcagcggagtgggagcgcggtggcgcggaggatttcgggcacgggaaggctcgggagagaggggaaaatggagagggagggtcggggcgacggtatcgttgctgatttggggcggcaaccgacggcgacgtgggaaagagagagagtgagaggtgccggattccgcgggggagtgggggaggagagtggggcgacgcgagcggcgaggtggaggagaggggcggcgcggttcgggcccacacgggagagggtgcgggctgccagaggaggcggcgacatgggtggctcgggcggccatggcggttgccggcccgggctggaggaaggggatgacaggtgggacccacgggcccacctgtcggcgagagggagagagcaagccggttag

SEQ ID NO: 233 - DNA, 678 bp, Oryza sativa
  misc_feature (184)..(184): n = any nucleotide
  misc_feature (261)..(261): n = any nucleotide
  misc_feature (269)..(269): n = any nucleotide
  misc_feature (324)..(324): n = any nucleotide
  misc_feature (326)..(326): n = any nucleotide
  misc_feature (335)..(335): n = any nucleotide
  misc_feature (403)..(403): n = any nucleotide
  misc_feature (408)..(408): n = any nucleotide
  misc_feature (411)..(411): n = any nucleotide
  misc_feature (414)..(414): n = any nucleotide
  misc_feature (421)..(421): n = any nucleotide
  misc_feature (443)..(443): n = any nucleotide
  misc_feature (448)..(448): n = any nucleotide
atgcggacctatcccatgtttaagatttctgtgtgcgggagcgcgcacggcgcgaacctcgcgagccccggcctcccccgcctccggcccctggggaagcacgagaggcacccttccctctcctcgccgaggctcccaatcgccgccgaggccgcgccgacagcttccgtccgcctcctcaacntgcagggcaacacacaacaatccacgctgaaaatcagagtctcgcgggcggccaattccgctggaaccctagacgantggggccnggggcgggacagaggtaaccaaactcctcttcgggctcacctgggcgaaaaggcncngcggtggantcaaccgaaggggtttgcccgggccgccaaggccattgaggacccgcgcgccaaggaggagggcctgngcacngcngcngcggccngggggaggccccgggcgaagcngggcngcgctttggccgccgccgcggcgagcggaggggaggggaaggaggccatcgcggtgcggggggcccacgccacggcggcggcggctttcgtggagacgagggcgcaacgcagacgcgaatcgcaaatatcgtgtgatctcgcgcgtaccggattgtggcctggcggtttgagccggacctggaagatatttccgttcgatgtgaccagcttcacttcatcacatgattga

SEQ ID NO: 234 - DNA, 669 bp, Oryza sativa
  misc_feature (62)..(62): n = any nucleotide
atgacgaggagggcggggacctcgacctcgggatggggggcatggacgccgccgccgcccgngcctacctcagccgcctcgtccaccaccaacttctacgacgacgagcccatcgacgtcgcggccgccgcggtgtccctgctgcagcggagcggcctccaccagggctgcggcggcggcgagagcgccccggccgccgccgcgtccatcgccgcgctgcccacggtcgaggtgtccgagcccgccacggcctgcgccatctgcaaggacgacctccccctcgctgcccccgcccggaggctcccctgcggccacctctaccactccgaatgcatcgtgcagtggctggagatgcgcaactcctgccccgtctgccgctcccgcctcccgtccgacgagccccaggacgcggcggcgccgtctgacccgggccccgcgcccatgcggatcacgatcaggctcagcaccaaccgacgacgcgtccgcaccagcagcgatgcggctccgcccgtcgcggcgtcgcccacccagctcgcgcaggccgtgaccggggaaggaggtggtggacctgcgaatagcacggagactgtgtcgtctgagtggccaccgccctctgagtccgatgccgtcatgtcagacgcccgtgagggccagagattcttcgattga

SEQ ID NO: 235 - DNA, 666 bp, Oryza sativa
atgactgcccgactgaccgtctgtcttcaactcgttcttctcgttggcagagagagaagctgggagagagggggacagaggaggaggtacagccgcatcacctcgctgatggtcgcgtgcagccgtgcagtcgccgtcttctccggcgtcggcgcggcgagcgtccgcgtgccgcgacacctcctcgtgcacgcgacgctcgcagcgcgggttcgcggcgaggagccacaagagccacgtcagcgcgggtgctcgtgctcgtcctccccgcgacggaggcgctcctccgacgccacgtcggcgggaaaggagggagcggcgcgcggaaatgtcggcgttcctccgggctccggccccctcatcttgagcctcgtcctcctgctcttcccttcgccggacgccgtcgacctcgcttcctggtgccgatacacgcctccgcccgcgcgagccaacccgacgctgctactcctcgatgggacatggaagcatgccaaggagatgcaggccgccagcctcccgtttttgtcctccttcgtctcgtccccgtgtcattgctcgtctactgcgatgtcggcgccggcggggtcgaggtggtggaggatgacgacggtggtggaggcgggttgcggcggagggcgtgcgctgcgccctctctgttgcgcctga

SEQ ID NO: 236 - DNA, 597 bp, Oryza sativa
  misc_feature (278)..(278): n = any nucleotide
  misc_feature (321)..(321): n = any nucleotide
  misc_feature (344)..(344): n = any nucleotide
atgggcggagcagaggggcggcgggcgacgggtgagctcctcaccctccccacctcctactcctgccctcttctctatatcgtctctctctacactacaaaaagaagtgtggagcggcgttgggcagcgtacaggggcaacaggcgaagcggagtggagcgatggcatgaggagcgaacagcggcggacgagctcctggaagatgtttgccgcttgggccaccaagcgggggagctcaagacaaagacgcttcgtatcctccgtggcccttctcggcnaaccccaacaccgtcgatgacgtcgaagtgcagcaccgccctnacgacagccatggtctccccacntcgccgagcgccgaccacacgcctcacggagctcgaggagcaccatgtcacccgcctcttcatccatgttgggggtgcgctcggggccaaggcggtggaggcggttcccaacagcggcatgctgctggaagaagggaagaatttcggactcggcgacaatttgagggacctaaaggcaacgtactggctccagctctgggctcaactacaaaggtctaatgaagatggtgagttcataaaagttgcatgctag

SEQ ID NO: 237 - DNA, 597 bp, Oryza sativa
atggttgttggcgctgctcgtcggccagagcacccaggtggacatctggacgatgaacctcctccacaggacggccttgcgccgaatggcgtgcaccaaggtcatcgacttgacgggagtaccccggagtccctgcacgccgccggtcggcgtggtgctccggctcgggtggacggtctgcttgctttgctggaccggcgtcggcgcgccattgtggtctgcgcgctcggcgaggcgttcagcgagtttcgctctgggcgccgccatgtgttgccgccatatgaggtcgagcggtgcgccgcgcgggggcgggtggtgagcagcggtggcgggtcgacgagctcggccggctctagtggcagcagcgggggtggtgagggcggcgggacttggagcgaggcaacggcggcgggacgtggaacaacgcgtgttcgctacaatttcatcgctccatccatccatccatgccgcgtgtgtgctggatctgctggttgttggatctgctgctcctgcgacccgtggccgcgtgtgtgctgtcctctcgctggttctgacgaccttttcttcctcgatgccgctgtagatggccggcggtga

SEQ ID NO: 238 - DNA, 591 bp, Oryza sativa
  misc_feature (478)..(478): n = any nucleotide
atggagaggagggctgtgtcaaaggagtcttcctcggcgatatgctcctcccacactcgtgctggttggccagcggatgtcacattgcatctctgttcgtctcccgctacactctattgtaaatgggctatcctcgctacgacgtggaacaaaagaagtagcagcaccatgcaatacgaaacatacgaaggagtgacgcgcgacttccctatgacgttgagagcaatatgtggtggggacacgtggcagcacgaaggcgcgtgggagagacgtgggcagcacagcaggcggcgtggtgggccccggcgacagcagatgcctggcgctaagcattccctctatgtcttggatggcagcggatacatcacggttcacggggattcccttccccctcgagcgacggcgcgagagagattcaggaacgccgcgtgcaggcctccggtgcaatggcccaatgggccaaacgggtacggaggtntggcttggcacttggcaggtgctttgaccggaagcctacgtggcaactttacggcgcaacggccccacatgtcagtgggtgagaaacccgcgctagtagatcctgttgactag

SEQ ID NO: 239 - DNA, 549 bp, Oryza sativa
  misc_feature (441)..(441): n = any nucleotide
atggccatgggggatgactactccaaggcgaggcaagccctggcggtgagcgcccacgagtgctcgctggtggacgcggtctcctccgcggccacgccgccgaccgcggacgacggggaggggcacgcggcgggcttcttcgagggcttcgtgctgggcgggatccgcgtggacagcgtccgcccgggcctcgtcgactgctccttcaccgtcccctccaggctcaccgatcggagcgggtgcctggccgcgggcgcggtggtgtcgctggtggacgaggtggggtcggcggcctccatcgccgacgggcgccccgtcaaggtctccaccgacatgtccgtctccttcgtctccctcgcgcaggcccgccccggcgaccgcctgcggatcacggccagggcgctcggccacaagggggcgtactccgccacccacgtcctnatctccaacgccgccaccggcgaggtcgtcgccgagggcaggcactccctcttcggcaggatgaaggtcgtctccacctccaccgccaccgccaccagcaagctgtga

SEQ ID NO: 240 - DNA, 513 bp, Oryza sativa
  misc_feature (296)..(296): n = any nucleotide
atggtttcaatcaacagcaatccatctgcgtgggagggagcaatccataaagtagcactcggcgacggtgagctctcgcatctccttcccctctctctctcgtggtgcctgcccggcgaaaacggcagcggcggcggttggccgcgccctcggccagatccggcaggaggggaggcggcgccggcgggcaccccacgggcggaggcggcgggctcccgcggccatgcccttccctccacggatccggcgagaggggaggtggcaggttccacagccgctggcgggtaccccacggntggcggcggcgggcttccctccaccagatccggcgagatgggagcatgtggggaaggcagttgggagtcggcgggctctcgcgccggcggctgcctggtggaggcagttgcggcgcacctcggcagtggtggcggccgcgccatccccatgtggcgacggcggcaggggtggagaaggacactagtggtgcaggcgaggtggcggctggcggcttga

SEQ ID NO: 241 - DNA, 504 bp, Oryza sativa
atgggagacgcgctgtgtgatcagctcctcttggtggacagcgacggcggcgagttcatcccccaccacgccgacgccgacgccgacgacctcttcaccatcctcgagacgtgggagggctgcgccaacgtcgtcgccggcggcgcccccgcgaccacgacgacgttaggtagtcctattgccgccgctgcctgcatctccggcgttgttggtgggcagaatcatcagcagctgccggaacctgccgccgcgaagaccgtgccagccaccaataacaagcggcgggaggaggaggtggcggaccgtgacggcgacggagacgacgacgacggttcgccgcagaagaggcgcaagtgctgctcgccggagtcttcgacgacggacgtggcggcggcgacgacgcccaagacggcgcacatcgccgtggagcgcaaccggaggaagcagatgaacgagaacctcgccgtgcttcgctccctcatgccatgcttctacgtcaagcgg

SEQ ID NO: 242 - DNA, 474 bp, Oryza sativa
atgtgtacaacttctcctatttctcaacccgttcatgagaaaagagatatgcacgaaacaattggtgttgttactggttgcgcctccaataggctcgcggatgtgggcgactttatggtgcaaggtggattgtatccaatccgtgtcgggggcaacttcgttagcatggctggcaccttcttgcgaagaatggtagcaaaagaccggggcatgctttttacaaaatggatgcatcgaggcatcgatgaactagcgatgctcagtcatatgtatcttgcttggtacctcaatatcaatcagattcgcgcgggtaggaccccgtcctcctcctccggagcgcccacgaaaaagaagaagaagccgccgttccgccccgtcgccgacgacaccaagcccgtcctccgcgacccgatatctcggtcggacccggtggagaccgagcaggccgtgctgcggctgccgccattcccctag

SEQ ID NO: 243 - DNA, 456 bp, Oryza sativa
  misc_feature (14)..(14): n = any nucleotide
  misc_feature (18)..(18): n = any nucleotide
  misc_feature (27)..(28): n = any nucleotide
  misc_feature (33)..(33): n = any nucleotide
  misc_feature (52)..(52): n = any nucleotide
  misc_feature (54)..(54): n = any nucleotide
  misc_feature (71)..(71): n = any nucleotide
  misc_feature (81)..(81): n = any nucleotide
  misc_feature (85)..(85): n = any nucleotide
ccggagttccccgnaaancgcagagcnngggcnaacgaggggaaaccggaananagcccggggattccggnaaaatttggntggngaaagggagaggatggcccggggagtgattttataggctcgggagggagtggctcaggccgggatgggcggcaaccggcgtcgaagtgggaggcgacgtggagctcgtggggaggtcaaaccggcgccgtttttttgggggaaagtgggggagatggtggaggacgtggaggggatcgtgcccacgtcgttggatgcgagcccgggtgcgggagggcgccgtattttgcggcgacgtggacggcaatggcggttggggttggccggcgagaggtaggaggaggagctgacgggtgggaccgccggtcccacctgtcggcgaagggagagaaggagggatgcaaaacagacttttgcgagcgggccaagtga

SEQ ID NO: 244 - DNA, 447 bp, Oryza sativa
  misc_feature (118)..(118): n = any nucleotide
  misc_feature (182)..(182): n = any nucleotide
atgcgtgcgtcggcgaccgagagcggcgggcaccaaggcgtgtgcgcgcggcgttgggcaactgggagcggcggcggacgaccatcccccacccggatccagcggaggcagtttcccntcacccgattctggcagcggcggccgtccccaacccggatccggcggcctcggctgcatgcgcntggcatcgcccgggggttgcaagcgggaacagctggcgggagcggcgagctcggcggctcgtgcgtgcggcggcggccgttaccggcccggacagtgtggaggctccggatccgctaccgtggcggcgacggcgacggcgaccgcgaccgcgaccgcgaggaggcggcgacgacagctttagggcttctgataggcctctcacacattggagataccaccaaatctccaaggatcatgcgtacgagttttttaagttcattctga

SEQ ID NO: 245 - DNA, 432 bp, Oryza sativa
atgaagcgtaataccctactcctgtgtatgggatttagactgagagttacaagggttcctaagctcgggagaacactcttacttccctcctccacaagctcagattttctgagagtcgtcccctttctcggtgggcaaggtccaccttttatacctcaaggggataccacatgcaccacctctacctactcttctttcggcgccgtccctcgcctgacacgggggacagccctatgcgacgtgggaacacggttgtccgtccagtcatacgtgaccggcgtcaggccggtcacagaccggggcaaagcagtgcaagggcccgaggggcataacgtggcaccccgaggccccgaccccccggccgctcctgcggttcacggaatgcggggacaggaccaggctgtagggacacgtggcaggatgggaaggtag

SEQ ID NO: 246 - DNA, 432 bp, Oryza sativa
  misc_feature (246)..(246): n = any nucleotide
atggcggcgaagctccggctcaggctcctcgccgcggcggcggccgccgccgtcatggcgtcgtccatggtcgggatagcctccgccgccgaagcgccggcgccggcgccgacgtccggagcaaccgccgccccggccttcgccgtcgcgtcgctcgccgtggctgccgttggatacctgtatccaaaggcaagggcggtcaaggacgcggcggcggcggcggcggcggcgaaggccggcgcagcnaccggcgcgtcggacgtcggggaaggagccggcgcgtcggcggcggacgccgtgccgaccagcgacgtcgccaggacggccgcggccgctgccacggcgaggagcctgagcttcagtgttgccgccatttgcttcctcgcttcttggttgactgatcgatctgcacttggagagcaagaacactag

SEQ ID NO: 247 - DNA, 426 bp, Oryza sativa
atgggcacaggcgacaccgaaaggacgaggacggggcagcgagaggagagagatccttaccaccacgcgatgaggcgtgggaacgaccacgacgaacgggaacgacaagaggacgacgacaacgacgaccgtggccggcgaggaggcgacaagggacagccagcagcagctgcacggagacgaggacggtgtggaacacgccgctgcgatgacgatgacggaggcggcgccgtgaaacgacgagccggtgaggatgaacgggcggccgaagggacgtcggcgacgatgaggatggagaggccagcacgggcgacggcgttccggcgaaacagaggagcagctggaggagaggacaacgctgcgacgtcgatcggcgtaccggtgtcacatcctgatttttgtttcaggatttataaaattatttaa

SEQ ID NO: 248 - DNA, 423 bp, Oryza sativa
atggcgaagggacagcgtggcgagccgatgcccatggcgaggatgttgttgaggtcggagcacgatagagtacagaggatggcgagcaggttggagggcgttgggaagggcgggcactgtgtggcgagcagtgtccgtgagagggagttgagatcggtgaaggagaggaaggaggtggagaagacgaagtggcggaggaggtggcggagatcgtgctgggagaggtgcggcggttggaagggggaggggaggacgaacagcgtggtgtggcgagcaacagtggtgcgaagacggatgagacaggggagaggaagaggagcaggttgggaagcgggagctcacccgccactgcccatggcgaggatgccatcaaggttggaggatggcggagacagtggcgggcgccacggtggtgaggcatga

SEQ ID NO: 249 - DNA, 402 bp, Oryza sativa
tttaccgcgccatggggggctctcgccgtctccggccttgctggtcgccgtcgtggcgagcccggtataccttgtagtacagctcggcgcggcgaacgtcatgagcgagcgcgcgccgccgccgccgccgcagcagcagcagcacgtagcggcgagagaagaagggaagccgcgtcggcgccgtcgatgatgtcagcgtcgagcacgcaggagccgcggcctttgttcaggcccatacagaaatgggccgcgcataagccgaaccgccgtttaggccaaatttttatatgggcccggcccgctcgtcgcccagcgaggcgattccggccgtcgcgccgccgtcgccggtctgaggagtacgcgggacgcggctacgcttcttacgccttccacattcgaacg

SEQ ID NO: 250 - DNA, 402 bp, Oryza sativa
atggcggtgcacggtggagcggcggcgacggctacggccgcacggagggaggggtcagcaacgacaggcccggtggatccggcgggggaggtcaacggcggctcgacgacgaggagtggcggcaactggtctaggcagtggagctcgagctgcggtcggcggattcggcgacagtgctcggcagcggcgggcaaatccggtggcggcaccgacgcgtggagggagggaggtggcgccagcacctacgcgagccacggggaggtaaggtgtggcatcggcgcggagggcgagggaggcgatgccggtgcaaggagggagaagattgcggcgctagcaaggaggcaacgccagcgccagtgcgtggagggagggggcgctgtcggccaaacttgtgtcgaataa

SEQ ID NO: 251 - DNA, 394 bp, Oryza sativa
  misc_feature (1)..(1): n = any nucleotide
  misc_feature (20)..(20): n = any nucleotide
  misc_feature (32)..(32): n = any nucleotide
  misc_feature (35)..(35): n = any nucleotide
  misc_feature (79)..(79): n = any nucleotide
  misc_feature (100)..(100): n = any nucleotide
  misc_feature (118)..(118): n = any nucleotide
  misc_feature (183)..(183): n = any nucleotide
  misc_feature (262)..(262): n = any nucleotide
ncgggggccgccgaaaggtnccttcggtttanatncgggggccgccaggttttttcttttccaagttcgcgttgccggntcccttcaagacgaagtccgnaagccgccggatcccttngccgctggccacgacgagcgacgacgacggctccagatccgggggccgccgggttccctccttgncgcctccgccggccacttcctctcctcccctccgtccgctgccgtcggcgcccgtgtcgagatggtagcggcggtcctntcctccgcctgcgaaaatggttttggaccgcctggaaaaatcttttttctagtagtgctaatctactgctgcatggacggtggagcccgggcaactgcccgtggtggccaggtcctggctccgccaacataa

SEQ ID NO: 252 - DNA, 390 bp, Oryza sativa
atggacgcgatcggggtcgccaggttcggcctggtcggggtcagctatgggggattcgtgggctacaggatggcggccatgtacccggacgcggtggagagggtggtgctggtgtgcgcgggggtttgcctggaggagaaggacctggccggtgggctgttcccggtggccggcgtcggggaggcggcggacctgctcgtgccgcggcggccggaggaggtgcggcgcctcgtcaggctcacattcgtgcggccaccctgcattatgccctcctgcttcctctgggattacattaagacactgactaaggctgcgttcgttgtgatgagttctggggattgggtgagaaaaggacatcgtattccgcgcgcacgcttcctaaactactaa

SEQ ID NO: 253 - DNA, 381 bp, Oryza sativa
atgccgtcgcctgctctagcgctatcctcgccccgatgcccgccgccgcgctatccccacgtgcgccctcgcgcgatgacaccccgcgagtccctacggcagccgctgcgctttcctacgccccctcgcatgcccccgccgcgacggcgtgtggatcctcccccgtgcagtgaaggtgccctactaggtcgctgtcgtccagtccgccgaccatatcccaacccatcgataagaaaggacataaagaagaatgagaagaaaacggaaaagaaaatgaaaaagaagaagaagaagaagaagaagaagaagaagaagaaaagaaagaaaataaagaaaaggacacatcacgtccatgtagcaagacacatcatcgccacatga

SEQ ID NO: 254 - DNA, 362 bp, Oryza sativa
  misc_feature (24)..(24): n = any nucleotide
  misc_feature (26)..(28): n = any nucleotide
  misc_feature (38)..(38): n = any nucleotide
  misc_feature (40)..(40): n = any nucleotide
  misc_feature (42)..(42): n = any nucleotide
  misc_feature (47)..(47): n = any nucleotide
  misc_feature (50)..(51): n = any nucleotide
  misc_feature (53)..(53): n = any nucleotide
  misc_feature (65)..(65): n = any nucleotide
gcggcgacgtgggcgcagcgcgcngnnncgggtggagngngngcggnaanncngacggcgacgtnggagcggcggttgccggccgagcgcggtcggctggaggaaggggacgacctgacaggtgggccccacctgtcagcgtcccggagagaggggaaggggaacgggctggcccaaagaaaggaggccgagcgcgggagggaggcgtgacagccggtgcggtaaacggaggtgggagcgacgaactctgggggagagctggagttttctggcgttgtcgtcacgagacgaggaggcggcggcacgagacgaggagggtgtgcgtggcggatgggtgctcaccgggactgcggtggaagtag

SEQ ID NO: 255 - DNA, 327 bp, Oryza sativa
  misc_feature (12)..(12): n = any nucleotide
  misc_feature (14)..(14): n = any nucleotide
  misc_feature (19)..(19): n = any nucleotide
  misc_feature (138)..(138): n = any nucleotide
  misc_feature (140)..(140): n = any nucleotide
  misc_feature (194)..(194): n = any nucleotide
ccgctgccggcngncctcntcgcctcctcgccggccccggtcgtcgtcgtcgtcgtcgtcctctcgtcgttcccggtcgtcgtggcgttcgtccctccgtcaggccgttctcgtccgtctcgtccgcgtccgtcaagngngccgctgcagcccgtcctcgtcttcgtcctcggctccgcgtcgtcaagcctcgngccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaa

SEQ ID NO: 256 - DNA, 315 bp, Oryza sativa
atgtctctccgcgcggtgcctcctctccttactcctctctcctctcctctcctcccgatggtggcgcgcgttggcctcctccacgtggcggtggtggaggcgcgggatccagcgggcggcggctggccgccctcccccgcggctccccggtggtggaggctccccttccttccctccccagatccgacggaggggaggggtgttggcggcggtgcagccagaggggagagcggatccggcggcgggccaccgccgacgtcgaagacgagagcagcgtcctcggccaacgatgacgataagggcgggagcgattaa

SEQ ID NO: 257 - DNA, 300 bp, Oryza sativa
gcgcgggcggcggcctttgcggagtcgaacgtgccgagccagatcggggtcttcttcgccgggtcccggatctcggccgcgtacctccccgacggccgcctcctcaccccacggagaggtggaagggtggaggaggtggtcgtcgcgctgcgtaccactagcgaggcatattcgctgcgccctgccggcctcgctcggccgtgcacctgctgcctgctgctgctggctgccgtgcaggttgtggagatgatcagatcagctgggatcttcgagttcagactttcaggcctgggggcttag

SEQ ID NO: 258 - DNA, 2567 bp, Oryza sativa
  misc_feature (743)..(743): n = any nucleotide
  misc_feature (802)..(802): n = any nucleotide
  misc_feature (805)..(805): n = any nucleotide
gtgaacaaaggaatagtgtcatcgccgaagaagacgaggagggacaatcccttctccttgaccccgatgatgttggccgccttaaccatgtgcacaacgacgacagagaagaggttgaggtatatgatgacgacgaagacgatggggaggtggtcgacatcgacgacaaaaacgagtgcagagaggaagaggaggacgacgaggtggtgcatgtcgatgatggtggcggcggcgaggacgacgatgtcgtggacgatggctttggggtgttggttgtggtgcggattgatgattcaattaacatcacagtctatgggatcttaatgcttatggctacccatggcaacttcaaaacatgtactggaggagtatgtatttggcttgccatatatgccatgagccagctcagggcctcaggtgatgatgttaaggtggagaaatcgatggcaggagcagaggctgtgagcgctgcatggaaagaatgggctctccaagcactggtgcttctcagcctcatggtccaagtcacactcctcatcttggcagaattccgccggtacattgactctggcgtgctaagggcctttatatggtccgcatacatgctggccgacgggacagcgatctacggtgcttggccacctctctgttaccagcagggtcaccagagcatgagctgttggcactctgggcaccgttcctgctgctgcaccttggtgggcaggacaaaatcactgcctacnccatcgaggacaaccggctgttggctgcgccacctgcagacgcttgttgtgcaggtggncgnagctgcctatgtcatctatgggtcctccatagtcattgttggcgacagccggaccttgcttctcctgtcagccaccatcctcatgttaatggtaggtgttgccaagtatggggagcgtgtctgggcgctcagatgtgccggtagtagcccaactggaaaagataggtttaaggggccattacctcgtctgtttttgtgtggccccatgaatgaaggatcacgattgcaaggggaggacgagttgtacaaggtggctgagatgcaactctccctcctccacgacgtcttctacaccaagtctgagattacacacacttggtatggcctttgcatccgagtgctttcgtctctggccaccaccgttgcattctttctgtttaatatactactagtctggggaaatcatcatcagcataagctgaatggttacagcagagcagatgtcattgttacatatgtcctctttgttggagccgtcatcctggagactatgtcacttttgagggccatgttctcgagctggacatgtgcactcctggtaaagaagggatcggaaggaagtaatgtgtgtaattttcttgctcacatacccgcctgtctccgccggctggtccgtgcggcatattggaggaggaggcgcagctggtcacgctccatggggcagctcaacctgattcagttgtgcgtgcacagcagggccagccgatgcagcaagattgcgaggtggatgggagtcgaggactggtggaacaggttggcttactcgggcctgcccatccccatctcggcgtgtaccaagcagctgctgctggagaccatgaaggcgaagcaatggggtcaggaggaatttgaaagcagaggattgtacagggacccagcctgggttgctgagtccaagatggagcagaggatcctcatctggcacatcgccactgagatctacctgtgctggtacaaggatcaggagaagaagcaagcagaggccaccagtggttcaggttcagctgctgaagaggagcaagcagcggccaccggtggttcaggttcagctgctgaagaagggcaagcagaggctgccagtggttcaagttcaactgctgaagaggatcaagcaaaggccgtcggtggttcagtttcagctgctgaaggggagcaaggagaggttgccaatggctcaagttcagctgctggagaggagcaaccagaggtagtcgatggttcaggttcagctgctgaccttatggaaacggctcaggcgctgtccaatcacatgcttttcctgcttgcatcacgtccccacatgctgcctcccgatgccagccgcaatgattatcttgtgctgtgctatgctatcactcgtcacctgaggtacagcacagctgaggatgtgctccacttgctacaacttaacgcagatgcattgaggacgaatagctctaaaccgaagtttaaattaacttgtacaaatactaatagacttggggacaagatgttgaggggaggatgctcgcttggtgcattcctcatcgaccggcaagactcgcctgctgatggcactggcacgctagagatgatctgccaggtgtgggcacagatgctgtgctgctgtggggaacaatgcagcacagattctcatgtcaagcagctcagcagtggcggtgagcttgttaccgtcactgcccttgtcgcaaaatacatgaggtcaaggatgttgtcttggcactttcagatagattcacatgagcgtttgagcgaatggtga

SEQ ID NO: 259 - DNA, 2304 bp, Oryza sativa
atgctgctccccgtctgctccgccgcgcccacctgctccccgctctgcccggtgacgtcgtcggtggcccatgtcgtcggcgcgccggcgctacgagggagggtggtggaggccgccttcgcgaggctcatcgactccctcgggaagaagatcttccaggcggaggacgcgctcaccgaggggtacgacaagctgcggctgtcggcgtaccagtcgctcagcgcctggaggaagtccgtcgacggcgcggttggtggcctcacggcgtcggtggacgccaccaagaagcaggccgccggtggggtgacggacgcctccggcgcgttgcaggacaaggtggccggagctggcaccgtcgccgtcgatgtccttaggaaggctattgttgctgccgaggattcactgggcagcgcagcaacatccattggatattactatggatcaaccaagtcgtcgttgccaccgaatgtgaaagatttgctgaactcctccgaggagaaagctagtctagttctgaaaccgattggaggtgcccttcaacaggtatatgtagtcgtcgaaggtattgaaaagaatgttggtttggacccaagtgatcctattgttcaattggcagttctgcttggaggttcaaccacaatcgggttaacttactggctcttcgcatacggtggctattccggagacttgtcacccgaatccacactagagctgttgagaaatgatgacaaagccgacttgagagtgaaagatggaattccggatctacgccgtgcagctagatctaaatatgcaactgctgcttcacctgagattaaaggttcagtaaagaggctacttaaaagtggaagagatgttgatgatgcgttgctcgcagttatcatccgcaacttgaagttggtcaaacgaccttaccttgttaaaggtggtttccaatcttgggcaaagaaccttcgagtgaaagaattgaaacctgagaccgcattaacagtaataaatgaggacgcagaggaaatccttgaagacataaagcccactccaacacttgtccttggatctctcctgggcctctcagcagcagcgtacgctttgctagaatgggaaacgactctgcaatacataggtgttctaagccttggtctgactatctatctgcgattctctacgtacgagggttcagaggatctggagcaagatctaaaactgctgctttccccgttaagagtaggcgcggaggcgttctcgtgggcggccaagaagctggagccaagcaagattggcttggcgacttccccctccacgacggcggtccaagaccgggttctccaggccgccgcgaagcacgagtcgcagccgtctgacgccgaggcagacagtttggtctctgaagcatatttgaacaacctttttctatggatatctttcgatttctggtctgccagagataaaaaacacagaaaactgcaagaacggggattcgatcctaggaccaactggtcgcacgcatcacgactcaaccaacaacggctctccctctctgccatcccggtcccacctgccagtgaccgccgtgtggcccacccgctcaccgagactagccgttgcctcgcggccatcgcctttcttcccccaacggccaaatcccccgcgccacgcagcataagtagcagccccctcctcctccctctccacctccacccacgatctcctctcgctctcgccatctcgccgccggcctcctccaccaccaccgacgactccgactccgactccggctcgatctctcgcggcggcggcggcgatggcggcggggaaggggagccacacgcacagggcgttcctgctctgcaactacgcgctcctgggggcggcgtccagctgcatcttcctcacgctctccctccgcctcctcccgtccccgtgcggcctcctcctcctcttcctccacgccctcaccgccgtcttctccgccgcgggctgctcgggctccttcaccgcgcccgccaaccccgcgcagtggcacaacgcccaaaaccgcgggcgccgcccttaccgccatcttccagggcgccgtcgcgctgctcgcctttacccggaacctccgacttcctcgccgagctccagtcctacgtccgcgacgacgacgccgccgtcatcctcaagatggtcggcggcctcggcaccgccatcttcgtcctcgagtgggccgcgctcgccctcgccttctccctccgcctcgacgacgacgacggcgccggcgactacgacaacaagaactgggccgccgcctcctaccatgtctga

SEQ ID NO: 260 - DNA, 1959 bp, Oryza sativa
  misc_feature (208)..(208): n = any nucleotide
atggagcgagcggctggtactggtagcggcggcgacgatgacgagctcgtgctgccgccggcgtcgtttcaggacgggcttccgtcgtcccgctcctacccctcctgcatcggcggcggtagcgcagcggcggcgtcggcgtcgctggagcgggagctgctgtaccgcgcggagctgcaccagcaacagctgggcggcggcggcggcntagagcggcggaagaggcgcgcgatgaagaaccgcgagtcggcggagcgttcgcgcgcgcggaagcaggcgtacctgcaggagctcgagcaggaggtccgcctcctccgcgccgagaacgccgccctgcgccaccagtgccaccagatcgacgtgttgatgagatgtgcagctgaaggccgccgcggcggaggcggaggcggaggcggcggcagcggcggcggcggcgaagaagccgacgtcgtcggcgacgttctgatcggtgtcagcatgcaacccgtgtccctgctcacgccgtcggggtttgccatcgaagccatctcccagcagagggccgcgacccctctgcaagggacgtggctctacgagctcctcggctgggggaccaagcaagaagccgcactgggtcggccgtggctaggggaggagcctgtggacaccgctctctccccctgttttcccccttaccctcgccggctgccagagagagagagagagaggcgacgacgagagaaagagagagaggccattgctgcccgagtacctacgtctccgcagccggcgtcgcgcccgtcactgccaccatctcctcctcaatgcggcgcgaccggcgccgctcaaaccggatctggccgtgtgggggccagatccgcccaggacgatgctgaatctgtcgcctccggccggtggcggtgcaaggcggaggagccgccgccgccgcccgacattccgtctttgcccctgtcctccaacaccgtgggagatcgagcatggagctgggatgcgcttccctacggctgcatccacaactccctcatgccgtcccctccggctactgcttgctatcgaagaggtgatgatgtcgctgctcgccgacgatggcctcgtcctctgcctcggtgcctcgtcgccgccgccggcggcggcatggcggacgtcgaggccggtgcccgacgacgaacaccatatggtgcttgtgtagaatacgatatgcacgagagagcacccagcagcatcaagttcagatcagaacgcagcaacagcagcacgagcaccatttcggatcagcaacaacagcaatgctatgggttcctgctcttgtgtggcggcgacggcgtggggagacgacatgaaagacaaaatcgagacgacgagctggaggcctcgtgcggcatcaaggcggcgaggcagacggccgcctcgtcgccgagccggcggagcagcaacagtcgttaccgtgcgcttctacagtacggcatcgcatctacacccgatcgagcgagagtagctagagtgcaagatcgttccatcgatcgatcgatcagctcgcggctggatcgaggcgaagacgcatcagatattgatcagatggaggtggaggagatgaagccggccggcgccggtgggacgacggtgggcgacggcttcttcacggaggccgatctggcggcggcggaccagctcgtgcagctcagcgtcagcggcggcgggtgcgaggacgatggctacgactcctcctcgtccaccacgctgcagtcggtgaacaacgccgaggcgtcggcggcgatggacgacgacgacgacatggggctggataggagggtcaggaagaggtaccgccacctgtcggagctctacgccgccacgctgccggtgaaggagaaccacggcggcggcaagcggaagaagagagaggaggacatggggaagaagaagcagccgcagccgcagccgcagccgcagccgcgctag

SEQ ID NO: 261 - DNA, 1806 bp, Oryza sativa
  misc_feature (359)..(359): n = any nucleotide
  misc_feature (380)..(380): n = any nucleotide
  misc_feature (414)..(414): n = any nucleotide
  misc_feature (448)..(448): n = any nucleotide
  misc_feature (504)..(504): n = any nucleotide
  misc_feature (513)..(513): n = any nucleotide
  misc_feature (565)..(565): n = any nucleotide
  misc_feature (577)..(577): n = any nucleotide
  misc_feature (621)..(621): n = any nucleotide
  misc_feature (631)..(631): n = any nucleotide
  misc_feature (644)..(644): n = any nucleotide
  misc_feature (667)..(667): n = any nucleotide
  misc_feature (669)..(669): n = any nucleotide
  misc_feature (679)..(679): n = any nucleotide
  misc_feature (710)..(710): n = any nucleotide
  misc_feature (719)..(719): n = any nucleotide
atggcaaagccttctgccacgtcggcggcggcggcgccgccggcggcgagggtgctgatcggtgccagcgtcaacgtggccttcttgctcctgctcgccttcttcttcttcatctcgccacgcggcggctcgccgccggaggtggtttcgtcgtcgaaggaggtcgggatccgggggcgtcgcgatggcggcggcagcggcggcggcggcgtgttccgggttgagagctacggggagaggtgcgagcacgtcggcgaggaggatggccttgatcgccggcgattcccgcgtggctacgtcgactacctgtacctgttcgactgcgtgttcggcgaggagcggcgggttcttggctacgncgtgatggcggcgtggctcgncgtgctgttctacctgctcggcgacacggcggcngtgtacttctgctccagcctcgagggcctctcgnggctgctccgcctctccccggcgatcgccggcgtgacgctcctgtcgctcgggaanggcgcgccngacgcgctctccaccatcgcgtcgttcgcctccggcgggggagagggggagnccaccgccgtgnggctcaacggcgtgctggggagcgcgatgctcgtgtcctccgcngtgctcggcntcatcggcgtccncctcggcgcgcgcggggtcgccntngacagggtgnacttctaccgcgacgcgtctttcctcctcgncgccctcgncgccgtggccgtcgtcctcgccgccggcgaggtgacaatctggggcgccctcgccttcacctccctctacgtcgtctacgtcgtcgccgtcgccttcacccacggccgcgccccgagcaaaggccacggcgcggaggcggaccacacggcggacgccttctccgagctctgcaacgtcgcagagacgaagttctacggcgaccaagaaccactcctccccgacactgcaccgctactcagctactaccccggcgacggcgacggcgacggaggcggcgcgcggcggcggctccaagaagaagatcaggagcgcgttctgctcccactatggcttccacggcggctgaccatcccggacgcgagcaaggagcggtggagcaagccggcggcggtgaccgcggtcaccatggcgcccgtcctcctctcccacctctgcagccgcgccaccggcatcacctcgcccctcgctgtcctcctcggcgtcctcgccggcgcgtccctcggcgccgtcgccttcttcaccacctccccggacgcgcccccagccgaccacctcgccgcctggctcgccgccgggttcgtcatgagcgtggcctgggcgtacgccgtggcgaccgagctcctcgcgctgctggtctccgcggcgcacgtcatgggcgtcgactcggcggcgctggggctcaccgtgctcgcgtgggggaactccctgggcgacctcgtcgccaacctcgccgtggcgtcgcgcggcggcggcggcgggggcgcgcaggtggccgtggccgggtgctacggcgggccggtgttcgacgtgctcgtgggcctcggcgtgtcgatgttgctgtcgtcgtgggcctcgcatccgcggcccgtggcaatgccggcggaggccggcccattccagacgctgggcttcgccgccgcggggatttgctgggccgtggtggtgatgtccaggagagggatgagggtggacaggacgctggggtttgggctcctggccatttacttgtgctttctttgcatcaacatttctcaggcacttggaccgggacgagaagttcccaacttctccaaaacaaaggcttag

SEQ ID NO: 262 - DNA, 1803 bp, Oryza sativa
  misc_feature (1210)..(1210): n = any nucleotide
atggaggcgccggggctgaggcccgccacgcagcagcagcagcagcagggaatcgggctctgcagtgtctgcgctgaaggggaggcggcggcggtgcgggggatggagccgccggggctgcgccccgccacgcagcagcagcagccgacggtcttcacgccgcctccgccaccgccgcagcagcaggggttcgtgttcggcggtagcggcgctgcagaggcatcggtggtgcgctcgccgcgggggatgatggcggcggggatcgggccgcgcctcgccacgcagcagcagcagcagccgacggtcttcgggtcgcctccgccaccgccgcagcagcaggggttcgtgttcggcggtggcagcgctggagagtcatcggtgcagcagccaactctcgcgccgccgccggcgcagcaaccgcagcagaatcagggcgttggcttcggcgggaccggggctggagcggcgacgacggtgtcccctgcgccgcgggggacgacgatggcgagggaacgcgcggcggagcagctcgcgtacgacgacgccatcagcaggctgatcaacaagttcgcggggcacgacaaggacgcgatccaggggaagaacacgtcgaacgtgcaggtgttcgatgacatccacgaaggcgacgcgatccgcatggccgagctcgaggagttcgagaagcaggtgctggcattgaacgccgccgcctggaacgacgccgcctcctcctgcggcgaggagccggccgttgcggataacttcctgaacggcgaggagcagcgggaggaggaggaggaggaggaggcggcggagcggaggagctggacgcttgagcggtgggagctggagctgaaggcgagccgccggcgtgtggtggaggcgaacgagcgcgcgcggggggtccagcgcgagcgcgagagggtgcggcggcaggtggcggcgctgctgcagcaacggatgctgaagcgtcagcagatgtccgcgctgtcgcgggaacgcgcgctggcgcacaagcgattcgtgctccagcagcgtcaatggccgcaacagatggtggagcagcagcagcagcagcaacgcgcgccgatgcagcagcagcgcatgccggtgcaccaacggggaagcacgccggaggagcggcgcgcgtcggtgcgggagcgagtcaggctagagctgcagaaggtggttgcatttctgcagcgacgcnagctggagcagaggtatgagcgggcggcggcactgctgaggcaacgcgcgcagctggagcaggcagcgttacaggagcagctcaagctggagatgcagcagatgcggcggcggcaagagcagcgcaagcgcgcgcgtgactggcgatcatgccgcagccgcaggggcatcgcggccgcggcggcggcacggcgcggaacccgaacgccgcaatcgcccaggggggatccggagtcggacacaaccacccccggcgtggaggagcagctgcccgcgcagcagcagcagcatcggcggcagcgcgtgcgatcagtgcgaccgacgttcgtggcgccgcgcggcttgggcacgtcgagcgggcaggcgtaccgggcaccgcccgcgaggcagatcgttgttcagccgcagccgccgccgcagcagccggagctggcagggcaggcgttccgggcgccggcgccgcagacaccgcagcgaccggagtcggcggggcaggacgtgccggagccgcagccggaggaggaggaaggggaggcggtgggtggcgaggccgtcgtgatggcgccacagccttcgtcgacgagggagcagtag

SEQ ID NO: 263 - DNA, 1785 bp, Oryza sativa
  misc_feature (244)..(244): n = any nucleotide
  misc_feature (266)..(266): n = any nucleotide
  misc_feature (673)..(673): n = any nucleotide
  misc_feature (1421)..(1421): n = any nucleotide
atgtccacttcctcagctacttccgctgccaccgactccgctacggtgtcgtcttccacctctaccgtcgccccggttttcgtcaacccgtatgcgaccatcaccgtcaagtcccatgttccaatctccctcgagcttcgtaaccccaactacaacaagtggaaggccttcttccgctcgatgtgtgggaaattcggtctcctcgatcttcttgacgctgctcctctcaccaaccccgacgccncctgggaacaggccgattgctncctccgcaactggctcttcggctccgttgccgacgacgtcctcgacctcgccatggagcctgatcaatcggcccgggacttgtggatcgccatcgacaacctctttcaagccaacaaggagcctcgcacgatctatctgcatcacgagttccactccatgacccaaggcgatctctccgtcgccgactattgtcagcgcatgaagacggcggctgatgccctccgcgacgttagccaccccgtcaccgagtcccagctcgtcctcaacctcctccgcggcgtcaactcgcgcttcaccagcacggccgacaacatcgcgagcgcccctgtcttgccgtccttcgcctctgcgaggaacacgctggttctcaaggagcttcgcaacgccaactcggtacaagtccagnccgagactgccctcgtcgcagccaacagcgcccactccaactgcaccgggggcacttgccactcctctggcagcggtgggcagcagcagaaccgcgccggcggcggcaacggcggcaagaacaagggcaagaacggcggccgcaacaacaaccgcaactccggcggcaacggcggcggtggattcggcggccgccctggacagcagcaaccctggcgttctcccagcgccgggatacttgggccgtatcctcaggctcacactgccttcgccgggccatactcctcgccaccgcctgcagggtctgtccagctggcttgggaccaagccggccttgtcgccgctctcaatggaatgacgcttcacaaccccaactcatgggttctcaacacgggtgccacttcgcacatgtcctccaccgacggtatactcgttactcgcctccccaactcacaaacttatattaccgttggtaatggtcactccattccggttgtttgccgtggcacttcctttctccctattggcaccactagattcgaccttcgtcatgttcttgttgctccctctttggttcgcaatttactctctattcgccaatttacccgtgacaataaatgttccattgagtttgatgagtttggtttttctattaaggaccctcagacccgacgcgtgattcttcgttgcaatagccatggcgagctctacaccctcccggccgctgcaccttccatcgccgcccactncaaccttgccacctcctccacattatggcatcgccgcctcggtcatccgggtccaaccgccgtcaccactctccaacatttatccgccatacctcgctccaagacaaataattccctttgccatgcttgtcagttagggaaacacactcgtcttccttttaataagtccacctccagtacctcttctccttttgaacttgtgcactgtgatgtatggacttctcctgttatgagcatttcgggcttcaaattttatttagtgctggttgatgattttactcatttttgctggacgtttcctctttgccagaaatccgatgttcatcgccatattgttgagttcgttgagtatgcccacacatag

SEQ ID NO: 264 - DNA, 1578 bp, Oryza sativa
atgactgctgccacaccagccgccactattttaagcaagaggacagcggtgacgacagcggcagcggctcccgagcactcccaccgcggatggcatcgaggacggtggcagcggcggctcccgagcactcccaccgcggatggcatcgaggacggcggcggcggcagctcccgagacctcccgtcgatgatcgaggacagcggcggcggtggcgactcccgagctccaaattgcgtcgaggatggaggcaacggccatagaggggatcgaggacagcgacggcggcggcggctcccaagccctcctgccatgcccgcgctctcacgccgcctctgctgcctcctcccctggctctggaccccaccttcctccttctccgcagagctgccgccttctcgtcggcgccctcccaaggctgcccgctccacgctgcgctggcctgccgctgtgcccccgcggctgccacccttgccctctactcccgcatctatgtcgtactccagaggatcaagaagtgtggactcaagtgatgttgaaaaccctgggaacaacctgtatgttactggcttatctgctcgtgtgacagatcgagatctggagaaacacttttctgctgagggagaggtaacctttatagagtatctgcaaagggataccaaaatagtgtacaactttttaagctcaccgtattacaggttattgattgctagcatagtacttgatccatggacaagggaatcccggggatttggatttgttaccatggctactgttaaggaggctgatctttgcatcaaatatctagaccgctcagtgttggaaggtcgtgtgataactgtagagaaggccaagagaagacgtggtcgaacaccaacgcccggaaggtatctaggcacaaaatcatcatgtgtgacaccagcacggaggtattccccaagctactcgcctgttgaaagagaccgctacagttcacgctactcacctgagcgagaacggtcttattctccttatgaaggcgatcatattctccatacaacaggcgaagatcatactccccctatgagaggcgtagatcctactctccacatgaaaggagacagtcctactctccgtatggcagatccccttctccttatggtagacggcgatcatactctccctatgacacacgtggttcacggcgtcggtcatactcatcttaccgtggttcccgctaccgttcaagatctccataccgttacagaagagagaggtcatgttcctatgaccattctgtttcaccatactatagaaggtgctattctccaagtgctagaggacggagctattctcgcagtgtatcacctcagaggagctactcccatagctgttccccggattctcagaggtcagggagctattctccaaggaaaagatacagtgaaaggaaaccgtcgcgcagcaggtcgtcgggtaagaggcattctagggagagctactctcacagccgcagttcctactcaaggtctgtctccagggagcgctcagaatgaattgaagcttgatgttctagagatcaataaagctctctatgcctaa

SEQ ID NO: 265 - DNA, 1389 bp, Oryza sativa
  misc_feature (373)..(373): n = any nucleotide
  misc_feature (375)..(375): n = any nucleotide
  misc_feature (499)..(499): n = any nucleotide
atggcagtcgtcgccgtcgccgtcgtcatcgcgctcctcgccgccttcctgacgccgctggccgtgtacctggcgaggagggcgtcgccgccgccgccgccgcggcgcaacctgccgccgggctccctcggcctgccgctcatcgggcagagcctttccctgctgcgcgccatgcggcgcaacaaccgccgaccggtggctgcaggacaggatcgacagccccggagcctggcggcgatcatcgggaggaggaacatactggagctcgtcggcgacgaccaccggcgcgtccgcggcgccatcctgcagttcctcaggccggacatggtgcggcggtacgtcggcaagatcgacagcgaggtgaggcgccacntngccgccaggtgggccggccgccgcaccgtcgccgtgttcccgctgatgaagacgctggcgttcgacgtcatcgccaccctgctgttcggcctcgaccgcggcgccatccgggagcagctcgccnacgcgttcgacggcatgcacgagggcttgtggacggtgccggtggacctgccgttcaccccgttccgcagaggcctcatggcgagcgcgagggctcgccggctggtcgaggcgaccgtgagagagaaggcggcgaagctggagcacggcgagtcttccccatccgacgatctcatcagctgcctcctcagcctccgagacggcggccggcagctgctcaccgaggaggagatcgtcgacaactccgtgctcgccctcgttgccggccacgacacctccgccgtcctcctcaccttcatgctccgccacctcgccaacgacccggccaccctcgccgccatggcccaaggcaaaaacccaactctcccctcccctgacgaacactcagagcatgaggagatcgccaggggcaagcgagacggcgaggcgctgacatgcgaggacgttgccaagatgaagctgtcgtggcgcgtcgcgcaggagacgctgcgcatggtgcctccggtgttgggcagcttcaggagagcgcccgtcgacgtcgagttcgagggctacacgatcccgagagggtggcagatcttctggtcgccgagcgtgacgcacatggatccggccatcttccacgagccgaccaagttcgagccgtcgcggttcgacggcgcggcggcggcggcggcgtactcgttcgtgccgttcggcggcgggccgcggatctgccccgggatggagctcgcgagggtggagacgctggtgacggcgcactacctggtgaggcatttcaggtggaagctctgcctcggggaggagaagaacacgtttctcagggacccgatgccgacgccgcacgacggcctccccgtcgagctcgaccacatcgctcctctctgctaa

SEQ ID NO: 266 - DNA, 1218 bp, Oryza sativa
atggcgacgctcctccggcgatccgtcggccccgcgcgccagctcctcctccgcccgcgcccgctcccgctcccccacgccgcctcctccacccgctccttctcccgctactactcccgcgacgacgtctcgaggtcagcgccccaactcctcctcctcgttttggttttggttttggttttggaagggtggttgatgtgtggtggtggtggttgcaggtacgaggcgctgagcacgccggtgaactggggggtgagcatcgtgccggagaagaaggcgttcgtggtggagcggttcggcaagtacgtcaagacgctcggctccgggatccacgtgctcgtccccctcgtcgaccgcatcgcctacgtccactcgctcaaggaggaggccatccccatccccgaccagtccgccatcaccaaggacaacgtctccatccagatcgacggcgtcctctacgtcaagattgttgatccctaccttgcttcctatggtgtggagaatccaatttttgcagtcatacagcttgcccaaacaactatgagaagtgagcttggaaagattacgctagacaagacttttgaggagagggatacactaaatgagcaaattgtgaggtccattaatgaggctgcaactgattggggactgaaatgcctccgttatgagatcagggatatatctccgccacgtggtgttaaggtggctatggagatgcaagcagaagcagaaaggaaaaagcgtgcccaaatccttgaatcagaaggtgctatgttggatcaggcaaatcgcgcaaagggtgaggctgaagcaattcttgcaaagtctgaagcaactgctcgaggaatcagattggtctctgaggccatgaggaccaagggcagcactgaggctgcgaacctgagagttgctgaacaatacatgaaggcatttgctaatctggccaaaaagagcaacacgattctccttccaagtgacgctggcaacccatcatccctcatcgcccagtctctccagatatacaagcacatctgccagaccaacagcttgaagagtgggaagtacctcacagatgctctagaggagacggaaccggaggaagaagagttggactctactgacctaccttctctgagcagcgggatgccgtcccccgacatgccagatgaccatgacaagactttctccctgcagcgccgcaacaaggacaagcactga

SEQ ID NO: 267 - DNA, 1212 bp, Oryza sativa
  misc_feature (1140)..(1140): n = any nucleotide
atggcagatcagaaggtgattctcgccgagccgctgcttccggggaaggaagctgacttcgccgacgacgacgacgtggaggcgcagctcacttcgtaccacaccggcgcctccttctccaggacgtgcctcaacctcaccaatgccgtctccggcatcggggtgctgtccatgccgtacgcggtgtcgcagggcgggtggctcagcctgctgctcttcgtcctcgtcggcgccgtgtgctactacaccggcacgctcatcgagcgctgcatgcgcgccgacggctccatcgccagctacccggacatcggccagtacgccttcggcgccaccggcaggagagccgtcgcattcttcatgtacgtcgagctctacctcgtcgccataagcttcctcgtcctcgagggcgacaatctcgacaagctcttccccggcgcaaccatggagattcttggctaccagctccacggcaagcagctattcattgtactcgccgccgccgtcatactgcccactacctggctcaagaatcttggcatgctcgcttacgtgtcagcggccgggctcatcgcctcggtggccttgacggcgtcactgatctgggccggtgtcgccgagaccgggttccaccggaacagcaacacgctcaacctcgccggaatccccacctccctcggtctctacttcgtctgcttcaccggccacgccgtcttcccgacgatatactcctccatgaagaacagcaaacacttctccaaagttctcttgatctcgtcggtgctgtgcagcctcaactacgggctcacggcggtgctgggctacatgatctacggtgacgatgtgcagtcgcaggtgacgctgaacctgccctccggcaagctctacaccaagatcgccatcgtgatgacgctggtgaacccgttggccaagtacgcgctgctcgtggcgccgatcacggcggccgtcgaggagaggctgtctctgacgcggggcagcgcgccggcgagggtggccatcagcaccgccatcctcgccagcacggtggtggtggcgtcgacggtgcccttcttcggctacctcatgtcattcatcggctcgttctcagcgtcatggcgaccgtgctgttctgcctctgctggnacctcaagatctacaaggccgatggcatccaccgcacggagatggtggccatcgccggaattctgctgctag

SEQ ID NO: 268 - DNA, 1188 bp, Oryza sativa
atggagccaaactacagcgactaccaccccaacagtgtccccttcgatgcctactacgagcacggccatggccatctcgacgatcatggccatggccaccaccacctgatccctgcccatcctgagccctcctactcctacggcaactggtccttcctccatgccgatgccaccgcaacgtcctcctccgagtcgtcgtcggcgtccgccagctccggcgcggcgcacattgttggcgcctccggtccttctgcatccttcgtgcggcagcttcatttcggcggcgagtactacgacgacgacgcggcggacatcagcgccctcatggaagccgcctccatctcctgctggacgacgaacggtggtgccggtgcgtcaacgtcgcaaaccacaggcttggagggggtggaggtgatgaggagagcggcggccccggcgccggacaacggatcaagtgacaaggaggaggcggcgcggccgctgatcggggtgcggaagcggccgtggggcaagtacgcggcggagatccgggactccacgcgcaacggcgcgcgggtgtggctgggcaccttcaacacccccgagcaagcggcgctggcgtacgaccaggccgccctctcggtgcgcggccccggcgcggtgctcaactacccgctccaccgcgtgcgggagtcgctgcgcacgctcgagctcggcgccgccgccgccgcctcggagtcccccgtgctcacgctcaaacggcgccaccgcatccggaagcgctccacgaccaagaaggcgctggcgggcaaggaggccgacgaggcacccgccacgacgtcgtcggaggggaagaagaagcggcaggtcaacaccaccagccatagtcatgacggcgcatggcgccgacacctcctctcctccgggcggctctcgatggaggggtcgacggcggctggcgggcacggcgggctcgcgggaggacgtggggaggcagccgggagcaacgtgcgtgcggccgacgacgacgaggacggcgaggcggcggccgggagcagtgtgcacgtggctaacgacgatgacgacggcagcgaggcggcggccgtgagcagcatgcacgcggccgataatgacgacgaggcggtagccggaagtggcgtgcgcatgacgacgacgacggcggcaaggaggcggtcgggagcgggctga

SEQ ID NO: 269 - DNA, 1176 bp, Oryza sativa
atggccttcggccgtgtggcgagagagaagcaggaggcgcgcgcggccttggcggcactccagggtggtccgagtaggcacagggagagcggcggcgcgagagatcgtcggggaatcggccgacggcggcgcgcgactgcgcatggcggcggcacgagcaaagcaatgtcgagagggtgggaaggaaggccggcggcgcatggcgatgcgccggcgagcaaagaggggtttcttgccggggcgacgaggagtcgattcgccggagctagggctactccaagggttcaagaactcgttccaccggtcgagggaggaggagcggtgctagggagcgacggcgacgacgagtggcctccgggacagagcgaggcggccggcgagtctaggcgagtggcgggggcgagcggtaggaggaaagggttcggcgggagctcaccgacgagaggaaacggcgtcggcggcgcggaaggagtcgtggcgaggtgtcgcaacggcgggacggcgcggcaccgagtgggcgcggccggggaagaagagagggagacacaaggatgggggcggcgcagagctcctcgtagactcctcgtgctcgccggcctcctgggcacgttcggcggaagaacgagcgacgacggcagcgagcagccaggcggcagggggcggcaagggtgctgtgggtggaaacgggagggaacgagagggaggttgagacgcggaagcgaggtcggttcgaggcgggagcgagcggcaaaggcggttcgtgggcgacgtggagacggcgacggcgtggatgcaagggacgatggaggcggtggatcggacggcgaaaaatcgggtcacgagcacgggtggggcaatatggctcggtcaaggtgggggcactggcgcggcgggacgtcgtcggtgtcctctgcctccgcgcgcaagaagacaaggacgggagagagagaggccgggcttagaagggaaaaagggagggacaacggtgaaaagggaagcctctcccttccgttttgggcggcgggcaggcaaggcgcgtgggagcggcgtccttgccgttcggctatgcgcgagcgcgcgggaaacggcgacaattttggggcggcgtcagcgggaagcgacgccgagagagagagaaaggagacggcgctgtctctcgctcccgaacagtattga

SEQ ID NO: 270 - DNA, 1176 bp, Oryza sativa
atggggcgcgatgcacggccggtcgaagaggacgaggccgacaacgccgttcgtcgtcggggacgcctcacgcatgcacggatccaccattgtcgactgccgccgaggagggcctcccgcgccatgcactcgccgctgcctcaaatgcgcgagggcacgccatcgccgtcgccgctcgggtgctgccgccgccgccaccgtcatcactcggcttcttccccgccgccgatttccgccgctacctccacctccgtcagatccgctcgcccgcccgctgacggcacgagggaatcgacgaggaacggtggcgtcgtcgagctgccgccgtcgtcgtcgtcgaggtcgtcgtggcaagccgccgccgtcgccatccccgccccgagctccgccgccgccgtcgccatcccggcgagcgcctcccgcctcccgcgccgccgcgccgccttccgcctccccgcgtccaccgcgcgccatgcgtcggccaccgttgtcatcagcgtggttgacgggaaggaaggaaatgggaaaagaaggaaaggaaaggaagaaggtggggaggagagagagaaagaagaggggcagaggcttacatcagccatggacgatgaggaggagaacggtgcgtgcgcggcactaccgtctccctcgatgtcatctcccttgctcgccgatcccctctccctcccggtggccatgaacagcaaggaggagcacaacgcggcgtggcgctaccgtctccctcaatgctatcccccttgctcgcaggcgtgggacatcgtcaacgctaccagggatagagacggagccagaggtggggaagggcaacagaaagggcacgaaggagagagtgcggatattgacgaaaaggagatcagaaaggagaagccggaggagcttgtggtcgcgctggctcatgcaaaagcagatgctataatggagaagctgagggataatgggatgatgaaggaaattcttgattctcaagagactacactgttgataactgcagaccagattgaggagggcgatgtcttctatgttgccggtggcctgctggtagagcacccgctgacttcacctcttgtggaagctattgttggcaccatcgacagtgtaatgggactcccgaaatccctcacggagaagctgatcaaggagtcccttgaggagccatag

SEQ ID NO: 271 - DNA, 1083 bp, Oryza sativa
atggccacctttgcgcgccaccgcgtcctcctctgccgcctcgccgcggcgctcctcctcgctccggtggcggcggcccagccgtggcagttctgcgggcaaggcggcaactactcggcgaacggcacctaccagtccaacctcgccgggctctccgccaacctccccaagaacgcctccgcgtcccggacgctcttcgccaaggacagcctcggcgccgtcccggacatcgtctacgcgctcgcgctctgccgcggcgacgtcgccaaagccaccgcctgcgagtcctgcgtcgccacggcgttccaggacgcgcagcagctgtgcccctacgacaaggacgcgttcatcgtctacgacctctgctacctcgccttctccaacaggaacatcctcgccgccgccgccgacgacgacgggagccccaggttcctgatgaacacgcagaacgcgagcgcgccggcggaggtgttcgacgccgccgtcgccaccctcctcaacgccaccagcagctacgcggcggagaactcgtccaggcggttcgccacgggggaggaggccttcgatgccgccgccgctactccgaccatctacgggctgtcccagtgcacgccggacatgtcgccggacgactgccggagctgcctcgggcgcataatcgcgctgatccctcggtacctcagccggaggaagggcgggagggctatcgggatgcgctgcaatttcaggtacgaggtgggtcctttcttcgccggaggctcgatgctgcggctcccggcgccggcgaactcgacgccgacggcgccaaccggaggaagaaagaaaaataaaagtggcacagctctagccattgcattgcccctagttgttatattgttggctacggttgtcatttgtctttctgttcagaggtggagaaaaagatcaaggtcaaaacagcaatcttcatattcaattcaaatggcggaggacattgaaagcacggattcactttttatcgatctatcaacactgcgtgctgcaacgggtaacttttctgagagcaataggattggtgaaaggaggatttggttcagtttataa

SEQ ID NO: 272 - DNA, 1035 bp, Oryza sativa
  misc_feature (513)..(513): n = any nucleotide
  misc_feature (588)..(588): n = any nucleotide
  misc_feature (591)..(591): n = any nucleotide
  misc_feature (594)..(594): n = any nucleotide
  misc_feature (596)..(596): n = any nucleotide
  misc_feature (608)..(608): n = any nucleotide
  misc_feature (616)..(616): n = any nucleotide
  misc_feature (699)..(699): n = any nucleotide
atggccggcgttgaccgcagccgccggtcgtcgtcgtcgccgccgccgcttccgtggacggtgcgcgtgcagcttgctgcgctctcggccgcgcaccggtccgacggcagcgtgcggcgcctcctcttctacctcggcgacctccacgccgcggccagcccccgtcccgacgcggccggcgtccgctccgtcgacgtcaccatcgacgcctcccgcggcctctgggcgcgcgtgttctgcccgcccacgaacacggcggcggtgaagctcccggtcgtcgtctacttccacggcggcggcttcgtgctcttctccgcggcgtcgcgcccctacgacgcgctctgccgccgcatctcccgcggggtccgagccgtggtggtgtccgtgaactaccgcctcgcccccgagcaccgcttccccgccgcctacgacgacggcctcgccgcgctccgctacctcgacgccaacggcctcgcggaggccgccgccgagctcggcgccgccgtcgacctntcccgctgcttcctcgccggcgacagcgcgggcgggaacatcgtgcaccacgtggcccagcgctgggcggcgtcnacnacntngccgtcgtcgtngctccggntcgccggcgccgtgctgatatcgcccttcttcggcggcgaggagcggacggaggaggaggtggggctcgacaaggcgagcctntcgctgtcgctggcgaggacggactacttctggcgggagttcctgccggagggcgccacccgggaccacgcggcggcgcgcgtgtgcggcggcgagcgcgtcgagctggcggaggcgttcccgccggcgatggtggtgatcggcgggttcgacctgctcaagggatggcaggcgaggtacgtgcggcgctgcgcgagaaggaaggcggtgcgggtggtggagtacccggacgccatccatggcttccacgcgttcccggagctcgccgactccggcaagctcgtggaggagatgaagcagttcgtccaggagcatagctccaaccgtatggcttaa

SEQ ID NO: 273 - DNA, 975 bp, Oryza sativa
atggcccacacgtcagccacctacctgcctagaggtggccaaacgggccgggccaaaacgggcggcccgaggcacggcggaacctgtagccggcacggcccggcacggcctgctacagtaacgggccgtgccggcacagcacgagtagccgtgccgtgcttgggccgccggccgagcccgcgggccggcacggcacggcacggctactgtactgatggcccagcccgccagccacctccgcaagtccgcatcgcatccctccgcgccatttcggttcctgggccaaccgtgccccgtccacggcccatttttcattcacgggcccgtactgacacggcgggccacacgcatgccgtgcccggcacgggcacggcccggccatccacgggccgtgcttgggccggcggctcggcaccctcatcccgccaccgtatcagcgttgtcgccgcctctgcctccttgagcccatcaccatggacctcacactaccgccacccagctccttccctagcggttgccggccgtgcccatctccgccctcaccggccgtcccccgctccttccccaccggccgccgctcgacgcccagccgagcgcgacctggccgcgccgcctacggtcctatccacgctgcgtcgggaggaagcaaggaggccgttgatggttgagcacgaccttgccgccgggatccaaggccgccgccagtgcttcctccgacaacttcgactccctcttaccggtcaacctcaccgtcggcgtcctctcggcctcatcccgccaccacatcagcgttgtcgcaacctttgcctccttgagcccatcgtcgtggacctcccaccaccgccgcccagctcctccctcggcggctgccggccacgcccatctccgccctcgccggccgtcccccgctcctcccccactggccgccagcctcgcccagctgctctccgtcaccgtcgccatggaaagggatga

SEQ ID NO: 274 - DNA, 849 bp, Oryza sativa
  misc_feature (107)..(107): n = any nucleotide
  misc_feature (204)..(204): n = any nucleotide
  misc_feature (210)..(210): n = any nucleotide
  misc_feature (238)..(238): n = any nucleotide
  misc_feature (247)..(247): n = any nucleotide
  misc_feature (272)..(272): n = any nucleotide
  misc_feature (286)..(286): n = any nucleotide
  misc_feature (296)..(296): n = any nucleotide
  misc_feature (325)..(325): n = any nucleotide
  misc_feature (327)..(327): n = any nucleotide
  misc_feature (333)..(333): n = any nucleotide
  misc_feature (385)..(385): n = any nucleotide
  misc_feature (387)..(387): n = any nucleotide
  misc_feature (404)..(404): n = any nucleotide
  misc_feature (432)..(432): n = any nucleotide
  misc_feature (435)..(436): n = any nucleotide
  misc_feature (438)..(438): n = any nucleotide
  misc_feature (441)..(441): n = any nucleotide
  misc_feature (461)..(461): n = any nucleotide
  misc_feature (469)..(469): n = any nucleotide
  misc_feature (479)..(480): n = any nucleotide
  misc_feature (483)..(484): n = any nucleotide
  misc_feature (488)..(489): n = any nucleotide
  misc_feature (492)..(492): n = any nucleotide
  misc_feature (494)..(494): n = any nucleotide
  misc_feature (498)..(498): n = any nucleotide
  misc_feature (500)..(500): n = any nucleotide
  misc_feature (502)..(503): n = any nucleotide
  misc_feature (505)..(505): n = any nucleotide
  misc_feature (507)..(507): n = any nucleotide
  misc_feature (510)..(510): n = any nucleotide
  misc_feature (514)..(514): n = any nucleotide
  misc_feature (517)..(517): n = any nucleotide
  misc_feature (592)..(592): n = any nucleotide
  misc_feature (691)..(691): n = any nucleotide
atgtaccccacctccttctcccccggcgcgtacggctccgaccgcgcgcacgcgtcgcgcgcgtcccattccccctcgaagtgcgccggcgagaacgtcgtcaccanggcgagcttctgctgctgcgacggggaccgggcggcccgggtgatgacctcgcggagggcgttcttgacggcaaggcggaacacgccgaagaacccngtctcngtccggttcggctccgggccattggtgncagccgatnaccttggcggcgctcgtagtacatngccgggtggaggancagtggccgncggaaagaccaccacgtcgatgccgtcgngntccccngccaacgcttgtcgggctggtccaggtagagccggttgtggtcgagcccccngncccgccgccgccgccgncgacgacgacgacttctccgtgccgttnacnngnaangggacagaaccggaaccganctttttcncggggtgcgnnggnnacanncancnccgnancnncngngcntcgnccncgtccccaccgtccccgccgttgccgccgcgcaccagctcggcggggaaccccgaggccaagaggcagacgagcnactcgcactggttccgcgccagcgagtctcccacgaacgcgacgtgccgcccgcgcaccagctccaggaactcccccggcgcgaacggcggcagcgcgnacccgccgccgccgcgcgggcgccaccgccagtggaggtaccccgtgtcgggccgcccgtgcgccatgcagttctgcccgcccttgatcgtcgagccgcagctcgtcccgttgtaccgcggcgccgacgcgctccgcacccactccccctccgagtag

SEQ ID NO: 275 - DNA, 843 bp, Oryza sativa
atgcagatagggatcaaagaaagcgaaggtccaacatcactggatcctaaattagctccggtgttatggtttcataacaactatgatcaatatgtggaagaaagtgatgacgaggatggtgaggtaagtggtgatgatgaggaggtgagcgacgaagacgagtttagtgcgacaagtgatgaggatgagtccatagaggaaaccgatgacgatggaataagcgacgacgacgacagtaacgatgatgaggaggagtctaatgaggtaaatgataccttgctcctctacagcatatctagccaacaattgctagccaacagcggactagatgatttgaaagacctcttttactggataacaccgcaagtggggggcaagttctgcacggcgttttttagcactgtcgtgacattagatttctccccgaatccaacatttgatattgttgctgttacactggtacaaaattcagtgtacaactttagggaaatctacttgttagaatcaagaggggagttgttctgcttgtacttctaccctccaggagcatgttctaataaaacagtggagatttctgtttacaagctggacataccaacgacagcttgggtgaaggtggacacacttggtgatagggcgtttattatcaataccaggaagggctacggagcatcggtcaatgcaaaagaagcttgcctacaggaaaactgcatttatttttcgaggcacagagacaaaggactatatgtttacagtatggagcgtggaactactgctgcaatcaatcccagtacagatcttgtagatgatgtggcagctcaaatattgatgcccgcatcttga

SEQ ID NO: 276 - DNA, 807 bp, Oryza sativa
  misc_feature (78)..(78): n = any nucleotide
  misc_feature (88)..(88): n = any nucleotide
  misc_feature (468)..(468): n = any nucleotide
  misc_feature (636)..(636): n = any nucleotide
  misc_feature (726)..(726): n = any nucleotide
atggtcaccgcgctagcccacgtcatccgcgccgcccccgacctgcacctcccccaccacccatcctcctccgcctcngccgccgccnacccgcagcaggcttcttccttctacccgaccgccgccgccgccgcctcctcgccgtccgaccagctcgccgccgccgccgctgccgaagagcaagggaggaggcggcactacagaggtgttcgacagcggccatgggggaagtgggcggcggagataagggacccgaagaaggcggcgagggtgtggctggggacgttcgacacggcggaggacgccgccatcgcctacgacgaggcggcgctccggttcaaggggaccaaggccaagctcaacttccccgagcgcgtccagggccgcaccgacctcggcttcctcgtcacccgtggcatcccccccgccgccacccacggtggcggctactacccctcgtcgtcgccngctgctggggcatgccccccgccgcggcagcagcagacggtcgtgccgtacccggacctcatgcggtacgcgcagctgctgcagggcggcttcggcggcagttacatgccgttcggcggcgccgcaacgatgtcgtcgtcgacggtgtcgtcctcgtcggcgccgcanatactcgacttctcgacgcagcagctcatccgggccggcccgcggtcaccaatgccatcgtcgggctccggctcggcgaccgcggcggcntcgtccacgacgtcggcgtcgtcgcccggtgcatggccgtacggcggctcggagcgcaagaagaaggattcgtcgtcgtga

SEQ ID NO: 277 - DNA, 774 bp, Oryza sativa
atgctaccgaagagggtcgtgaaggagaaggttgccaggcgaaaggaaagcgacgccggaccggacatggccgccgaggaaggagcagagccttcggcgcccgtggccgaagatggaggaggacaagcgccatcacaaccgccttcggcccctgcaacctttgtgcaagagccgaacgcggccgacgtggcgaaggcggctgcggcggcaagggcactccagaccagggcggagatcctttcgacaggccaactggtggtgccccaagccgctccatcgcagccggcagcggccccaactgcgctcgccgttgtgcaggcccagccacacaggcgccggtgtacttcgccgggcagcaatcggccgcagcagtgcatccggcccctcacgtgcaacagcaagctcaaccagtcgctgcccaagtacaccatcaaccacctggccaagcgccacaaacagtggcggaaggggcttcggctctgcaggcgcaacttcaagctttccttcagcaactcaaccaaccccactgcatttcaagtacaatcccatcggcccacccggaggggaatacaagtcaagcaaggtgcggtaaacagggcgggaggcgaaaaggggctaccgctgagtgggggaatcaagactcgtccaatcccaccccagttcaagttcccacccgtcctgcgctattcaggcgaagttgacccgaaggagttcctctccatctacgagtcagcgatcaaagcggctcatggtgacgaaaataccaaggcaaag

SEQ ID NO: 278 - DNA, 711 bp, Oryza sativa
  misc_feature (324)..(324): n = any nucleotide
atggaactcccgtggctggatctgcccttcacgctgctgacgctgctgctggcgacgcggctcgcctacgactactacggcgtcgtcgcggccaccttcacggggagcttctcgctccagatcttcctcttctactgcttcgcgcgctgggccggggcgttgaagccggggcccgggcgcggcgtcgtcgctggcgaaccggtgcttcgccgtggtgttcatggtgttcgtgccgctggtcatcgtggtgttcgagcggagccaggccgacgtcgtggcgtacgcgctctgctcgccaacatcctcgtcatggtcgtctggctntcgcccgacgccgccgcggaccccgcgtcggcggccaagtcgttcctccgcctcagcgacgacgaggacgaaggcagctgcagcggcagcggccacggcgccgccgaggacaagtgctgcgtctgcctcgccgggatgcgggaggcgcaggcgctccgcgacctcccccggtgcggtcaccgcttccacgccaagtgcatcggcaagtggctcacggcgcacccgacgtgccccgtctgccgcaccacggccgtgccgccgccggcgccgtgcccgccagcggcgaccatgccgacgacgccatcacccctgtctagctctgcacatagtctgacagacaaactcagattcaagattgtgataagagttgccttgcttgttccgtga

SEQ ID NO: 279 - DNA, 690 bp, Oryza sativa
atggcgtgcgcgtcctcccgggcaaacgtctccgacgtgttcggggcgtggcgggccttgtccttggccggcgccggtctgcgccgaccaccccggccccgcgtccgcactgcggcggcttcttgctccctcctcccgccacctgctgctgcttcgccggcggtcgttcttcgcgtggccggcgggcacgacgaggagaagaacgcgctgcagtccacggtcgcgtacgacgccgaggccgacgcatgggtgccgctcccggacatggcgacggagcgggacgaggccagggggctctgcgtcagtggcatgttcgtcgtcgtcgttgtcggcggagacggagctcgctcgggcagccacgacggcgccgcctctgccatgcacgccttgctcctcgccgccgcctccaccatgatgaagacgacaacgatgacgagtagtccggcgaggggcgcgtcgtcgaggcctgggcaaggggcccggatgagtccgtctccgctgccgaccgtccgggtgagctccgcctccgccgtgcaggccttgcgtggttgcgccagcgagagagaagggagtaattcggttgaccgcgatagttcgggaggtaccggtacttcatggtaccaaatcgttttcgatctttggatccagctaggtaggatagacattgttagatccaacgatcgtaaatga

SEQ ID NO: 280 - DNA, 627 bp, Oryza sativa
atgtgtaacgtcctcgtcctgtattttagaagaacgctcgctaaaaagagacaaaaaaaggcggaggcaggagctggctggagacgatggcggcgtcgagccagaggcggaggtggaggtggctcgctgtcgctggaggcggcgtggaggcggatgcggctcgttgtcgctagaggcagcgccgtcgcgccaaggcggaggtgggccactggaggcggcaccgaggtggaggcgggctggctggacggcggaggcggtacggtggcgcgatggaggcggcgccgcgccgatccagtccactcccagtctcccaccgtccagtcccagacagagtcccacaggcgcacgattcctcacctcctcatcggccggcgccgccgcggggccaagccgtcgtcgcctcctcgctgcggggccaagccgccaccgccgccgggaccaatcgcctcctcgcccagtcgccacatcgccgccgtcggagcaacccacgccggctctgccgcgccccatcgcctcctcgcgccgtcacgcgccacatcgccgccgccgggccaagccaacgccgccgccgcggcgccccatcgcctcctcgcctgcctcaccgtcaagccccaagatttggtatga

SEQ ID NO: 281 - DNA, 621 bp, Oryza sativa
  misc_feature (129)..(129): n = any nucleotide
  misc_feature (133)..(133): n = any nucleotide
atggccgcgtcctactacaacaacccgccgccgccgcactcctcgtacgcggccccgcctccgccgccgccgccgccgccgggcacctccctgtacgcctcctaccgccaccacgcctaccctcctcanccgncgccgccgcccgcgtacgtcggcgcgtactacgaccacgcggcggagccactgccgccgcgcgacgagctccgcacgctcttcatcgcgggcctccccggcgacgccaaggcccgcgaggtctacaacctcttccgcgacttccccggctatgtctcctcccacctccgcacctccggcaaatcctcgcaggcatatgcgttcgctgtctttgcagatcaaccttctgccttagctgcaatgagtgcccacaaacgtaagagctcgcttcagcattatcagggaaggatatttgaccttgagaataattgcacactgcatgtagatcttgcgaaatctaattcaagatcaaagcgctccagaacagttacacgaactttgagcctgctgctttcagcaagtcccaccattgccaccattgcagctcatctgcttgacgatgaggagcagcagcagacgcatgagatggttatggagaggggagcatga

SEQ ID NO: 282 - DNA, 600 bp, Oryza sativa
atgaccaccaccaccacaacctcctcctcctcctcctcatcctcctctccttcctcctcccctcccccgcctcgccgtcgccatcgccaccaccgccgcgccgcccgcaggacccacccggtggaggcggaggccgaggaggtgtggcgcggggcacagtgggaagccgcgtggccgcggcggacgaagccggtggtggtcgccgaggacgagccgccgagcggcggcgtcatcgtcggcgcgtgcacggcggggggcggcgaagagggcggcggcgtggggcgcgcgcggagcctgaccgacgacgacctggaggagctcaaggggtgcgtggatctcgggttcgggttcagctacgacgagatccccgagctctgcggcacgcttccggctctcgagctctgctactccatgagccagcgcttcctcgacgaccacccccagtcgcaccactcgccgccgcctccgccgccgccgatgccctcgccgtcgattcccaactggaagatctccagccccggagacagcccggacgaggtgaaggctcggctcaagtactgggcgcaggccgtcgcgtgcaccgtcaggctctgcagctga

SEQ ID NO: 283 - DNA, 549 bp, Oryza sativa
atggccacgtcagcctactctctctctctcttcccctcttctctcccttcctcatctctctctgtctctccccttctctgcgaggctgccagtgcgagccgggagaggagggcgtcggcggccggcgatgggcgatgcggcggcggtgggggaggagctgcgggcggggagccgcacctagtgaagctgcagccgtcgacgaggagttccttgccgtcgcggtggagcgccgacgccgggcagcgtcctgggtgggcgtcgggctcgccaccgaccagtgctgccttctccctttacaacctcaagccggcacccaccagtgctgcctccccgctggccgtcgtgctcgttgacgagtcggcgagaccggcgtcgccgtctgcaaagtcgcggctgttcccggccaaggtcaaggggagggtgggacccgtttctgcggcggtggcgagcgcggctcgtccgcctcgccgccgtcttcgtcgctgcggccctcatcctgacagtggatctgatactgctgagttcgtcgatttgatacatatctgctaa

SEQ ID NO: 284 - DNA, 543 bp, Oryza sativa
  misc_feature (59)..(59): n = any nucleotide
atggcgtccgcaccgagcaccaccgcgtccggcctcgcgccgccgccgttctcctcggngcgcggcgcgcgcctcctccccggcgcgctgctgcgcctcccgccgcctccggcctcggtgggtagcttccgcgtggtggggcccgccgccgccccacccggcggccgccgcatcgccagcgcgcgcgtgcggtgtggcgcggcggtgaggttcatcgggcagagcgagttcgaggcggaggtgttgcagtcggacctgcccgtgctcgtcgacttcgtcgccgactggtgcgggccgtgccgcctcatcgcgcccgtcgtcgactgggccgccgaggaatatgaagggagattaaagattgtcaagattgatcatgatgccaatcctcaactgattgaagagtataaggtttatggtctcccatctcttattctattcaaggatgggaaagaggtaccagggagcagaagagaaggcgcaattacaaaagccaagttcaaggaatacctcgaacctctcttgtcaacctcaacagttgcttaa

SEQ ID NO: 285 - DNA, 513 bp, Oryza sativa
  misc_feature (390)..(390): n = any nucleotide
atgcggcggctggttgacgtcgtggaggcgccggcgctggtgctgacgccggcatgggcggccacggcctccatgcagcaggccggcgggagctccggcgccttggacgccaacatggtcatcgtcctcgccgcgctgctctgcgtcgtcatctgctccctcggcctcagctccctcatccgctgcgcgctccactgcgcccgcggcctctcaccctcacccgccatggcgacgccggcagctgccaccaccacgggcgggctgaagaagaaggagctgaggaggattacggtggaggtgtacggcgccaagcaggccggcgtccccgacgccgagtgcgccatctgcctgggcgacttcgccgacggcgacaaggtgcgcgtgctcccnaggtgccaccacggcttccacgtcggctgcatcgacacgtggctcgccgcgcacacgtcctgccctacttgccgggactccattctctccgtccatggagtcgtcgccggcggccaaacatag

SEQ ID NO: 286 - DNA, 503 bp, Oryza sativa
  misc_feature (1)..(1): n = any nucleotide
  misc_feature (4)..(4): n = any nucleotide
  misc_feature (6)..(6): n = any nucleotide
  misc_feature (10)..(10): n = any nucleotide
  misc_feature (14)..(14): n = any nucleotide
  misc_feature (20)..(20): n = any nucleotide
  misc_feature (186)..(186): n = any nucleotide
ncantnctanggtnccagantttggaaccgaaggaattataactggtgcacgggggcacacggtccgcgcatacctccttgttggcgatctcggacttgtaggggaggacgaagttgacggtgagcttggaggggatggccgccggcgtgggggggccgggctgcatgagcgacatgggcctggcnggggcctcgatgttgggggccaccttcttccaagcctccgcgaaggcggagtccgtggccgcctcggccggcacctccgccgtcgagagcaccctgctgctgcggccggcggcggcggcggcggcggcgcgggtggtggccaggcggcgggcggcgtggcgcagcatttttctttttcttctttttctctctctctcgtttctcctctcctcgctgcggctgcgggtgggtggaatggggttccagaggtgtgggcgatttggagggcgagggtttacgaccgatatgcccttccgttccgtttcgagcaccggtga

SEQ ID NO: 287 - DNA, 450 bp, Oryza sativa
  misc_feature (284)..(284): n = any nucleotide
atggaggcccagccgcccgcgcatgcgcagctgggtgggtctgcgacgctggcgaaggccggcggtcgggaggcggcggcggaggaggaggtcgtgttgtggagggaggacgcgaggaggttcgagacgcccgacggcgaggcctacctccagtaccgcctcctcgccgccgcccagccgcgctcctcctcctccggcgacggcggcggcggcggcggcgcgacgacgccggcagcggtgatggagatggcgcacacgtacgtgccggggagcaagcgcgggcntgggctcgcggcgcggctctgcgacgccgccttcgcccacgcgcgggagcgcggcatgcgcgtcctccccacctgctcctacatctccgagacttacctccctcgcaacccggagtggaacgagctcgtgatcacggagaaagaacccaaacccagcagcatgtag

SEQ ID NO: 288 - DNA, 444 bp, Oryza sativa
atggcggggatggcggacgagtacaaccagtacggcggcggcgggggagggccgcgcgggggggcggcgccgcacgggctgctgctggcggtggtggtggggctggtggtggcgggcccgctcttcctcggcgacggcggggaggccgtgacggaggccgtcgcggagctgctcagccccgtggggctcctcctcctccccgtgtgcctcctcctcctcatccgcctcctctcctccgaccgcggcgccgccgcgttcgccgaacgcgttcgccttcgggggctcccccgacgccgtccaccgcgtcggcggctcgcccgtcggcgtcgcgctcatgctgctcctcatcctcgccctcctctactaccgcaccggccctctttcgggcggcgaacggcggcgacgacgagtagagctccgccgtggtggtcgatctcgtactag

SEQ ID NO: 289 - DNA, 435 bp, Oryza sativa
  misc_feature (151)..(151): n = any nucleotide
  misc_feature (318)..(318): n = any nucleotide
  misc_feature (374)..(374): n = any nucleotide
atggcgctcgccgtgaagctcgccgtcctcctactacttgccgcggcagcagctggaggaagcagcacgacgaccgtgccgccgctggaggagaggctgggcgcggcgttcgacgggatggcggcggcggcggagggaggaggaggggganggtggatgatggagtgctggagcgcggtgacgaagctggggtcgtgcacgaacgagatcgtgctcttcttcgtcaacggcgagtcctacctcggcccggactgctgcgtcgccatccgcaccgtcacccgccgctgctggccggccatgctcgcctccatcggcttnaccgcccaggaggccgacatcctccgcggcttctgcgacgccgagctcgccgcccngcccccgccctccaccaacgcctcctccgccgcccccgcgccggcgccggcgtccgcttag

SEQ ID NO: 290 - DNA, 333 bp, Oryza sativa
  misc_feature (244)..(244): n = any nucleotide
atgttccgggcggtcggcgggcgaatcggaggggcggacggggtcgacgaggacgcggcgaagccaaaggaggcgacgccgagaggggaggaagtccggagcgacggcggcggcgaaccggagctcgtcggcgacggcggagagagaggaagacggcacgggcttgattccgacggggagagaagagagggaaaagagggggaaagagggagggaatcacggggagtgatttccccctcttttnactggcgcgcggggacggcgggatgcggcggattcggcggcggcggcggcgctagggcacgggcgggcggcgggcgcggcgcgaggtag

SEQ ID NO: 291 - DNA, 318 bp, Oryza sativa
  misc_feature (7)..(7): n = any nucleotide
atggccntgagaaaaatccgaggtcgccgctactcttcacccaaggccgccgtcggattcgggcgggacgaggtccgccgccgccggatccgggcgggacgagaaccgtcgccgccggatctggcccgtcggctcctcgtcgtcgtcggcggcgacggtgaggaggagatggcggtggtgccgccgcccgaggttgccgcccactcttcgaccgaggtcgccgcccccgccaccgccagctccaggccggagcccaaggcggccgagcagtgccgccgccgccgccgccagctcccgccaccgccaccgccgccctag

SEQ ID NO: 292 - DNA, 315 bp, Oryza sativa
  misc_feature (144)..(144): n = any nucleotide
  misc_feature (147)..(147): n = any nucleotide
  misc_feature (149)..(149): n = any nucleotide
  misc_feature (153)..(153): n = any nucleotide
atggagcccgcgacgagccgggcgccgcgcagccgcttcgtggtgtggctgcacggcctcggcgacaccggccgcgccaacgagttcctcgccgacagcttccccaccacggccgccttcgccgacgcccgctgggccttcccnacngngccnaccgctccggtcacttgcaaccgcggcatgctcatgccctcgtggttcgacatccacgacgcgcccatcacttccgttagatatctctgccacaacgaaaattcccctgtttatgccatgcttgcagaagccagaaaaggaacaattgtgatgttcacttga

SEQ ID NO: 293 - DNA, 300 bp, Oryza sativa
  misc_feature (17)..(17): n = any nucleotide
  misc_feature (33)..(33): n = any nucleotide
  misc_feature (71)..(71): n = any nucleotide
  misc_feature (100)..(100): n = any nucleotide
  misc_feature (105)..(105): n = any nucleotide
  misc_feature (116)..(116): n = any nucleotide
  misc_feature (140)..(140): n = any nucleotide
  misc_feature (144)..(144): n = any nucleotide
  misc_feature (161)..(161): n = any nucleotide
  misc_feature (166)..(166): n = any nucleotide
  misc_feature (204)..(204): n = any nucleotide
atgtcgggctctttccnaatcattgtgaaggcngaatttcaccaagtgttggattgttcacccaaccaatnggggaacgtgagctggggtttaaaccgtngtganaacagggcctntaagtcagaatccaagctagcaancggngcctgggcccgcggccngcccngacccacgttaggggcgcaagcccccaagggcccgtgncaacggccaagccggcccggccgaagcgccgcggccggccgcctcgaagctcccttcccaacgggcggcgggctgaatcctttgcagacgacttaa

SEQ ID NO: 294 - DNA, 2908 bp, Oryza sativa
  misc_feature (32)..(32): n = any nucleotide
  misc_feature (60)..(60): n = any nucleotide
  misc_feature (106)..(106): n = any nucleotide
  misc_feature (115)..(116): n = any nucleotide
  misc_feature (124)..(124): n = any nucleotide
  misc_feature (400)..(400): n = any nucleotide
  misc_feature (429)..(429): n = any nucleotide
  misc_feature (1462)..(1462): n = any nucleotide
  misc_feature (2350)..(2350): n = any nucleotide
  misc_feature (2362)..(2362): n = any nucleotide
atggcacggggttccgctctgctcgatggtancgtgctgccgcctttccgggatcgtgancgagaggcaggctgggctgtcgcgccgcttcatgccggaatctgcnaccggccgnnagatagtnacgctgggcgagggacgcccggcgccagactacccggggcggtccgtcttctttctcccctttgcaatggcagggctggttccgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggnggctgctacttccagccacgggggccggngctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcgacgcgctcggggcgcctgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgagagggggtcgtgcttctgggtcccgcgacaggggcccggggagcagccgccctgccgacgcccgggggaagaggaagcagggaggaacacctcccccatctcctccccgaggggccggggcggcgcgtgccagcagcaggcgcccggagggggccgcgccaacatcgcagcccgagggggagcgcaagaagaagcggccccgcaagatgggggagacagaaccatctcggggaaacctcatttcccctccaaagtggtcgtttaaccgaccccctcgcagcagcgagatcccgtcgcgtccctcccgccattccaagtccggccagtctgaggccgaggatccggcggccgcagaggccctcaggcgggaatctgaccggcgagaggccgcggatcgcctacgggaagccgaggaggccgcccaggaggccgcccgggctcgccaggccgaggaaaccgctcgggaggaggccgcccgngcccgccaggccggggaagccgctcgggaggaagccggatttcgccaggacgaggcgatggcgacttccgaggcagctcgcgacgaggccgcgggcgcgtcgcttgggcccactccctcgggcgacgctcaggcgacaacttccggggcagctggcgacgaggctgcgggcgcgtcgcttgggcccactccctcgggcgacgctcaggaccaaccgggtccgggggacatccccgagtccggcacttccatcggcggcccgagccgcgtggcatcctctccaaggcggctcttccccacgccttctatcgccccactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcggtggaggccatggtggaggtgggccgtaaggctcaccgccggcacgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaggcggagctaaggaagaagctcgacgccgcccagggggtgcttgacgctgccgctgcccgagaacagcgggcggcggagaccgaagcggcgtcccggcagcgtgaagaggcccttgaggcgcgcgccatggcgctggaagagcgcgcctgcgtcgtggagagggatctggcggaccgcgaggccgccgtcaccatccgggaagcaacgctggcggcgcacgaggctgcttgcgccgaagaagangaggagcaggcncgccgcaatctggaaggtgcccgcgccgagagggccgtactgaaccaacgggccgctgagctcgaggcgcgggcgaaggagctggacgcgagggcgcgcagcggcggggcggccacgggcgaaagcgacttagccgcccgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcag

SEQ ID NO: 295 - DNA, 2322 bp, Oryza sativa
atggcgatgctgctgttgttgcgttctttggagttcttggcgatcatggcggttgcatcgagcttggcaatgccggtggcggcggcggcggcggtgccacagccggagccggaggtgaagccgagcgacaccgacgcgctcaccatcttccggaacggcgccgacgcgcacggcatcctggcggcgaactggagcacctcgaacgcctgcgccggcgggtggatcggcgtcggctgctccggcgacggccgccgcgtgacgtcgctgtcgctgccgtcgctcgacctgcgtgggccgctcgacccggctctcccacctcggcgagctccgggcgctcgacctccgcgggaaccgcctcaacggcacgctcgacacgctcctcctcggcgtccccaacctcaagctgctctacctctcccacaacgacatctccggcgccatcccgggacgccatcgcgcggctcctccgcctcctccgcctcgacctcgccgacaacagcctgcgcggggccatcccggtggccgcgctcgccaacctcaccggcctcctcacgctcaagctccaggacaacctcctcaccggcttgctcccggacgtcaccgccgccctcccgcgcctcgccgagttcaacgcctccaacaaccagctctccggcagggtgcccgacgccatgcgcgccaagttcggcctcgcctcgttcgccggcaatgccggcctctgcgggctggcgccgccgctgccggcgtgctctttcatgccgcgcgagccagccccgacgtcaccctccgtcccgtcgtcgccgcagtccgtggtgccatcgaacccggcggcgtcgtcgtcgtcgggttgcttcgtcctcgccggcgttggccacaccggagtcgcgcgacggacccggcaagggggggttgagcaccggcgccattgccggcatcgtcgtcggcaatgctctcttcctgttcgccatgctgtcgctgctcgtggcgtcctgctgctgcagcaccggcggcgagagcggcggcgagccacccaagaagaggaaacgaggcggccgcgtcggcctggaggatgacgacgacggcgggatgttcggccaaggcaagggcgtgcagccaggccggccaggcagcgccggcatgcgcagcgacgacggcggagacagcgacggcgcgcgcagcaagctggtgttcttcggggtggacggcggcgaggacgacgacgacgacgacggaggcggcagcgacagcagcgccggcaggagggcaaccggcggcggctggacggcggcgccgcaccagcctcacgggaggaggagcaggttcgcgctggaggagcttctccgcgcgtcggcggagatggtcggccgcggcagcctgggcaccgtgtaccgcgccgtcctcagcgacggccgcatggtcgccgtcaagcggctgcgcgacgccaacccatgcgcccgcgacgagttccaccgctacatggacctcatcggccgcctccgccacccaaacctcgtccccctccgagccttctactacgccaagcaggagaagctcctcatctacgactacctccccaatggcaacctccatgaccgcctccacgggcaccggatgtcgggggagtcgccgttggactggacgacgagggtgaggcttctcctcggcgcggcgcgcgggctggcatgcgtccaccgggagtaccgcacgtcggcgatcccccacggcaacgtcaagtccaccaacgtcctgctcgacaagaacggcgtcgcctgcgtcgccgacttcggcctggcgctcctcctcagcccggcgcacgccattgcccgcctcggaggctacatcgcgccggagcaggaggacaacaagcggctgtcgcaggaggccgacgtgtacagcttcggcgtgctcgtcctcgaggcgctcaccgggaaggtgccggcgcagtacccgcagccgtcgccggtcgtcgccgccgacgccgccgcagacgcgcagaggaaagacaagaggtgctcgacggcggtgagcctgccggagtgggtgcgatcggtggtgcgggaggagtggacggcggaggtgttcgacgtggagctgctccggtacaaggacatcgaggaggagatggtggcgatgctgcacgtcgcgctggcgtgcgtcacgccgcagccggagcagaggccatccatggccgacgtggtgcggatgatcgagagcatcccggtggatcagtcgccgttcccggaggaggacagggacatctccaccatgtcgccgtcgatcggcattaccactgacgacggagatggtcgtctcagctgctag

SEQ ID NO: 296 - DNA, 2004 bp, Oryza sativa
atggcacggggctccgctctgctcgatggtagcatgctgccgccttcccgcatcgtaagcgagaggcaggccgggctgccgcgccgcttcatgccggaatctgccaccggccgggagatagtcatgctgggcgagggacgcccagcgccatgctacccggggcggtccgtcttcttcctcccttttgcaatggcagggctggttccgccattttcttctttcttcatggatgttctggagttttacgatctccagatggcgcacctcacccccaatgcggtaatgacattggccatctttgcgcacctgtgcgagatgttcagcggggtgcgcccatcccttcggctgttccggtggttcttcaccgtacagtcggtgtcgccgccgtcggtggctcgggaggaggccagactccaccaggccacggcgacgacgacttccgaggcagctcgcgacgaggctgcgggcgaatcgcttgggcccaatccctcaggcgacgctcaggacaagccgggtccgggggacgtccctgagtccggcacgtccatcggcgagccgaaccgcgcggcatcttctccgaggcggctcttccccacgccttccgtcgctccactgagcgcagaaccccttctacaggccttggccgtcgcaaacaccacggtgttggacgggttaagtgcccaggtagaggccctgcaagcagagcgggcggagctcgacgccgcatgggcgcgtgtcgaagaggggcgacgctcggtggaggccatggtggaggtgggccgcaaggcacaccgccggcacgtctctgagctcgaagcccgccgaaaggtgctgggggagatcgccaaggaggtggaggaggagcggggggctgccctcatcgccaccactgtgatgaacgaggcgcaggacaccctccgccttcaatacgggagctgggaggcggagctagggaagaagctcgacgccgcccaggaggtccttgacgctgccgctgcccgagaacgacgggcggcggagaccgaggtggcatcccgtcggcgcgaagaagcccttgaggcccgtgccatggcgctggaagagcgtgccggcgtggtggagaggggcctggtggatcgcgaggccgctgtttccatccgggaggcaacgctggcggcgcacgaggccgcctgcgccgaagaggagtccgcactccgcctccgcgaggacgcgctcaccgagcgggagcgagctctcgaggaggccgaggccgcagcgcaacggctagcggacagcctgtccctccgcgaggcagcgcgggaggagcaggcgcgccacaatctggaaggtgtccgcgccgagagggccgcactgaaccagcgggccgctgaactcgaggcgcaggcaaaggagctggacgcgagggcgcgcagcggcggggcggccacgggcgaaagcgacttagccgtccgcctcgcagctgccgaacacaccatcgccgatctgcagggcgcgctagactcgtccaccggggaggtcgaggccctccgcttggcaggcgaagtagggcccggcatgcttcgggacgccgtctcccgtctagatcacgccggccggcaggctggcctctggggcgggcggactgtgaagtacgccgccaaccaggggggcctcgcccagcgcctctcggaaatggccgggactctccagcggctccccgaggagctcgagaggacgattaagtcatcctcgagggacctcgcccgaggagcagtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgacccgggtgcatcggagtga

SEQ ID NO: 297 - DNA, 1980 bp, Oryza sativa
gaaattccgggcgtgacagtagttgagtgtgaggaaggcgaacaagagggccctccggctcgcgatggcccctcatcccccgaaggtctagcgcccaaagcttccagcccccgggagggccccgaggcccccaagggaggagcgaaggctttggcaagtggccctgagcttgatgatcccgaggcagtccgggatccccccgggaccaccgaacaggtgcgccccgagtcaccagcccctgacagcacgaatcggccccgccgaaaggtgcagcggcccgtctacttcgtcagcgaggcactccgagatgcgaaaacccggtatccgcaggcccagaaaatgctttatgccgtcttgatggcctcgaggaagttgcgtcattacttccaagcgcatcgggtttccgtagtgacgtcataccctcttggccaaattttgtacaaccgagagggtactggacgggtggtaaaatgggccatcgagctggctgagttcgatctgcacttcgaaccgcggcatgcgatcaagagtcaaatcctggctgacttcatcgcggaatggaccccgacttccaggccacgaacaacatggcagaatatgaagggctcctcgcgggattgagggcggcagccagaatgggcatccgccatctcctggtcttaggtgactctcagttggtcgtaaatcaagtacccaaagaatatcagtgcacctgaccagcaaatggaagcatacgtccgcgaggtacggcgcatggaacgcaacttcgacggacttgagctccggcacgtgccccaacgcgacaacacggttgctgacgagttgtcgcgtgttgcgtcggcacgagccccactccccccggggactttcgaagaaaggcttgcgcaaccatcggcgcgaccgagccctttgagggaccccaacgacgcgcccttcggcccaacccctggcgacccgcgcccctcggggcccgaggaggtcaaccccgacccctctcgtcaggttgtgtggatgaccgacatccgggcgtatctcgacgggaatactcttcctgaggaacgcgcggaagctgaaaagctcgcacgcatctccaagcggtacatcctcgtagagggggccctctaccggcgtgccgcgaacgggatactcttgaagtgcatttctcgggagcagggcatcgagctcatagccgacgcccatcagggtgagtacagagcccattcggcctcacgaactttggtcggaaaagccttccggcaaggtttttattggccgactgcattacaagatgcccaagaatgggtccagcggtgcagggcatgccagttccacgccaagcagacccaccagccggcccaagcattacaagtcattccactatcttggcttttcgcagtctgggggctagacatccttggaccgttcaaggcggctcgaggcgggtatcagcacttgtacgtcgccatcgacaaattcaccaagtggcccgaggcctacccagtcgtcaaaatcgacaagcattctgctcttaagttcatcaggggcatcacgtctcgattcagagtgcccaatcgtgtcattacagacaatggcacccagttcaccagtgagctgtttggcgattactgtgacgacatgggtatcaaattgtgctttgcctcacccgcccaccccaagagcaacggccaagtcgagcgagccaacgccgaaatcctcaaaggactcaagaccaagacgtacaatgtcctgaagaagcacggggattcatggcttgaggagttgcccgccgtgttgtgggcaaatcggaccactccaagccgcgccacgggggaaacaccatttttcttggtgtactgcgccgaagcggtcctaccctccgagctttccctgggttcgcctcgtgtcgcactgtacaacgaggccaaccaagatgaccttcgccgcgacgatctcaattatcttgcagaacggagaaggtga

SEQ ID NO: 298 - DNA, 1948 bp, Oryza sativa
atggcgaagggagagggcccggcgatcggcatcgacctcggcaccacctactcgtgcgtcggcgtgtggcagcacgaccgggtggagatcatcgccaacgaccaggggaaccgcaccacgccgtcgtatgtcgcgttcaccgactccgagcggctcatcggcgacgccgccaagaaccaggtcgccatgaaccccatcaacaccgtcttcggatgccaagcgactgataggtaggcggttctccgacccgtccgtgcagagtgacatgaagctgtggccgttcaaggtcatccctggccccggcgataagcctatgattgtggtgcagtacaagggcgaggagaagcagttctccgccgaggagatctcctccatggtgctcatcaagatgagggagatcgctgaagcctacctcggctccaacatcaagaacgccgtggtgactgtgccggcctacttcaacgactcgcagaggcaggccaccaaggacgccggtgtcattgccggcctcaacgtgatgcgcatcatcaacgagcccaccgccgcggccatcgcctacggtcttgacaagaaggccaccagctccggcgagaagaacgtgctcatcttcgatcttggcggtggcacgttcgatgtgtcgctgctcaccattgaggagggcattttcgaggtgaaggccactgctggtgacactcaccttggtggtgaggacttcgacaaccgcatggtgaaccatttcgtcctggagttcaagcgcaagaacaagaaggacatcagcggcaacccgcgtgctctgcgccggctgcgcacggcctgcgagcgcgccaagcgcacgctgtcgtcgaccgcacagaccaccattgagatcgactccctgtacgagggcatcgacttctactcgaccatcaccagggctcgcttcgaggagctcaacatggacctgttccgcaagtgcatggagccggtggagaagtgcctgcgcgacgccaagatggacaagagcagcgtgcacgacgtcgtgctcgtcggcggctccacccgcatccccaaggtgcagcagctgcttcaggacttcttcaacggcaaggagctgtgcaagagcatcaaccccgacgaggccgtggcatacggcgccgctgtccaggccgccatcctcagcggcgagggcaacgagaaggtgcaggacctgcttctgctcgacgtcacgccgctgtcgctggggctcgagacagcaggaggtgtcatgaccgtgctcatcccgaggaacaccaccatccccaccaagaaggagcaggtgttctcgacctactccgacaatcagcctggcgtcctgatccaggtgtacgagggtgagcgtgcccggaccaaggacaacaacctgctgggcaagttcgagctctccggcatccctccagctccccgcggcgtgccccagatcaccgtctgctttgacatcgacgccaatggcatcctcaacgtctctgccgaggacaagaccaccgggcagaagaacaagatcaccatcaccaacgacaagggcaggctgagcaaggaggagatcgagaagatggtgcaggaggcggagaagtacaaggcggaggacgaggagcacaagaagaaggtggacgccaagaacgcgctcgagaactacgcctacaacatgaggaacaccatcaaggacgacaagatcgcctccaagctctcggcggacgacaagaagaagatcgaggacgccatcgacggcgccatcaactggctcgacagcaaccagctcgcggaggcggacgagttcgaggacaagatgaaggagctggagagcatctgcaaccccatcatcgcgaagatgtaccagggcgccggcgcggacatgggcggcgccgctggcatggacgaggacgcgccggcgggtggcagcggtgcaggccccaagatcgaggaggtcgattaa

SEQ ID NO: 299 - DNA, 1830 bp, Oryza sativa
atgctgcgacgctctttggtcgcccatgccgttctcctcttcgcggcggtcgcgctcccgctcgccgccgcccagccatggcctgtctgcggcaccagcggcggcaactacacggcggggagcacctacgagtccaacctcctgcgcctcgcgagcaccctccgcgcgaacgcctccgcctcccccaccctcttcgcctccggcgtccgcggcgtcggcccggacgccgtctacggcctcctgctctgccgcggcgacatgaacccctccgactgcttcgactgcggcaccaacgtctggagggacgcggggccaacctgcaaccgcaccaaggacgccatcctcgtctacaaccaatgctacgcccagttctccgacaggggcgacttcctcgccgccaccaacaactccggcgaggtgagcctcctcataagcggcaccaacatcaccagcaccgacgtcgccggctacgaccgcgcggtcaccgagctcctcaacgccaccgtgcggtacgcggtggagaactccacgaagctgttcgccacgggccagcgggtggggaacgacacggggttcagcaacatctactccatggcgcagtgctcgccggacctgtcgccggcgcagtgccggagctgcctcgacggcctcgtgggccagtggtggaagacgttcccgctcaacgggaagggggcgagggtcgccggcccgcgctgctacctgaggtccgagctgggccccttctacaccggtaatccgatggtgcggttgccggtcaaggccgacgagctcacgcagtttagtcaaaattatgcaaacttgccagctgatacaaatgaggactttgaaagtgtcaagtcaaccctgttatctctggcatcactgcaagtggcaacggataacttccacgaaagcaataagattggtgaggggggattcggtgccgtttataagggaattcttcatggacaagaagtggctgtgaagaggatggccaagggctccaaccaggggctggaagagctgaaaaacgagctagttcttgtcgccaaacttcatcacagaaatcttgttcgtcttgttggtttttgccttgacgagggggagagattactcatctatgagtacatgtccaataaaagcctagacacctttctttttgatgcagagcaaaagagaaaactagactgggcggtaagatttaagataatagaaggcattgcccgggggctacaatatcttcatcaggactcccaaaagaagatcgtccaccgtgatatgaaggcgagcaacattttactagacgcagacatgaaccccaagattggggactttggccttgctaggctctttgggcaggatcagactcgagaagtcacaagccgtatcgccgggacattcggttacatgcctcctgagtacgtgctgcgcggacagtactctacgaaatcagacgtgttcagctttggcattcttgtcatagagatcgtgacaggccggagaaggaatagcgggccatatttgtctgagcagaacgatgaagatatattgagcatagtacggaggcactgggaagagggagcaattgcagagatgattgatcattccttaggaagaaactacagtgagaccgaggtgctgaaatgtgtcaatattggactcttgtgcgtccagcaaaaccctgtagatcgacctacaatggcggatgtcatgattttactcaatagtgacactacttgcactatgccagctcttgcacctaggccagcatatttgatcgatgggacctctggttactcccagaccgtaacacaatggtccggcaggtag

SEQ ID NO: 300 - DNA, 1790 bp, Oryza sativa
  misc_feature (130)..(130): n = any nucleotide
atgacggcacgcggggcgctccgccgcctcatccctagccacctccaacccgtcagccgccgcgccccgccgccgccgccatcggcggccgacgaggggcccttcccggacccctacgctctccttgtcnacgaccccatcgatctcctttcctctctgtggcgccgcgccttcgctcacccgctcccggcgcccttccccaacttctccgggtacgcctcccgcctcgatctctggctcctctcttaccagcgagcctgcgcccacgccacgggctccttcccgccacgccacgccgtccagctccccaccctccactccctcctccgcctccccccgttccaggaccgcgtcgtccaggagctcctcctcctgctcctcgagcccgtcttcgagccccgtttctctccgaagtcccacgccttccgccccggccgcgggccccacaccgccatccgctccgtccgctcccacttcgccgcctacctctggttcatctccgcggacctcaccggggtggtcgacgcactctcgccttataccatactctcctgcgtccagaaggccgtctctgaccgcaaggtcttatctttgctgaagtcggcgctcaatgcccctgtccggcctggggcctagctaagaagaggctgaagaggaaggttctcaggaaaagcaggaagaagaaggtgctcaatgagaacgagcccaagcctgatccgtattggttgaggttattcttcgggtttgccccagaacaggcgtgccatgcaccgaattatgggcattgtgggatacttagccctttgcttgccaatgtgtgccttaacgaactggattggtggctcgaggagagaattcatgagtacttccgcccgtcaagccatgattcgatttggaaggaggcgggtgatgaaggatgccataatcctgcctggcctgagtttgtcccatcaagtgggaaggagaagacaaggaagatggattaccttagatttggctcccatgttcttattgggatcaggggaccaagggaggacgcagttgagataaggagacaactgatggagttctgcgagagcacgtttggtttgaggcctgagaattcgatggtagagattgagcacatcacaagagggattgagttcttggatcatgtgatcacccgccgggtcatctacccaaccttaagatataccgctagtggagggaacattgtgagtgagaaaggtattgggacattattatcagtaacagcaagccttcagaggtgcataaggcatttcaggaagcttgaacttgtaaagggggatcgggatcctgagccattgccatgttcaccaatgctgtactctgggcaggcgcacactaactctcagatgaacaaatttcttgagaccatggctgattggtacagatatgcagacaaccggaagaagattgtagggttctgtgcatatgtcattaggagttccttggcaaagctttatgcggcaaggtatagactcaagtctcgagctaaagtttacaagattgcctcacgtgaccttagccgcccattgagagagagcacaaggaatgatgcaccagaatactctgatctcttgagaatgggactagttgatattattgagggtgtacaatttgcacgcatgtcatcaattccatcgtgtgactacacacctttccctagaaactgggtgcctcaccacgagcttgtattgcgtgagtatattaaactgcaagatccaaaattcttctgtgaacttcataagacaatcaaaaggaaggag

SEQ ID NO: 301 - DNA, 1776 bp, Oryza sativa
  misc_feature (293)..(293): n = any nucleotide
atgagagatgcgtcctccgggctcctcaactacgcccgcttcagcggcctcctcgccagctgcggtcgcgagggagacctccgcctcggcgccgccctccacgccgccgtcgtcaagaaccccgcccacttccgcctctgcgcgagccggccctggctccgccacgtcctcgtcgcctggaactcgctcgtctccatgtacgccaggtgcggccgccgcgaggacgccgccagggtgttcgacgaaatgcgcgtccgcgacgccgtctcctggaactcgctcatcgccgcctnccgcggcgccggcgacgcgctcgcgctgttcaggcggatgctgcggtcggacgcgcgcgcctgcgaccgcgccactttcacgacggtcctgtcggagtgcgcgcgcgcgggcgcggcgtcgctcccagcgtgcgccatggtgcacgggctggtggtttcgtgcggcttcgaggcggaggtgcctgtcgggaacgcgctggtgacggcctacttcgagtgcgggtctccagcctcggcagagagggtgttccatggaatggcagagaagaacgtcatcacgtggacagcgatgatctctgggatggccagggcagagctgtacaaggagagcttcagtctttttgggcagatgatccgcacggtggatgccaacaacgcgacgtactcgtgcgccctgctagcttgcgccagatctttagcagcaagggaaggtcagcaggttcatgggcttgttgtgaaggctggattcgaggatgatctccatgtcgaaagcggcctcatggatgtctattccaaatgcggtttgatggaggatgctctgaccgtctttcgctcttgtcgagaacccgatgaagtttttctgacagtgatcctggttggatttgctcagaatggactggaagagaaagcattcgaattgttcgccgagatggtgggtgcaggaaatgagattgatgaaaacactgtttctgcagttctgggggcattcggtgcttctgcgccatttgctcttgggaagcaaatccatgcattggtcatcaagaggtgttttggagtgaatacctatgtctgcaatggtttggtcaatatgtattcaaaatgcggtgaattgagagagtctgtccgggtgtttgatgaaatgcccagtaagaactcagtttcatggaactccatcattgcagccttcgccagacatggacatggttcagaggtctatcagctgttcgaatccatgaaagctgacggtgccaagcccaccgatgtcacattcttgtcgctgcttcatgcttgtagtcatgttgggtcagctaagaagggactggagatcttgaattctatgtcatcacagtatggagttcttccaaggatggagcattacgcatgtgtggttgatatgcttggccgagccggcttgttagacgacgcaaaatcgtttatagaagatggacctttcacggacaatgctcttctttggcaggctttaatgggagcttgtagcttccatggcaactccgaagttgggaagtatgcagcagagaagttgctcctcctggaccctagttgtacggctgcttatgtgttgctgtcaaacatctactcatccgagggaagatgggatgatcgagccaaggtgatgaagaggatgagcgaaatgggcttgaggaaggacactggcaagagctggatcgaactcgagaaggaggttcactctttcgttgtcagatcaacatctcatcctaattcagctgctgctgttcgttga

SEQ ID NO: 302 - DNA, 1704 bp, Oryza sativa
  misc_feature (514)..(514): n = any nucleotide
atggatctcctccagtcgtcctacacgccggacgacgaggacgacgacgagcagcagcccctctcctcgccggacgcctcgccgctccgcctccccgccaagtcggccgcccccgccgtcgacgacacggcgctcgcgctctccgccgccgccgcgtccacctcccgcccgctcgacccctccctccacctcgtcccctttaaccccaccgccgaccagctctgggcgcccgtcctcgggccccagcacccccacgcccccatctcctccgcctccggcaaccgcaaccacaagctcggccacgtcgaggacgccgccgtcctccccttcctcttcgacgagcagtacaacaccttccaccgcttcggctacgccgccgacccctccggcctccacatcgtcggcgacgcccagccctcggccgagcccgacaccgtctacaacctcgccccctccgagcacaagcgccgccgcctgcagtccaaggacgaggagggcgccaaccaggagcccntaccgccggaggccaagaacccgccctgggccggcaagaaggaggcaccacccgcggagctcactgaagagcagcgtcagtatgcggaggcgcacgctgccaagaaggccgagaaggaggcgcgcggcgaagggaagggcgagaagtctgatatggttgccaagagtactttccatgggaaggaggagagggattaccaaggacggtcatggatcacaccgcccaaggatgccaaggcgagcaacgagcgctgctatattcccaagaggtgtgtgcacgagtgggttgggcacaccaagggggtctcggcgattaggtttttccccaagtatggacaccttttgctgtctgcgagtatggattgtaagattaagatctgggatgtgctcgagtcgaggacatgtatgcggacgtacatggggcactctaaggcggtcagagatatatcgttttctaatgatgggactaagttcttgagtgctgggtatgacaggaatatacagtattgggatactgagaccgggcaggtgatctcgaccttctctactggcaaggtcccttatgtagtgaagctcaacccggatgaggataagcagcatgttctcctcgctgggatgagtgacaagaagattgtgcagtgggatatgaagtcagggcagataacccaagagtacgaccagcacttgggagcagtcaataccatcacttttgtagataataataggaggtttgtgacatcaagcgatgacaagtcgcttcgtgtgtgggagttcggcatcccagtggtgattaagtatatcagtgaaccacacatgcattcaatgccatcaatatcactgcacccgaattccaactggctggcagcacagagcttggacaatcagatattgatatacagtaccaaggagaggtttcaacttaacaagaagaagcggtttgcgggtcacattgtggcaggttacgcttgtcaagtgaacttctcaccagatgggaggttcgtgatgtcaggagatggtgaaggtagttgctggttctgggactggaaaagctgcaggagatttaagacgttgaagtgccacaatggagtttgcattggatgtgagtggcatcccttggagactagcaaggttgcaacatgtggatgggatggcgtaattaagtaactggtaagttggctggacaaattataa

SEQ ID NO: 303 - DNA, 1682 bp, Oryza sativa
atcagggagacaacagtgaagaggctgtgcaagagccacaacataatgacggtgaacggtcagttcccggggccgacgctggagataaacgaaggggactcgctgatcatcaacctgataaaccgtgggaggtacaacatgacgctgcactggcacggggtgcggcagatgaggacggggtggtcggacgggccggagtacgtgacgcagtgcccggtgaggcccgggcagagctaccggtatcgcttcacggtggcggcgcaggagggcaccctctggtggcacgcctcctcctggctccgcgccaccgtctatggcgccctcctcatccgcccccgcgatggcaccagctaccccttcgacgtccagcccaccagagagctcgcccccatcctgctcggtacggggagtggtgggacatgaaccccgtcgacgtggtgcgcgccgccacgcgcaccggcgctgctcccaacatctccgacgccctcaccgtcaacgcccagcccggcgacctctacagctgctcctcccacgacacggccgtcttccccgtcacctccggcgagaccaacctcctccgcttcatcaacgccgcgctcaacacggagctcttcgtctccctcgccggtcacaacatgaccgtcgtcgccgccgacgcctcctacaccaaaccgtacaccacctccctcctcctcctcgcccccggccagaccaccgacgtcctcgtcaccttcgaccaacctcccggccgctactacctcgccgcccgcgcctacgccagcgcccagggcgtccccttcgacaacaccaccaccaccgccatcttcgactacggcgccgccaacaacgcctccagcgccgccatcgccatgcctaccctcccggcgtacaacgacaccaccgccgccaccgccttcacgacgaacctgcgcggcctccgcaaggcggagctcccgtcgcgcgtggacgagagcctcttcttcaccgtcggcgtcggcctcttcaactgcaccaacgccacggcgcagcagtgcggcgggcccaacgggacgcggttcgcggcgagcatcaacaacgtctccttcgtgctcccctcctccacctccatcctccaggcgcaccaccacggcgcgcccggcggcgtgttcaccgccgacttcccggccaacccgccggtgcagttcgactacacggcgcagaacgtgagccgcgcgctgtggcagccggtggcgggcaccaaggtgtacaagctcaagtacggctccgccgtgcaggtggtgctccagggcaccaacatcttcgccggcgagaaccaccccatccacctccacggctacgacttctacatcctcgccgaggggttgggcaacttcgacgccggcgccgacacgggcaagttcaacgtggaggacccgccgatgaggaacacggtgggcgtgccggtgaacgggtgggcggtgatacggttcgtggcggacaacccgggggtgtggctgatgcactgccatctcgacgtgcacatcacctggggcctcgccatggccttcctcgtcgacgacggcgtcggcgagctgcagtcgctggaggcgcctccacccgacctgccgctctgctagtgcctcgaccaacacatcaaattaatcacctcttaatctcttatgttattgttagcagctgattaa

SEQ ID NO: 304 - DNA, 1628 bp, Oryza sativa
  misc_feature (1056)..(1056): n = any nucleotide
atgactcacttggttgacacctcggggctccagttcttcggctggctcatcaccgccggctccttcggcctcgccgcgctcatctacgccctcctcaggctgcagagggcggcgtcgctgtactggatcaaggcggctgccagggagaagaaggcggcgtggaagtcgttgcggtgccccagctccggccacacctggaccgaggactacttccgcggcggccagccttcgacgtgctgcgtgtgcctgtcgtccctgaccacagctcagggtgtgggctctcggggtgccgatgccgttgtggtccaccgctgctcggtgtgtggggtggcggcccattctggctgctctcgtggcgccgagaaggactgcaagtgtgtttcacagcatggtgcttccaccttgcttcatcactggtcggagaggtgggtggagctggatgacaacccagagatgtcctctttctgttactactgcgatgagccatgtggtgtgccatttctcggcgtctctccaatatggcgctgcctgtggtgccagcggcagatccatgttgattgtcatgcaaagctgttaaaggagacggggaatacttgtgatctaggccttctcaggaggctcattcagatatttgagcttagtgcttctcagggacctgaagttggattgcaatttttccacaatgtaaaacacttcagaatccttgtttgtggtggggatgggactgttgcatgggttcttgatgctattgaaaagcagaactatgaatctcctcctcctgtttccattcttccattaggaacaggaaatgacctatctcgtgttatgcgctggggtggaggtctgtcttctgttgaaggacaagggggaatatgtgcacttctaaatgatgttgaccacgcagcagttaccgtgcttgatcgctggaatgttgccatcaaagagaagaatggagcagaagatcaatgtaccaagcaagttaaatttatgactaattatatagggtgttggatgtgatgccaaggttgcatatgacttccacactacgagagaggnaaaaccagataaattttgcagccagcagtttgtcaacaagctgatatatgctagagaaggcgctaaggatatcatggataggtcatgttctgatttaccatggcatgttagtcttgaagttgatggaaagaacgtcgaaattccagaggacgcagaaggtgtgattgttctgaacattcctagctacatgggcggtgttgatctttggcaaaacgacaatgaacatgatgatgattttggtttgcaatccatgcatgacaaaatgcttgaaggttgtctgtatatctgggacgtggcatctaggaaaactgcagggactctctagagcacacaggctagcccaagggaaagttataaggttgcatctccacagttcattccctgttcaggttgatggtgagccatggatccagccacccgggtgccttgagatatctcatcgtgggcagcccaccgggcatgccgctgctatcatgagcgaggtcctcatgaatgcagagtgcaatggtgtgattgatgctgctcagaagagattgctccttcatgagatcgcactacgtttgtcctcctga

SEQ ID NO: 305 - DNA, 1452 bp, Oryza sativa
  misc_feature (112)..(112): n = any nucleotide
  misc_feature (115)..(115): n = any nucleotide
  misc_feature (121)..(121): n = any nucleotide
  misc_feature (123)..(123): n = any nucleotide
  misc_feature (129)..(130): n = any nucleotide
  misc_feature (134)..(134): n = any nucleotide
atgacgacgacctcgaggagcgcgcctacgaggcgaccgagaaggtcatcgtctcgatctcggacttccccgacgccgacgacgacgaggaggagtccgggctcgccactcnccnccgccncntcgggnntccngcccttctcgtggaggaagctgtggctgttcacggggccggggttcctcatgagcatcgcgttcctcgacccggggaacctcgagggggacctgcaggccggggcggtggccggggacacgctgctgtggctgctcctgtgggcgtacctccatgggcctcctcgtccagctgctcgccgccagggtgggcgtcgccacggggaggcaccttgccgagctctgccgcgacgagtacccctcctgggcgcgccgcgcgctgtggctcatggccgaggtcgccatggtcggggccgacatccaggaggtgatcggcagcgccatcgccatcaagatcctcagccgcggcttcctccctctctgggccggcgtcgtcatcaccgccttggattgttcattttttggtctcttgaaaactacggggtgaggaaattagaagctgtatttgcgattctaattgcgactatggctgtctcctttgcatggatgtttactgataccaagccaaacatgaagaacctgttcatagtggtcccaaaattgagctccaggacaataagacaagcagttggggttgttggatgtgttatcatgccacacaatgtgtttctccattcagcgcttgttcagtcgagaaaaatagacccaaacaaggaacaccaagtccgtgaagcgttgagatactattcaatagagtcaaccatcgccttggctgtgtccttcatgataaatctctttgtaacaactgtttttgcgaaaggattttatggcacaaaagaagctggtaatattggccttgaaaatgctggacagtatctacaggagaagtttggtggagggtttttccctatcctctacatttggggaattggactattagctgcggggcagagtagtaccataacgggaacatatgctggacagtttataatgggtggatttttgaacttgaagttgaaaaaatggatcaggtcactcatcacccgaagctttgcgattgtgccaacgataattgtcgcactcttcttcgataaatcggattcgctggatgttctaaacgagtggctaaatgtgcttcaatcaattcagatcccttttgccctgattccgctgataactttggtttccaaggagaaagttatggggatcaatggctatctcttgctggatttcttctcttcagaaataagaggcctattatctggctcaattctctgcgtggcagtacttgcttatgcttcttttgtattgtatctcatcctgcggggtaccgagctgccaaatcagatcatcacaactatacgcaagagtttttcatga

SEQ ID NO: 306 - DNA, 1427 bp, Oryza sativa
  misc_feature (11)..(11): n = any nucleotide
  misc_feature (24)..(24): n = any nucleotide
  misc_feature (27)..(27): n = any nucleotide
ctcgtggagangctcctcgtcggnctnctcgcagccgccgtggtcgcgatcgccgtgtccaagctccgcggccggaagctccgcctgccacccggccccaacccggtgcccgtcttcggcaactggctgcaggtcggcgacgacctcaaccaccgcaacctggcggcgctggcgcggaggttcggcgacatcttcctcctccggatggggcagcgcaacctggtggtggtctcctcgccgccgctggcgcgggaggtgctccacacgcagggggtggagttcgggtcgcgcacccgcaacgtggtgttcgacatcttcaccggcaaggggcaggacatggtgttcaccgtgtacggcgaccactggcgaaagatgcggcggatcatgacggtgccgttcttcaccggcaaggtggtgcagcggcaccgcgccgggtgggaggccgaggccgcggccgtggtggaccgccgccgcctgcagctcatgatgtacagcaacgtgtaccgcatcatgttcgaccgccggttcgagagcgcggacgacccgctgttcctccgcctcaaggcgctcaacggcgagcgcagccgcctcgcgcagagcttcgagtacaactacggcgacttcatccccatcctcgccccttcctccgcggctacctcaggatctgcgaggaggtcaaggagacccgcctcaagctcttcaaggacttcttcctcgaggagaggaactcaaatgcgccattgatcacatcctggaggcgcagcagaagggggagatcaacgaggacaacgtgctctacattgtcgagaacatcaatgttgccggcagcgatcgagacgacgctgtggtcgatggagtgggcgatcgcggagctagtgaaccacggggagatccaggagaagctgcgccgggagctggacacggtgctcggcccggggcgtcagatcacggagccggacacgcacaggctcccctacctgcaggccgtggtcaaggagacgctccggctgcgcatggccatcccgctgctggtgccgcacatgaacctccgcgacgccgagctcgccgggtacggcatccccgccgagagcaaggtgctcgtcaacgcgtggtacctcgccaacgaccccgggcggtggcggcggccggaggagttccggccggagaggttcctcgaggaggagaggaacgtcgaggccaacggcaacgacttcaggtacctgccgtccggcgccgggcggcggagctgccccggcatcgtcctcgcgctgcccatcctcggcgtcaccatcggccgcctcgtccagaacttcgagctgctgccgccgcccgggaaggacagggtcgacaccaccgagaagggtgggcagttcagcctccacatcctgaagcactccaccattgtcgccaagccgagagcgttctag

SEQ ID NO: 307 - DNA, 1389 bp, Oryza sativa
ggcttgaacagcaaaacggtggagcgctgcgttggccaactgatgatcagcggcccgacaatggcaggcgacatccccgttcccctttgtgagaaggaggcaaccgagcgtgaagcggtgatcaacgctctccctctgactgacgtcattggaccgctcgtggaccatcaggcggcggcctcgttgaaggagcgagtcgtccaggagacgtccgatgcggccactgctgttgccgcgagtagtgggagccgcccccagaggaggggaagaaagttcacctccgtactggcgtcggacgcgtctccgccacctcctcgacgacaaaagctggtgacgctaggcgagaagcgcgggcgaaggcggcacaagatgggtctggtgagacctccagcgcgtctcctgcggtggcctccacggacgtcgtggtcgccccacgaagtcggaaggcgacgccccactgcctggccggtgatctcgggcctgttcgcggcccgcctgccgatgtcctcagcaggggggagctccaagtcgagatggggcgcctcctcgaagctggtgctcgtggcataagtcgcgagattgccgaggcgaggacagcggcggcgtcgtcggccaacaagcgcgccgacaagctggagcgtaaactggcggaggttcgcgaggacctccagaagatgagggagctggtggccggcaacgagcgacagcggcggggtctcgagggccgtatggcagaactcgagagcaacctatcggagctccgtggcttgttgcgagtcacctacactggcctacaccagctcgccggggaatgtggtgtcaagaccacgatcccggtgaaccccgacaagttctcgctgacgtctttgctcgaggaactggctacggcgatggaggcgatatcctccaagcacacggccaggatcggggaggaggcgtccaacgggatctacaccggggcatgtcacgtcctcgcgtgtgtcaggttggcgcatccggaacttgatctctagcggatcttggagcagggggcgacgaacgacgcgtgtagaggcgtgatggaggaagtcggcgatctgggagagtctgttctcccgctctttgaagaggtcgatgtcgaggatgtccagcagcgtgggcagcctgtggcgccagcgatcattccggctctcgcgtttgaggcacacgcgtcgccggacgatgtagatgagattttaccctcgacaacgggggtggcgacgacttccttagctgcacctcgagtttctccatgaagggttcgctcgttctcgggggactccagcggagatagaccacctagcgaagtcgatggcaccgctggcggagaaagttttccagtctatggactggcattggccttcctggtag

SEQ ID NO: 308 - DNA, 1211 bp, Oryza sativa
atggcgacgaagaggagcgtggggacgctgggggaggcggatctgagggggaagaaggtgttcgtgcgggccgacctcaacgtgccgctcgacgacgcccagaagatcaccgacgacacccgcatccgcgcgtccgtgcccactgtcaagttcctcctcgagaagggcgccaaggtcatcctcgccagccatctggggccgtccgaagggtgtcacccccaagtacagcttgaagcctcttgttccacgcttgtctgagctacttggagtcgatgttgtgatggccaatgattgcattggtgaggaagttgagaaattggctgctgctttgccggaaggtggtgttctactcctagagaatgttagattctacaaggaggaagaaaagaatgatcctgagtttgccaagaagcttgcagctgtcgctgacctctatgtaaatgatgcttttggcactgcacacagagctcatgcttcaactgagggagtgaccaaatttttgaagcctgctgttgctggcttcctgatgcagaagaggaacttgactatcttgttggagctgttgcaaacccaaagaagccatttgcggccatcgttggtggatccaaggtctcaactaagattggggtgattgagtctctgttggcaaaggttgatgtcctcatccttggtggtggtatgatcttcacattctacaaagcccagggatatgctgttggaaaatctcttgtggaggaagacaaacttgagcttgcaacttcacttattgagaaggcgaaggcgaagggtgtttctctcttacttcctaccgatgttgtagtggctgacaagtttgccgcagatgctgaaagcaagtgttgctgcctccgctatccccgatggttggatgggtcttgatgttggcccagatgccatcaagacttccagcgaagcattggacacctgcaacactatcatttggaacggacctatgggagtctttgagtttgagaagtttgcagcaggcactgatgcaattgccaagaagttggctgatcttactaccacaaagggcgccacgaccatcatcggtggtggtgactccgttgctgcggtcgagaaggctgggctggccgacaagatgagccacatctccaccggcggtggtgctagcttggagttgctggaaggcaagaccctcccaggtgttcttgcccttgatgaagcgtaag

SEQ ID NO: 309 - DNA, 1188 bp, Oryza sativa
atgtcaaccctaagccaccagcaccaccatgttctcgtcctccaactcatcctacttctgccctttctccacctcgttgtccccggaacgccagccgccgcccgcaagttctccgacgtgttggcgagcggccgcaacgtgagcgacggcgacgtgctcgtctcccccggcgggtccttcaccctcggcttcttctcccccgccgccaccaggaggaggtggtgtggtcctcttccgccacgcgctgccttccgcgactacctcgccgcggcgcggctgctcgattccggcaacttggtggtgcaagggcagggctccggcaccgccctgtggcagtcgttcgactaccccaccaacaccctgctgcccggcatgaagatcggcaagaaccggtggaccggcgccgagtggtacctgctgtcgtggcgctcccccgccgatccttctccggggagctacaggtacgtcaccgacggcgacgaggcgctgccggagaacgtcgtgctcgacggcaatggcaccgaggtgtaccggaccggggtgtggaacggcaggaggttcaacggcgtcccggagatggcgtcgttcgcggacatgttcagcttccagctcacggtcagcccgggcgaggtcacctacggctacgtcgccaaggccggggcgccgttctcccgcgtggtggtgaccgacgacggcgtggtccggcggctggtgtgggacgcggcgacgcgggcgtggaagacgttcttccaggcgccgggggactcctgcgacagctacgccaagtgcggcgcgttcggcctgtgcgacagcaacgccggcgcgacgtcgatttgccggtgcgtgaaggggttcagcccggcgtcgccggcggagtggtcgatgagggagtactccggcgggtgccgccgggacgtggcgctcgactgcggcacggacgggttcgccgtgctgcgcggggtgaagctccctgacacgcgcaacgcgtcggtggacatgggcgtcaagctggacgagtgcagggcgaggtgcgttgccaactgctcgtgcgtggcgtatgccgcggcggacttgagcggcggtgggtgcattatgtggacaaagcctttcgtcgatttacgtttcatcgacaatggccaggacatctaccagcggctagcgaaatctgaaataggtaatttaacctaa

SEQ ID NO: 310 - DNA, 1150 bp, Oryza sativa
  misc_feature (6)..(6): n = any nucleotide
  misc_feature (10)..(10): n = any nucleotide
gcgccngccnaccgccgcgtcagggagagccccctcagctccgacgccatcttccgccagagccatgcaggccttctgaacctatgcattgttgtgctggttgctgtgaacagcagacttattattgagaatttaatgaaggtatggcctactaattagagctggattttggtttagtggaacatcgctggcagattggcctcttctcatgtgctgctcactttaccaactttcccgcttgctgcacttatggttgagaagttggctcaaagaaaacttattagtaaacatctccatatcgttattacaacatctgtccttgtctatccagttgttgtgattctaaaaggtgtgattcggcagtattatctggatttgtgttgatgtttcttgcaagcattatttggttgaagcttgtttcttttgctcatacaaattatgatataagaatgctgtccaaaagtattgaaaagtttaaaaggctatcctacttcatgttggccccaacactttgttaccagcagccaagttatccccgaactacatatattagaaaaggttgggtggtccgacaactgataaaatgccttgtttttacaggcttgatgggttttataattgagcaatttatttttcagtacataaatccaattgtgaagaattcgaagcatccattgaaagggaatttcttgaatgctatagagagagtattgaaattatcagtgccaacattatatgtctggctttgcatgttctactggtttttccatctctgttgaatattcttgctgagctcctctgttttggtgatcgtgaattctacaaggactggtggaatgccaaaacagttgaagagcctgttcacaagtgggtcattcgacatatatattttccatgcataaggaatggtttttcaaagctatgtgttgctgttccatgccacatttttaaattctgggcatttattgggatcatgtttcagcagattcccctggtattcttgacgaaataccttcaagataaattcaataacacaatggtgggcaacatgatattttggttcttcttcagcatcctggggcaaccaatgtgtgttctcttatactaccatgatgtcatgaacaggcaacaagcccaaacaaatagatag

SEQ ID NO: 311 - DNA, 1138 bp, Oryza sativa
atgtgtcaatcaccaggggctagggctagtgaagcccatggaagagatgctgatgggtgcaaatccaaatcctaatgggagctcaaatcagccaccgccaccgccgtcctcggcggccagcgcccagcggcctatcgccccaccggcggctggagcggccgccggcgcgggcgccgccggacctggggctggcacggagcgccgcgcgcggccgcagaaggagaaggcgctcaactgcccgcggtgcaactcgacgaacaccaagttctgctactacaacaactacagcctccagcagccgcgctacttctgcaagacgtgccgccgctactggacggagggcggctcgctccgcaacgtccccgtcggcggcggctcacggaagaacaagcgctcgtcgtcctcggtggtgccgtcggcggccgcgtcggcctccacctccgcggcggtgtccggctcggtccccgtggggctggcggccaagaacccgaagctgatgcacgagggagcgcaggacctcaacctagcgttcccgcaccaccacggccgcgccctgcagccgccggagttcacggcgttcccgagcttggagagcagcagcgtgtgcaaccccggaggcaacctggcggcggcgaacggcgccggtggcaggggcagcgtgggcgcgttctcggcgatggagttgctgaggagcaccggctgctacgttccgctgccgcagatggcgccgctagggatgccggcggagtacgcagctgcggggttccatctcggcgagttccgcatgccaccgccgccacagcagcagcagcagcaacaagctcagaccgtgctcggtttctccctggacacgcacggcgcgggtgcaggcggcggctccggggtgttcggcgcgtgcagcgctgggttgcaagagagcgcggcgggcaggttgctgttccccttcgaggacctgaagccggtggtgagcgccgcggctggcgacgcgaacagcggcggcgatcatcagtacgaccacggcaagaaccaaggtggtggcggcggcgtcatcggtggccatgaggccccagggttctggaatagcagcatgatcggcaacggcagcagcaatggcggcggcggcggcggttcttggtaa

SEQ ID NO: 312 - DNA, 1118 bp, Oryza sativa
  misc_feature (694)..(694): n = any nucleotide
atggcgcccccaatcgcctggaacggccacgccattcccggccgccttccatggccgccggccgccccttcccgagctccctcgtggccgcaccacctctccccgccttctccttctctctctccggcgccggccggcctccagccgcctctccctcctcgcccgagcaccgtccggtcgcgccgtcgccgccctcggcctcgcagccgcctcctctcccccggtcagccctccgtttcgcagggagacgcgtcctcgccggcaaaacagtggcgttgccgccactgtactgcctccagcctcccctgccgcgccgctcaggtgcgggccggccgcgccgtctcctccctcggcgtcgccgcgtcgacctccaccccggcctaccctctgattcgtccagagaccgccgtcaccagcgccgggctctccatcctcttcgtcgccggcgtcccttcggccgccccaccctcctccccggctcgtcggctcgctgcgacaccaccacctccggcatcgcagcggcaaggtcgccctcggcctcgcctccccttcgaccgacccccgccggtgttcgtcatcgtcgtcatcgttcctcctcgccggctcgttgtctcgctgcgccgcctccatcgtcggattcgcagcggcgtgttccacgccgtcctcgtctccgtgcagccgctgccggctgccntcgtcgcctcctcgccggccccggtcgtcgtcgtcgtcatcctctcgtcgttcccggttgtcgtggcgttcgtccgtccgtcaagccattctcgttcgtcgtcctcgttccgtcaagtgccgcagccccgtcatcgtcttcgtcctcgcctccgcgtcgccaagcattgcgccggccgcgtctcgccttcgtccaaggatcgacgccgaagtcgtcccctcgcctttcgtctccgtcattcccggccgtctccgccgcgcccgttcgtcgttgtcgttcccacgcctcgttgcatggtggtaaggatccctctccctcgctgccccgtcctcgtcctttcggtgtcgcccgtgcctgttgtgcggttgtcggccccggtacccgtgtatcggtgtcggcagtcgttcgcttgttcgtgtcgtga

SEQ ID NO: 313 - DNA, 1077 bp, Oryza sativa
atgtctgaggtgtccgttatggccgaggtggaggagacggcggcggcggcgccgctggacctgccgccggggttcaggttccaccccaccgacgaggagatcgtctcgcactacctcacccccaaggccctcaaccaccgcttctcctccggcgtcatcggcgacgtcgacctcaacaagtgcgagccatggcacctcccagccatggcgaagatgggggagaaggagtggtacttcttctgccacaaggaccgcaagtacccgaccgggacgaggacgaaccgggcgacggagagcggctactggaaggccaccggcaaggacaaggagatcttccgcgggaggggcatcctcgtcggcatgaagaagacgctcgtcttctacctcggccgcgcgccccgtggcgagaagaccggctgggtgatgcacgagttccgcctcgagggcaagctccccagccagctcccgcgctccgccaaggaccagtgggcggtgtgcaaggtgttcaacaaggagttggcgctggcggcgaagaacgggccaatggcggtgaccgaagcgaccgccgacgacgcggggatcgagcgggtcggctcgttcagcttcctcagcgacttcatcgaccccgccgagctgccgccgctgatggacccttccttcgtcgccgacatcgacggggtggacgacgccaaggtgtccgcgtcgacctccgggcaggccgcgatcgccgccggcttccatgtcgcgtcgcaggtcatgagctaccagcaggtcaagatggaagagccgttgccgctgccgtacctgcaccagcagccgccgcggatgctgcactcgggtcagtacttctcgctcccggcggtgcaccccggcgacctgacgccgtcggcgatccggaggtactgcaaggcggagcaggtctcggggcagacgtcggcgctcagcgcctcgcgcgacaccgggctcagcaccgaccccaacgccgccggctgcgcggagatctcgtcggcgccgacgtcccagccgttcccggagttcgacgacgggattctgggcctcgacgacttctggaactaa

SEQ ID NO: 314 - DNA, 1011 bp, Oryza sativa
tggtcttcttttggtttcttgatgcctgtagggataatactagccagaatgtcaagcaaatctaaaagcggcaggagcatcagagtccttttctattgccatgtcatttctcagcagattgcagctgtccttcttgctaccggcggtgcggctctttcactaatgaactttgagaattcattcagtaacagtcaccagagagtaggattagcattgtatggattcatgtggctccagccgcttatcggtttcttcagaccagaaagctttggaccggcctccttactttcgagctctccttactgcttttcttctacctcgagtcgctggggtggctgacggagtcggcggtgatgccgaagaagcacaaggccatcgagggggtcggcgccgcgtccatcctcgacctcaaggcgcagctctaccgcacccaggaggaggcccgggccaagaagcgcgccgctcctggtgaccccctcggcgcgaagaattccggcgtcgatgcccgcgcccacaagataagttggagctaaaagctgtgaaggatggttcagtaagttatgctgccttagaaaagaaggcagaattgtatgaaaaattatcaagaggcgagatacctgatgaagaagacaaggaaaaatattgtgttgactttttccaaaagagtttcgatcatgtctatgagcctcggcaaccagagagccagagtgttattgacagggcagaaccagaaaatgacaatgatgattctatgtcaagtgccaaaccagtaggccttggtcgaactggcactactattgacagagatgagcacaagcgctttgtaagagggaggttcatgaggaagtaagtgaggcaaggcagaaggcttcaacaatgaaatcccgacgacaagagcaggaggctgctcgtagagagaaactcaagcaggcttatttgaagaaacgcctggagaagttacttgctgagaaacgggccacttcagcaaccgacgaccaaccagctagctag

SEQ ID NO: 315 - DNA, 985 bp, Oryza sativa
gagaaatccgtaggctcagaggatttttggtagtcttgtttcgtgatattcgtgaagagggggggagctaaggggggattcgtaagatcagaattggatcacgcgggggcgcgctcgggatcgggggttccaaacacagcttcttcgttgaatttaagtggatgtactaatggagtcaaagggtggcaaaaagaagtctagcagtagtcgttccttgatgtatgaagctccccttggctacagcattgaggacgttcgacctgccggaggcgtgaagaagttccagtctgctgcttactccaactgcgcgaagaagccatcctgatagccctttcggcttctccatcctagtagtttaggatttcttgcaattccattttggcacttttcttctgacctatttctctggctgctgcttcctgataatcgaccagttctctagtcttgctccctgcactcctccctcctccatctccggcacagtgttctgaccaacctgctccaatgggtgtcttgtctgctgctgaccctcccccagtctcagcaattgggtttgagggctatgagaagcgccttgagatcactttctctgaggcacctgtctttgctgaccctgatggtcggggtttgcgcgccctctccagggcccagattgactctgttctggatcttgcacggtgcaccattgtgtccgagctgtccaacaaggactttgactcctatgtcctctctgagtccagcctgtttatctattctgataagattgtgattaagacctgtgggactacaaagctcctgctcacaattccaaggattcttgagcttgctgaagggctttctatgccacttgctgctgtgaagtactcccgcgggatgttcatcttccccagtgcacagcctgctccccacaggagcttctctgaggaagttgctgtcctcaaccgctactttggccatctgaaatctggtggtaatgcttatgtga

SEQ ID NO: 316 - DNA, 885 bp, Oryza sativa
atggagaagccccggcaggtggtgcggaagttcctggcgcggccgcagcacgagggcgtcggcgccgtcgttcgccggagcatcgggaggtttgagctgaggtacttcgatccgttcctcgtcctggacgagttctcaggtgtctgctccggctgggttccctgaccatccacacagaggtttcgagaccgtcacttacatgctcgagcagggagccgtgacgcacgaggacttcgagggccaccgtggcacgatcaaggccggcgacgtgcagtggatgacggccggacgcggcatcgtgcactcggagatgccggcggggcccggcacctccaggggcctccagctctgggtcaacctctcctcccacaacaagatatcgagccggggtaccaggagatacagagcaaggacatcgcgagcacgacgtcggacggcgtgacggtgcgggtgatcgccgggcagtcgatgggcgcccggtcgccggtgcgcacgcggacgccgaccatgtacctggacttcacggtccgcccccacgcggcggcgcggcagccggtgtgcgcgacgtggaacgcgttcgcgtacgtgctggagggggagggcgtgttcggcggcggcggcggcgacaaggccggggcgcaccacctgctgctgctcggccagggcgacggcgtcgaggtgtggaacaggtcggacaagccgctccggttcctgctcatcgccggcgagcccatcggcgagcccgtggcgcagctggggcccttcgtcatgaacaccgaggaggagatcgacatgaccatcaacgacttcgagttcagcatcaatggcttcgagaaggccaagcactggaagtctcaggcgctggtggcgctgggcttagagtag

SEQ ID NO: 317 - DNA, 884 bp, Oryza sativa
atggcggatcagatcgagcacctccacctccccatccgtggcctcaacctccacatcgctgtggtgttcttgcacgggttcccggagatatggtactcgtggcgccaccagatgctcgccgcggcggccgccgggtaccgcgccgtcgcgccggactggcgcgggtacgggctgtcggggcagccgccggagcaggaggaggcgacatgggacgacctcgtcgccgacgtgcttgccatcctcgacgcgctcgccgtgcccggggcgttcctggtgggcaaggacttcggcgccatgcccgcctacgacttcgcgctccgccacccggcgcgcacccgcggcgtggcgtgcctcggcgtccccttcagccccgccccggcctccttcgacgccatgcccgagggcttctacgtcctccgctggcgctggcaggaggcggggaaggcggaggcggacttcgggcggcacgatgtgcggcgggtggtgcgcaccatctacatcctcttctccggcgccgacatccccgtcgccaaggaagggcaggagatcatggacctcgccgacgcctccacgccgctgccgccgtggctcaccgaggccgacctcgacgtctacgcctcgctctacgagaactccggcttccgcttccccctccagatgccttacaggtgccggtgctgatggtgattggggagaaggactacgcgttcaagttcccggggttcgaggccgccgtgcggggcggcgccatggagaggttcgcgccggagctgaagatcgagttcctcccggaggggagccacttcgcgcaggagcagctcccggagcaggtcaaccggctcctcctcggcttcttcaccgagcacccggttgccgccgattga

SEQ ID NO: 318 - DNA, 872 bp, Oryza sativa
atggtcccgggcgcgggccggcctaccggccggcacggcacggcagcggtgtccggtgtgtgggcgtgtacacgagttgactacggcccgtgacgatgcgtcgatcgggtttggatgtccaagagaccattctgctcagtgcaaatgtcaggctcccaatgtgtcctctgccatcaatcaatcccaaatacaatcgatctttcgtgcccacctctcagcctctatttctagtaaagagaagtagccgaccagttgacaaatctaggcatcaagcagtggagaccaggcggagaggtcgggctaaggagcgcctcctcccgccggcggccgctgctcgcctcctcccgtcggccgtctcctcccgccggctgaggcgccaccgcctcccgccgacgcggctctcagcgcccgcaccgtcgtcgttgccgttgtcgggtccgcatcgtcatcgtcaccggcaggcgtctccgagctcgcgcctcctcccgccggcggccgcctcctcccgctggccacctcctcccgccagccgccgcctcccgtcgacgcggctattgcctcccgcatcgtcgtcgtcgtcgggttcgcatcgtcgtcgtcgccagttcgcatcgtcgtctccgccaacgtctccgagctcgtcgctatcgtccctcttcccgttgccgcgccagcgccggccactgcgcccgtataacgcgccggcccactcgcccgggcgaccgcctccctccctcgctcgcccgggcgctcaggcggctggatccgggcaaatcggccggatccccccatccagcatctgggggaatattcctccccgagccgccccatcccacccctgcccagcaaccaaacacctacaaaaaaaatag

SEQ ID NO: 319 - DNA, 863 bp, Oryza sativa
atggagagctgggtccgcgcggtggtggaggctatccactcatctcgcgcccaggccgtcatctacctcgccggcggcgcctcgcagctcgggtggctgctgtccgtgcccggcgcgtccggcaccgtcctcgaggtcgtcgtgccctactccatggcctccatggcgcagctgctcggcaagatggcattggccgcgttcaaccgcgccctcaagctttctggaccaggtaatgggtgttggcttcactgggtcactggctagctcacgtccaaaacatggtgagcataggaaagcgtggaacaatttgatgaagaccaagaactccagcaagttattgatgggcaagtctgcataggaaaataattctacctggttcattcaatcccctgcatgatggacaccttaggctgttagaagttgcatcaagggtcttccatgctttgagatatcagcaatcaatgccgacaaacctccactatctatcgcagaaatcaagcgccgggttgagcaatttagaaaagtagaagaatgtgataatatctaaccaaccatacttttacaagaaagcggagctatttccaggcagtgcatttgtaatcggtgcagacactgcagctaggcttgttaatcctaagtattatggaggtgattacaatagaatgctagagatacttctcgaatgtaaaaacacaggtacaacatttcttgttggtggtcgaaatattgaaggagttttcaagaaggtccttgaagatttggacattccagtcgagttaagggaaatgtttatctctataccagaggagaagtttcgcatggatatttcatctacagatataagaaaaaaacaagggccttga

SEQ ID NO: 320 - DNA, 843 bp, Oryza sativa
  misc_feature (72)..(72): n = any nucleotide
  misc_feature (81)..(81): n = any nucleotide
  misc_feature (106)..(106): n = any nucleotide
  misc_feature (354)..(354): n = any nucleotide
  misc_feature (432)..(432): n = any nucleotide
  misc_feature (732)..(732): n = any nucleotide
  misc_feature (772)..(772): n = any nucleotide
  misc_feature (775)..(775): n = any nucleotide
  misc_feature (789)..(789): n = any nucleotide
atccgctggtcgcgcgcctgcgacgccacgtggaagggctgggcgcgccccgccgccgtggcgagcggcctngccggcctngtccgccttgccgtgcccagctgcntcggcgtctgcctcgagtggtggtggtacgaggtggtcaccgtgctcgccgggtacctgccggaccccgccgccgcggtcggcgccgccggcgtgctcatccagaccacgagcctcatgtacaccgtgcccatggcgctcgccgcctgtgtctctactcgggtggggaatgaactggggggagggaagccgaggagggcgaggatggcggcgatggtggcgctggggtgcgcggtggtgatcggggtngtgcacgtggcgtggacggcggcgttcagccgggagtgggtggagctgttcacgcgggaggcggcggtggtgaggctngcggcggcggcgatgcccatcctggggctgtgcgagctgggcaactgcccgcagaccacgggctgcggcgtgctgcgcggcacggcgaggccggccgtcggcgcgcgcatcaacctgctctccttctacctcgtcggcacccccgtcgccgtcaccctggcgttcggcgcccgcgtcggcttcggcggcctctggtacggcctcctctccgcgcaggccgcctgcgtcgcgctggtcctcctcgccgtcgtgtggcgcaccgactggcacctcgaggccctccgcgccaagaagctcacnggcctcgagatgatcgccgccgccgccgaaggcgacgacnacnagtgcaagcgcctnatcgcgccgctgccgccgcccgatggtcacgatgtcgccgtcgacgtcgtgtag

SEQ ID NO: 321 - DNA, 841 bp, Oryza sativa
  misc_feature (9)..(9): n = any nucleotide
  misc_feature (87)..(87): n = any nucleotide
  misc_feature (126)..(126): n = any nucleotide
  misc_feature (165)..(165): n = any nucleotide
  misc_feature (176)..(176): n = any nucleotide
  misc_feature (178)..(178): n = any nucleotide
  misc_feature (259)..(259): n = any nucleotide
  misc_feature (298)..(298): n = any nucleotide
gtcccccangccctctaccgagctctccacgccgatccccttcgccgccgctcgccggcgatctccagccgcccgccaccgccgctnccgtcgctgccgcgctgcgccgccaccacttccctcctncaccgccggaaccaccttcccatcgcgaggccgagccantaccgccacanancgccttcagccggccgctgccgctgcgttagtcgtcgccggaacttgccgcttgcgccgtcggaaacgccgtgccaagctntaccccggcctccgctccgtttccccattccaccaccgnaaccacccttccaccgtgcatcccgagccactccaccatacgccgcctccagccgtgtgccaccgtcgccttagccgccgccgcgtcgctccgtcttcacctctcgcctcgcagcgccgtgcagcacctcggtcaccgttgttcatcgccggaaacccaccggaacgtggtacctctcggtcgccggtgagccccaccattcctctcctctctggcgtggtattctcgccgctccggtcgcctatttccctccctaaccgctccaataatttccctaggtcttgccggccctcggccgcggctccgccatggtcgggcgtcgtcggaccgccgttcccgtcgcctcccgtgtcggccgccgccatcctttccgccgccggtcgcctccccatggtcgtcccgtcgccggcgctcctcggtgaggacccccttcatctcctttccctttcccctcttttcgtcgcctcccgtgcgtgccgtcgcgccggtggtcgtcgccggcgaccatcgggccgtgcgccgtcgctcccggccggccgaccg

SEQ ID NO: 322 - DNA, 807 bp, Oryza sativa
atgtgcccaagatgtcagctggccacgtcacccaatctctttcctctttctttttctctattcctctccttccttcttgtcgctctctgctcggggtggccagcgacgggcggcggggtggcgtggcgacgcagcggcggcagcccgggcgcaggcgggcaacgcggcggcgggcccggacgaggaggaggaggagggcatcgacagcggtgcccgccggtacgaatcccatcaccgcgccgccatgtcctcctcccacgggccacacttgttccgcctcggcattgtcgccacccatgtcgtcgtcagccattgaggccatggacgagctcatccagctcgccgagtccatgcgccaggccgcctccctcctgggtgacgacgacccctccgacgagtccagccgcgccgcccctccaccttcctcaacgccgtcgcgcttggcaacgtcctcgcccacagcggcggtcgcatccgccgcccgccccatgctggatccgcccctgtcgacgaggccgtcggcaagctcaagtccgtccttgataacggcgaaggcgacctcgacgaggtggtgctgcaggcggaggagctgatggcaccgctggagagccactacagtgggtggcggcggtggctttagtgggattccgtccaggcggtcgtggatgcgtcgccgccccggctcccgccgccgtgtcgcctcgtgctcctacctccgcgtcaccggccgtgtcgcctcgtgctcccgtgctcccgccaccacgtcgccggccgccccggcgtcctcctccccacccgccccggtag

SEQ ID NO: 323 - DNA, 779 bp, Oryza sativa
atgacggcagcgatgacgtcagcaccggcggcagctcgggagcgcaagctcgccggcgaacgacggcgcgacgacgagaacggagggcaccaggacgtagagcgcggtgcggcgaacttaccggtgaccaaaacggcggcagaaaagcaacgaacggccccggcaacgaggaagaagcggcggcggctccggcgttggcgaagcggtggacgaggacggcggcgacttggcgatcacaatggcgatcttcccgagcgacgacgacgaccggaacggcggcggcgcacagctggagcggcgacgacggcggcgctaggtcacacgacgctagggcgcttccgacggcgagagacgaaggcgagggaggtggcgggtagaggagagctcggggatccttataaaggggcaaggaggcggcggcgaaggcccacggcgaccggcggcgagaaggaaagagagaaaaggaagaggagatctcgaagatcatttcccctcaaaagattcggccggagaaggaaagacgcggccgaattggaaagcggcggcgcacggctcggctagggttcgggcggcggcggcggcgcgaggaggaagacggctccgacagatggggcccatctgtcagcggctgagagagagaggaggaaggggcgcggcggactgggccgagggaaagagagagagagggttttgggccggctttcggcccaaagccaaaacagacttttaaaaacctttttcaatttaaattattcatgaaatgcaattccatttattaa

SEQ ID NO: 324 - DNA, 768 bp, Oryza sativa
  misc_feature (329)..(329): n = any nucleotide
atggcgggcagcaccaagctgcggccattcctcctgacgctgctcctcctcctctccaccaccgtggcttccatcctcgcggagtacgacccggaatgcgactgcgacaagcccaagcaccccaagccctcgcacccttctccctctcccggccaccccaagggccccaagaaccctacccctcgcccccccaagggccccacctacccgtctccggtcacccgcccgccgccgctcgtcgcccctcccaaggtccccgtcacccacccgccgaagggccccgtcacccgtccgccgccggtcacctaccccacacctccggtcaccanccccccggtcgtcgtcggcccgccggtcacctaccccatacctccggtcaccacccctccggtcgtcgtcggccctccggtcacctacccgacgccgccggtgacatacccgacgccgccggtgacgtacccgacgccgccgacgacgacgccgtgcccgccgccgccgccggcgacgcagaggtgcccggtggactcgctgaagatcggggcgtgcgtggacctgctgggggggctggtgcacgtggggatcggcgacccggtggtgaacaagtgctgcccgctgctggaggggctcgtggagctggaggccgccgtgtgcctctgcaccaccatcaggctcaagctcctcaacatcaacatctacctgcccctcgcgctccagctcctcctcacctgcggcaagaaccctccccccggctacacctgctccatctag

SEQ ID NO: 325 - DNA, 691 bp, Oryza sativa
atggcggaggagctggtgctggacacggcgatccgggactgggtcctcgtcccgctctccgtggtgatggtgctcatcggcgtgctccgctacttcgtcgccaagctgatgcgctccccgtcggcgtcgccctcccccgaccccaagctcgtcaaggagggcaagtggtaattagggcgaggaacctgaggatcaattcgcagtacatcccggccaaggccttcaaatcacgcaaggaaaacggattgcttcatgtcccgaaagaggaagcacagaaagctcaggctgccatgttttcagatccaaacatggccatggacatgatgaagaagaacctctctatgatagttcctcagcagacacttacatttgcatgggtgaacttcttcttttcgggttttgttgcaggctaagattccctttccattgactccgcgattcaggggaatgctgcaaaacgggatagacctgagtactgttgatgtgagctatgttagcagccgttcatgtactttctcaatttgtttggtttgaggggtctcttcagtctgatcctcggtgaagaaaatggttagataacaaattggccgcagagaaagacaacctggatataatccagcatgactgggctttaccaaagatggagcatcatgctgaggaagtgctgaggaagcttctgaagaaatgatag

SEQ ID NO: 326 - DNA, 667 bp, Oryza sativa
  misc_feature (505)..(505): n = any nucleotide
gaggtccgcgcggtggagcggcgcgcgctcctcgaggcgctggcgtccaagctgccgccgggcgccatctccttctcgtcgaaggtgcggcgcgtcgccgtcgccgggcagcagcaggggcccggcggcgccaccgagctggagctcgaggacgggaggcggatcgtcgccaaggtggtggtcggctgcgacggcgtgaactcgccgatcgcgcggtggatgggcttctccgagccgaggtacgtcggccacatggcgttccgcgggctcgcgcgctacgacggcgacggcgggcagccgttcgaggcgaaggtgaactacatctacggccgcggcatgcgcgccggtttcgtccccgtctcacccacccgtgtctactggttcatctgcttcaatcgaccaagcccagttagggccaaagatcacggacccggcggcgctcaagagggaggcgctggagctcgtccgcgggtggccggaggacctcctcgccgtgatgcgcganaccccggacgacgccgtggtgaggacgccgctggtggaccggtggctttggccggtccttgccccaccggcgtcgaggggcctcggccccttcctcgagcacaccaacttcgactgtggcctgctcgagccgtcggcggcggcggcggcaccgtcgccatga

SEQ ID NO: 327 - DNA, 661 bp, Oryza sativa
  misc_feature (305)..(305): n = any nucleotide
  misc_feature (337)..(337): n = any nucleotide
  misc_feature (367)..(367): n = any nucleotide
tcagtcgaggaatccggtgcggcgcaggacggcgtttcggacgcggcggaggtcgcggcccttgagcgtcctcccggcgccctccagcaccgagctgtgcgccgcggcgcgccgcgcgacgacctcgtgcggcgggacgaccatggcggcgtccccgtcctcgccgccgacggatgactgcgccgcggcccacttccccttcttccccgccgccgccgcggcctccgagggtatcctcacgggcgccgacctcgccgcgcccgccgtcggggttcaacggggcggtctccgggacaggtcgggangcggaccgtacggcggcggggcccgcgcgctncttcttcttgctcccctcgtcgtcggggancgcggcgaggaggcctggggcagaggaggcgggccagaggacgtcgcgctcgaggaggtcgccgtccgccaccgcggcgacggaggaggaggaggccggtttccgggggcgaaagagcaggaggcggtccatggtgggtgggcgggtgtgctccggggatcaccaggacggcggatctccggcgatgtggcggcgctccggcatcggagggtggggggcggcgcgggtggaggcgagagtgaacgaggccgcgattccggcgaggtgaggcggggggcggtggggtggttatag

SEQ ID NO: 328 - DNA, 616 bp, Oryza sativa
  misc_feature (541)..(541): n = any nucleotide
atgtcacgtaggatagatacacaacgaatccacaccgttcacagtgcagggtactacaggggatcccaaaccaaccaccccaacctattctatctcccactttcccctttctcccctactttcccttttccctctcctactttcactcccacccacccgatagagccggagcgcgcagcggtacaggtcgccatcgttgcccacggaggcgcgcgccatccccgcgaatctctcggcggcgacgagaaggcggagcgaggaggacggcggcggcgcggatctggagcggcgacgcgggagtacagcggcggcggcgcggattctggagtggagcggtgcgcgcgtcctcgtgctcgtgctcagcgcgtcctcgccctgccctcctcaccgacggcgctctcctcaccgcctgccccaacgccgagcggcggcagcatcctcgggacctggcgaagaagcggcggcggaaagacggcgacggcggcgcgtccttgccccaccctcctcaccgacagcgggcgcgtcctcgcctgccctcctnaccggcgacggcggcgcggatttgagctggacccggagtcgtcggagtggaaggagttctggctcgggaatcaag

SEQ ID NO: 329 - DNA, 596 bp, Oryza sativa
  misc_feature (99)..(99): n = any nucleotide
  misc_feature (112)..(112): n = any nucleotide
atggcggcggcggcggcggcggcggtggagagcgtggtggtggtgcacaacgtggcgaagcggcacaacgtggggacgctggcgcggagcgcgacggcnttcggggtggcgnaggtggtggtcgtcggccgccgcgacgtcagcgccttcggcagccacggcgccacctcccacctccgcttccgccacttcgcctccctccccctcgcccgcgcctacctcaagtgtgacatttgcggcgtggagatcacccacaacgcgctgccggtgacggcccatccgttccgccggagcaccgccttcctcttcggcaatgagctctcgcagaaggagtgcgagatctgcgacttttttgtctacatccctcagtatggtggtggaaccgcatcattgaatgttacagttgcagcgtcgattgttcttcatcactttggagagtctgggctggctttccagaacgagggcgagaaggtaataaattcgttgtagctgataaaccaaagggccaatctaggggactctactgtacagactcaattgaagaagtgattgaagaacggaagatgcgaagagaaaatgcctgtgacatatttgag

SEQ ID NO: 330 - DNA, 545 bp, Oryza sativa
ccatggcggccggtggcgacacgcgcggtcaccggccgcgcgagagccggcaacggcaagcgacggcgcgggaggcggcggcggacgacgcacaggccggcggcggcggacgaaggcgatggcgagcgcaggggcggcagcgcgtgcgggacagagggaaggagggaggagaggagctcctcaccgtgagcacggcggccggcgcgaagaatgaacacggaagcgatgaccgacgatgcggaggcacggacgggcggcggcgacaccctaggagaagatggagaggcgttaggagaggagacgacgaccacggcggcttgaattgccggccggagatggaggggagggaaaaactcaccggctcgcgaggggagaggcgctccggtgggattccggcgacgcgaggcggcggccgggaaagctcttgcggcggtgaagctaacggcggcggcggtttggcgcggcggcgactccagcagtggcggcgcgcggccgaagacggcgacaagcggcggagctcgggtgtgacggcgcgggcgcggtag

SEQ ID NO: 331 - DNA, 485 bp, Oryza sativa
  misc_feature (60)..(60): n = any nucleotide
aagtcggagtggtgggcggtggacggcgagatgcacgagatcggggagggcgtgccgcancgcgagcgcttcgccatcccgcgcgacaacctccccaaccgccgccggaagcagatgcgggagcagttcatgcgccgcacgcgcctcgtcctcaaggacacggaacatgaagcttggtgtaaaaaatatatggaactataccaagaacttagagagaattgggaaaggttatattgggatgaaggttattccaaaaagattgctgaagatcatgctaattatgattctgctgaagaagatgatctagacttctcaccttacagcaaggtgaaacatgggaaagggttactcaaattcgtgacaagtttgaatatgacagagagagaagaatgagggaacgaggtaaacatcatgtcttcatagttcatactggaatttttcttttttgtctgccattgctatttgtaccctcagataatgtatag

SEQ ID NO: 332 - DNA, 482 bp, Oryza sativa
  misc_feature (301)..(301): n = any nucleotide
atggcgtggtgtcgtctccgctggccgcgccgcgcctcgccggcgtgtcgcgctcgtcgtcagggcccagtccgagtgggacgtgctggcgttcagcgggccggcgccggagcggatcaacgggcggctggcgatggtggggttcgtgtcggcgctggccgtggaggcgtcgcgcggcggcgggctcctggaccaggccggcagctggagccgggctggcgtggttcgccgccaccgccgccgtgctctccgcggcgtcgctggtgccgctgctccgcggcgagaccgcggaggcgaggancggcggcgtgatgagcgccgacgccgagctctggaacgggcggttcgccatgctcggcctcgtcgcgctcgccttcaccgagttcctcaccggctcgccgctcgtcaacgtctaatttaattaattaattaattaagctgtacgtacaatacgtgcatgtacgtatgcgtgtactgggtag

SEQ ID NO: 333 - DNA, 474 bp, Oryza sativa
atgaagcgcaacccacgcgtgacgagctcccggaggaagtgccgcaaggcgcacttcacggcgccgtcgtccgtccgccgcgtgctcatgtcggcggcgctgtcgtcggagctccgccacaagtacaacgtgcggtccatcccgatccgcaaggacgacgaggtgcaggtggtgagggggagctacaaggggcgcgaggggaaggtggtgcaggtgtaccgccgtcgctgggtcatccacgtcgagcggatcaccagggagaaggtgaacggctccaccgtcaacgtcggcatccacccctccaaggtcgtcgtcaccaagctcaagctcgacaaggaccgcaaggccatcctcgaccgcaaggcgcgcggccgcgccgccgacaaggccaagggcaagttcaccgccgacgacgtcgccgccgccgccgggggtgccgccgccaccggcgcctcgctccaggagatcgattag

SEQ ID NO: 334 - DNA, 456 bp, Oryza sativa
gcgccttcaatcgccgggaacggacgcgccaaccccggccaccttccatggccgccggcccggctcgtcgtctcgctgcaccgccaccgtcgtcggcatcgcagcggcgtgttccacgtcatccttgcctctgtgcagctgctgccggctgcaatcgtcaatctcctcgccagccccggtcgtcatcgtcgtctcgttgttcccggtcgtcgtggcgttcgtccctccgtcaagccgttctcatccgtcgtccgcgtccgtcaagtgtgccgctgcaaccccatcgtcgtctttgtcctcgcctccgcgtcatcaagctctgcgccagccacgtcttgccttcgtccaaggatcgccgccgaagtcgccccctcgccgttcgtctccgccattcccgtccatctccgccgcgcccgttcgccgtcgtcgttcccacgcctcgtcgcttggtggtaa

SEQ ID NO: 335 - DNA, 432 bp, Oryza sativa
  misc_feature (303)..(303): n = any nucleotide
  misc_feature (340)..(340): n = any nucleotide
atgcgaattccggcgacgaatcccgacggggaagggcggacgaggtggagtttggcctcgcgaacccgacggcagcgacggcgcggtgcggcggcgaccctagcggcggctagcggcgaccggagtaacggaagcggcggcggcgggtggttgcacggcgcgggagcgatggggggcacgagggagttcggcgaaatggggaaaaagagagagggggcgacggcggagcttaaataggggaggggaatcccggatttggccgaggggcaggattccgccggccaacgcggggaattggggagngagagagagggagagaggggattgggtgcgggaagtncggcgcatgcgcgggcgtgaccgacgtggcctggaggaggcggaggcgtgggcgcggcggcgcaggcgcgaggtaggagacgggcccgacag

SEQ ID NO: 336 - DNA, 390 bp, Oryza sativa
  misc_feature (1)..(1): n = any nucleotide
  misc_feature (51)..(51): n = any nucleotide
ntggcaaagcagttaaacctccggccgcgccaggtggaggtgtggttccanaaccgccgggccagctgaagcggtgctgcgagacgctgacggaggagaaccggcggctgcagaaggagctcgccgagctccgggcgctcaagttctacatgcacctcccggcgacgacactctccatgtgcccctcctgcgagcgcgtcgcctccaactccgccccggccaccgcctcctccgccgcaacatcgtcgacggccgcgccgcccgcggcaccctcatccggcggcattgcggccacctcctcctccgccgccgccgccgcggcgccggaccacaggccgtcgtcgttcgccgcgctgttctcgtcgccgcgtggcttcccgctatccgtag

SEQ ID NO: 337 - DNA, 357 bp, Oryza sativa
aaacgcgagggtttcgcatctccgccgacgcctagaggaagaagggatccgccgccggtagccaagccatgccgaagaacaagggtaagggagggaagaaccgcaagaggggtaagaacgaggccgacgacgacaagcgcgagctggtgttcaaggaggacgggcaggagtacgcccaggtgacgcggatgctcggcaacggccgctgcgaggccatctgcgtcgacggcaccaagcgcctctgccacatccgcggcaagatgcacaagaaggtgtggatcgccgccggggacatcatcctcgtcggcctccgcgactaccaggacgacaaggccgacgtcatcctcaagtacatga

SEQ ID NO: 338 - DNA, 1287 bp, Oryza sativa
  misc_feature (570)..(570): n = any nucleotide
  misc_feature (835)..(835): n = any nucleotide
atggatcgtggcttcaacgagatgatcttgagcgagagcgtgtggaatggcggcggcggcggcggagatggagatggtggggcggtggtgctgccgccggaggtgggtggtgtcaatgcggtggacgggagcggcatgacgatgctggagaggctggtgctcgacgaggccctggcggcggcgatactcgagctgcagggcatccaggcgccggggtgcggcgggggcggcggcaaggtggcggtggtgccgccgccgacggccggtgacggcggcgtcgaggcggcggtcgccttcgcggcgatggcgacggggacgcctgcctacgctgacgttgacgcggatgtcctgcagcgacagcggcagcatcaccatcgccaccagggcgcgatggggatggctgccgagtacgacgtcgcaccagcaacaccggctgtcacgttgagcgctgtaccaccaccaccaccaccacctgcgttcgcgaccgcagccgcctccgttgacggcggcggcgccatggacgcgacggtcttctccggcatcggcaacgacgacgtcgtcgacgcggtnagcgccacggtggcgatgactactgccactgcaacgaccagccagtgcgaacgagacaaccctctctgcagcctcctggcgtcgaacaccgccggcgccgacggcggcatccagatcgcgttcagcacgagcgccccggcgtcgaagcgggcgaagccgtcgctgagcagcagctcgtcgagcatcagcttcgacggcaggggccccggcggcaactgcggcggcggcggcggcgacgacccactgtacgagcccgacacggagncgctggcgcaggtgaaggagatgatctaccgcgcggcggcgatgcgccccgtgaccctcggcgccgaggacgccggcgagcgcccccgccgccgcaacgtgcgcatctcctccgacccgcagacggtggcggcgcggcagcggcgggagcgcatcagcgagcgcctgcgcgtcctgcagaagctcgtccccggcggcgccaagatggacacggcctccatgctcgacgaggccgccaactacctccgcttcctcaagtcccagatcagggagctgcaaaccctagaccgccggaactacccgaacgccgccatgtccatcaacaccgccgccgccaccaccatggcgacatccagttcaccaacctacaacaacagcaacgccgccatgccagccttcgccttcccggaaaccctaggatgcggaggaggaggagtcgagcagctgatctaa

SEQ ID NO: 339 - DNA, 1182 bp, Oryza sativa
atggtgacggcgacgaaaaacggcaacgggagatggccggcgacgacaaatgatgacacaacgccggcgacgagcttcgagcggcggcgagatcgggacgactgtgacggcggctttacggcgaacactggtggagaagaaggggttagggaaaaattcgggaaaaaggaggaaacggaagaggaggtcgaggggctgctatttatagccggaagagggagaggggaatccgtttttgcaaccaattttggaaacggagcacgggatgcaccggatcgagcggaggatgcggcgtcggcttcacggtcacgggacgggagagatgctggaggaggaagatggcactgtagcctagtgggccccaggggtcagagagaaagaaggaggagggagctaatgcagacttcggccaagggagaggcacgggctgcggaagggagaagggagagagaggaatgtgctttctcaaacatccacagcgaagcggtgtgttgcggggatggcatggaggatttgagttgggcggagagcaatgggggagggcaggaaggggcggcaaggcgttgtgggaggctgtcaatgccatggctaggttgcagacttgcggtgatggtggtggcagcagatgcggagaaaaaccaggaagcgagagggggagttgctttgcattgtgatgggcgtagatgcaaagagaaagcacatgtttgcctgttatccgaaccattggatttggcgatcaaactatccatattacgtgaatgcaaagttcaattcagtgcagtgaagaacctgccaacatatcaagggcgagggcaggggaagggtgctgagtgcttcgacacatttgcgcttccagatcactctagcgtgtggccttggtgtactagccacttgccaggaaaaggagttgatggattatgtgggggtatgggagtgggagcttatggcacgagctggagacatggagagagattagcagcccctcacctaatagctctcaaagctcttgttcagacagtttcttcatccacaacgttaaaggtgaattttgcaaagtctgtgagagcttctcctcattttatagaggctaacgacagttgtaggttagtggttaaggcagttaacacccttaaccgtcattggggacagatggggagttgccacatggaagctgatggttag

SEQ ID NO: 340 - DNA, 1041 bp, Oryza sativa
atgcggaccccacatgtcaacctaagggaccatggcaaaccgggtacacagagacagtccacgggtcgatggaagcggatcccacaccatgcgggctgcacatgtggaaaccacgcggctaccaagcgggcacacaaacacggtcaccacacgcacacacaaacgactaccgacaccggtacacgggtagcgggatcgacaaccgcacaacgggcaggggcgacatcgaaaggacgagggcggggcagcgagaggagagacccttaccaccatgcgacgaggtgtggcacgatgatgacgaacgggcacggcggagacggctcagggacgacggaggcgaacagcgagggaacgacttcggcggcgatccttgcacgaaggcaagacgcggccggtgcaatgcttgacgacgcggaggcgaggacgaagatgacgacggggctagggacgaacaccacgacgaccgggaacgacgagaggacgacggtgggaaccggtgaggaggcgacgacaaacgccggcgggttcggccgaaggggaggcgatgccgaggacgacatcaccgctgcaatgccggacggggcgacgagccggcaaggaggaacgggcggttggcgcggcggcggcgtttcagcgaacttcgggcgacgccgcagccgggccggagaagaggatggcgctgcagcaccgacagaggtggcagcgacgtcggcctgcactcaggcgaggtggcagggatggttggagatggccgagcgagaacacggcgcggccggccggcgcacaggcactgcggcaggggcggccggagttgaccgtcagcacaggagagagaggaaggtgatggggaggtggctatggttcgggagagggacagagcggaacggccggctagaggaggaagactaccgcgcgtgggcccctcctgccagcgcgtgggcccctcctgctagcacgcggtcagcgcacacagcgcacgggagttgggccaaggggaaggagggcggggcggcccttgagagacagagtgtcacgccctaa

SEQ ID NO: 341 - DNA, 1035 bp, Oryza sativa
atgggctatgctacaaccatcacctgcacgcgccgtcagcttgtcacgccttctggtataccggtatgtgtaattcccccaacgtgtacgtgcgtgcgctaccgttctcgtcaaccattgaattgtagcctcgcgtcacggcaaggcaagctgctccacaccatctcatctcacgggggcagcttaaagagccatacacgcaatcacgcgtcagtaacagcagtaggtttgcaccgtttcaggctagcagccgagacaaatccccaaatctcccacgctccaaagcccgaaaccctagctcctgttcacatggcgccagggctccagcgcttcaccgacatcgccggggacggcgggccccgcctcgacgccgcctccggcgaggagctcctccgcatggaccgcgccgcctccgtcgccctcggccgccgcgcgccggagcccccgggtaccctgttcgtcaccaccaggagggtgatttggcttagcgaaacggaaaagggccaaggctatgcggtggacttcctcgccatcacgctccatgctgtgtcgcgcgacctggaggcgtacccctccccttgcatctacacgcagattgacgcagaagatggctctgatgaggaggctggtggatcagatttcgaagcaaatggtgatctgcagctagcaaaagtctctgagatgcgcattatactttcagaccctggtcaacttttggatcctttacaaagtttttcagttgatgcacttttcgatgtcttctgccattgtgctgaactgaaccctgatcctaatgctgtgcgcaatgaagagaatggctggtccggtggtgaaaatatggctgagggtgggtggattcatggtgatgaagacatgattgatggaaatgatcttgaagcccacatgttctttacgaacttgataggccaaaatggtctacatgaccttggtcgttctgtacgtgagcttcaaattgatgaccagcgtttcgaggatgctgaggaagaagacgagatccaagaaaatggacattag

SEQ ID NO: 342 - DNA, 972 bp, Oryza sativa
  misc_feature (198)..(198): n = any nucleotide
atgaagatcccgccaagtcaaccaaaccacaagtactacgtccccaccacaccacgtacgtacgcgacagcgcgcgaaacagcatccgtccgtctcgcggtcgcgccgtttcgcctgtcctgtggctcgctcgcggcctcactcccaatctccgactcgattcccactcccactcgcgacgtatataaattcccccangcgcccgcgctctccgacccatacaccgccacacgccgcgccatctcttcgaaccaacgcgacacgacgcgacaccggcagcagctagccgcggtgatcgctacgacgatgaggttcgcgtgcttcagcgccgcggccgtggccgacgaggcggaggccggggctcgccaccaccaccaccggagcggcggcggtggcggccggcggcatcgggggacgtcgtcgtcgctgcggagcaagttgtttggcggtaggacgacgaaggcgggcagcaagaagtactcttcggcggcggcgctggacgatgtctacgacgcggcggagtggtcgtcgtcgtcggtgccgtggtcctcgacgtcggcgctgtcgctggactcggcgcgctcgtcgtcgtcgtcgtcgtcgacgacgacgacggcgccttgctcccgctcccgctccttgtcgtcgctgtcggacgcgctgtctccgcctgctgcgaggcgcgcgccggagaggagggggaggacgccgcggccggcggcgggcttggccgcggtgatcgtgtgcctcgtgatggtgatgctctgcggcagggtcggagccacggcgctcgtctcggcggcgttctaccttttcccgcggcggtggcggccggtgggtgccatcgaggcggcggagagcgcggcggcgtcaccggagcatgactggccgtcgtcggcgacggatcaggagacgacgacgaagaggaaggtggttaaggaggggttcttggcgcggaactgcaagaagtga

SEQ ID NO: 343 - DNA, 813 bp, Oryza sativa
  misc_feature (465)..(465): n = any nucleotide
  misc_feature (472)..(472): n = any nucleotide
atggcggtacaggcccagtacccttccagtctcctcttccacgatagaggtgagccggagaggacgaaggagatggacctgcccaggccgcagatgttcgccggagtctcgccggaggtgtactttcccagcggaggagcgagtgggattaatcggaggaataagcgctcgagggaggccattgccatggcgccgccgccggccaaggaggagttggtcaatctgttcacgctccagccgcagcagtctacgtcgtttgtcaacatggcgcagctccacaacagggtatcggcgtcgccgtcccgcgcgccggcggcactcgtgtccactggccttcgcctggcattggatgagcagcagcagcagcagcagcaacaacaagagagcaaacgcctgaaagccttgtgctactcgtcgtcgcccatgccgttcgtctcgttctcgaagagttgccgaaagatgaancggcaanatgaggacgcgaaggccctctcggagcaggccgccgccgtgtccctccaagcgcagctccagcaggccgcggccgcggcgcgggcgtccggcgatgagctccgtggcggcgaggcgggcccggcggagtcgtcctcgtcggcgtacgtggacccgcgccgcagcgggtctgaccgcgcctgcctcacctgccgcctgaggccggccaccgtggtgctcctcccctgcaggcacctcagcctctgcggcgattgcttcgccgccggcgacgtggacgtggccatggcgtgccccgtctgccattgcgtccggacagggggcgtggaggccatcctctgttga

SEQ ID NO: 344 - DNA, 807 bp, Oryza sativa
  misc_feature (45)..(45): n = any nucleotide
  misc_feature (48)..(48): n = any nucleotide
  misc_feature (422)..(422): n = any nucleotide
  misc_feature (792)..(792): n = any nucleotide
  misc_feature (798)..(798): n = any nucleotide
atggctcgtaaggagaagcatggacctggaacccctccggttccngtntggcagcttcggccgcccccggatccgccgctcagacagggcggcgtgacaggaggaggaagaagagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgncctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatggtgctccggccgtcccagccaattatcggagtgacgccggagcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcngtccantacgcctaa

SEQ ID NO: 345 - DNA, 804 bp, Oryza sativa
atggggctccttgaccagctctgggacgagacggtggccggcccgcgcccggactccggcctcggcaagctccgcaagtactcctccttctcgccctcctcctcctccgccgccgccgccgcccccgggacggcgccgccggatgcgccggccgcgacggtgacgcgcagcatcaccatcgtccggccgccgtcgctgtccgtcccgtcccgcgccgcgcggcggcggcggcgagtacagctcgtccgtgccgtcctccccagccagcgcgccggactccccgttcgcgtcagagccgccctcgcatcgatgcactgtagaactctagatctgcgttcgtggttggttggttgggggattggatcccgatgcgacgagagaccatggttgcgtgtcaatctgtcaacagaatacagatctacggagttcattcatctgttcttgattgatgctatctgtggagttcatctaatcaagaaatgctactacgcccaagggggacagctggaggaggcttcgccggaaacccaagacggccaccgacgccgcgccggaggcccccgccgccgtcgggccgagaagccccaccgtctacgactggttcgcactcttcccttctctctctgcaaggttacagttccgccatggttggttggctctgatctgaaactcttggttcttcttgctgtgcttgcaggacctgaatctagtgattcccagcaggaaatagctctcgctcggttctatatggctgcaaactctttatgcttgtcaacttgcaagtatatggatttgcttttctag

SEQ ID NO: 346 - DNA, 735 bp, Oryza sativa
  misc_feature (273)..(273): n = any nucleotide
atgatggaggcggcgccggacgaggaggccgggctggcgctccccgagggcgagcggattctggaggtcaccctcatctccgcgcaggggctgaagcctccctccggcctgcggcggcggctgctgcaggcgtacgccgtggcgtgggtggacgcggcgcgcaggctccagacgcggccggaccgcgcgggcggggtcgacccggagtggcacgagcgcctcctcttccgcgtccacgaggccgcgctcgccgacgactcccgggccgccgtnaccgtcgagatctacgccgcgcccgccggcggctggcacatcgggggggactccctggtcggctccgcccggttcctgctcggcgaccacggcctcctgtcccggcccgtcgggtccccgtcgatgttcgccgtcggtgtgcgccgcccctccggccgcgtccacggcctccttaacgtggcggccagtctcgtcgccgcgccgccgtccccggcagctgcccacgctctccgctcatcccccgccgtctccctcagcggcctctccacggcgcccatcccagcaggccgcgtgctccgcgtcctcaaccgctcgtttccgacgcccccaccctctccgacggttcttacgaccaagaagcagcagattgcagccaagccgaacaagaagtgcgctgacaagctggacgttgcggtgaagctgaacaatggcgcagatgatcggagcgatgaggagcactag

SEQ ID NO: 347 - DNA, 708 bp, Oryza sativa
atgattctcgcaagcagccgaaattcacaagcggctgagaacactgcatcaattttccacttcattttcaacaagcaaacatcaatacatgtagatgaaattgcatcaacaaccgtcgaccattgttgtgccgaccgtcatcgtggcagtatcgtcgcagcgccgcccactcccgaagcctccgccgccggcggatctgcagcccgtgcccggagccacggtcgcccacaatccaagctgccgcccgtcccccgagctgcatggctagatccgtcgtcgcactccggccacacctcgagctctgccacgctccgaaccgccgccgcccggatctgtcgccctagctgcacctcgagctccgctgtcggccggatccgtggcccacgatcgagccactgcccaggatccgccgtcacacttcgagccgccgactgctggatccatgcctcgagctccaccacactccgagccgtcgccctagctgcacctcaatctccgccgtcgaccggatctgtcgcccacacggccgcgcctcgagctccgccgccggctggatctgtcgctagcggcggagccaccgccactgaagatgtatcattctctagcggtgacttaaccgggccaccagcgaagatccattttcgctggtggtccttagcccccagccctcgttacgtacttgctggcggctttccatttggctgctag

SEQ ID NO: 348 - DNA, 696 bp, Oryza sativa
atggcttcggggctgcttctaggatctattaacgtgcttcacagggattgccatgatggagataaagctctcggaaaggcaattgagcacgggcggtccacgggcagcgcccaaaatcagcaatggagggagctgacttgccaggcgtcggcggcggcgcgacgtggcggcgaaaagaggggaaagggagaggagacggagggggtcctcaccgaggggcgtcggcgacggaacgacgacggaaggcagccggcggagctcgggcggagaggggtttgcggcgctccggcgatgggcggcgccaacagaggggcggccaaggggcgccgtgacctgaggaaggtgattgatgggttcgacgagcgcggggtggccgggaaccatgaggaagggcaactggaggcaacaagcacggcgacggagctcacctcgcgcggggcagatggcgttccggcgggggatggcgatggtgaggaggcaaccaagggaatcctcgtccttgcagagccgaaggaggcgacggcgcatcgcgaggtggtctgggacggcagcaggaggcggcaaatgcggcggcggcctcaggttggcggtggggatggtttttcggtggtggttgaaggaagaggagcggctgccggggtggagctcagcatggcgatgctgacggcggcggtggcgcagcgcagcggccactag

SEQ ID NO: 349 - DNA, 666 bp, Oryza sativa
atgcggggagtcgggggcccgctgctcaccatcggcgacctcctcagcgacctcgccgtcgacggcggcgccgacctcgccggcggggaggtgtccgtcccgtcgtcgccgtcgtcggcggggcagcaggcggaggaggccgacccatccgagctgaaccggctattcggggttagggctcccttcctcttctttcctctcctccccgttcctagatttggtcggcaccaatcgatcgatccatcctaccatatgagatttagttccctaatcatgcgtccgtcctgcaattggttcgatttcctgagctatctgttgggtgccgatgtgcttcaaattgaccgtgtttgctgtaaaattcaaattaaatctatagtacagatgaatgatcttcaggagcactatgacaatttgatgaaagcgctgcaagaaaatgacccttcatggccttcattgatgctgaagctgtgcacggctctgaagaccgcagataagctggtgagctgtgcgagtattgatgctgagcagctgctgcagaaggtagagttgctggagcgcctcttagtgaggggcgatcgtgcggtcacggcaatagttgaggaactccagcgctcacgcccctccgaggatagtcactcatcgaaatcaaaaccaagtggcaaatag

SEQ ID NO: 350 - DNA, 654 bp, Oryza sativa
atggtcgtcgttgtcggtgaggtgggggaggcggaggaggggaaggggaaggatggttgcggcggcatggtgcgaggcgacgacgaaggaggctgggccccattggccagctcagagcgatgcatcggaggggccaccgacgcagaagagggaagccctgccccggccatggcagcggcggcggcgcaaccgccgcaaaggaggctaccggcgcaccgcctctaccgatcgcacccgcacttccgtcatcgacagcctttgcaagaactccacaactcctgcaacacacgatctagatggccgcgacgaggtgctcggcgtggtggccgagatccaagagtggcacgacgcgcctccgcctccagatgctcgacgtcgaccgccgtccgccgcttccgtcgcctctgcatccgcggctccacccccaccaccgtgtgcatcctcgctcacctcgtcgccgcctgggcccacgccgcggccgcggcgatgacggcgacgagtgtccgttggccaccatatgctgaacgggatgctaaatctaatgggccgatcgaaatattaggaccttatacgccatcagaagaaaatgggttaggttgggttgggttgggtttggatggacctcttgaaaaagggttagaatggactaggtag

SEQ ID NO: 351 - DNA, 615 bp, Oryza sativa
atggtcgccgccggcgaccaacggcgcggcggagcggcggccgagagaggggagggaagagggaagcgaagcggcgcggaggaaagcggcggcgcggttcgggacggcgaggacgacggtgctccggcggtcggcgggcgaaacggaggagcggacgaggtcgacgacgacgcggcgaagccgatggaggtgacgccgagacgggaggaggtccggagcgacgacggcggcgaaccggagcttggcggcgacggcggagagagagtacaacggcgcgagcacgaatccgacggaaagagcgagcggcgagcggcggaaacggaggagggaggcacggggaacgtttatatagtgccgggagagagagagaggggccggaggggaaggaaacggccgcggcgatctcgggcgccattgatgcgccggcgaagatcgcgggagcaaatccgaacgaatccgagggagagagagagagaaaagtggggggaaagagggagggaatcacggggagtgatttccccctctttatggcgcgcggggacggcgggatgcggcggattcggcggcggcggcggcgctagggcacgggcgggcggcgggagcggcggaaggtag

SEQ ID NO: 352 - DNA, 555 bp, Oryza sativa
atgggacccacggtttgggaatcccgggtcgcctttaaagcgagtcccctctccgtcccaagccagtttgccgctctccggctcctccacctttctgcagttctgattccattcttgcaagttctagaactacagaaagcagggagtaatggcgtccaactacgtggacactgctggggaggaaggcaggttccacggccacggccaccacagcagcggcacgacgccgaccggcgcggcggcgtcgccgaagatgcggaggagctggtcgtccgccgcctcggcgtcgtccggcggcggcggacacgggtccggccccaagtgcgtctgcgcgccggcgacgcacgccggctccttcaagtgccggctccaccgcagcagctcgcacggccacccgtcgtcctctcccaccgccgccgccgcgccggcggcggccgtgcagtcctcgtcctcccgcaccgtcgcggcgcagtgacgcaagaacggtctctcggaccaagaaacgcccaacaagaagagaggagaaggaaaaaagaaggaaagaacataatctaa

SEQ ID NO: 353 - DNA, 489 bp, Oryza sativa
atggatcgtcgtgacgattcttgctgccccggcggcggcggcggcgtctcatctctgatcggagaatttgttggggacgtggtgatgtggcggcggggcgacgtgagcgcctgcctgctggcggcgaccgtctccggctggctgctcttcggctccggcggctacaccttcctctccctcgcctccaacgtcctcctcctcctcctcaccgtcctcttcctctgggccaaggccgcccgcctcctcaacagcctgtggatcatttctatcattggcagcctgactgatttcaccactttatgttacacaagtattgttgctgttctgaccatccctgcattgtaccagaagtatgaggaatgcattgacagatacatgaggtttgcgtatttgaacctgcagatgtacgagatggtgtacgagagattctctgccaagtgcttccacagggctagggatttggttattgaggttctgaaagagccatga

SEQ ID NO: 354 - DNA, 453 bp, Oryza sativa
atggcatgtgttaacatgtacaacccggagcatcaccaccaccagtcgtcgtcgttcatggcgccgaggatatccttttccagcgacttcgcgctcgagccgccgccgccggcgcagcagcagccggcggtgcgggcgcctggggacgccgacttcgagttctccgtcggcagccacccgatgatggccgccgaccagctgatctccaagggccgcctcctgccgctccgggaggccccgcacggccacggcggcgccgacgccggcggccggccactcacgctccgcgacgagctgcgcacggacagccgccatggccgcgtcccccgcgcgcccaacattcggtggaaggagttcctcggcctcaagaaggcgcccaagaaggccccaaccgccgacgctgccgccggcgccacatcgtcgtcggccgacacccagatgagagagacctga

SEQ ID NO: 355 - DNA, 438 bp, Oryza sativa
atgggtgcgagcacggggaggtgttggatggagacggatggtggatattgttgggagtggggcagtgatccgtgggtgtcgctatcggtggcttcccattggctgcggctcgggaggggtggatcgatgggcgcgagcacggggaggcgtcggatggagatggacggtggagatgggttgggagtggggcagcgatccgtgggtgtgggtatcggtggcttcccattggctggggttttggtcggttggatcgatgggcgcgagaacggggtgggtttgggtgggggtggttcgatgggcgcaagcactgggaggtgtcagatggagacggacggtagatatgggttgaaagtggggcagcaatccatagatgtgggtatcggtggcttcccattggctgggcttcgggtggggtggattgacgggcccaccggttag

SEQ ID NO: 356 - DNA, 411 bp, Oryza sativa
gcttccttattaggccatggtcaacgctctagcgtgaagcttggtctcaccccttccgaggcaaatattcgcgctagctcggtcgggatcgcacccccgcacagcgccgtgacccccagcagagggccccgtagtttcgttagcttttggtcgaggagttgcgttgaggagatgcctcaccccaagccgttgccccgcaccagggaagaagatggagagggagtggactggagagaagggacacatcgattcccaccgcacggctccgatctgcaccaccttcaactcgatccgccgccgccacaccttgatccgccacctccacctcgatccgccggcaccgcccccgatatgtactatctctgccttgatctcccaccactgcctcaattttcacctactccaccttga

SEQ ID NO: 357 - DNA, 402 bp, Oryza sativa
atggcgaagctcaccggcgcacggcgcttcggggttccggcggcggattactacggaggaggggtggatgggacggcccgcacgacggcgaacgcgacgacgtcgacgacgcggctcggcacggcggctagcggcggcggcggcggcggcggcggcggagaggaggtcgatgacgacacacgagggttgatcgtggccgggagaccgcgatttcgccggaggagtggggagaggtggggaggagaaagaggcgggattcaaaaattgaatcctggccgtgtcgagcgctggcgcggggcgcggcggtgccggctggaggtgggagacgggcccgacaggtgggccccacctgttggcgacccggggagagaggaggggggctcgggcggctggctgaactag

SEQ ID NO: 358 - DNA, 396 bp, Oryza sativa
atgcgggccccacatggcggtaacccgaggagggcggtccacggcggaccgggtccacggaccgggaagaagcggcgtaccacgtggcgcacacgcagcaccgacgtggcgcacacgcggcgaccacgcggcggccacgcggcagccgaaccgacggccccgatctacccttggatcgggcggcggcgcgagacggcgaccggtggcgaccgaccggcggcggagagcggcggcgtcgcggcgacgtgggcggcgaagcggcggctatgccgctacgcggcggctagcggcgcgggagagagagagggaggggaaggggacctcaccgacgacgaccgacgacggcgagcgacggagggcggcgacgttagcgggactagctccgggatcacctaa

SEQ ID NO: 359 - DNA, 387 bp, Oryza sativa
ggaggcgccgggctcggggatggcgtcgagggaggtggtggccgtcggggagcctggatcttgagcggccccggcctcgggggatggcggtcttgcgcaacggcagcggtcggcaatcgggtagaagcaggcagcggcgtggaggaggtcgacacggcggctaggacaaggtcgacagccgccgggcgtagatctggagttgaaggatgccggatcttcaagggaggaggaggcgacagcgttgaggacgaggaggcagcggcggaagccggcgatggcggtcttgggcatggaggacacggacttggagaggataccggcggcggcggcggtcttgggcgcggaggaggcactggcggcggtggatctgagagagtgagagtgtga

SEQ ID NO: 360 - DNA, 366 bp, Oryza sativa
atgggtgattttagaagtgaaaacgagaagagtatttttacgctcgctcaacccgagactcatggaaaggatatgggagagaaaaatgggatacctggtagtatcagagacatcaacaccatcgatactatcgaggaaagatcctcaatagcgaggagtcgtgagaccccccttctcgtgagttcggccgggggcagaggctcgtctcttggaaatcactcgctcgtccctaagactaccgacaagcttgcacatagtcggattatacaggttttctgggcgtcgtccccccgtttcagtgggccgggtcctccttttatagctcaaggggataccacatgcgccgcctctacctaccctccatag

SEQ ID NO: 361 - DNA, 350 bp, Oryza sativa
  misc_feature (277)..(277): n = any nucleotide
  misc_feature (305)..(305): n = any nucleotide
  misc_feature (331)..(331): n = any nucleotide
atggacacgaccccctccacgtcctccaccttttcccccactcaccccgcaagaaacggcgccggtttgacctccccacgagctccacttcgccgccccacttcccctcgaaatccgccgctccccggccctctcctcgcccccttgagctataaaatcaatccccgtggactcctcttcctttttccccgttttcccgagtcccccacgccctctaccgagctctccacgccgatccccttcgccgccgctcgccggcgatctccagccgcccgcnaccgccgctcccgtcgctgccgcgctgngccgcggcaacctatagcatcacagnggccttgccggaaccccgg

SEQ ID NO: 362 - DNA, 315 bp, Oryza sativa
  misc_feature (4)..(4): n = any nucleotide
  misc_feature (126)..(126): n = any nucleotide
atgngcgccggggcggcgctggtgctgctgtcggcgacggcgcaggcggtggcggcgacggcggcgcgggcggctgcgaacggggcgcggttcctgtcggggttctttgccctggtggcgcacttngccggcgcgtacaccgccgccgtcctctccgagctggtccccgtcgtggtcgccgccgccggcggggtctgcgccgcgtccggctacaagcacatgctggtcgcccactacgtcgttctcgacataccgctcatcgtcttctacctcgccggctttgtcgcgcttattaatcagtatcatctagaatag

SEQ ID NO: 363 - DNA, 1944 bp, Oryza sativa
atggatttcggaccttgcaacgagacgctcgacaccgaactgctacacgtgctgacctccggcgacgaggtccgcatggcggacctgctgggcagagaacgccgtggccatggccactccctgtcccaggtggcgatacgcgtcgacgacgacgacgacggccgcgcgccggcgggagcgagccgcctccttggcgtgacgacgggcaacggcaacacggcgctgcacgtggccgccacccgcgggcacgccgcgctcgcggcgctggtctgcgcgacggcgcccgcgctggccgccacgcgcaacagagatgctgcgagccggcggcgcggcgtcagcgcgctgccgctgcggcgggcgacgaactgcctgggcgccaccgccttgcacgaggccgtgcggaacggccacgccggggtggtggctctcctcatggcggaggctcccgagctggcctccgtggccaacgacggtggcgtctcgccgctgtacctggcggcgacggttggctccgtggacattgtccgggcgctgctccacccgttgcctgatggaacgccctcgccggcctcggccgctggtccggacggacggacagctttgcattctgcggcaactactagcaaagaaatcgcgcgagaaatactggactggaagccagagggtcgaacactgctaaccaaagctgattcgtcgggcagaacacctctccactttgctatatcatcacaaattgagcggtttgacgtgtttcagctgttcctagatgcagagccctccctagctctggtttgtgatatccaaggatcatttcctttgcatgttgctgctgtgatgggcagtgttaggatcgtcgttgagctcatacagaaatgccccaacaactacaacgatttggtcgatgatcgaggaagaaattttctgcattgtgctgttgaacataacaaggaaagcatagttcgctacatttgccgagatgacaggtttggtatcctgatgaatgcaatggacaatgaaggaaatactcccctccatttggccgccgagtatgggcacccaaggatggtcagtttactcttggagacgatgagcgtcgatgtagccattaccaacagggatggtctaactgctgctgaccttgcttatcgccatctgcaacctggtttgcactattttctgaatcctcgagccgtggtaaagaatctcttctactgcaccagagcaccggttaccctagaaggggatcatgctaggactggcatcccatcggccatggaggatgccgatgctcccaaggacagtggtggcgtgacatccaccggaacagtcgcgtccgtgctgatcgccacggtgacgttcgcggcggctctcaccgttccggggggctacgtcgccgacgaccacccgaacgccgggacggcggcgtcggccgggcggttcgccttcagggcgttcgcggtgtcggacaccatggcgttcctctgctccatcgtgggcacctgcctcctcgtcgtcggcgaggcgagggaggtccggccgagcaggggccgtctccgcgcctaccaggggtcggcgtgggcgctcgtgacggccggggcgcagttcatggtcgccgcgttcgcgttcgggctccaggtcgcgctcggcggcggcgcggacagccggtggctggtggtgttcgtccacgcgctgtgctcggcatcggtgctgctctgcttcccgggcatctgggcgccgttctgcctcgggaaggtgatctggaggcgcgccggatggcgagggctcacgaatcttcaccggtgtccgtccagtttggaagagttcttgtggtgtttcgtgacaagcttcttggccaaaactctcttgcggacattcctcccggtgcttatcgcggtcaccttggtcgtcgccatcgtgctaaatattgcaaagcccaactgctga

SEQ ID NO: 364 - DNA, 1677 bp, Oryza sativa
atggcgcgtcgtcgtgatttgaccccgctgccgccgtgcagggaagggagggcagcgcaagcgagtacaacaaagaaaacaattctttcgttttacaacgtgcttgagaatttggaatttggatacgcttggcgagtaagctcgctgctggtttcctctttcatggctaccgaggccatcgtctccggcgtcgtcgccgacatggccggcaggctcgtgtccctcgtcgccggccacctgctggccgaccggaggggcgtcgacgacaagctgcggagggtgcggcgcctggtcgtcaggatcgagagcgcggtggaggcggccgaggcgaggcggatcaccgggcgcgcgctcctcgcgtggctctcggacctcgtcgacggcgcgcaccagggccgctacttcctcgacgcgttccccgtggtggcggaccacgacggcgacggcgacgtcgaggtggcgccgtcgtcgttcaaccccgccaagcggctgcgcgtcgcggcgaggaggctggtgttccgcgacggcggcggtgtggctgcggagctcgacggcgtccttgccgacctagagagtgtctccggcgatctcaccgggtttatcatgatgcttcagagctgcccgccggcgatgcaccggccgctggccacgaacatctacgcggacagccagatgttcggccggcaggtccagaggcgccgcgtcttcgacttcttgctgcaagacggcgacggcgatgacggcggcgagccggcggcggcggagctcggcgtcctctcgatcatcggccgttccggcctcgggaagaccacgctcgtgcagcacgtctgcgacgaccccgccgtgcgccgccgcttctcgcggatcatcctggtggacttccactgcgtgagcctcatggcggccggcgagacgactgctctactgcgctccctgttcgccgccgccgccgccgccgctggcacggggagcactagcatctccggcgtcggcgagaagctgagacttctcgagaagaatctgcgcggcgagaggctgctcatcgtgttcgacaacgtcgacgcgcggaggaggccggcggtcgacgcgatcatgcgggcgctgcggcgcggcggccggcgagggagcaaggtcatcgtgacgagcagcgacgccaggcacgtcgcgggccttgccaaccgcggcggacaccatcaccctccgccccccgccgccagcggagtactggctcttcttcaaggcgcacgcgttcggcggcgcggacgacgccgacgccgaccggcggctggcggcggcggggcaagccatcgccgagaggctccgcctgcgcgcgtcctacttcggcgggaaggcgctgggcgccctcctccggtggcgccccgaccaccggctctggcgcagggtgctgagcagcggcgccgcagacctgccatgcctcggcaccggcgactacatcgccgcggcggccggctgcctgttcccgccgcacctgaacctccacggcgtcaccgtctcccgctcgccgctgagaggtctcgtcggcctccatggctcctccttgatgactcctcctcccaccgactccggccgccgctcgccggagttgcccgtgttgctgtgcaagtcagtcttcccttcctactgcctctactacgccgcgcattgcaccatcgatga

SEQ ID NO: 365 - DNA, 1293 bp, Oryza sativa
  misc_feature (1165)..(1165): n = any nucleotide
  misc_feature (1180)..(1180): n = any nucleotide
atgcacgcgcaccagcaccagcacgcgctgctcgcggcgctcctcgcgtgcgcgctcgcggcgtcgtcgtcgacggccggagcgcagccggcggggcagcaggggtatgcctacggcgacgtgtccgggcagcaggtgcacgtcagcacgacgatgatcgtgctgctggccgccgtcgtcggggttttcctgttcatcgcgatctccaccatctacctccgccactgcaccggttacgaccccgcgacggagggcggcggcgtcggcgggagccgttccatgatcctccctgccaacagcttcgtctcgaggcggcagcggcggccgcgcgggctcgactcgtcggtggtccggatgttccccaccatgaagtacgccgaggcgaaggcgctgcgggtggggaaggtcgccggcgccgcgctggagtgcgcggtgtgcctcagcgagttcgaggacgacgagatgctcaggttcctgcccaagtgcagccacgccttccacccggactgcatcggccagtggctcgccagccacgtgacctgccccgtctgccgccgcaatctcgaccctaacaaggacaccaccgaagaggtgatcatcccggccgccgccgccgccgatccgaacagcacctccagtgaaatagttgtgatacggcaagaagacggggcgcacccagcagccgtggtgatcgacgtggtcaccgaggaggacgacgaggagcggaggaaggaggagctagagcttcaggcgataggcacccagctccgcgcgatgcggtcacggtcggggctgcggccaaagacgtcggcggcgaagcttccccggtcgcactccactggccactccctcgccgtccggctcgacggcgacctagagcggtacacgctgcggctgccggagcacgtacacagggagatggtcgcggcgggggagcagagcgtgcgccgcgggaggagactcggggaaggggtcggcatgggcgctcggtgcagcccccggttttcgcggtcgggcagatggtcatcttttctctcaaattctttgtcaggaaagctgtctttcctctccccgtcgtcgaggagaacgccggatagcacccaggtggaagtgtcatcatcctcgtcgtcgtcggtgacgaaggtgaaagggaagcgcgtggccnccgtcgatgttgccnacgacggttctgctcatgggactgcacagtaccctggttgcactgtggccagctcggcggcggcggcggctgtggacgtggagaaggcagctaccaggcaagttcgaacatag

SEQ ID NO: 366 - DNA, 1290 bp, Oryza sativa
  misc_feature (70)..(70): n = any nucleotide
  misc_feature (83)..(83): n = any nucleotide
  misc_feature (85)..(85): n = any nucleotide
  misc_feature (90)..(90): n = any nucleotide
  misc_feature (99)..(99): n = any nucleotide
  misc_feature (101)..(102): n = any nucleotide
  misc_feature (104)..(105): n = any nucleotide
  misc_feature (115)..(115): n = any nucleotide
  misc_feature (154)..(157): n = any nucleotide
  misc_feature (214)..(214): n = any nucleotide
  misc_feature (222)..(222): n = any nucleotide
  misc_feature (262)..(262): n = any nucleotide
  misc_feature (487)..(487): n = any nucleotide
atggcgcacgacataaccctgatcgaaggcggcggcaatggtggaagctcaccggagtgcgaggagatgngagctccggcgangnaattngacgggagnanngnngaacgaggtngatctcggcaacgcggacgcggacggcgccgatggcggnnnncggcggcgaccctagcgactgctagaggcggccggagcggtggagatggtggcggcnggtgggtncacggtgctagggcgatagggagctcgggagcggacggcnaaagagggaaaaaggtggagagaggcgcggtggtcggttatatagaggtggggaggccggacgtggccgggagcggcggttccgcggcgacgacgtggagaggtggaggaggagagagagggggagaggattcaaatcgaatcccgccctctcgagcgcgcgcacgggccgggagatgcggggagagggcggcgacgtgggcgtgcggtacgggcggagtgggcncgggaaacggggaaaccggcggcgtcggtggcggtttcggcggcggccggcttggggagcggcggcgggagttggaagaaggggccgacaggtgggccccacctgtcggtgacccggaggggtttgggaggagggaggaaccagcttgggccggcccagccgagggaaggccggcgcgggagcaagggaggggaacttcagggcgtgacactcgtccaccgagtcgtctctctctctctctcagctctctcttttttctttctccaccgaatcggcatgcgacgatgggagggaatactgctgctacggcagcgggtcgacgacatgaggggaagcggcggtggtctgacggccccgcagcggcgccctcccctccgctagatctggtgggaggggaggtcggtggcgtgaggggaggcggcagtggaggtggcgatggtggtgccgcggcagcggcgctcccctcctctccatccaacgacaatggcggctgtggagacgttagtggcggtagtagcggtgctggtgaaggcagtgacgccctcctctccttccgattcatgatgagcattcttgatgaatatgggatcggcttgacggctcaatgcatcgagccgtttttttggctcatgggcgcctcaaaggtgccggttaaaaccgcctcggtcatcagtgccgccaaccggagtagaaccgattcaacgtcctactacatggaagtacttggtcaaagctacaactcatggacgatgaagagaatgagctctatgtggaagcactttgatgtgacgatggaattgtga

SEQ ID NO: 367 - DNA, 1272 bp, Oryza sativa
  misc_feature (253)..(253): n = any nucleotide
  misc_feature (450)..(450): n = any nucleotide
  misc_feature (465)..(465): n = any nucleotide
atggacgccgagatggccatgggcgagagcttcgcctactactgggagacgcagcgctaccttgagtccgaggagctcgacagcatgtacctgccgacgcaggatgactccaactacgagtcgagctcgccggacgggtcgcactcgtcgtcggcgccggcgccggcggccgtgggcggggacgcagccgccgcggtggcgggtagcggtggcgggatgacgacgatgatgatgggcggcggcggcggcggtngcgacgacgccgttggcgcgaacaagaacatcctcatggagcgcgaccgccgccgcaagctcaacgagaagctctacgcgctccgcagtgtcgtgcccaacatcaccaaggcgtcgatcatcaaggacgcgatcgagtacatccagcgcctgcaggcggaggagcagcagatgctccgggaagtcgccgcgctcgantccgccgccgcggcnagcgccgccccggccgcggcgaacccgttcgccggcctcggcgccgacgaggaacacgagtacggccaccaccacccctcgtcgtcgtcggagcggacgaagaaggtgaagcgggcgctgtccgtgtcgtccatcagcgacgccctggttgccgcggcggagccggcgccgccggtggagatccaggagctgcgcgtgtcggaggtgggcgacagggtgctggtggtgagcgtgacgtgcagcaagcgccgcgacgccatggcccgggtgtgccgcgccctcgaggagctccgcctccgcgtcatcaccgccaacatcacctccgtcgccggctgcctcatgcacaccctcttcgtcgaggtagatcacatggatagtgtccaaatgaagcagatggtggaggctgctctctcccagcttgtggcgaccggcaggtgtggaagtgcttcacatgactacttgctatttgtcgaccacggcgccgtcgtcaatgtccgatactgtgaattcttcctgctgtgcagctccagaaccctcgccaatctccctccccggctctctttggaggctgtggcggcgcatacaccgatgccgccgttaactcgagttgaggtgggagcaaccgggacaggggtgcgcttcatgtgggagtcattgccctcgctgatgaggatggtgccgattgggtcattgaagccagcggccaatgtcagagcttgtgcggaggtggctgcaacatcgggggagtcgaacctcacgtgcagccagcaacaagtccacctccgtctcaagctttcttgcgcttaa

SEQ ID NO: 368 - DNA, 1254 bp, Oryza sativa
atgaagcgccgccacctcccgcccgtcctcgtcctcctcctcctctcaatcctctccctctccttccgccgccgcctcctcgtgctgcagggccccccgtcgtcgtcgtcgtcgtcccgccaccccgtcggtgaccccctcctccgccgcctcgcggccgacgatggcgccggatccagccagatcctcgccgaggccgccgcgctgttcgccaacgcgtcgatctcgacgttccccagcctcggcaaccaccaccggctgctctacctccgcatgccgtacgccttctccccgcgcgccccgccgcggcccaagaccgtcgcccgcctccgcgtcccggtcgacgcgctcccccccgacgggaagctcctcgcctcgttcagggcatcgctcgggtcgttcctcgccggccgccgccgccgcggccgcggggggaatgtggccggcgtgatgcgcgacctcgcgggggtcctcggccgccgatcgacgcgcacgacctcgtcatccgccttaacaaaggcgcgcgttgccgggtttgccgcggaagtcggcgtcaagacctccctttccttcgtcaactccaacatcctccacatttgcgccgcccgcaacgccattacccgggccgcctgcggctgccacccgtacggcggcgaggtgcccatggcgatgtacgtctgccagcccgcccacctcctcgacgcgctcatctgcaacgccaccgccacgccgtcctccccgttcccgctcctcgtcaccgacgcgcgcctcgacgcgctgtgcgcgcgcatcgccaagtactactcgctgaggcggttcgtctccgccaccggcgagccggcggcgaactggacgcggaggcacgacgagaggtacttccactactcgtcggggatgcaggcggtggtgatggcgctcggcgtctgcgacgaggtgagcctcttcggcttcggcaagtcgcccggcgccaagcaccattaccacaccaaccagaagaaggagctggacctgcacgactacgaggcggagtacgacttctacggcgacctccaggcgcggccggcggcggtgcccttcctcgacgacgcccacggcttcaccgtgccgccgaatcccattgtaatttgtaaattcagggggaatgggaggagatacggacacaagatgtgtgtcagatttgggagctttatcttgcttaggtatgaaaatgatccagtagctgatgctactaataactattacgtctttgtttaa

SEQ ID NO: 369 - DNA, 1233 bp, Oryza sativa
atgggttacctttaccgcaaggttgagcaaatgctcgtgatgtgctcggcggcgtgttcgctcgcgcgcgcgcacggcggcggcctccggcgaggtgtagagcgtgccaacatgcgcggccgcctcctcgccgacgcggcggtggcaggaggcggcggcggcgtcgtgccgatctactggtcccagccgctctacatggcgaacctcaccatcggcacgccgccgcagccggcgtcggcgatcatccacctcgccggggagttcgtctggacgcagtgctcgccgtgccgccgctgcttcaagcaggatcttcccctgttcaaccggtccgcgtcgtccacctaccggccggagccgtgcggcacggccctgtgcgagtccgtcccggcgagcacctgctccggcgacggcgtgtgcagctacgaggtggaaaccatgttcggggacacgtccgggatcggcggcaccgacaccttcgccatcgggacggccacggcgagcctcgccttcgggtgcgccatggacagcaacatcaagcaactgctgggagcttccggggtcgtcgggctagggaggacgccgtggtcgctcgtcgggcagatgaacgccacggcgttctcctactgcctcgcgccgcacggcgcggccgggaagaagagcgcgctgctcctcggcgcctccgcgaagctcgccggcggcaagagcgccgccacgacgccgctcgtcaacacctccgacgactcctccgattacatgatccatctggaagggatcaaattcggcgacgtgataatcgcgccgcctccgaacggcagcgtcgtcctggtcgacaccatctttggggtgagcttcctggtcgacgccgcgttccaggccatcaagaaggcggtgacggtcgccgtcggcgcggcgccgatggcgacgccgacgaaaccgttcgatctctgcttcccgaaagcagctgcggcggcgggggccaacagcagcttgccgttgccggacgtcgtgctcacgttccagggcgccgccgcgttgacggtgccgccgtcgaagtacatgtacgacgccgggaacggcacggtgtgcctcgccatgatgagctcggcgatgctgaacctgacgacggagctgagcatcctgggaagattgcatcaggagaacatccacttcctcttcgacctcgacaaggagacgctctccttcgaaccagcggattgcagctcactctcctaa

SEQ ID NO: 370 - DNA, 1176 bp, Oryza sativa
atggcgagcggcggcgtggtgaagaaggagatcggcgggaaccacgacgtcctccgcttcggcgtcaacgacagcgtcaagggggacctcgcgccgccgcacccgctccaggccagcgtccacaaggatgccaagttctgggcggacaagaagaggttcggcgcggaagccatctacggatccgccttcaacatccgcaaggatcttgatgcccaaatcctctccaagttccaaaggccccctggtgcattgccgtcatctatgctaggatatgaggcactgactggttccttagatgattttgggtttgaagattatcttaactacgctgcggcctccgaggatggctgggtcctggggcgtggagctctggaattgctgctcggcggcaccgcctacacacaagcgacaagtgcgccacaaatctctctctcgatgcagcaagtgcagcggagggagctgcaactggtcgccgtttctgccatgctgatagattgcaagtacgaggagatttgggccccagaggtgaacgacttcatcttcatatcagatagtgcatacactagggaacagattcttgcaatggagaaggggattctgaataagcttcagtggaatctcaccattcctacaccatatgtcttcattatgatgctatctgcgtctgcagataacaaaagtgacaaggagaatgctgaggccctcaagttcaaaagattatcacagagccggcaacaactcattgattggtcagtaaaaataaaggtttcaaaggagcatgggggtttcatgagatttatccaggtttcttgcctaggagcatcggcctcttcttctagaatgctgagggccaaggctgctggggaagaatctgtgttgaaggaatttcctgagccattacggcttttaatcagtcataggcaatcaatggggacctgcatcttaaacttccacagcaggattcagcctgtttatgttgtggatgttgctgctgctattgtcaactccctcaaggatgatggcaccagcatgggaaagagctacggacttggtggaccagagatttatactgttcatgatctggctgagctgatgtatgagacaatatgtgaatggccacggtacatcgatgttcctcttcctattgcaagggctatcgcatctcctgaaagctga

SEQ ID NO: 371 - DNA, 1158 bp, Oryza sativa
aggaaggtgactgataaggcggatgatccagaacttggtaaggaaaatccagtgccggaagtgccaccggagattgcattgccggagacagccaaggagattgcaccgccggagacagccatggagattgcaccgccggagacagccatggagattcaagtgccggatgtgcccatagagattacagtggcagaaccagaggtggaatttgtggcatcagtcgggtcagacaaagatgaagtaccaggattggaatgggatggtacagagccagagatatttgaagacccttctcctgcgaaagaacccgaggtgccacgagtgattaggagccacgaatccaagtccaaagatgcgaacaaggagaagttcatgctaaccgtctttagagggggtaaggaacgtgccaagctcagagatgacgacccccagaaggcttctgtgctagccgggccaacatacttcgcaaccgatgattgcccggaaaagtacgaacatgggaaagcactcttgccggaatgggcactgaaagaggcaccatgggagatgagaaggttacataacttctacatggaggccagcaagaaaggcttgggcaatataacagctcgatcaccggcagattgtttcggcgaagaaggttactgtcacaagcaaccgcgaggaacggtcctttgcgggtattatgcgtgcgaattccttagggttaatggacggtacaggactaacgcggaggataaattccacgcagcagctgagctctcgatctcgccacagagccaggtgtgcgtctccgggatcgatgaggcagctcatccggcggctctcccgcgtcggcgactcctccgccgccgccgcctcgtcgtcgtcgccggggaagcggcggggcgcagggacgaagaagaaggcggcggcggcgggggtgccgccggaggggcacgtgccggtggacgtcggggaggaaggggaggaggcgacggagcgttcctcgtgcgggccgagctgctggggcggccggcgctggccgagctgctgggccgcgccgcgcaggagtacggctacgaccaccgcggcccgctccgcatcccctgctcccccgccgccttccgccgcgcgctcgccggcgccggggatggagaccacgacgacgacggctag

SEQ ID NO: 372 - DNA, 1107 bp, Oryza sativa
  misc_feature (395)..(395): n = any nucleotide
atggtggacccgtcgacggcttgtgcgatgcagaggcgacttcatgttcatcccacactgttgaagctcgtcggcagggccggcggtcaggcaccatggatccacatcgatagctcgaggtcttcatcactgcactggttcctcttttgtgcacacctctatctgtttcaccccaatgtatatcttcctccattggcttcaccgctggtgttcattgctcgccctcttgtgcaacctgtcctccctctgagagggctgattgcaaaaatatgtgctagcatggaacaccacgttgacaattgcgacgtacccgtcgacagcgagtcgcctgtggtgacttcgtcaatctctacaggatttgccggcacagtcttcgaagatgctcataggggtanggacgtccgtgtctccctctaccttggcaccatcaccggcctcctccatgctgacgatggcgtcaccgtggggccattggtcgtcgccgccatcggcatctctcctccctcccctgatccttctccacggctggcaaggcagagatggggaagaggaaggccaatgtgtgatggagaaggcgacgtcggtgttcctgatccggtcgcctttgctcttcagccaagatctgttcgcctttcctcgccgcgaggagtcttgtgcgacgatgatgccaagctggcttcatgccacactgccaacaagcccctcacgggcaagggtgagatcggagcttcggccgagaccgtgcaaaccatgtggtatgtcctttcgttcgctccctttgttcgccactgcacacactgttcgccactgtatacacccttcgtcatggctccccgcaagcctaacccctcttcggcgaaagggcccgatcttgaacggatcaacgacgactccaccgcttatttggggatctctctcatagacgacggtgaattggcgaagttggtcagctctggggcgctagtcgaaggacaggctttcgccccggggaaagccgttgtaccgaagcccgtcgacaaccgaacggtggtgttcgccgtgttttttgaggcggggctccggtttccgtgcagcgcgttgttgccggagatccttcgccttttctag

SEQ ID NO: 373 - DNA, 1074 bp, Oryza sativa
atgttgtacccggagcggccgagccgcgtcaacgggacggccaccgtcgactgctcggcctacccgctcgactgccacccggtctgcccaggcggcagctgctacgagatcgccgagcccccgccgccgtcgccggtggtcccgcgcgtcgacgtggccgtcgacgaccaccacctccccgtacgcctcctcctcaccgtctcactcctctccgccttcctgttcatctcgctctctgtctccacgatcctgctctaccgccgccgcgtcgtcctgcgccgccggcgccgggccgcgaccgcgccgctccccggcgacgacgggttcggcgacggggatgaggaggcggggggcggcggcggggatgtgcaccacgtgtggtacatccgcacggtggggctggacgaggccaccatcacgtccatagccaccgcggagtaccgcgccggagttgggtggggaggggactgcgcggtgtgcctcggcgagttccgcgacggggagttggtccgcctcctcccgcgctgctcgcatccgttccatgcgccttgcatcgacacctggctccgcgcacacgtcaactgcccgctctgcagatccccagtcgtcgttccctccgatctccccgccacggctaccgaaggtgaggcggagggtggtgggcaagcggaagagcaccaggtgtttgatgaaatctcgctatcggaatcacgtgccgatgtctccgaggattctgacacctcttcggacactcaaagtgaggacacagcagcttcaccagaggatggtgggagggtgatgcccaagccaatacggcgctcggcgtccatggactcaccgttattcctggtggttgtgcctgaagcgcaggacgatgccatgcggggtgatcgaaaatttccgaatggtcaagagatgaagttattcagcgtgaaagagaaggatgcaacagggacgtcttcttcctcttgtcaggcagggcggtttgggattggcagatcgatgtcgagcagtgggcaggggttcttcttctcacggaatgggcgctccagtagtgctgtgttaccactgtga

SEQ ID NO: 374 - DNA, 1024 bp, Oryza sativa
  misc_feature (40)..(40): n = any nucleotide
  misc_feature (44)..(44): n = any nucleotide
  misc_feature (160)..(160): n = any nucleotide
  misc_feature (170)..(170): n = any nucleotide
  misc_feature (173)..(173): n = any nucleotide
  misc_feature (191)..(191): n = any nucleotide
  misc_feature (217)..(217): n = any nucleotide
  misc_feature (227)..(227): n = any nucleotide
  misc_feature (263)..(263): n = any nucleotide
  misc_feature (316)..(316): n = any nucleotide
  misc_feature (698)..(698): n = any nucleotide
  misc_feature (703)..(703): n = any nucleotide
  misc_feature (709)..(709): n = any nucleotide
  misc_feature (771)..(771): n = any nucleotide
  misc_feature (795)..(795): n = any nucleotide
  misc_feature (804)..(804): n = any nucleotide
  misc_feature (819)..(819): n = any nucleotide
  misc_feature (854)..(854): n = any nucleotide
atgggccggccggcccaaggcggcccaagtgcgcgccttncggnagggaagaagagagagggccggtggaccgggctcaccgtgcgcggtcccgggtgggacccgcttgtcagcggctcggttcaccgtgcggagggagcacgcggcgaacgcgcgcggncgggggaggnacntggtgcacgcgcgcggtntgcggaggaacggatgcggcgggccnacgcgcagcntcacggttcgcggtggaacgcgcgcacgggaggggntgaccggggtcggcccgtcccgacctcggctgagctggcgccgacgtggcgcntacgtggctgccacgtgggctggcgggaggtagacgacgacgccggccggaacggacggcggacaacagcggcgagcggcggagcgaaccacggcgataccggcgaaagcgagcacgccgggtggttgcacgagacgaggggagacgagccaacggctcggattcgccggaggaagcttgacggcggcgaatcgcggcggcgacaaccggcggggagggaagagggaaaccggcgacgaggccacgaggggcccgatttcccggcggtgagagcatccacgcggccacgggaatccgatgctagcgtcggattgggcggacctacgccgatcgaggcttgccaacttccgggtgctacggagctcaagcggccaccgttgcnagcanacggcnagcgacggcaatggttggggcggcgccggctagctacggggagtctactcgtgctaccaccnaagactaaggggggagatggagcnaggaggaanaacggagaggggcantaccgtgcgggtcggggcgctgtgacgagaggccnatggcgcgggagtaatctttccggcctcgggccggagaagaggaaggagagggcgcggccgaagttcccttccgcgggaaaaggggaagggagggcgcctgggtttatagggggcggcaatgtcggtttggaaaccgactttggcggtcaaggcgcgagctggcgtccgg

SEQ ID NO: 375 - DNA, 981 bp, Oryza sativa
  misc_feature (455)..(455): n = any nucleotide
atggctaagcgcgggtcccacacgtcagcggcacaagggggagggcgcacggtggaccaagtccacccgtggccttgggcgcgcgtccaccacgtggacggcccagatcggcccaagcggctgaggggagcggtggccgggcacgggcacagccggggctggcccgaccgaccacagaggttggcggtgcgcagacggccggacagccggcggcgcaacgcgatgctggcacgggaggcggccgacgaaggggagaaggaggagggaggcggctcaccgagactggatggcgagagcgaggaggcagacgaggtgcagcacacgacgacgaagccgacaaaggtggtttcggtggtggtgagggagagaaaaacggtggccgagcttgggcttgcggcgacgaagccggcggtggcggcggagcagtgctacggtggttctagcaacgggaagtngcggctggcactcacaaaggcaatggcagctcgggttggcagtggaggtggcagcccggtggtggattgggggagtggagcggtggacggcgtgcggcgtggagcggtgatgccgacgtcagtggttgcgtggcgcggcggtggcgctagcggcgacgaggccgaggtgcagcgcgcgacggcgaagctattggtggcggctgcgcagtgcggcgacggcgggagcggcggtggcgcgcggctggtgatcgccggcgagcggcggcgcgctcggggagggagaaccgtagccgagcggggcggcaacggccggggtgcgagcgggaaggcgccggatttgacgggacgtgggtggcaaccgtcggccatggctgcttcggcctggaaggccggagggcggctgctgctggtgccgctccagtgcgggtgcctctcccactcgcccaatgcatacgcgcctatgcagtaccagatcaacactgacgacacattctggatcgtctggggaaattggaaatttgattga

SEQ ID NO: 376 - DNA, 969 bp, Oryza sativa
atggaagcagacgccgtgtgccaaccgaggcgagtggcagacaaacggactccactagacaccacgcgggctgcacacgtgcaaaccacgtggctaccgagtggacacccaacacggtcaccaaacgcacccacgaatgactaccgacaccggtacatgggtaccggggtcgacaaacacacaatgggcatggggagacaacgaaaggacgaggacggggcagtgagaggacggatccttactaccacgcgacgaggcgtgggaacgacgacgacaaacggcgcggcagagatggacaggaacgacggagacgaacggacgacacttctccggcgatccttggacgaaggcaggacgaggccaactcagggcttgacgatgtggagccgaggacgaagacaacgacgaggctgcagcagacttgacgaaacgcgggcgacgaacgaacgcggcttgacggagggacgaacgccacgacgatcgagaacgacgggaggacgacaaccagaaccggcgaggaggcgacgagggcagccggcagcagctgcacggattcgaggacggcgcggaacacaccgctgtgatgacgacgatggaggcagcaccgcgggacgacaagccggcgaggatgaacacgcatgggaggaggaagggccgaccggggaaattccggcaaggcggatggagaggccggcgcggcacggcggtgttccggcgaaatacgggcgacgcctggacggggaagatgacggcgttctggttccgggaaaagttgttggcgacgtcggccagcgcacaggagacgcggcagaggcggccggaggcggaacagtggcggcaacgccactgttgccggcggggatgcacttccggaggcaatggaggggagtgccgaccactggaggggacgggaacgatgccggagagcgtggccggcggcatcaatggcggtcaaagaagagggattaa

SEQ ID NO: 377 - DNA, 948 bp, Oryza sativa
  misc_feature (678)..(678): n = any nucleotide
atgatgaagaggttctactcgtcgatcgggcagggggtggaggcgctgcaccggagtctggcggtcggcgaagtggggttcatgtcggcggcgttcgtgcagcaggctgcggcgctggtgcggtcggtgcacgcgcagctgctggaggtggtggggaggctgcacctgccggcgggggaaaggtggctggacgagtacatggacgagacctcccgcctgtgggacgcctgcctcctcgtccgcgccggcgcctccgccctccacgcctactccgccgccgccgcccacgccatccaccacctctacgaccatgacgacgactacatccacgccgcccgcgccatcaacgcccctcgccgccacgccgccggcctcctccaggacaaccgcgccctcctccacgacaacatcctcgacccggcctccctcctcctcctcgaccaccgctccccgagggacctcaacctcaacgccttcaacggcttccgcgccctcctctacgccctccgcaacgccacctccttcctcctcgccatcctcctctctgccaccgtctcctcctgcctccccgaccacctcatctccacctgcactccccttcccctgcccaccgcacccggctacgcctcctccatggctcgcctccgccaccgcgtcgcccaggagatgcgcgccctngccgcccccgccgccgacggcatcctgatgtacgagttccgccaggccagggccgccatcgacagcctcaaggccgacctcgacagggtcgtcgccaccggcaccggctacgcccaccgggaggacatggccgagagggcccacctcgtcaaaggctgcctcgccatgctcagctccggcgccgaggccgtcatcgccgagctcgacgacttgttcgatgacattgtcgagggcaggaagatgctctccgacctctgcagccatcgctga

SEQ ID NO: 378 - DNA, 903 bp, Oryza sativa
atgccgcaaccacctccacctccgccggagggaagtggccggaggagagcgtggcggaaaaggaggcgacgccagccaccacctcgcagcaaggaggtggatctagaggaggaggggagaagaatggaggaggaggaggaggagtggactactactacacctacattgacaattttgacattcgacgcagcgcccaaaacccaagcgaagcgaagcgtggacggcgttggtgttgtggtcctctctccccaccgacgcgtccgcgccaccaaccgcctcatactgtactgtactatactagaacgtgaacgaataggtgtaactcgtacgtttttctcatcgggtttagatggtgttcgtttgtactatcgaagattaagttatatcacaggaagtaataacaagggatccagcaaccagcatcgatcatcaagttcctcaagctattacctagctaaatttgatgattcccggacggcattgtcctggcttttaatttgggagcccagttcatcagccaggatggatcgatcagtacgtgagtacagtgttcaagtccttaaaattgcaatttgccactacaccgtacccatatgtgcccaaaaagaagaaaataatttgaagggggggcgaaaagacattcccccgctgcggccccccggttttacctcttctcgcgaacaaagaaggagcaaactgtacaatagagctggtggtggtactggcagtaccaccactgcagcatctcaagcccaatccaacgtgcacagttcagaagaaaactgcatctgcattggctgtcataactgcattgcagccattgaagaagaagaaacacatcacacatgcagcaagcgctgcaaagcaaggcattgcaatgtggtcacagaaaggggtttgtaa

SEQ ID NO: 379 - DNA, 900 bp, Oryza sativa
atgacgacccgatccaacggcgagcaccaccacgggccgccctcgtaccagcagcggcgcccgcactacgggggcgggtacggcggcgggtcggcctcgttccgcggctgctgctgctgcatcttcctgctgctcaccttcctggccctcctcgcgctggccgtcgcgctcgtcgtggtgctggtggtgaagccgcggaagccgcagttcgacctcaaccaggtgtccgtccagtacctcctcgtcaccccgccgtcctccgccgcctccgccgtgggggggaccgtggccgccgcggtccccgccgcggcctacctctccctcaacatcacgctcctcttcaccgccgtgaaccccaacaaggtcggcatccgctacggcgccacggcgttcgacgtcatgtaccacggcgtgccgctcggggtggcggccgtgcccgggttcgagcagccggcgcacagcacccgcctgctccagacccgcgtcatcgtcgaccgcttcaacgtgctccaggccgacgcccaggacctcgtccgcgacgccgcgatcagcgaccgcgtcgacctccgcatcaccggcgacgtcggcgccaagatcctcgtgctcggcttctcctccccaaaagtccagtggtggggacgaggtgtactcgagaatttacggttacctggaaatgaggggcgtgggttaggcgataaaccatttgtaaatgcagacctgcagagttgcggaagaacgttttggagaaggaacgtggcccttccgtgttgtgtcgagtgtcagacggcaggaatataccgtagagtagtcctcatgccgactggagagtgtcttgaacctggttataaaggtgggtctccggacacagcaccgggtttggacttcccaggcttaacgtaa

SEQ ID NO: 380 - DNA, 876 bp, Oryza sativa
atgggactccggtttgataaaagtatagagcaggaaatagaggattttttcgcaagtaaaaatctggatacagtagcgcagagcccatacatagggcttattcgcgctgtagagcttttagagaaagagggagatggacctgccccagccaatgggaatgacgcagggagcccaggcccagcggggagtgaaaggctctcctcgtcgggctcatcggtaaaccaacctgagccgttgacacaggatttattggctgatgctgtgacctatgagagcccaaattatttatcagatgcggaaagcacaaattctttaggaccagtaactgatttggcgagccccttggatccattctccattcacccaataatggatcttcttatgggcaactattatttagcattcacaaatgaatcattgtctatggcgacaaaaagctacgcgcaaattctcattggatctcggttgttcttaacagcgatggctattcatttaagtcttcgggtagcaccaccagatcttcaacaaggtggaaattctcgtatttcgtatgtacatgttcctgcggctcggatgagtatagttatttatatcgcgacagctataaacagttccttgttcccattaacaaaacatcccctttttcttcgctcttccggaaccggtacagaaattggtgctttttctactttgtttacgttagtgactgggggatttcggggaaggcctatgtggggtacctttcgggtgtgggatgctcgtttaacttctgtattcatcttgtttcttatttacctgggtgcactgcgttttcaaaagcttcctgtcgaaccggctcctatttcaatccgtgctgaccgatcgatataccaataa

SEQ ID NO: 381 - DNA, 854 bp, Oryza sativa
  misc_feature (557)..(557): n = any nucleotide
  misc_feature (574)..(574): n = any nucleotide
gtggggtcggtgtcgtgctggggcccacgcgtcagtggcgttgggtcttcccgtcggcgcgggggctcgaggaggaccgcgtggagctccctgacacgtgggacccaccaaacctcttgtccccacccgccatccagagcagctcgaggaaggaggaggaggaggttgattcgatggggatggaggcggagtgcgataggataaaggggccatggagccctgaggaggacgaggcgctgcggcggctggtggagcggcacggggcgaggaactggacggcgatcgggagggggatcccggggaggtcggggaagtcgtgcaggctgcggtggtgcaaccagctgtcgccgcaggtggagcgccgcccgttcacggcggaggaggacgccgcgatactccgggcgcacgcccgcctcggcaaccgctgggccgccatcgcgcgcctcctccccggccgcaccgacaacgccgtcaagaaccactggaactcctccctcaagcgcaagctcgccaccgccacggacggcggcgagatcgaccggccgtgtaagcgcgtnagccccgggccggggancccgacgggatcggagcgcagcgagctcagccacggcggctgcggaagcggaagcggcggcgggcaggtgttccgccccgtgccgcgccccggcggcttcgacgccatcagcgcggcggacgtcgagatgatccgcacggaagtccgcaactacatggccggcgtcgggctccgcgccggctgcggcccgggcgccgtggccgagtccttcatgccgcagctcgtcgacggcgtcatgggcgccgccgccgagagggtcggcgtcgtgacccgccaataa

SEQ ID NO: 382 - DNA, 836 bp, Oryza sativa
ctggcgctgaccgtggggacctccgagcgaaaccactgatgtcaccgaagaagatcgtcaaggagagagttgtcaagcggatggaagatggaagcgaaggggagatggtagccgaagagggagcagagccttcggcctccgagccttcagcctcgcaagagaacaaaagagaagaagagatactcttcgacattgtcaacatcccctacaactacaacgcaatcttcagcaggggcactttgaccaagttcgaagcagtctctcatcacaactacctcaagctcaagatgcctggcccagccggaagtccacaccctagaggtcgaaggacaagaaaaaacaaagccaataccaaagcctgcccccacggcaaggttatccagtggcatatagatgaattcgaccccgccaaagtcatatcgcttggtggagacctgagcgaacaagaggttgtcagcatcctggttgtacttaagaagaacattgatatcttcgcttgggggccagacaatgtagggggtgtttcgccagatcttatcatgcaccatctcacagtcaagcttgaagcaaagccgacgaagcaaaagttgaggaaaatgtcggcagatcgccaagaggcggcgaaagcagaggtgaacaagctgctgaaagctggggtcatacaagagagtgaccacccagagtggttagcaaatccggtactggtgaagaagtcgaacggcaagtggcgaatgtgtgtcgacttcacggacctcaacaagatgtgcccgaaggatgatttcccattgccccggatcgatcagctggtcgattcgaccgccgatgcgaactcatga

SEQ ID NO: 383 - DNA, 819 bp, Oryza sativa
  misc_feature (471)..(471): n = any nucleotide
atggaccccaaattccccccacccccaccgctaaacaaaacggagcccaccaccaccaccaccaaccagcagcatcaccacgatgagcagcagcagcagcatcgcctccagattcaagttcatcctcagcagcaggagcagcaggatggaggtggaggaggagggaaggatcagcagcagcagcagcagatgcaggtggtggttgcggcggcggcgggggagaggaggatgcaggggctagggccgaagcggagctcgaacaaggaccgccacaccaaggtggacgggcgggggcggcggatccggatgccggcgctgtgcgccgcccggatcttccagctcacgcgggagctcggccacaagtccgacggcgagaccgtccagtggctgctccagcaggcggagccggccatcgtcgccgccacggggaccgggaccatcccggcgtccgcgctcgcctccgtcgccccntccctcccttcccccaactccgccctctccaggttctccggcgccgactccggggtgatcggcgggatcatgcagcggatggggatccccgccgggatcgagctccagggcgggggagcgggggggttggggggtgggggtggcggcggcggtggccacatcgggttcgcgcccatgttcgccagccacgcggcggcggcggcggccatgccggggctagagctagggctctcgcaggacggccacatcggcgtgctcgccgcgcagtcgctcagccagttctaccaccaggtgtataatagccgagagctggatggactggatcatcgctgtcgagtcgttgtgtag

SEQ ID NO: 384 - DNA, 816 bp, Oryza sativa
  misc_feature (52)..(52): n = any nucleotide
  misc_feature (55)..(55): n = any nucleotide
atggctgccagccgactcctcgtggacctcgtggctcagcgcagggttgtgntgntcgtcgtcatggtcaccgacgacgaccaccgcctccggctccgtctcgtgcgtcgggctgctgctgctgggggacgcggcgcgcttggcggcggctgctccggcaagcttggcgccgtgcttggagttggagctggaggaggcgcgcttgaagcgggtgcggccgccgcgcgcgacgcggagcaggttggcggcggcgtcggcctcggcgtccttggagacgtggcggatgtcgtaggccctgagcggcggggtggcctgggcggcggcggcggcctcagaggagacctgcacgacggggtcgcccttgaggacggcctcgacggcggcctggcacgcctgccactggcccgaccagagcaggccgacggagccgtagatcgggttgacgatgcggccgcaggcctcgtagaggagcgagcggaagacggcggggcggaggtggtcaggcccggcagcgagcaggttgagaagcccggcgcggccgtagaacttggcgaggaagacggtggcgttggcctgcgcctcgggggtcttgatccactgcaggcacggacggatggtgcacccttcgctgcatcccttgcgcagcacccggcaaccgttgcaactcatccgcatcttcgaaatgcttctgcaaacccttatcaactgggcgccggacttgttggagatccgaggtggtactattcttccttcttcttctccaagcctgtgcgaggactcgactcgatactgccttgcttgttggagatgagttga

SEQ ID NO: 385 - DNA, 792 bp, Oryza sativa
  misc_feature (54)..(54): n = any nucleotide
  misc_feature (534)..(534): n = any nucleotide
atgggaacggcagtcggcgagggaaggggaggggagcaaatcgagggtggcctnggagaaccgggacgggaagcggagcgccgccgatggctgccgtcacgcggggaggaccgtggtggtcatctgccttccctcctcccccacgtgccgtgcgcggccattgccatgaccgtgcgtcatcgtcggggtgaggcggctggcggctggtggctggcgagggaggagcgcggcgaagaggagggcagatgcggtggcggcggcgtcaccgatgcggcagggaagagggacggtgcggccgacggggaaggagagacggagaggaggaggagcggcgaagagggtcggcgcggccgacggggaatgagcggcggggaaggggagggcagcggcagggcaaggcagcgtcggcgggtgttcgcggtggcggagaggcagcggccgcagcagcagcaggcgagcacggctgcggatggggagcggcggcgccgacgactccgtgccgcccggcctcatcgtcgtcggcggcttcggganggggcgccacgccgccggcttcttgtcgcttgtccgctaggccgcggccggaccggagtggcgagcgtggacgacgacgaggcatgcgaactggtgagcggcgtggacctcttcatcggtggcgacatcgacgacgagggcaagggcgtccgtgcatacctcctccgcctcccctgccggccgcagctgcgcgccgccatcgccgacgcccgacggcagcgacttgatggcggcgttgtcgagtcgatctccgcatga

SEQ ID NO: 386 - DNA, 705 bp, Oryza sativa
atgcccatgccattgccatcccaagtgcaccggtgccaccttctcccagcgccaccacactctccatctcttgtcaccttgctctactctccccttcttaacctcttcacgccaccgccggccaccaccaccactctctactccggcgacatcatgttcatcaacacggccagcttcgtcgccggcgccgtcgtcgcttcgccggagcagccggccaagcttgtccgggatcagaggagggtggtgcctggctcctgcagggcaagaagaggtgcagcatccaatggcttcagaacttactgcatgcagacatggaaccctttcaccaacaggaggtacgaggcgatgtcttacctgcctcccctgagcgcgaagtccatctccaaggagatcgagttcatcatgtccaaaggatgggtcccttgcctcgagtttgacaaggagggggagatccaccggagcaacagccggatgccggggtactacgacgggaggtactggacgctgtggaagctgccgatgttcggatgctctgacgcggcggcggtgctccgggaggtggaggaatgccggagggagtacccggacgccttcatccgcctcatcgccttcgacagcagccgccagtgccagtgcatgtccttcgtcgtccacaagccgccgtcggccgccgcttctccggccacggtcgccggagctgaatga

SEQ ID NO: 387 - DNA, 673 bp, Oryza sativa
  misc_feature (220)..(220): n = any nucleotide
  misc_feature (362)..(362): n = any nucleotide
  misc_feature (407)..(407): n = any nucleotide
atggcgccgctagcacgtccttccctagctgcgttgctcgcgctgtgcgcattcgccgcggtggagcggccgccggccggcgtcggcgccgccaacgtgccgatcacgacgtgccggtccttctgcggcaacatcacggtggactacccgttcgcgctccgggcggggtgcggcacgccggggcaacggttcgtcgtcgagccgtggcgcgcgccgtacntggcgccggaccggacaacgtgttcctcctcctcggctgccgcgccagctcgcgctgttccagggcttccccgacgcactgccgtgccggaacgtctcggatgggctgcggcgagtactacggctgccccgcgtgggacgantacggcggcgcggccgtcgggcgccgcgtacggcgccgccgcgcngcccgagtgctgcgcgtgtcgtgggacgccatccgggcgtgaacgtgagccgcctcgagtgcgaaggcgaaccgcggttctgcggccgtgccgcgccacgggcggggtgtgcggccacgacggggacagccacggcgacctctgcctctgcggggactggaactccacctccaactgcgactcctccgccgacgcggcacggccaaatgccgcctccgcggcgccgcgtgccatcgtcgcgctttgcttgggtgttcttgcctcag

SEQ ID NO: 388 - DNA, 627 bp, Oryza sativa
atggcgatgcaggtggcggcgccgtcgcggaggaggccgagcttggggcggcagaagatcgagatccggcgcatcgagagcgaggaggcacgtcaggtgtgcttctccaagcgccgtgccggcttcttcaagaaggccagcgagctgtccattctgtgcagcgccgacgtggccgccgtcgtcttctcccccgccggcaaggcctactccttcggccacccctccgtggagtgcctcctggagcgattcctgccggactcgtcgtcgggagcggcggcgcgggtgcggcgaggagcgaataataatggtggtggtgggatggtcggggagctcaacaggcagtacggcgagctgcgcgcgatggtggaggcgcacaaggcgcggcgggagagggcggacgagaagatagagatggagcgcgcggcggggaggtggctgcccatggacgccgatgtgcgccgcatgtcgccggaggagctcatggctttcgggacgggcctcatggctgtgcaggctgccgtctccgcgcgcgccgaccagatgctgcgcgacgcgctcctcattggccgcaggccgcccaccaccaccaccgccggcttcggcttcttccacatgccacactactga

SEQ ID NO: 389 - DNA, 603 bp, Oryza sativa
atgtcgacgccgacggtgcagatggtggcgccggcggcggcggtggtggaggacccgagcaagcactggacgcggcacgggccggtgctgacggcgtgcctcgtcgggatcaacctgctcatggtcctcctcgtgttcttctacttctggcggttcttctccgggaagcgtggcccgccgacgtcgtcaacgtcaacgatggccagcggcggcgacgacgacgaggaggagggggcgtcgtcgtcgtcgtcgtcggccgacacgtcgccagggcgccaccaccaggatcgggaggacatcgcgtcgtccctgcccgtgttcgtgtactcctcctccgccgccgcccccgacgtcggcgacgccggggggaacgggaaggcggcggcggcggcggagtgcgcggtgtgcatcgtggagttccgcgacggcgaccgggcgcgcctcctcccccggtgcggccaccggttccacgccgactgcatcggcgcgtggctccagctccactccacctgcccgctctgccgcgccgccgtgctgctccaccccgccgccgccgagccggccaagaacgatcagcccaaggatgacgactgcccggtgtga

SEQ ID NO: 390 - DNA, 577 bp, Oryza sativa
  misc_feature (6)..(6): n = any nucleotide
  misc_feature (17)..(17): n = any nucleotide
gccganagggtggtccnaaaggcgccgagccggagtcgccatagagctcgacttcacctgcggcctaggcgtcggcgtcggcggcgccaagcagtcctacagctcctacaccgccaccgacctcgctcacagcggctcgtcgtcggaggtgggcgtggtgccggaggccatgtgcggcggcggcggcgccatcgatctcgacttcacgaggccgaagcctcaaccctacatgccgtacacggcgactcctcctccgagccacagcgtagtaagcgcgcagatgtcgtcgtcggtggtcgacgtgggcgtggtgccggagcgggcggcggcgatgggggaagggagggaggcgaggctgatgaggtacagggagaagcggaagaaccggcggttcgagaagacgatccggtacgcgtcgcgcaaggcctacgccgagacgcgcccccggatcaagggccgcttcgccaagcgcgccgaccacgacgccgacgacgccgaagccgacgccgacgaccccgccgccgtcccatcctcctacatgctcgacttcggctacggcgtcgtcccgtccttctga

SEQ ID NO: 391 - DNA, 567 bp, Oryza sativa
atggacaagaagcagtgcggcgccaagggcggaggcggcggcaatgctcgccggagcgcgacgggcggcggcgcggggaggatgcatcggaaggggaagcatcagggcgacggcggaggcggaggagggaagaggagggagatcaaggtggtgtacatcgccaacccgatgcgggtgaccaccagcgaggagggcttccgcgcgctcgtgcaggagctcaccggccggcacgccgacccgtccaagtaccgcggcggcggcggcggcgcgcccgtcgacgagaccagcggcggtggtggcggcggcggcggcgagatgatgcagggcgcggcggcgatgatgcagcccagcccgggcagcaccgtggactcgtcgtcgacggaccacggcggcgccggcgccggcgggcagggcgccggcctgcaggcggcggcgctggacgacgacgagaacagcttcatcgcgccggagctgatcgacaacaggtactccgtctgcttctcgccgccgacgttcctctacggcggcggctcgcacacctacgacggcgacgactacggtttgtag

SEQ ID NO: 392 - DNA, 516 bp, Oryza sativa
atggctgccgcggtcgcctcccatcggttcctctccgtcgccgaggcgggcgccgccttccgctggaccccgtcccagctcgaccccaagatgttgtcattgcaaaacgaaatcttcattacatctggtggagaccgggatttgattaataggattctcagcaaaagcaaaactgaaacggttcctgagaacaaggatgatggtgagtctgatgatgataacgatgaggagggagatgacgaggatgctgaaaatcaaggcgacgatgatgctggtgatgaagatgcctcggaagaggaagggaatgatgaggacgaggacggggaccctgaagccaatggtgaaggagggagtgatgacgacgatggtggagaagatgacgatgacgaggatgaggacggggacgatgatgagggtgagggcgagggcgaggatgacgatgaggatgaggaggaagaagaggaagaggatgacgacgatgacgtcccgcaaccacctgccaaaaagaggaaatga

SEQ ID NO: 393 - DNA, 492 bp, Oryza sativa
atggaggagatgtgcagggctgggcgcgcagaggatgcgttcgagctgctggaggagctgaaggagaggaagcgagggcccaaacagcaagagaagagaagagaagagaagagaacgcgtcccgcttccgactccggcgaaagcgagaccgagagcgcgcggcggcggcggcggccggaggaggagaagacgatgggttgctgctgccggtgcctggagatcctctgcgccatcctcctcccaccgctcggcgtctgcctccgccatggctgctgcaccctgattaattatttattaattcctctgatgatttctttcttttctcttggcgttgttgggagggagcagatggagttctggattagcgtgctgctcaccatcctcgggtacctccccggcgtcctctacgccgtctacgtcatcgtctccgtcgaccccgaccgcgaacgccgccgccgcgtcgaccccgacgaatacatctacgtcgcctga

SEQ ID NO: 394 - DNA, 488 bp, Oryza sativa
gctcgtcgacgccggcgggccgcgttggccgcgagcagaaaaggttgggtggtgaggaagcggcggggaagacggtggcgatggcgatcccgacgcagcggatggcgactgcgagcaaggcggtggcgatgactgcaacgactggcaggccaaatgatgccggcggcgcctgcgtggatggtgggaaagacgacaccggcgctgcgcagctgctgccagcgacagttgcgcggatggcagactcgatgacgacagcggcggacgaggcaagcatggcggtggtggatggcggcctagacctcggcgacgaaggcagccgcggcggcagagccatcctcggcggagagtgggaggccgcagcgatgctcgccgcgctggaggcggccgacggcgagcgagaagctgaggcgatgctcccggcggcagtgctggaggtcgcgcttctggccctgccgaccacccgtgtccgtgtgtatttcttctactag

SEQ ID NO: 395 - DNA, 483 bp, Oryza sativa
atggctcgacccttagcaatggcgatgagtcagggagcctgggtgtgccacttcctcgcggagattgtggagctcatggccttcatcttctctcttcctttccgcctcctcgccgaaatcctctccggcggcggcggcgacggcgacctgcaggacgcccacgattacttcgtcgaggaaggcaggaagcacctcgccgggcctggggcgctccacttgctgggcgagcgccgccgcgacgcgctgagcgccctcgacgcagccctcagcacaggctacggctacggctaccacgacctccttccgctggaggagcgcgccgacgcgctcgtggcgcgcgccgagatcgagctcgtgcgctatctccgctgcaccctcctcaactccggccaccgcggccaggccatcgccgacctcagggaggccgtccgcatctgccccgacaacggccgcgccaacgcgctgctcctgaagtacaattaa

SEQ ID NO: 396 - DNA, 426 bp, Oryza sativa
atggcgtcgccttctctctcctccctcttctccgcggcggctcccctggccggcggcggcggcggcgccggagtacgcacgctcggatcgcccgcgtccgtccggccgatctcacaccggcagcggaggcggcggctggtaatagcgtccgtgaagtggaggtacaaggggacggcgaggaaggaggcggcgctgtcggagctgatcgagcggaaggtggcggaggcaacggaggcgtgcgccggggaagccgccggggatgcggggtgccgggtggcgtgggacgaggtggaggaggtgagccaggcgaaggccgacctccgccgccgcatcgcccagggcgccgacgaccccctcgagcccttctgctcccacaatcccctcgccgacgactgtgccgtcgtctacgacgacgacgacgaatga

SEQ ID NO: 397 - DNA, 342 bp, Oryza sativa
atggagaacatcaagggggggcatggcgcggcggcggcgggcggccggaacgggtggatgacggtgccggcgttcggggactgggacatgaagaacggcgcgctgccggactactccatggatttctccaagatccgcgagatgcggaagcagaacaagaaggagctctcccgcaccagcctcggcggcgacgacgacctcctcgcccagcagaagcagcagcagccgcagccgcagcagaagcccgccaaggccaacctcggccggccggccgacgaccaccgccaccggcaactccatggccgccacggctcgccgacgtacaagattggctttaactga

SEQ ID NO: 398 - DNA, 327 bp, Oryza sativa
atggcggcggccgcgaagacggcggtgcagccggccgtggtggtgggcggggggcgggtggggcaggcgctgctctccatgggcccgccgggagcggacgtgctcgtcggccgcggcgagaaggtgccggaggacgcgcccggcccgatccttgtctgcacccgcaacgacgacctcgacgccgtgctcgacgccaccccgaggtcgcggtggcgcggtcgttcgtcagtaactcagtatgcgtttgattggtgcctgtggtgcatcgcttcgttttcacccgaaaatgcggacggcttggacgaatttaaccaagttgtgccgtga

SEQ ID NO: 399 - DNA, 4155 bp, Oryza sativa
  misc_feature (2810)..(2810): n = any nucleotide
  misc_feature (3461)..(3461): n = any nucleotide
  misc_feature (3518)..(3518): n = any nucleotide
atcttatcagaacgtggtgcttgtggtgttggatttgtcgcaaacttgaaaaatgagccttcattcaatattgtccgggatgcccttgtggctcttggctgcatggagcaccgtggtgggtgtggagcggacaatgactccggtgacggttcaggactgatgagtggtatcccatgggacttgttcaatgactgggccaacaagcaagggcttgctcccctggacagaacaaatacaggtgtcggaatggtctttcttccacaagacgagaatgaaggccttgaggttcttggctggagaactgttccttttaatgtatcagtggtaggtcgctatgcaaaagaaaccatgcctaatatacaacagatatttgtgaaagttgcaaaagaagataatgctgatgacatagagagagagttgtacatctgccggaagctgatagagcgggccacaaaatctgctagttgggcagatgaactttatttctgttctttgtcaagcagaactatagtctacaaggggatgcttcgatctgagattcttgggcaattctatttggaccttcagaatgaactctacaaatcaccttttgccatataccatcgaagatacagtaccaatacaagccctagatggcctcttgctcaacctatgaggttacttggacacaatggagagattaatacaatacagcaggggaacttgaactggatgcgatcaagggaagccacactacaatctcctgtatggcgtgggcgtgagcatgaaatacgtccatttggtgatcctaaagcatctgattcagcaaaccttgacagtactgctgaattactgctaagaagtggcagaagtcctgctgaagctatgatgattctcgttcctgaggcatacaagaaccatcctacattgtcaataaaatatcctgaggacttctatgactactataaaggtcaaatggaggcttgggatggacctgctttgctcttatttagagtgatggaaggacagtaggagcatgtcttgatcgaaatggtctccgcccagcacgctattggagaacatctgatgattttgtttatgttgcatctgaggttggtgttataccaatggatgagtcaaaggtagtaatgaaaggaagattgggtcctggaatgatgataacggttgacctacaaactggccaggaaaacacagaagtgaagaaaagtgtggcttcagcgaacccctatggatcctggttgcagcaaagtacacgttcaataaagcctgtcaacttccagtcatctgttgctatggacaatgaaacggtcttgagacaccagcagcctttggatattcgagtgaagatgttcaaatggtaattgaaacaatggcttcacaaggcaaggaaccaacattttgtatgggtgacgacattccattagctgtgttgtcacaaaagccacacatgttatttgattatttcaaacagcgatttgcacaagttacaaatcctgctattgatcccctcagagaaggtttggttatgtctcttgaagtcaatattggtaaacggcgcaatatcttggaagttggccctgaaaatgctgatcagcaggttaccctatcaagtcctgtgcttaatgaaggtgaactagaatcacttttgaatgactcaaaactgaagcctaaagtactctcgacatacttcgacatccgtaaaggtctagatggttcccttgataaggctattaaggttctttgtgatgaagctgatgctgctgtgcggaatggttctcaacttcttgtgctttctgatcgttctgaagcactcgaaccaactcgccctgccatcccgatacttctagctgttggtgccatccaccagcatttgattcaaaatggtcttcggatgtctgcttccattgttgctgatactgctcagtgttttagcacccatcagtttgcttgcttgatcggatatggtgccagagtgctatatgtccgtatctggcactagaaacatgccggcaatggaggctgagcaacaaaactgttaatttgatgcgaaacgggaagatgcccacggtgaccattgagcaggcccaaagaaactttatcaaggcagtaaaatctggcctactcaagattctttcaaaaatgggaatatcattgctctcaagagttattgtggagcccagatcttcgaaatttatggccttggtcaagaggttgttgatctcgccttctgtggaagtgtatcgaaaattggaggtctcacccttgatgagctgggtagagaaacattatcattctgggtgaaggcgttctcagaagatactgcgaagaggctagagaactttggattcattcaatccagacctggagggtgaatatcatgcaaataatcctgagatgtcaaagctgctgcacaaagcagttcgtgaaaaaagtgacaatgcatacaccgtctaccaacaacatcttgcaagccgtcctgtcaatgacccaatccgctggagtccccttgcagatgtagaggatgggtattctccaacacttcctcatctcaagggtctacagaatggagacactgccacaagtgccattaagcaggtgcagatcaatccaaaagcgaaggtatctgtaaagcttgtagctgaagcaggaattggaactgtagcttctggagtatccaaaggaaacgcagacataattcagcagatatcaggtcatgatggtggcactggagctagcccaattagttcaatcaagcatgctgggggtccttgggaacttggtctttcagaaacgcaccagacacttatacnaaatggattgagagagagggtagtacttagggtggatggtggattcagaagtggcctagatgtccttatggctgctgccatgggcgcggatgaatatggttttggttctgtggctatgatagctactggatgtgtcatggcacgcatttgccacacaaacaattgcccagttggagttgctagtcagcagagagaagaacttcgtgctaggtttcctggtgttcctggtgatcttgtaaactacttcctctttgttgcagaagaggtacgagcgacattggcccaattgggttttgaaaagctcgatgatataattgggcgaacagatatacttaaagcaaagcatgtctctttggcgaaaacacagcacattgacctcaaatacctcttatcggtacagagagtgctggattacccaaatggagtagctctcagataaggagtcaagatgtccacagtaatggccctgttcttgacgagacaatccttgccgatcctgatatatccgatgcgattgagaatgagaaggaggtttccaagacatttcaaatttacaatgttgacagggctgtctgtggtcgagtagcaggtgtcattgccaagaagtatggtgacacaggatttgcaggccagctcaacattacggaagcncagggcagtcctttggatgtttcctaactcctggaatgaatattcggctagttgganaggccaacgattatgtgggaaagggtatggctggtggaaagctggttgtagttcctgtagaaaaaacaggatttgttcctgaggatgctgctatagttggtaacacttgtctgtatggagctactggtggtcaggtatttgtgagaggcaaaacaggtgaaagatttgcagttagaaactcccttggtcaagcagtggttgagggcactggagatcattgctgcgagtacatgactggtggctgtgtagttgtacttggcaagttgggaggaatgttgcagctggaatgacgggtggccttgcctatattctagatgaggatgatacactcgtcccaaaggtttcataaccttgaaacttctggttttactagcttgataacatgcacaacaaggagattgtgaagatgcagagagtgaatgctccagccgggcagatgcagctgaagggcttgattgaggcttacgttgaaaaaacaggcagcgagaaaggtgccacgattttgagagaatgggaggcatatctgccactcttctggcaactggtaccaccaagtgaagaagactctcctgaagcttgtgccgagtttgaacgagtacttgccaagcaagcaacaacagtacaatcggcgaagtga

SEQ ID NO: 400 - DNA, 1598 bp, Oryza sativa
ggtgcgaagcctttggtaatacagttgcccattggttcagaggacaatttccaaggagttatcgatctagtcaagatgaaggctattgtatggacaggagaggaacttggtgcaaaattttcttatcaggatatacctgctgatctccaagagatggctgatgactacaaagctcagatgatggaaactattgtagagttggatgatgatgttatggagacttatctagaaggtggcgaaatagacgaggaaactgtcaagagattgatccgaaagggaacaatatctgccagctttgttcctgttctatgtggttcggcctttaaaaacaagggtgtccaaccactgcttgatgctgttgttgattacttgccatcaccacttgacctaccaccaatgaagggcactgatccagaggaccctgaactgatccttgaaagaaagcctagtgatgatgagccattttctgggttagctttcaagatcatgactgacccatttgtgggatcattgacatttgttcgcatatactctgggaagctggttgctggttcatatgttctcaatgcaaacaaagataagaaggaaagaatcggaaggcttctagagatgcatgcgaacagtaaggaagatataacagttgctgtggcaggtgacatagtagctcttgctggtctcaaagatacaattactggtgaaactcttagtgacccagataagcctgttgtgcttgaacgcatggaatttcctgatcctgtcattaaagttgctattgaaccaaagaccaaagctgatgctgacaaaatggcaaccggactaatcaagcttgctcaagaagacccatcattccacttctctagagatgaggagaccaaccagactgttattgaaggaatgggagaattgcaccttgacatcattgttgacagattaaagagagaattcaggaggttgaagcaaatgttggagctccgcaagtcaactaccgtgaaagtatttccaagatttcagaagtacaatacgttcacaagaaacagtctggtggatctgggcaatttgcggacattattgtgcgattcgagcctttggaggctggaagtgggtatgaattcaagagtgaaataaagggaggggcagttccaaaagaatatgtaccaggcgtgatgaagggaattgaggaaagcttgcccaatggtgtccttgctggttaccctgttgtggacctccgagcggtgctggttgatggctcataccatgatgttgattcaagtgtcctggcattccaaattgcagccagaggtgcattccgtgaaggattgaggaaggctggtccaagactcctggaactataatgaaagttgaggtgataaccctgaggagcatttgggtgagttaatggtgatttgaactccagaagaggacaggttgtcgatgctttcgtgccacttgcggagatgttccagtacgtcagcacgctgagaggaatgaccaaggggcgcgcgtcttacacgatgcagctcgccaagttcgacgtcgtcccacagcacatccagaacgagctctctgcggcgaaacaggaggaagctagtactgcttaa

SEQ ID NO: 401 - DNA, 1100 bp, Oryza sativa
  misc_feature (52)..(52): n = any nucleotide
atggattggacacgcgtctctctcgcctccttcccaatcccaccaccaccantgcctcttcctcttctccgggagtcccaaactgcagcagcgcgcggcacaggagagcgaggaggaggaggagatggcggaggcgaagcagcagcagcagcagccgcaggcggcgacggcggcggcggcgagcggggtgtggaagacggtgaagcccttcgccaacggcggcgcctccgggatgctcgccacctgcgtcatccagcccatcgacatggtcaaggtgcaggtgaggatccagttgggtgagggctcggcggcttctgtcaccaagaaaatgcttgcaaatgagggaattagtgccttctacaagggcttgtctgctggtttgctcaggcaagcaacatacacaaccgctcgtctcggatcctttagctgtattccctcagggttctaacaaacaaagcggttgaagcaaatgatgggaagccactgcctctagtccagaaagctggtattggtctcaccgcaggagcaattggagcctgtgttggtagtcctgcggatttggcactcattaggatgcaggctgattcaacgttgccagcagcccaaagtcgcaattataagaatgcttttcatgcactttatcgtattgctgctgatgaaggtgttctagcactttggaagggcgcaggtccaactgtagtgagagctatgtcgctaaatatgggcatgcttgcctcctatgatcagagtgtggagttatttagagacacacttggtgctggagaaggggccagtgctgtttcagggttatgtgcgtctgcttgcagtttaccctttgattatgtgaagacacagattcaaaagatgcagcctgatgcctccgggaagtatccatacactgggtctcttgattgtgccatgaagaccttgaagagtggaggcccatttaagttctacactggctttcctgtgtactgtgtcaggattgcaccacatgccatgtgacttggatattcctaaatgagatccagaagctcgagaagcgtttaggcctctaagagctggttggttcggtcatgctgtccttacctaagacataa

SEQ ID NO: 402 - DNA, 714 bp, Oryza sativa
atggtcgcgtgtaccgtctgcagggaggagggttcggtgcgcggcgactgcgccggcgccgatgggggagaagacggagtaccgggacgggccggtggagcgcgccttcatggggctgttcgcgcgcaagatggagaaaagaagaaggagaagagctcgaggtcggtgtgggagtgggactacgagagcttcgtggacgtgtcgcggcgggtgatggtggggcggacgcgggcgcagcagcaggaggccgtccgcgaggtgctcctctccatgctcccccccggcgcccccgagcagttcaagaagctcttcccgccgacgaggtgggcctgcgagttcaacgctgccctcaccgtccccttcttccactggctcgtcggcccatcagagcaggttgtggaggttgaggtcaatggggtgaagcagaagagtggagtgctgataaagaaatgcagaggtacctggagaacagcggctgcgtcggaatgtgcgtcaacatgtgcaaaattccgacgcaaaacttcttcaccaacgagttcggactccctctcaccatgaatccaagaagatatgagctgtgaaatgatttacggccaagtgcccccacccttggaagaagacccagcatcaaaacagccctgctatgccaatctatgtgagtttcacccaaattgccaacatctcagattgaagaatctgaccaaatctagctag

SEQ ID NO: 403 - DNA, 1002 bp, Oryza sativa
  misc_feature (17)..(17): n = any nucleotide
  misc_feature (82)..(82): n = any nucleotide
  misc_feature (85)..(85): n = any nucleotide
  misc_feature (178)..(178): n = any nucleotide
  misc_feature (200)..(200): n = any nucleotide
  misc_feature (217)..(217): n = any nucleotide
  misc_feature (242)..(242): n = any nucleotide
  misc_feature (244)..(244): n = any nucleotide
  misc_feature (270)..(270): n = any nucleotide
atggaaggggacgacangtcgccggtggtgggaggggcgtactgggggctggcggcgagggcgtgcgacgcgtgcggcgggnagnctcccgcggctgttctgccgcgccgacgcggcgttcctctgcgccgggtgcgacgcgcgggcgcacgggcccgggtcgcgccacgcgcgggtntggctctgcgaggtctgcgagnacgcgcccgcggcggtnacgtgcagggccgacgccgccgcgntntggccgcctgcgaagccgacattcantccgccaacccgcttgcgcgccgccacgagcggctccccgtcgcgcccttcttcggcgcgcttgccgacgcgcccaagccgggttccggtgcccacggcggcgacgcggcggcggccgacgatgacgggagcaacgacgccgaggccgcgtcgtggctcctccccgagcccgaccacgggcagaaagatggcgccgtcggtgcaaccgacgagctctacgccgactccgacccttacctcgaaatcgacttcgcgcgctccatggacgacatcaaggccatcggcgtccagaacggtccgcccgagctcgacatcaccggcggcaagctcttctactccgaccactccatgaaccacagcgtatcatcctcggaggcggcggtggtgccggacgcggcggcgggcggcggcgctccgatgccggtggtgagcagggggcgggagcgggaggcgcggctgatgcggtacagggagaagcgcaagagccggcggttcgagaagaccatccggtacgcgtcccgcaaggcgtacgcggagacgcggccgcgcatcaagggccgcttcgccaagcgcaccaagggcggcgcgggcgcggacgccgacgcggacgccgacgccgacggcgaggacgaggagatgtactcctccgccgcggccgccgtcgccgcgctcatggcgcccggcggctccgacgccgactacggcgtcgacggcgtcgtgccgaccttctga

SEQ ID NO: 404 - DNA, 693 bp, Oryza sativa
atggaagcagcagtggctactccttccttgctcttctctagcccaacccccaggaggccttcctcctgcttgcctcctcctcctccttgcagcagcagcagcagcagctacgcctcccatggtttcaagctgctgcagccgcagttgctgttcatcaatcggctaaccagcagaaacagcaacgggagtagcagaagaagcatttccattttgtcgctgaggtgctcttccagtggcactgacagcgcgtcttcttccgccacttcagaaagatgggttctcgagcctgcaggagacggcgattggcgtcatatcgggtaccgcgtcgcacgacccggcggcttccagatagcatccgaggcggcggtgacggtgggtcgggttcctgaacaggctgacatcgtcctgtctgtcgcaacagtttctgggacgcacgcacggctggagaagaaagaggggagcttgttggtaacagacctggagagcacgaatggcacctacatcaacgagaggcgcctcaccccgggtttccccactcctatcgatcccggcagcctcctcatctttggtgacatccacctggccatgttccgtgtctccaagatgatcgtcgatgtgtccagtgacaccaatgaagctgagcaggaagctgagacggctcaagtatcagcggcaactcaacaaaccaattag

SEQ ID NO: 405 - DNA, 1210 bp, Oryza sativa
  misc_feature (173)..(173): n = any nucleotide
  misc_feature (183)..(183): n = any nucleotide
  misc_feature (210)..(210): n = any nucleotide
  misc_feature (342)..(342): n = any nucleotide
atggcgtcctcctcgtcggcggcggcgctctggacggcggcgccccaaccccacggcagctgcatcaggatccacgccatcttccaccagcgtcaccagcggagggggaagaggccggtcgtcgtcgcctcgtcggtgaggccgctgcaggccgcgagcctggcggtggccanggcgcccgtngccctggcgtcgaggaggacggcggcngaggaggccgtctacgaggtcgtgctgcggcaggcggcgctggtggaggaggccacccaacgccgcggcgcgggggcgccgcggtgggcggaggaggacgccgtcgactggggcctcctcctcggcgacgcntaccaccgctgcggcgaggtctgcgccgagtacgccaagaccttctacctagaggtactcagcttatgactcctgaaaggcgcaaagctgtctgggcaatctatggtatggattaggtatggtgcagaagaactgatgaactggtagatggccctaactcgtcttacattacaccaaaggcacttgatcgatgggagaagagattagaagatctcttcgaaggcaggccatatgatatgtatgatgcagccctctcggacacagtgtcaaagtttccagtagatatccagcagccattcaaagacatgattgaaggaatgaggcttgacctgtggaaatcaaggtataggagctttgatgagctctacctctactgctactacgttgctggcacggttggtctcatgacagtaccggtgatggggattgcccccgactcgaaggcctcaaccgagagcgtgtacaacgctgcgctagctcttgggatcgccaaccagctgacgaatattctcagagacgtaggcgaagaaggaggggaagaatctaccttccattggatgaattggcagaggcaggtctgacagaagaagacatattcagagggaaagtgactgataaatggaggaagttcatgaagggacaaattctgcgtgccaggttattctttgatgaggcggagaagggcgttgcgcatctagactctgcgagtagatggccggttctggcatctttgtggttataccggcagatccttgatgctatcgaagcaaacgactacaacaacttcaccaagcgcgcgtatgtaaacaaggcaaagaagctgctgtctttaccggtcgcttatgcaagagcggcagttgcatcatga

SEQ ID NO: 406 - DNA, 1004 bp, Oryza sativa
gctcttgctggatttatgaggcaaatcatgcaaggatcagtgtcctttgaaccatctcaggtggttataacatctggtgcaactcctgcaatggaaatactgagtttctgccttgctgatccaggaaatgcatttcttgttccatcaccatactaccctggaaatggcgcactgtgaattgagtgatacctgttccttgccgtagcactgacaacttcaacattagtatcactgctctagaaatagcctacaatcaggcaaagaagcgaggaataaaggttcgtggggttctcatatccaacccaaataaccctacaggaagctttgtgcccaagcaaacactgcatgatcttctagagtttgctgcagagaagaacatccacttgatatctgatgaagtgtttgctggctcaacatatggatctggaaaatttgtaagtgtggcagaggttgttgatgatctagaagactttgacaaaggcagggtgcacataatatatggactctcgaaagacctatctcttgccgggtttcgggttggggtaatatattcctataatgaaagcatcgtgacagcagctgctaagattgctaggttctcgtctgtgtcaactccaacacaacgcttgcttgttgccatgctctcggaccaaaagttcatttcagattacctaaaagttaatagagagagattgcgcaagatgtaccatttgtttgttgatgctttggatcaagtggggattgagtgctacaagagcagtggagggttctactgctgggcagacatgagcaagttcatcaggtcttacagcgagaaaggggagcgcaagctttgggataggttattggaggaggcaaaggtcaatgtcactccaggttcatcttgccattgcatcgagcctggatggttcaggtgttgcttcacgacattgagcgaacatgatatccctgtcttagtgcaaaggctcaggacgattacagatagccataaaccgaatcattga

SEQ ID NO: 407 - DNA, 882 bp, Oryza sativa
ttcaacccgttcgggttcgtgacggacaacccgtcgagccgcggcgccatccagctgccggagtcgccgcccaggacggcaatgtcggccagatgctctacaggatcgaggacaaggggagggagttcggctcaagagtgaaatcaggaaagctgcggtggtttgtgagggaaacagtatggtgatacaattgtaggttccgctggtgcacgacgtgggactgtcgtgtttattcacggtgctccatctcagtcatttagctatcgtatggttatgtctcaggatgctggctaccactgctttgctcctgattggataggatttgggttcagtgatatgccacagcccggatatggattcgactacacagccattcttcttagttgtccagtcatatgggctaacatgggcactaaagaactcaagcaaagttctgaaggtagcaattcttaacagtccactcactgtttcttctccagtgcctggattgtttaaccagctaagcaatgcaggttgccactttttggtgaatttacctgccaaaatgctgttttggctgagagattcattgaagcaggtagcccgtacaagtcggagaaggctgatgtatacagattaccatatctatcaagtggtgcacctggatttggcattgcttgaagctgccaggaaagctaacttccgagatgtattaagtagaatttcagccgggtttgcatccaacagtcctgcagctgggaaaaaccaatattgcttgcatgggggatttctgataagtacttgccactccccatagctgaggagttccagaaaggtaatcctgcagccataaaattggagccaatagaaggagctggtcatatgcctcaagaggactggtaa

SEQ ID NO: 408 - DNA, 869 bp, Oryza sativa
ggcaaggccgcccttccgctcaagcgcgaccgcacgaggtcgaagcgattcctggagatacagaagctgagggagagcaagaaggagcacgacgtgcccacggccatctcgctggtgaagcagatggccagcgcccgattcgtcgagtccgctgaggcgcacttccgcatgaacctcgaccccaagtacaacgaccagcagctccgcgccacgggttaatttgcccaaggggacgggccagtcggtgaagattgcggtcctcacacaagggtgagaagatagatcaagcaagagctgcaggagctgatattgtcggtggagatgacctgattgaccaaataaaaggaggatttatggaatttgacaagctgattgcatcacctgatatgatgcctaaggtcgccggattgggaaagattctaggaccgagaggacttatgcctaaccccaaagctgggactgtttctccaaacataactcagcaggctatcgaagagttcaagaaaggtaaagttgaatacagagttgacaagacagggattgttcacattccctttgggaaggttgattttcctgaagaagaccttattgcaaacttcatggctgttgtttctgtcgaaaggaacaaaccatctggtgcaaaggggatatactggaaaacggcatacttatgctcatcaatggggccttcaatcaagttaaacatcaaagaaatgcttgactatggctcagaatcatcagactaaatgccacgaaaagcaccagttaagaaatctggtgtttgctaccaccttcacaaaattaaccatccacccttagcgataaatgaaccgggaaacatggtgggggaaggcaagggaggtgcttag

SEQ ID NO: 409 - DNA, 623 bp, Oryza sativa
gcagatgttccacccactgtcgcagaaacaaagatgaattttctcaagtcatacaagcgtcctatcctaagcatttacagtacagttctacaagaacttttggtacagcaacatctgatgagatacaaaacaacatatcaatatgatgcggtgtttgctcttggttttgtgaccgtctatgaccaactcatggaagggtaccctagcaatgaggatagggatgcaatcttcaaagcatatataacagcgttaaacgaagaccctgagcaatacaggtgcctactagagctgacgcacaaaagatggaagagtgggctcgttcccagaatggtaattctttagttgagttttcatccaaagatggagaaatagaggccattctgaaagatatttcagaaagggcccagggtaagggaagcttcagctacagccggttctttgcagttggcttgttccgtttgcttgagcttgcaaatgcaacagagccaaccatactagacaagctttgcgctgctctaaacatcaacaaaagaagtgtcgacagggatctcgatgtttaccggaacatactctccaaattggtccaggctaaggaacttctcaaggaatacgtggaaaggtaa

SEQ ID NO: 410 - DNA, 599 bp, Oryza sativa
gagaaatcaccgtacgagacgctcggagctggacagggatgcagatgaggagacaataaagacggcatacaggcgattggccaagttctatcaccctgatggtttatgatggtaagggaacccttgaggaaggggaaactgccgaagcccgcttcatcaaaatccaagcagcatatgagctactgattgatgaccaaaggagaaagtcatatgacagagagcatcatgtgaatccaatgaaggcttctcaggcatggatggagtgggtgatgaaaaagcgaaaagcttttgatcaacgtggtgacatggcagtagctgcttgggctgagcaacagcatcgggaaatgacattacgtgctcgccgtctctcacgatcaaaggatcctgaggaggagaggaaactgtttgccaaggaaaagaaggcatccatggaattctacagcaccactctaaagaggcatacccttgtcctgcggaagagggatattatgcgcaagaaggcagaggaagacaagaagaaagagatcagtagacttctagctcttgaggggcttgagctagatacagatgaagacgacaacataaatttcctaaagtaa

SEQ ID NO: 411 - DNA, 589 bp, Oryza sativa
gaggaagaaaggaagcttgtcttctcagagaaggatgcaagttggttcactcattcttctctagtcaagattggtgctatctatgatggaattgtcggttcagttttccactacggtgcatttgttcatctgcgatttcctgatggtacccattggcaacaccccttgtcatttttgttgggaaattatcatcttactggccttgtacatatctctgaggtctcttgggatcttgtccaagatgtccgggattttttaaatgaaggtgatactgtcaaggtcatagtggtgaacattgatatgagaagtcaaggatagctttatcaatcagacaattggaggaagatcctctactggagacattggacaaagttattcctttgcttccaggacttgatggtatatgtaatgaactattgcaagaggatgggagaaacgtgttgtttcacaagatctggaactctggctttccttcaagcttcttgctcgagctgggcgacagcaggtccaagaactatatttgacaaccagcctagaccaggagggcataaagaaggcggtacagagagtactaggacgtgttccttga

SEQ ID NO: 412 - DNA, 578 bp, Oryza sativa
atggcggtcgtcggcgtcctcgcgctgcagggctccttcaacgagcacttggccggcagcgctgaggaggatcggggtgaggggggtggaggtgcggaagccggagcagctgcaggggctcgactcgctcatcatccccggcggcgagagcaccaccatggccaaactcgccaactaccacaacctgtttcctgcacttcgagaatttgttggtacaggaaggcctgtctggggaacttgtgctggactcatcttcctagctaacaaggcagtagggaggtcaggagcttattggaggactagattgtactgtccaccggaacttttttgggagccagcagcttcaaagctttgaaacggaactttcagtgccaatgcttgcagagaaggaaggagggagcgatacatgccgtggcgtatttatacgagcacctgctatcttggatgtaattgttgctgtaaggcaagggaacatcctcgctactgcttttcacccagaattgacatcagactctagatggttagtgccttttcctacataccatatcatgttttcatgcatcttgtttaggctctga

SEQ ID NO: 413 - DNA, 503 bp, Oryza sativa
cgctcatcacgcaatatagcaatcagcctattcaagcgatataaaaatgtcattgaccgaggaggtggagataacctgaaggagtttgttagtgctggggtgaatgcatatgctctaggctgtactgaagaggggctcaggaaggaacttatggatattgaagattctggccttgagattgaagtccgtgaatgcatcctgtggctcagtatagtattcattacaatcctgtgcacaccacaaccaacgatcatcagatggtctactaccccaccagtgtcagctgacgttttgcatcagtggaaaggattttgtgccttaatagcgaacgcttactataccaaaggaatggcatgttaccagtgaaaactttgcagctggaacaaatggctgtcacgggcagttcagaggagccatcagtagtagctagtcgcatgcaattagttttcagtacattagagtcaactctgcaggtagttagtcctcaatggccaagagtgtga

SEQ ID NO: 414 - DNA, 303 bp, Oryza sativa
tatgaaaatggtgatcgactgagccctgaacatgaaaaggcaattttggaacgattgcttccttatcacccacaatatgagaagaaaattggatgcggtattgactaccttacggtagggttacatccagaatttgagaactcaagatgtcttttcatagttaggaaggatggtgagcaagttgatttttcattctggaagtgcatcaaaggtctcatacgacaaaagtaccccatgtatgcagatagtttcattctcagacattttcgcaggaggcaagattaccgaattagtgactcgtaa

SEQ ID NO: 415 - DNA, 1179 bp, Oryza sativa
atgaggacccacaggatagtgactgaggcgaaaatgatgaagaaaggcggtgaatgtggttcctctgaaccaaggttcagtcaaacctggagtgtgactaatcaccgccagcttccactagagttagaatataggaagatagtgagggaaagctccgaaaaaagtgcccaaaatatcggagttccctccgagtttcggaggagtgcatgtcgacattctctccatggggtgtactggaggattgctagagatgtcggcactctctcctatcttgtacctcgacaaatacttcttttatataactcgttatttagcatggctaggtcactcgctgctctcctactccttctggtcgccgccgcgggagacagccatgccgcgtcgccagcggagatgtactggaagatcgcgctcccgacctcgccgatgcccggcgccatccgcgacctcatcaacccggcgagctcagcggggtcagcttcgaaggaggacacggtgggcaacgtgttcttcctcgagaaggacctcttcccgggctccaagctgacgctccacttcacccgcgccaccgccggcgccgcgctgctcccccgcggccgcgccgactccgtcccgttggccaccgaaaagctcccggagatcctctcccagctctccgtccccgccggctccccgggccgccgacgccatgagtgcgaagccgcgccgtttgccggcgaggcgaagcaatgcgcgacgtcgctcgagtccatggtggagttcgccgcgtccagcctcggcacccgcgacgtgaacgccgtgtccacggaggtcgacagggcagggccggcgccgaggcaggcgtacagggtggaggccgtgaggcccgtgccggtgtccggcggcgacatggtggcgtgccacggcatggcctacgcgtacgccgtgttcgggtgccacacgaccacggcggcggcgtacacggtggcgctctccggcgccgacgggactagggcggaggcgctcgcggcgtgccacgccgacgcggcgccgggggtggcggaggcgtacaagaggctcggcgtggcgcccgggagcgtgccggtgtgccacttcttgccacaggacgacatgctctgggaaaacgaatacgaaagctcggatatgaaaacaaatatgaattatctcgaatatgaataa

SEQ ID NO: 416 - DNA, 441 bp, Oryza sativa
  misc_feature (175)..(175): n = any nucleotide
atggccatgtccctctccctcgcgcgcgtcgcgctcccgcctctgctgcagcagcaggggggcgcccccaggaagctccaccccggcgccctcgcgttccccgccaagtcgttcttcggcgcgccgctggcggccgtcgcggtctcccccgcgtcggcggcggcggcgtcgccgntccgtcgcaggccgtcgtccgcttccgccgtcgtcgcggcggggaaggggtacaagatgaagacccacaaggcgtcggcgaagcggttccgggtgacggggagggggaagatcgtgcggcggcgcgccgggaagcagcaccttctcagcaagaagaacaccaagcgcaggaagaggctatccaagatgatccaagttaacaagagcgactacaacaacgtgacgggcgcactgccctacctcaaagtgaacaggaatgcagaatga

SEQ ID NO: 417 - DNA, 2931 bp, Oryza sativa
  misc_feature (1271)..(1271): n = any nucleotide
atggcgcgcggcagagggctacacggaggagctcgccgtggcgcacgtgcggcggctgctcgacatcgtcgcctgcaccgccgcgttcgggccgaggaagccgccgccgaagctgggacagttctacgagttcttctccttctcccacctttccccggccctccattgtttgtagtgggaagccggtgaccatcgtggcctccaaagctggattctatccagcagggaagcgagcgctcatcagccactcccttgttgggctgttgcagcagacgagccgggcgtttgatggagcttacaaggctcttatgaaggcttttgttgagcataataagtttggaaatcttccttatggattccggtcaaacacttgggtggtccctcctgctgttgctgatttgccatcggtgtttccaccccttccaactgaagatgaaacatggggtagcaatggtggtggtcagggaagagatggaaaacatgaccataggccatgggcaaaagaatttgccatactggctgcaatgccttgcaaaacagctgaggagaggcaaatccgagacaggaaggctttcctactccatagtttatttgtagatgttgcagttcttaaagctgttgcagctattcagcaaatggtccctgacaagagttcacttgaaacaccgaatgacaccacaaatccagatttgcacacgcaacaaattggagatatgaaaataacagtcacaaaggacaaagcggatgcaagttctaagttagatgtcaagttagatggaagtcaagctccaggaatgctgtctgatgaacttgctaagagaaatctgttgaagggcatcactgctgacgagagtgcaacagtacatagcttaaggatgctgcttcataaaccatgtattcaaccatctggaggagttcagcggttgcaaagttctcctcaagagagtgaatatagtacaaattttgtccgtaagataatgacagatagtctgcagaagcttgaatgtgaagctccaagagaaacaagaccaataagatgggagcttggagcttgctgggtgcagcacctacagaatcagacttctgagaaggccgacactaagaaaaatgaggagaccaaggatgttcctacagtgaaaggtctggggaaacagtttggaagctgctttccagagactaaaggaatctgaaactggactgcatgctaagtcacctgatgaattaattgagatggcgcacaaatattatgatgatacagctctgccaaaatngcaggtagcagattttggttcacttgagctttcccctgttgatggaaggacattgacagattttatgcacaccaggggactccagatgcgctcactaggacaagtggttgagcttgctgataagctcccacatatacaatccttgtgtatacatgaaatggtagttcgagcatttaagcacgtacttcgggctgttatttcagctgttcatgatataaatgacatggctgaggtggttgcatcatgtttgaatatcttattgggaccatttccagaagaaaataacgatggcaagtgctatgaggataacaatctcaggcaaaggtggctggaggtctttctagtaaagagatttggctggacgtggaaagacgaatatcgtgctgatctaagaaaatatgccatccttcgtggtatctgccataaggtaggacttgagctagttaccaaagattatgacatggatatgccacatccattcagaaggtcagatataatcagcattgttcctatctacaagcatgttgcatgctcatcagcagacggtcgaaccctgttggagtcatccaagactttcctggacaagggaaagcttgaggatgctgttaactatggcacaaaggctcttgcaaaacttgttgctgtttgtggtccttatcacagaatgacagcaggagcatacagccttttggcagtagtgctttatcatactggtgacttcaaccagtatgtgaatcgtgccctatatcttttgcacctgacatgtggaccctctcatcctaatactgctgcaacttatattaatgtggcaatgatggaagaagggctgggtaatgttcatgttgcacttcgttaccttcatgaggctctaaaatgcaacaagaggttgcttggtgctgatcacatacagcagactgctgctagttaccatgctattgctattgctctgtctttaatggaagcatactctttaagtgtccaacatgaaaaaaccactttacgaatacttcaagcaaagcttgggtcggaagatcttcgtacacagcaggatgctgctgcttggcttgaatattttgagtccaaggcactagagcagcaggaagcagcacgtaatggtactccaaagcctgatgcttcaatagcaagcagaggccacctgagagtgtatcagatcttctggattatatcaatccagatgatgaactcaaggctaaggaaatgcaaaagaaacaagcccgcgctaagtcggatgaagggtggcaagaagctgttccaaagggacgatccactgggaaccgcaaaactggttcatacaaggaagttgcaatagctgcaccagggactcttgtcaaaaagctttctgctgctgctgctccattcaatccctccactgttccagcttttgggtcaatggccattccaggtttcagagaacatggaggattgctgccatcaccagccaatgtacccccgatgttgtcgatccctcaccaatctgcaaccgcaagagtcccttatggtccacggttggctggaggctacaacagatcagagggtgatgaaccctaacgcagccgagtttgtgccaggtcaatctcggagtcctaatggcaacccagcatctccaaacggacctctagcatcaccaggtggcactgaa

SEQ ID NO: 418 - DNA, 2699 bp, Oryza sativa
atgcaacccccgacgggcgccgtgtcagcagggtcgtcgtcgtcgtcgctggagtgcgtgagctcgtgcaggacgtcgtggaggggcggagggaggccgtacgaatgcagcgtgctctcgtgcgcctggaacgcgccgcgggcgctcacgggggcgctcgccagcaccaccgcgcagtgctcctcctgcagccacgccgaggctgggccaggttgaaggcggcggggccagtcgcagcggagtaacaattcggttactgcacataacctgggcagaaggcatcaacagggggaagtttggttatggttcatcagcccattcttttcccactggaaattttttcaaatcttggtcaacttccgtggatccaacatggagagttttctgctattcatcatctgaatcgttcaatcatatttctccagaaactttgtgggagaggatctcaagccagctatctcgtaccttcaacctgaagaattgaactttgtacacgatgctctgaagagttggcatatgaggcacataatgggcagaaacgccgaagtggggaacctttcattattcatcctgttgaagttgctcgtatccttggggagcatgaacttgactgggaatcaatagctgctggtttattgcatgacactgttgaagatacagacatggttacttttgaaagaatagaaaatgagtttggtgtaaccgtacgccgtattgttgaaggggagacaaagaggtatctaagctaggaaaacttcagtgcaaaaatgagggtaattcaaaacaggacgtcaaggctgaagatttaagacagatgtttcttgccatgacagaagagaggttcgtgtaatcattgtgaaactggcagacaggctgcataatatgcgtacactcacacatatgcctcagcacaagcaggcagtatgccattgccatggagacactgcaggtttttgcacccctagctaaacttctcgggatgtatcgaataaagagtctgagctagaatatctgtccttcatgtacatgaatcctggtgatttcgctgaactaaagaaaagagttgaggacctctacaaggcccatgaacaagaattggaagagaggcaaatcaaatcttaggggaaaagattgctgaggatcaatttcttgatcttgttagtgttgaaacacaagtgcgttcagtctgcaaagaactctacagcagcatttataaaactgcgctgaagtccaagagttcaataaatgagataaatcaggttgcacagcagctgcggatcatcataaagccaaaatcctgcaatggtgtggggccattgtgcactgcacaacagcagatctgctaccatgtccttggtcttgttcatggtatctggacacctatacctcaagctgtgaaagattacattgcaaccccaaagcctaatggataccaaagtctacacacgacagtgataccatttctgaatgagagtatgttccatttggaagttcagcagataagaacagaggatatggatctcatagcagaaagaggcattgctgcgcactacagtggaagaggggttgtttcagggcctgttcgtcctggaatatcaagtggaaggaattcaaatgggaaagtgatatgtctgaacaatacaggctttgctctgagggattggttggctcaatgcaatccgtgaatggcaagaagagtttgttggtaacatgagttctagggaatttgttgatactatcacccgagatcttctgggaagccgtgtctttgtgtttacaccaaaaggcgagagattaaaaacttgcctaagggggccactgtggttgattatgcttacctgattcacacagaaattgggaacaaaatggtagctgcaaagaggtgaatggcaatctagtttcaccaatccatgtacttgcaaatgctgaagttgtggagattataatttatgataaattatctgctaaatatgcattccagcgtcaccagcagtggcttcaacatgcgaaaactcgcagtgcaagacacaaaattatgaaattcttgcgggagcaagctgctctttctgctgctgaaataactgccgacgccgttaataactttgttgccgatcttgaagatgaaagtgactatgagcagtcgattccaagctctgaaaataaggactatacattcaactggcagaagatattgaattctgacaaactatcctttggaaacaagaagagcgactgctttttacctgttaaaaatgtctctgtgccaaaggttaatgggaagcacaacaaaactgtcaaagaactgggcatcaaaattaatggttcaacatttcgtggtgatagcttcactgattttattcaccctggtgtttccagcagtaaagaagttctccctagtgtggataactggaaagctggtaaaatttgtgcgtggcacaatacagaaggcagctctatccaatggctctgcatagtgtgtgttgatcgaaaaggtaggtatggttgcggaagtttcatcagctctaacagcgtgtggaatcaccatatgctcgtgtgtgggcggagcgagataagagaaggggaataggtgtgatgttgttccactttgagggggcatatgagaatgtggtggtcagtgcatgctccggtgttgatatgattcttggggttcttggttggtccgttggatgcagctgtaa

SEQ ID NO: 419 - DNA, 2139 bp, Oryza sativa
gaggatagggataaggttagggagtcattggatgaggtgttggagaaggctgagaagctcaggaagacaaaaacacttaagagcgtatggcgaaagggaaaccctgtgtcaactgtacataaggtgcccatcctgattgataaatttgcttccaataaaccaatagtggatccagttgtagctgcagcactgatagaacctgtaaagccagtacgaggcccaccacgcaaggggaggagatggagcaaggcaaaacgcagagctgcaagacttcagcttgaggcttcacaagttgaagagccagttagagtcgagatccttgaagttggtgaagaaggaatggtaattgaggaattggcatatcaattggcaattgacgaatcagaaattctgcgatttttatctgtgagaggagctatgcttgacaatgttcagacacttgataaagatctggttaagatggtttgtatggaatatgatgtagaagtactggaaagtggtccagtgaaagtggaagagatggcaaagaagaaggaatttcttgacgaggaagatttggacaagttggaagacagaccccctattgtaactatcatgggccatgtcgatcatggaaagactaccctgttggattatatacgcaagagcaagggtggtggcatctgaggctggcggaataacacaagggattggtgcctatcaggttattgtacaggttgatggaaaccctcatgcttgtgtttttcttgatactccagggcacgaggtatagcaaaagcatttggtgcaatgagagctcggggtgctagggtaactgatatctgtatcattgttgtctctgcggatgatggtgttcgtccacaaacaaatgaggcaattgcacatgcaaaggcagctggagtccctattgtgatagccataaacaagatagacaaggaaggagctaatgctgaacgggtcatgcaagagctttcccaaattggacttatgccagaggcgtggggtggtgatatcccaatgattcagcagataagtgctcttaatggagagggtgtagatgaactattggagactatcattcttgttgctgagctgcaagaattaaaggccaatcctcatagaaatgcaaagggtacagttattgaagcatgccttgacaaagctaaaggatctcttgccaccctagttgtacagaatggaaccctaaacaagggtgatattgttgtgtgtggtgaggcttttggaaaggataaggctgggccatccaatgccgtgcaggttcaggttattggcttgaataatgtaccccttgctggtgatgaatttgagtctgtggacaaccttgatgttgcacgtgaaagggcaaacgcacgtgctgaagcactgagaattgaaaggatatcttcgaaagctggggaagggaaagtcactctgtcatccattgctgcatctgtttcatctggaaaacaagtaggaattgatacacacgagcttaatatcatccttaaagttgattttcagggttcagttgaggccattaggcaagcaatccaagtgctgcctcaagaaaatgtctccttgaggttcctacttcaagctccgggagatgtgagtgtcagtgatgttgatctggctgttgcttcagaagggattatatttggttttaatgtcaaagctccaggatcagttaaaagctatgctaagaagaaaagtgtggaaattcgtctgtacaaggtgatctatgatttgattgatgatttgcggaatgccatggaaggacttcttgaacttgctgagccaattggttcagccaaagttcgtgctgtttttagtagtggcagtggcaaggtggcgggttgcatgattactactgggaaagttgttcatgactgcaatgttcgggttcttcgtaaagggaaagaagtttatatgggtacacttgattcgttaagacgggtgaaagaaactgtaaaggaggttggtgctgggctagagtgtggcattggggtagatgattttgacgaatgggaggaaggtgatgtcgtggaggcattcaacacagttaagaagacaagaaccctagaggaagcctctgcttctgtgactgctgctctaaaggatgccggcgtccagctgtag

SEQ ID NO: 420 - DNA, 1694 bp, Oryza sativa
  misc_feature (15)..(15): n = any nucleotide
gccatcgcgtcgccnaactcggtgctcagcgagcacgcgttcaagcggctgcagctcagcgacgagctcgccattgccaggctcggcctgcccgagcagctcgtatccacgctcgagaagcgcgggattacccacctgttccccatccagcagagggctgtattgattccagctcttgacggccgtgacctgattgctagagcaaagacaggaaccgggaagacgctagccttcggcattcccatgatcaagcaattaatggaggaggatgatggacggagtgtgagtttggtaggcgaggtcgtattcctcgtgttttggttctagcacctactagggagttagccaagcaagttgagaaggaaataaaagaatcagcacccaagctcagtacagtctgtgtttatggaggtgtctcatataatgtccagcagaacgcactctcccgtggtgttgatgttgttgtaggaacacctggtcgcattattgatttgataaatggcggaagtcttcagttgggagaagttaagtacttggtccttgatgaggctgaccaaatgcttgcagttgggtttgaggaggatgtggaaacgatattacaacagctaccagctgagaggcaaagcatgctcttctctgccaccatgcctggttgggtgaagaaattatctaggcgatacttgaacaatcctttgacaattgacttggtcggcgatcaagatgaaaaacttgctgaaggaatcaaactttatgctatcccgctcacatctacatcgaagcgcactgttcttagtgatctcattacggggaaaaccattgtgttcaccaagacgaaaagggatgcagacgaggtatcattagcactgacaaacagtattgcttcggaggcactgcatggtgatatttcacagcatcagcgtgagaggacactaaatggttttcgtcaaggaaaatttactgttctcgtagcaaccgatgttgctgcccgtggtcttgatataccgaatgttgatttgatccattatgaattgcccaatgatccagagacttttgttcatcgttctggacgcactggccgagctgggaaagcaggaactgcaatcttgatgttcacaaacagccagagaaggacagttagatcacttgagcgtgatgttggatgcagatttgacttcataagtcctccagcaattgaggatgtgctggagtcctctgctgaacatgtcatagctactttaagaggtgtgcacacggagtcgattcagtacttcattccagcagctgaaagactgcaagaagaattaggacctaatgctcttgcttctgcattggcacatctgagtggattttctcagccaccctcttcacgttctcttatcagtcatgagcaggggatgggtgactttgcacaaggtgcagttttcgatttacctgaggagattgcgagggatttgcttagtatggaactgcccccaggaaacaccataaccaaagtgacaaagctacctgcattacaggatgatggtcctgctactgatagttatggccgattctcaaactcggaccggggtttcaggaacagacggtccaggggtggtggctcaagaggcgggcggggtggtaggagcttcagtggtgcttgcttcaactgtggcgaaagcgggcaccgagcatcagactgcccaaacaagtag

SEQ ID NO: 421 - DNA, 1624 bp, Oryza sativa
atgctgctggcggcggcgagcgcgtcgcggccgtcgtcgtcgctggaagggttccagccgctgtcgaagatcgccgtccacaaggccaccccttccgctgacgactggattgctgtcttctctccggccgatttccaattcgcaaactactcggcgaactacgtgtactggggcaagggcagcatccggttccagctcatcaaccagcgctacgacttctccttcgccctgttcaccggcggcctggaaaaccctaagctggtggcggtgtcggaggcgatatcgttcaagaaccccaaggcgccggtgtaccctcggctggcgcagggcaagtcgtacgacgagatgaccgtcacatggaccagcggctacgacatcagcgaggcgtacccgttcgtcgagtggggcatggtcgtcgccggcgccgccgctccaacccgcaccgccgccggcacgctcaccttcaaccgcggcagcatgtgcgggtgagccggcacgcactgttgggtggagagaccccgggttcatccacacagctttcctgagagacctgtggcccaacaaagagggcatgaactttctgacggatcaattgtctggggcaagcaatacactttccgggcgccacccttccctggccagaactcgctgcaacgcatcatcgtcttcggcgacatgggcaaggcggagagagacggatcaaacgagttcgccaactaccagccaggatctctgaacacgacggacaggctggtcgaggatctggacaactacgacattgtcttccacatcggtgatcttccgtacgccaatggctacatctcccagtgggaccagttcaccgcccaggtcgcccccatcaccgccaagaagccctacatgattgcaagagcggtaaccatgagagggactggcccaacaccggagggttcttcgacgtcaaggactccggcggcgagtgcggcgttccggcagagaccatgtactactacccggccgagaatcgagccaacttctggactacgggatgttccggttctgcatcgcggactcggagcacgactggagggagggtaccgaccagtacaagttcatcgagcagtgcctgtcgacggtggaccggaagcaccagccgtggctcatcttcgcggcgcaccgcgtgctgggctactcctccaactggtggtacgccgaccagggctccttcgaggagcccgaagggagggagagcctgcagcggctgtggcagcgccaccgcgtcgacgtcgccttcttcggccacgtccacaactacgagcggacgtgcccgatgtaccagagccagtgcgtctccggcgagaggcgccgctactccggcaccatgaacggcaccatcttcgtcgtcgccggcggcggcgggagccacctctcggactacacctcggcgatccccaagtggagcgttttcagggaccgggacttcgggttcgtcaagctcaccgcgttcaaccactcgtcgctgctgttcgagtacaagaagagcagcgatgggaaggtgtatgactccttcaccgtggagagggattaccgcgacgtgctcagctgcgtgcacgacagctgcctccccaccacgctcgcctcctga

SEQ ID NO: 422 - DNA, 1527 bp, Oryza sativa
atggaattctcctcgagttcaacgtctctcttcctcctcctctctatcctgcctctcctctactttctttgccagcgccacgaccccaagaagcagcctcacgcccatgggctcaagtcctaccccgtcgtcggcacactgccgcacttcgccaagaacaaggatcgcttccttgagtttataaccgaaatcatgaagcggagccccacgcacaccttgtcgttcaaggcgctcggcctcaccggcggcgtcatcaccgccaacccggccaatgtcgagtatacgctgaagactaactttggtaactaccccaagggcgagctcgccgtgtccatgctcgtcgacttcctcggccatggcatcttcaactccgacggcgagcagtggcagtggcagcggaaggccgccagctacgagttcaacaagcgctcgctgaggaacttcgtggtggacaccgtcaggtccgaggtcgtcgagaggctgctgccgctgctggagcgggcggagcgcgacggccggacgctggacgtgcaggacgtgctggagcgcttcgcgttcgacaacatctgccatgtcgccttcgacgaggacccggcgtgcctcgccgaggacagcatggcctcgccccagagcgcgaagttcatgcgcgcgttcagtgacgcgcagaatgccgtgatggaccggttcatgtcgccggtcaagtcgcggtggcgcttcaagaggctgttcaacatggagcccgagaggcagatgcgggaggcgctcgccacgatccacggcttcgccgagcggatcgtccgggagcgcagggagagaggggaggccgggctggcgcgcagtgacgacttcctgtcgcgcttcgccgcgagcggcgatcacagcgacgagagcctccgtgacgtggtgaccaacttcctcatcgccgggcgcgacacgacgtcgacggcgttgacctggttcttctggctactgtccggccggcccgacgtggaggacaagatcgtacgcgagatccacgcagtgcggcgcgcttccggtggcacaggcgacccgacgttcaacttggacgagctgcgtgacatgcaatacctccatgccgccatcaccgagtccatgcggctgtacccacccgtggccatggactcgcacagctgcaaggaggacgacttcctgccggacggcacgttcgtggggaaagggtggtttgtgtcctacagcgcgtacgcgatggcacgggtggaggacatctggggcgcggactgtgaggagttcaggccagagcggtggctagacgaggccggcgcgttccggccggagagcccgttcaagtacccggttttccacgcggggccgaggatgtgcctcggcaaggagatggcctacatacagatgaagtccattgtagcatctgtgcttgagaggttcagtctccggtatgccggtggcgagggacacccggggttcgtgctctggttgacgttgcgcatgaagggcggtttaccgatgcaagtgaccactagaggttga

SEQ ID NO: 423 - DNA, 1456 bp, Oryza sativa
gtgcgggcagagatgtttgggcagctcacgaccgggctggagtccgcgtggaacaagctgcggggaacagctgacgaaggacaacatcgctgaaccaatgcgggatatcagaagagcacttttggaggcagatgtgagtttgccggtagtgagaagttttattgagtccgttactgaaaaagctgtaggcactgatgtgattcgaggtgtcaagcctgagcaacagctggtgaaggtgaatgatgaacttgtacagttgatgggtggggaggtatcagatttggtgtttgcaaaaactgccccaacagttatcctattggcgggtctacaaggtgttgggaaaactactgtttgtgcaaagcttgcctattatctaaagaaacaggggaagagttgcatgctgattgctgcggatgtctacaggcctgctgccattgatcaactcactattctggggaaacaggttggggttccagtttactctgaaggaactgaagctaaaccttcacaaattgccaagaatggcataaaggaggcaaaaagcaagaaaactgacgtaatcatagtggatactgctggaaggctgcagagataaagccatgatgagtgagttgaaagagcctacagaagttctacttgtggtggatgccatgactggacaagaagctgcatgcattggttagcaccttcaatgttgagattggtattactggtgctatactgacaaaactggatggtgattccagaggtggagcagcactaagtatcaaagaggtatctggaaagcccatcaagtttgtagggcgaggagaacgcatggaagatcttgagcctttctatcctgatcgtatggcacaacgaatcttgggaatgggagatgtactttcatttgttgaaaaggcacaggaagtgatgcgtcaagaagatgctgaggaattacagaagaagatcctgagtgcaaaatttaacttcaatgacttcttgaagcaaacacaagctatcgcacaaatgggttcatttagtcgtataattggcatgattccaggcatgaacaaggtggttacccctgctcaaattcgtgaagcggagaaaaaccttaaatttatggagtccatgatcaacgtaatgacccctggaggaaagggaaagaccagagctacttgctgaatcacgcgagaggaggataagagtggccaaggaatccggaaaaaacgaacgacaggttgtgagccaattggttgcgcagctcttccgaatgcgtgctcaaatgcagaaaatgatgggtgctatgcaagggcaagacacccctgatatggaaggcctcatggattccatcaaggcagaagagcaggtaaaggcacctcctctatcacagattccaacaagttctgctgcttttttttttctcagaacaattacttgggccttggggcatgttcatttgttcttctgttga

SEQ ID NO: 424 - DNA, 1360 bp, Oryza sativa
  misc_feature (9)..(9): n = any nucleotide
  misc_feature (38)..(38): n = any nucleotide
  misc_feature (100)..(100): n = any nucleotide
acagtggtncccatggtgcacgacaccggcggcgggcnagcgtcgtcgacggcgtgccactactcgccgtcgctggtggcggcgaacccgaaggaccacntcaagggccgctccaaggacgctttggaacaacacgcaccagggaagaagctaccagctgaagagagggaagagagtgagttcgacatctatctgagagatgataaaagccatgtcctttaccatccagaattcaggtacagcaggtgttcgttagatcgacgaggttactcgagaggagatccaagcggcgttatgctcctcgagcatcgatcgctgatgtttcctgcagcgctgacaattcgaagaagaaagagaaatcaaagaagtatggcagagttcttgaaccagatgagcctttcaagctgttcctaagagatcgggagacgacggaattcctgacagcaaaagaggagagacatttgttcagtaaaatacaggcaaagccttacttttaccctgtcatctttattttcagaactgctcagcagattcttatgaaaatagaggaggctcaccggaaactagaagttcaatgcggccgtgagccgacattggcagagtgggctgaggctgtagggatgagcagcaaggagctgcagtcctctattcgcaccggaagacggtgccgggagaagatggctcgatcgaacttcaggcttgtgattcatgtagctaggaaaggatggatgcagtgggttgatgaagacctttgagaagttcaatcccagcaaggggtgtcgattcccgacctacgcatattggtggatacgccaatcaattaagaagtcaatcttcaagaactcaagactaatccggttaccgttgcaggagagtgtgtatgcgcttctgagaaaggtgggcaaggcaaggatggaatgcatcatggaaggggagcaacccaccaacgcgaacgtagcgaggcgcgccggcatcaccatcgagaagcttgcgaagctccgagcgaaaacccggaaacccccggtcgatgcaggatcatgtctggtcagatgagggtgtcaccttccagcaggagatcacagaagacccaaatgtggagccacctgacctgagtgtggacaggatgatgatgaggcagcaggtgagggacttcctggggatcctgagccccagggagaaggagatcatcgagcaccggttcgggatccacgatggcgagccgaagacgctacatgtcatcggggacatgtttgggctgtccaaggagaggatcaggcagctgcagaaccgggcgctggagaagctcaagaggagtgcatccttgcaggggtttgatgtctactttgatttgctaacctga

SEQ ID NO: 425 - DNA, 1327 bp, Oryza sativa
atggcggtgacgatccagtccgtgaaggcgaggcagatcttcgacagccgcgggaaccccacggtggaggtggacgtgggactcagcgatggcagcttcgcgaggggcgccgtgccgagcggtgcttccaccgggaatatatgaggccttggagttaagagatggaggatccgactatcttggcaaaggtgtactcaagttggcaggctgtgagcaatattgataacttcatggttcaacagcttgatggaacctccaacaactggggctggtgcaaacaaaagaaacaatgacagcttggagcaaatgctattcttgctgtttcacttgctgtgtgcaaagcaggagccatggtgaagaagattcccctttaccagcagcacattgcaaatcttgctggaaacaagactctcgtgctgcctgtacccgctttcaatgtgatcaatggaggatcccatgctggaaacaaacttgccatgcaggctgtacaggagttcatgatcctccctactggtgcatcctctttcaaggaggccatgaagatgggagttgaggtgtaccaccacttgaagagtataatcaagaaaaagtatggccaagatgccacaaatgtgggggatgaaggtggctttgctcctaacattcagcaggaaaacaaagagggcctcgaactgttgaaggccgcaatagctaaggctggctacacaggcaaaaggtggtcataggaatggatgttgcagcttctgaattttacagtgaaaaggacaagacttacgatcttaacttcaaggaggataacaacgacggttcacacaaaatttcaggtgacagcctgaaagatgtgtacaagtcctttgtttctgagtaccctattgtgtcgatcgaagatccattcgatcaggatgactgggctacctatgccaagcttactgatgagattggacagcaagtgcagattgttggggatgaccttcttgttactaatcccacaagggttgccaaggcaattagtgaaaagacttgcaatgctcttctcttgaaggtgaatcaaataggctcagttactgagagcattgaggctgttagaatgtccaagcgtgctggatggggagtgatggcaagccataggagagtggtgagacagaggataccttcattgctgacctctcagttggtctgtctacggggtcaaattaagacaggagctccctgtcggtcagagcgtctggctaaatacaaccagcagctgctcaggatagaagaagagctgggcgatgctgcagtttacgctggagaaaaattcagagcccctgtggagccgtactaa

SEQ ID NO: 426 - DNA, 1323 bp, Oryza sativa
atgggggagtgcaaggtgggaggaggaggcggaggcggagactgcttgatcaagctgttcgggaagaccatccccgtgccagagcccggcgcctgcgccgccggcgatgttgataaggaccttcaacacagtggcagcagcacgactgaaccgaaaactcaagagaacaccgttcaagactccacaagtccacctccgcagccagaggtcgtcgacaccgaggactcttcagctgataagaactcatcagagaatcagcagcagcagggcgatacggccaaccagaaggagaagctgaagaagcctgacaagatcctgccgtgcccccggtgtagcagcatggacaccaagttctgctactacaacaactacaacatcaaccagccgcgccacttctgcaagaactgccagaggtactggacagcgggtggtgccatgcgcaacgtgcctgtgggtgcaggccgacgcaagagcaagagcgtatcggccgcttcccatttcctccagagggtcagggctgctctgcccggtgatcctcctctctatgccccagtgaagactaatggcaccgttctcagcttcggctccgacctgtccaccttagacctcacagaacaaatgaagcatctaaaagataagtttatcccaacaaccggtatcaagaacaccgacgagatgccagtcggtttgtgtgctgaaggattgtcgaaaacagaagaatcgaaccaaacgaacctaaaggagaaagtttcagcagatagatctccaaatgttgcacaacacccatgcatgaacggaggagccatgtggccatttggcgtggcaccaccacctgcttattacacttcaagcattgcaattccattctatccagctgcagcagctgctgttgctgcatactggggctgcatggttccaggagcttggaacgctccatggccaccgcagtcccaatcccaatcggtttcatcatcaagtgctgcttctccagtatccacaatgaccaactgcttcagattaggaaagcaccctagagatggtgatgaggaactggatagcaagggtaatggcaaggtgtgggtgccgaagacggttcggatcgacgatgtcgacgaggtggccaggagctctatctggtcgcttattgggatcaagggtgacaaggtgggagcagatcatggcagaggatgcaagcttgcaaaggtttttgagtcaaaggatgaggcaaaggcatcaactcacacagcgatcagcagcttgccattcatgcaggggaacccggctgccctaacacgctcggtgaccttccaagagggatcttga

SEQ ID NO: 427 - DNA, 1239 bp, Oryza sativa
aagaattcatttagctggaaagaatatgcaatttctgtagcattatcggctggattaatcactggcgcaccaacgttaggatggccagcacatgcttctcctcttgaaccagtgatcccagatgtttcagttttgatctctggacctcccattaaagatcctggtgctttattgagatatgctttgccaatagataataaagctgttcgtgaagttcaaaaaccactagaggatatcactgacagtcttaagattgctggtgttagagccttggattcagttgaaagacaagcatcgagggcactgagtaatgggaggaacctaattcttggcggtcttgctgaatccaaaagagcaaatggggaggaattattggataaattggctgttggacttgatgagcttcaacggattgttgaggacagaaacagggatgcagtagctccaaagcagaaagaacttctccagtatgttggaacagtgtagaagaagatatggtcgatggattcccctatgaagtgccagaagaatacagcagcatgcctcttctcaaaggaagggctaccgtggacatgaaggttaagattaaggacaatcctaatttagaggattgcgtatttcggattgttctggatggatacaatgctcctgtgactgctgggaacttcttagatctggtggaacggaagttctatgatggcatggaaattcaaagaggatggttttgttgttcaaactggcgatcctgagggaccagctgagggatttattgatcccagtactggtaaagttcgtacaatacctcttgagttaatggtcgatggtgacaaagcgcctgtatatggtgaaacacttgaagaacttggccgctacaaggctcaaacaaagcttccttttaatgcatttggaacaatggcaatggctagagatgaatttgatgacaattctgcttctagccaaatcttttggttgttaaaagagagtgagctaacaccaagcaatgccaatatactggatgggcggtatgccgtatttggatatgtcaccgagaacgaggactacttggcagacctcaaggttggggatgtcattgaatcgattcaagttgtctcaggcttagacaacctcgccaacccaagctataagattgtaggataaaatgtttctttttttcaggagttccttgataggcaattattttaccatattgaaatcagtgtaaagtgctataatctctaa

SEQ ID NO: 428 - DNA, 1031 bp, Oryza sativa
ctcctcggcctctccgaaccggatctccggcagctcgccgtcgacctcggccagtacagggggaagcagcttcacgacctcctctacaagtccagggccaagcaaatccaagaatttagccacgttccgtgaggccttggtcggcgctggctggaaggttggccgctcgccagtgcaccatgctgtgacggcctccgatggcactaccaagcttctcaagttggaggataacagattgatcgaaacagtagggatccctgtcgatgatgacaaaggcccgtcaagactcactgcctgcgtttcatcacaggtgcaggttggctgccccttgcgttgctcattttgtgccactggcaagggagggtttgcaagaaaccttcatgcacatgagattgttgagcaggttgtctctccacaacccacctagtacagcgtttatgtacaaaaaagttggccatagaggagacgttccaacacagggtgacaaatgtagtgttcatggggatgggtgagcctatgttgaacctgaaatcagttttagaggcacatcgatgcttgaacaagggtgttcccagcactataaaaaagttagcatctcacaagcttcagtcaacacttggaaagcctgcacgccccaaatcagaaactacgggaaacaattgttccaagtgcaaagtcatatcccttggaggcactaatggatgactgcaagaattacttcctcgaaactggctgggattaatgacgcaaaggagcatgctgaagaacttgcagagctactgcatacatgtggcggtggttatcatgtgaacctaattccttataatccgattcaaggttctgaatacaagaggccctacagaaaagtggcgtttgttgatgcgctagaagctcggaagataaccgtaagcgttcgacaaacccgtgggcttgatgctaatgccgcttgcggacaactaaggaatgagttccagaagaatccactgcttgaatcatcaccttcatcagagcccaacctcgtaccagcttga

SEQ ID NO: 429 - DNA, 913 bp, Oryza sativa
gttgaagaagctgagaccattgtaaagcttactgaggagttagattccatagatactggccttcttgaagaagcctcaaagatcataaaggcattaaacaaagcactagataactttgagatgacacagcttctttctggaccttatgacaaggaaggtgctgtgattaatattactgcaggtgctggtggcaccgatgcccaggattgggctgacatgttactgaggatgtatgttaggtggggagagaagcagcggtacaagacaagagtggttgagaaatcccctggtgaagaagctggaataaaatcagctaccattgaattagaaggaagatatgcctatgggtatctctctggggagaaagggacacacagaattgttcgtcagtccccattcaatgctaaagggcttaggcagacaagctttgctggtgttgaagtaatgcctctactgccagaagagtccatggatgtagaaatacccgaagaggatctggagataagcttcactagagcaggcggcaaaggaggccagaatgtgaacaaggtggagacggctgttcgcatggtccatatacccacgggcatcgctgttcgttgcacaggaggagaggagccagttggccaacaagataaaggccctgagccggctgaaggcgaagctgctggtgatcgccgaggagcagcgggcgtcggagatcaagcagatccgcggcgacgcggtgaaggcggagtgggggcagcagatccgcaactacgtcttccacccctacaagctcgtcaaggacgtccgcaccgcctgcgagacgtcggacatcaccggcgtcatggacggcgagctggacaccttcatcagagcctacctcaagtacaagctctctgccgctgctgaggagcaaagcgtcaagtga

SEQ ID NO: 430 - DNA, 912 bp, Oryza sativa
gtcggtgacctccacggtgatctaaaccaaacgagggcggcgctagtgatggctggtctcctgagctcggaatcggatggccatgtgctggttcaagttggagatatccttgaccgtggcgaagatgaaatcgcgatactatctctcttaagttcactgaatatgcaggcgaaatctcaagggggtgctgtgtttcaggttaatggaaatcacgaaaccataaatgtggaaggcgattatcggtatgtagatccaggagcatttgacgagtgcatacgcttcatggagtatttggatgaatgtgatggcaactgggatgatgcttttctcaactgggttaatgtttgtgaaagatggaaggaagaatatccaatgtcacctaatggtgactggcgtccttggaactttgtcaagttgaggcagaagcagaaaggtattgctgctagatcatcacttttcaagcgaggtggcccgttagcttgtgaattggcgcgacatcctgttgtgctaagtgttaatgactggatcttttgccacggcggccttcttcctcatcatggtcgaatatggtatcgagcgtatgaacagagaagtttcggtttggatgaaaagttcaagtggagacagtgatgatgaattagatatccccttcatagcaactagaggttatgacagtgtagtatggagtcgtttgtactcacaaggccctacggaaatgacgcgtcattcctggaagacactgaaatctgtgggagcaaaagggatggttgtagggcacacaccccagactcgtggagtgaattgtggtgtgttgatgtgggcatgtcttatggtgttctctattcaaggccagaggtaaactttcgttttgcctggaaatttggtatgccttggttcttcatagacatttag

SEQ ID NO: 431 - DNA, 853 bp, Oryza sativa
  misc_feature (37)..(37): n = any nucleotide
atggcgaaacccgcgccgctctccggcctccgcccgngcgctcccgctcccgctcccgcggcgcgcagtcgcctgtgcggccagtcgccgccggtcgtggccccgcggctcggggcgttcccgcggcggcgtggtggggcggcacggtgctcgccgcgcgccgaggccggggacgtggaggcgcttagggcgggggtgtcggtgtacaagccgcggtcctacgacgtgctcgtctccgacgccgcccgctccctcgcctgcgccatggacgagggcaagacccgcctcgagatcgagttcccggtgtttcctgacctaccagaaaagcgcagggcatcccagttgttcgggactgctctagactcgtatcagttccctggatgaggtatctaccggacctgttaataccttcttcagatcaatgagagataccctggattttgactttgctgacgatgttgaaggaaccaccatcgctatatatcttcatcaattgcagcacacgtgacctttcaactatagagaagtatgtggaacaatttgcctcatctgtcccagcccttctctttaatcttgaactagataccttgcggacttggggcttctgggattcccaccaaaagatttgcattacagatttctttctcagtttaccccagtattttatatcaggcagcgtgactactctaaggggccctggcaggtcatgcttaagcaagccgatggttcttatgcatgtgttgcagagagtgcagctcggttcactttgggacagaaggaagaactgttaagagttcttggtttgcaagaagaacaaggaagctcactagaatttctcagaagaggatacaag

SEQ ID NO: 432 - DNA, 845 bp, Oryza sativa
  misc_feature (427)..(427): n = any nucleotide
  misc_feature (429)..(429): n = any nucleotide
  misc_feature (432)..(432): n = any nucleotide
  misc_feature (435)..(435): n = any nucleotide
  misc_feature (437)..(437): n = any nucleotide
  misc_feature (439)..(439): n = any nucleotide
atggcggccacggctgtgaccctgccgtcctcgccggcccccttccccgtcaccaccaccgcctcctcctcccgtaacgtccgcctcctcctccgctccccgcctcctcgccgagccctccgcgtcgccgcctccgccgcggccgacgcgccacccaagccggcgccgccgccgacctcgccttcgggcatcgtcctcgtcgaccccaccgaggcacagaaggtgcaccgcctcaaggctgtatacgaccagaaggtggtccccctcatcaccgaggagttcggctacaccaatgtccaccaggtgcaggtgcccaaggttgagaagattgtagtgaattgcgggttgggggctgaagccggtaactccaaggggctcgaatccgccatgaaggacctcgccatgatcaccggccagtggcccgtcnangangangncnagaagtcctcgccagtttcaagatccgcgagggaacaccattggtattgccgttacgctccgcggcaggggtaatgttcaacttcctggataggctcatcaaccttgggcttcctaggaccatggacttccttggtgtcaaccccaacagctttgatggccatggcaacttcaccataggccttcgtgatcagggcgtgttcccggagatcccgtacgaggtcggtgggaagaagaatggaatggacgtctgcatcgtcaccaccgcgaagaccgacaacgaggctctcaggctgctcaccctccttggcatgccgttcgcggagcacatcaagtcctccgtggtgatccggaagaagaggttgaagcgccaccacttcatgagcaagggcaggggaagacggtga

SEQ ID NO: 433 - DNA, 776 bp, Oryza sativa
  misc_feature (370)..(370): n = any nucleotide
atggcgcagcaggcaagggcgcagtggccgcagaagcagaacaagctgttcgagcaggcgctggcggtgtacgacaaggagacgcccgaccggtggcacaacatcgcccgcgccgtcggcggcggcaagtcggcggaggacgtcaagcgctactacgagatgctggaggaggacatcaagcacatcgagtccggcaaggtccccttccccgcctaccgctgccccgccgccgccggctaccaggccgaaaggtataagccggccaagcaccgccgctgagccctcccgcctccccctctcggattccggcctctccggtatccgacccacccagtacccacccgatggcgagctttcaccgccccgccancgcctccgccgccgcgggaaccaaccgatacctagttacaagccctcgccgtcgcgcgaaggcattttctactgggaggtggtggttgcggcgctcaaatcaaggggaaccggagccacctcgactccgtggattcgtcttctcctacccggcctaactggtgactgctgtcagtctgtcggctactcggatctagtggttgctttgatgcctggatgcttagcactgctcgtttgatggtggtgaatacctattggatgagctacctcacacgatcaccagaattccacctcaatttccctcatattaacttaaggaaatatgagtaggtagtgtgtgttcagcctggattcatgcaggaataacaacacaactattgttgaagaagtcttcaagtactaaatag

SEQ ID NO: 434 - DNA, 743 bp, Oryza sativa
atggcggcggctgcggcggagggcgcggcggcgaaggcgctgcgggcggtgctggggcgcgcggcgaaggcggcggagcggtcggggcgcgcggcggaggcggtgcgggtggtggcggtggggaagacgaagccggtgtcgatggtgcgggagctctacgacgccggccaccgctgcttcggcgagaactacgtccaggagttcgtcaccaaggcgccgcagcagcttccagaagatatccggtggcatttcatcggccacctgcagagtaacaaggtgaaatcactgttaggctgctgttccaaatcttcacatggttgagggtgtagataatgtaaaggctaaccaccttgatcgtgctgttagtagcttgggaagggatcctttgaaagttttggtacaagtaaacactagtggagaagaataaatctggtattgatccctccagatgcgtcgagcttgccaagcatgtgaagttagcatgcccacacctaatattttcaggtctcatgacaataggaatgaaagactactcctcaacaccagaaaattttaaggtttgtaaggccattgatatgccggcagaacagtttgaactctccatgggaatgtctggtgactttgagcaagcgatagagatgggtagcacaagtgtgaggattgggtcaactatttttggaccaagggagtatccaaacaaaaagaattgaagctatgtacattgtactcctgactccatgtaa

SEQ ID NO: 435 - DNA, 714 bp, Oryza sativa
atggccaccgcctcctcactcttcctcgcctcccccgtcgccaccgcgccgacagcccgcgcccggtccacaccctcggcttcccctgcccggccgtccctgcgcctccggcggccgtcaacgttggccgcggccgcggtccaggccgagcaccagcccgcggtcgccgcggcgccgaagccgccggcactcccgttccgcgtcggccacggcttcgacctccaccgcctcgagccgggcctccccctcatcatcgggggcatcgacatcccccacgaccgcggctgcgacgcccactccgacgggggacgtgctgctgcactgcgtggtggacgcgattctcggcgcgctcgggctgcctgacatcgggcagatcttcccggaactccggacccccgttggaagggcgccgattcgtcggtgttcatgagggaagctgtgaaactgatgcatgaagctggctatgagctggggaacctagacgctacattgatcttgcagaaacccaaaattagcccattcaaggagacaatacggtctaacttgtgtgacttgctgggggcggatccatccgtcgtcaatctgaaggccaagacgcacgagaaagtcgacagtcttggtgaaaacaggagcatagctgctcacactgtagttcttctgatgcggaaataggaaaatggaagtgtactacatattacaggaattgaattgtaa

SEQ ID NO: 436 - DNA, 690 bp, Oryza sativa
atgagctggctcgggaagctggggctgggcgggctggggggaagcccgcgggcgtcggcggcgtcggcggcgctggcgcagggccccgatgaggaccgcccggcggccgggaacgagttcgcgcagttcggcgccgggtgcttctggggcgtggagctcgcgttccagcgcgtccccggcgtgactcgcaccgaggtgggatacagccaggggaacctccacgacccgacctacgaggacgtctgcaccggcgccacctaccacaacgaggtcgtccgcgtccactacgacgtctccgcctgcaagttcgacgacctcctcgacgtcttctgggcgcgccacgatcccaccacgcccaaccgccagactctttgtatgcagggtaatgatgttgggacccaatacaggtcaggtatctactactacacccctgagcaggagaaggcggcaagagaatctctggagaagcagcagaagcttctgaatcggacgattgtcactgaaattcttcctgcaaagaggttctacagggcagaggagtaccaccagcaataccttgcgaaaggcggtcgcttcgggttcaggcagtctgcggagaagggttgcaacgaccccatccgttgctacgggtgaagggcaagtttgaaccagaacgccacacaagaacagtgcttgaataaggataaataa

SEQ ID NO: 437 - DNA, 675 bp, Oryza sativa
ggttatggccctgctggatatgctttatttgtactagtgtatgcaggattggagcttgcgattccagcgataccattaacaatgtcagcaggtctattgtttggtagtattactggtacagttattgtctcaatcagcgggacagtaagctgcagcagtggcctttcttattgctagatactttgccagagagcgaattctcaaattggttgaaggaaacaagaagtttctggcaattgacaaagcaataggtgaaaatggatttaaggttgttactctgctgcggcttagtcccctattacctttctctcttgggaactacttgtatggcttgacttcagtgaagttcttgccttatgtcttgggaagagttggttgggaatgcttccaggatcatgggcctatgtcagtgctggtgcatttggacgagctataattgagtcagagatcggtttgggaggaaacagccagctactgacactgggcatcgggctattattcacagccattgctgctacatatgtaacacgacttgcaaaggtattgacttgctatgatctatcacacatactgaacaaatgggattcggcagtatttgaacatatgcttatttcgttagtggtcactttgggtttcaatttctctttttcgaaagccaattctaactgttcttaa

SEQ ID NO: 438 - DNA, 673 bp, Oryza sativa
tattttcttgatgttgataccggaagcgacttgacatggatacagtgtgatgcaccctgcacaaactgtgcaaagcaatgtgactatgagatcacttatgccgatcggagctcctctatgggaatccttgcaagggacaacatgcaactgatcactgcagacggtgaaagggaaaatttggacttcgtatttggtgtggatatgatcagcaaggaaatcttttgtcgtcgccagcaaacactgatgggatcctgggcttgagcaatgcagcaataagccttcctacccagctagccagccaagggataatttccaatgtttttggccattgcatcgcggcagatcccagcaatggtggatatatgtttcttggtgacgattacgttcctagatggggaatgacatggatgcctatcagaaatggtccagagtgatatttgacagtgggagctcatatacaagaacaatatctgcctaggagtgttggatggaacagagattggtcatgactcagcgatagtaatcggaggatgtttcccttcgaggaaagctagttgtatataacaatgatgagaagcagataggatgggttcagtcagactgtgccaagccacagaaacaaagtggatttcctttcctctttaaaagagtgctgcaaaatcaacttttgtaa

SEQ ID NO: 439 - DNA, 660 bp, Oryza sativa
gtcgccgaagactactacgctgttcttggcgttccggatgcaacacctcagcagatcaagaaagcgtactacaattgcatgaaagcatgccatcctgatctcagtggcaatgaccccgatgtgacgaacttctgcatgttcatcaatgaagtttacacgcttaccgatcccatccagcgagcggtgtatgatgagattcatggctatgccgcaacagcaaccaaccccttcttcgatgacagtgcccctagggatcatgtgtttgtcgatgagtttagctgcatagacaggatgtaaaaactgtgctaatgtgtgttctaaggtcttcgaaattgaggaagattttggtcgggcaagagtttacaatcaatcaggcaatgccgaactaattcaagaagctattgacacttgccagttgactgcatccattggacatcagctgcacaactttcactccttgaagatgaaatgcgaagagtagaaagagtgaatcaggttggtttgatgctagctgggatgggaagttcagttgatgtgtttcggatggagagagcaaagcgagcagcggcggcagcgaggaggtggagagaatactcgaggaaaggtgcagacaagcctcccacattcaaacttccagaggcagtgtccaacaaggagtga

SEQ ID NO: 440 - DNA, 585 bp, Oryza sativa
tatgaggttggggagctatttgagcttggaattcagttgtcttatcttctcatactacttggtcttcttggagctggtacattttttgtcattcgtcaagttcttgtccgtagagagcttgatctttctgccaaagagttgcaggaacaagtgagaagtggtgatgcaagtgctactgagtattttgagcttggagcagtcatgctacggagaaaattttaccctgctgctatcaaatatctacagcaagcaatccaaaaatgggatagggatgagcaagatcttgcacagcaggtatacaatgccctgggagtcagctacaagcgagataacaaacttgacaagtcgatccagcaatttgagaaggctgttgagcttcagccaggctatgtgacagcttggaacaacctcggggacgcatatgagcaaaagaaagatctgaagtctgcgctcaaggcattcgaggaggtactcctatttgatccaaacaacacggtcgccaggccacgccgagatgacctaaagcagcgtgtgggcatgtacaagggagtcccagtgaagtcagaaaaacgataggtcctgtga

SEQ ID NO: 441 - DNA, 542 bp, Oryza sativa
aagacggcggccaccgacgggtacgacgccgtgcaggtggggtaccacggcgtccgcgaggagaagctcacccgcccggagctcggccacctcggcaaggccggcgcgccgccgctccgccacctgcaggagttccgcctccagtccgtcgacgggtacgaccccggccagccgctcgacttcgccgacatgttcaaggagggcgacctcgtcgacatctccggcaagtccatcggcaaggggttccaagaggtggcatcaagaggcacaacttcaagcgagggctgatgacccacggctccaagagccacagagctctgggatcgatcggtgccgggacgacgccgggtcgggtgtacaaggggaagaagatgcccgggaggatgggaggaaccaagaccaagatcaggaagctcaagatcgtcaagatcgacaacgacctgaaagttgtcatgatcaagggcgccgttccagggaagcccgggaacctcctccgcatcgctcctgccaagatcgtcggcaagaacatccccaagaactag

SEQ ID NO: 442 - DNA, 446 bp, Oryza sativa
atgcacgattccgtatttgatttacttcacttgagtttctttttctcccaggtcatactgacagatgacatagcagaggtggggaagaaaggggacacgctttaaagtgagggccgggttctaccgcaacttcccttctgccaaagggcaaggcaacgctgctcaccccagaagtactcaagtaaaagaagaggcacagcaacttgcccgtgtttttgaaactattggggcattcaaagtgccacgtaaaggtgggaaaggaaaacagatatttgggagagcgtcacagcacaagatcttgttgacatcataaagtcacaacttaataggtcgacaagcgtctcgtgacagtgccagaaattcgtgaaattggggaatacattgcagagattaagcttcaccctgaagtcacagctcaagtaaggctgaccgtatatgcgaaataa

SEQ ID NO: 443 - DNA, 1188 bp, Oryza sativa
atggatacaccgccgccgttgtccgtcaaggcctcaagagggccaagactgggttttcacccgatagccccactggaggtgaaggggcggcacgacaacgccctcaagaaggcctccggccttgctccgcagccatcaaactgctcacgccgtcgctgtcgcccacaacccaccatgcccgcatgcggccgtcgctctccttcttccccattgccggtcacctccttcctcgcctcctctctggctatcgccgtcgtcgacacgccagtccaccgcatcctcctcccgtgcgccggccgtgtcccatctccctgcatgccagcgcagctccagccggcttcgcgcccgccgctgctagcagccaccgtcgctgccgccagcaccactggtcgccgccaccaaaaccactcaagcccggctgccatcgccagccgccatccccgccagatccgaccggcgcagcgcggatctggtcggggtgctctgccgccgccgctgccaccactcagcccaaccgccagcctccaccccacgagatccggccagaatggcgcggatctggacggttgccaccaccgccgccccgagcaattgccccgaccaccggacgcacgctgggcgcagccccgccgccgccgtccttgcggccacgcggctttgcctacgcccgctcaggcggcggcgaggcagagaaggaagaagggggaggagggagttggcggtggcgtcacctctcgtgttgcccatgtggagagcgacacgagatcttatggtctttctattacatccacaaatgttttcttttcaaagatcatctctaaagctttgtggtctgtatggagtcgtcaatcccaaaaaaaaaagtacgatcgttacggcagatcggaattgtatcactgtttgcatgcacagttgcccttcactcgcaagctcaactcacgcaaattaaaccttatccagtattgtgctcatgctcggacgcaggcacctccactccatggatttgatcatcgctctgatactggcttcagtactagtgcacataatgacctgaaagtacataatgacttgaagggtgcattatgctcctttcccgatgccacacattctgaaatgatgattcaactcgatccatcagttgggtcaaaaccgaaccagtatattgctctgatgagtacatgcatataa

SEQ ID NO: 444 - DNA, 969 bp, Oryza sativa
gaaatttcatcatctagtttagaccttgttcgccaggaggcactgacaggtgggcccgccgccccagagggtggggcgcggtcacatgcgcgtgtcgtgtccacgctgtcgtcgtccccgccagttgtgcagacggcgaggaaccagatcggttgccgctgtctgctgcttcctgcccccagccggaaacagccgcagtcacacacacacgccgaccggtgggcccggcactccgtacgtctacgtattggcgcggtgcggcggtacgagtgtacgtatagctggccgtatcgcccacgtctttcccggatggctactgttaaccgccggaaagaacagagagccctcgcgatggacggtcgtgatcgcctgacaacccgatctaacggctcacgtgggagtttgccgacccgacccgaccggtcgaaccacccaagggtcgttttgggctttggcgcgcagacgatccggctcgggccggggcacggggattggaccgtggcgctgacaggtggggcccgcaaagagggtctggctggctggctattggacggcgcggatttgtccgtccggtgcccacagaatcgaacaaacaaacaagagctagtactagcagtcacagccgttggatatgatgaattagtgcagcagacgatagatagatacactagtaccaccaaatatgtacagtatatgtatacggatattaatctatccaggtccatgaacagtatgagaaaacagaaaactcacggcttcagagaagaaaagaaaagaaaacgctttgatacgatgagaagaagtagaagtagatggacatgtcaatggcgattcgagcatgagatgaacagtgtgaccatcgagcctctgcaggccattgcaatgcggttggttgcaagtgccatccaagtacagactacagagacagtcacagatatatacagcagcagaggcaaacatgaaaggtaa

SEQ ID NO: 445 - DNA, 498 bp, Oryza sativa
  misc_feature (73)..(73): n = any nucleotide
atgctccccggcgagctacgacatcagagtacacgagtacagaagtattccgacgagaaccaggaggaacagngagacatcgatgcaaatcttctcgaggagcatcgtgagcgagttgccgtccgagcagccagctatcaacagtccctccgccgttatcacgagaagcacatccgagcacgcatactttcgatcggcaactatgtcctccgacgagttcaagcccaagcagggcctccgaggaacctaagggatcttcggctggggacgcccagagccgataaggccttgttagatcctatagagacaaaagaccatgtaagatctggtcgtgtaagagttctcgccgtgcatattaaccaagccgtgaaatcggaaatcaactttccaacctcacggctgggggctaggatcaaagcttattcaaccaaggcaggtcaagggtccaagagccttatcctccgagaaaactcctccgacgacaaggttagggtctag

SEQ ID NO: 446 - DNA, 4773 bp, Oryza sativa
  misc_feature (35)..(35): n = any nucleotide
  misc_feature (84)..(84): n = any nucleotide
  misc_feature (114)..(114): n = any nucleotide
  misc_feature (4367)..(4367): n = any nucleotide
atgcggccgccgaacccgccaaggagccctcgggntccaaggctggctccgccgcggccacgggcgggcgccgcacgggtcccnaacgccgtcgcctgctccggtggcaaagangcggccaccaaggacgaagccgccgccgctgcggcggctgcggctgccaaggagtcctcggcctccgcggagctggaggccgagatgagcggcgcgtgcccccgcctcggcgccttctatgagttcttctccctcgccaacctcactccgcccctccactttataaggcgagtggcgcagcctcggcaggaggaacagccttcggatgatcatctcttctttcttgaggcatatgaagatcttatgaaggcatttttggaacgtaacaagtttggaaatttcccttatgggtttcgtgcaaacacatggctcgttcccccaattgctgctcaatctccatcaacatttcctcccctcccttctgaggatgaaacctggggtggcaatggaggtggttggggaagggatggcaagagtgacatgttgccatgggcagatgaattcttgtatctcacatccatgccttgcaaaactgctgaggaaagggaaatccgtgacaggagagcattcctacttcacagcttatttgtagatgttgccatctttagagctattgcagctgtaaggcatgtaatggagattaaggatgtatcagcatcagccaatatagatgaagttttgcattctgagacagtgggaaattttagcatcactgtcacaagagattcttcagatgcaagctgcaagttggataccaagatagatggtagccgagccacaggaatggacttcaagcatcttgcggagagaaaccttttgaaaggaataactgctgatgaaaatacagctgcccatgatgtggagagtttgggcattgtcaatcttagatactgtggtttgaggatgctgctcaatgatgccaattcaactggagagaaaaagacgttgaaccttccacaaaataataagcaggaagaactaattgcagcacattcttttgtggagaacctgttaaaggagagtcttcagaagctcgaagaagaggaaagtgaaaaacagtcctttatgaggtgggaacttggtgcctgctgggttcagcatttacaggatcagaaaaattctgataaggacaaaaagcaaggtggtgagaaggaaaagaaaaaggtggtagataaatctgcgaaggagacaaagattgaaggtcttgggaaacctctgaaagctcttaagcactcaaaaaataatgttgatgtcgctgacaagggatcctcattgggagaaaaaagcatgtgtgatggaacaagttctgcagaaagccaaaaattcaagccatcagctgttcaattgcctcagggagaatctaatgcctcagagaatgaaagcttgctgaaggatttattatctgattctgcctttacaaggttgaaagattcagaaacaggactccaccagaagtcaccgcctgagttgattgagatggctttgaagtactatgatgaagttgctcttcctaagctggttgcagattttggttccctggaactttcacctgttgatggtaggaccttgacagagattcatgcataccagaggcctacagatgcgttccttgggacaagttacatgcgacaattagcacttgcaatagctgcagcgctgaatttactgcttggtgttcctgagcctgaggtctttacaagttccgatggtgtgcgcccactagtatggaaatggctagtggccttcttgaaaaagagatatgaatttgagctcactgagcaacattaccatgatgttaggaaatatgctctcctgagaggactatgccataaggttggcattgaactggcaccccgagattttgttatggattctgctttcccatttcaaaaacaagacattattagcttggtaccagtacacaagcaagttgcatgctcatctgctgatggaaggcaactgctggaatcctctaaaactgcccttgacaagggaaaacttgaagatgctgtcaattatgggaccaaggctcttgctaaactcataacagtttgtggtccctatcatcgaatgacagctggagcttatagtctgctagctgttgtattgtatcacactggtgattttaatcaggctacgatctatcagcaaaaggccctagacatcaatgagagggaacttgggctagatcaccctgatacaatgaagagttatggagatcttgctgtgttctactaccgtttacaacatacagaactggctctaaagtatgtcaagcgtgcactatatctactgcatcttacatgcgggccatctcatccaaacacagctgcgacatatatcaacgtagctatgatggaggaaggcttgggtaatgtgcatgtagcacttagatacttgcacaaagccttaaaatgcaaccagagattacttgggcctgaccatatccagactgctgcgagctaccatgccatagccattgctctctcattgatggaagcttattccttgagtgttcagcatgagcaaacaaccttgcaaattcttcgtgcaaagcttgggccagatgacttgcggactcaggacgctgccgcttggcttgaatactttgaatcaaaagttatcgagcaacaggaagctgcacgcaatggaactcggaaacctgatgcatcaattgctagtaaagggcatctaagtgtatctgatcttcttgattatataaatcccaatgaagaaagcaaaggaagagattctgaatcaagtaaaaggaggtactcaagcataaaggtcctgtcaaattcgaatggaggttccaatgtagcaagtcctgaggtatctccaagagactctacttctgcaaatgcagacgaggacaagcaaatcatagagccatcacaagatgatactgttaactttgttgctgaagctgaaattaagcaaaaccttaaatccgtagagtactcagcatcatctgagcaaccagtagagagagctgaggtgattaatgtaccaagggaggttgttcaggaggaactagtagaacctgaagatggttggcagcctgttcaaagacctaaatcggctgcaggttcagggaaacaaatgaagcatttcaatcccaccaccagaaagatgtatgaccctgataatcatgatccacaatatacatctcaatacaaggcacgaaattcctatccaaatagccgttactacttcttaaagaagcggactgttgtacctgcaacgtacacagaccctcatcagcacatgaaagtccagacatccagtgcaaggtttggtcgtaagatatacaaggctgtgacatatcggattaagccagggagtacatccacagaggcgcaagatgcttctgctgaacagatgagtggtaaagcagagtcccagatggcttactcacaagtacacagtactacttctgtagatcataaagaaagtgagccacatggaactttggtgacaagtagtggaaacgcgccatcatacaaagatgttgcattagcacgtccaggtaccattgcaaaagctcaaatacaaaaatcaagagatgatgtagtccagaatcaaccgtcacttggtcaaattattgcacaagaaatgaaggattccttggtagatacacatcaagtggaacaaggatctgtatctgcaaatatcaataatcccaaagaagtaggcaacattccagaagaaattcagcattcagaagacattaaagtgtctgatagagaactggacactggggatattgacacagatggttcaccaaatgatgagaaatccttaaatggcagcaatcttgcaaatgatcacacaagtcaagaaccagtaagttgtagcaatgaaaatgcagccgtcgagtttgcagagtcttctaattctgcaaaagatgaacagagtcggaaatcggatatggagattttcgaagaagctctgcccaccagcattggacctattgcagtttctgcttctacagctaatactgagggccttgcaggtgctggaaatgagaaatcaaagcccaatttgctgctaaatagtattgatttgagagagatgcctaataagaagttgtctgctgctgcaccgccatttaatccctctccgccagctatccttagtcctcttgcggtaagtgtgggtctcccgccaccaggtgctatcccaggagtcgcaccttggcctgtgaatgtacctatgcaccctggacattcaactatggtaccaagtggtcctccattgtgcacctcccctcaccatttataccctccagctcctcggtcacctaatctctngcatccagtgccatttatttatccaccatatagtcagccgcaggtcattccaagctccacatttcccatgaacactaatatttttcgccctaatcattatggatggcaaccctatatgaatgcaccttcatcagagtttgtgccaggatcagcatggccaagcaaccatccagttgattttacgccaactccacatgttgttaaccctatatcccagtctttagcagacacccacattcagtcggacgcagctgttgttagtataggaccttcactggacagcaatactatggcagtgaaggaggaaatggaggctacaatggttggaagtggcaatttgatcagcaacaaacgtcctgcagatgatcaggacaaacaattaaagatccagttagaattgaactga

SEQ ID NO: 447 - DNA, 3330 bp, Oryza sativa
atgaccccggtggttcattgctctgttggcaatatcagcctgttccacatcggcagtttcaggccaagccatgaaatccaaataaggaggttccgcagcacagagaggtattcaagagtaccttcacgtaggctgctgcaaccgcaacgagcattcaacttgatcagtatttacaagagaagcagctggtcctctgcccgcaggccaagaactctgtcagcagcaactgttgggactgatgttactgtagaggatccgaatccaccaccttccggagaaacttctgaagaaagctctgaggatacagcacctgacactgctgaagcaagtgagcaagctgaggcaagcacttcttccattcccaaagcaggacgaaacataagaaagagtgagatgccaccactgaatgatgaggatctagttcctggtgcatcttttactgggaagcattcacctgaaggccttgttcatatctctcgagtaagtgatggatttgtaaaagatatatcttccctcttcactgtcgggcaagaggtgtcagtgagattagtggaagcaaataaagagacagggcgcatctcattgacaatgcgaacaggtggtgattatgtcaagcctaaaacagaaacacctaaggctgcaagtggcgggaggaataccactgcaaccacgtccagaggctcgccaaggcaaacgagggaaagagatgaagccaagagcatgggcgaaacaaactatgtgcaaggacaatttctggatggcgttgtgaaaaattcaacaagagcagggtcatttgtgaccctacctgatggaagcgaaggattccttcccagagaagaggaggcagtggcattgttcacccttatcggacattctgcactggaagttggtcaacaggtaagggtgaaagtattgaacgtagtacgaggccaggtcacgttgacaatgaaggagggagaagatgatgaagaggatctggcttcattaaacacacagctgaagcagggttggtccagagggaccaatgcatttgagctagctttccgtaggaataaggaaatctctgcatttttggatcagagggaaaagataatagttccagatgtacaagaagctgctgttgcatcagtaggtactgaacttgatgcagaagtaggaattgagcaaagtccaggcaaggaacctgagacaggcaatgctgaatcagttgcaatcgatagttctataacggaggtcaaggagactgatagtatagctgcagtggagaaggatagcgaaattagcaagactgaatcagttgagactgctagttcagttgtaatttctgaagatgatagcacagttgatggcaaactcgttgaaccaactgcttcagtttctgcaactgaaactgagattaaagaagatagctctgagggatctgtcaccactgagcctacagaagctgcttcaacagaatttgtcaccgcagtcgttgaggaaagcgctccgactgctagttcagttgaaacttctgaagatgatagcacagttgatgacaaactcgttgagcctactgcttcagtttctgcaactgaagctgagagcaaagaagatagctctgagggatctgttgcttcaacagaatctgtcaccgcagtcgttgaggaaagcgctcctgtgtcatcagtagcaattgaagttcctgctcctgaagcatcagaggcctccgctcaggagataattgaggattctactactgtggaaggtgccgccgatgatcaaactgtagaatctgatagtccacctccagaaggtgttgagctgtcctcgaatggggctccagacagctctattgctgaggataagcctgatgaaccagaagaatcgttgatagtagaagaggttccagtaactgcaagtagtgagtctgaggataaagaacctgctgcggtacctgaagaagtagcagcctcaagtgagaaaactgcagatgttgctgttgcaggagctgaagcaagcacggccacagcaactatttctcctgctcttgtcaagcaattgcgtgaagcaactggagcaggcatgatggactgtaagaaggctcttgcagaatcagggggtgacattgagaaagcacaagaattcctccgcaaaaaaggtttggcggctgctgacaagagggctggcagggccactgcagagggaagaattggttcttacatacatgacagcagaatcggtgttcttattgaagtgaattgcgagactgactttgtatcccgaggtgacatcttcaaagagttggtagacgatctagccatgcaagtcgccgcttgccctcaagtacagtacatttctcttgatgacgtccctgaggaggttatgaagaaggagacagagctggagatgcagagggaggacctcttgtcaaagccagagcagatccggtctaagattgtagagggccgtgtaaagaagaggcttggagaatatgcattgctggagcaacccttcatcaagaatgacaaggtcacaatcagtgaatgggtgaagcaaactattgccacaattggagagaacatgaaggtcaacagatttgtccggtacaatctcggtgaagggttggagaagagaagccaggattttgctgctgaagttgccgcccagacagccgcgaaggcaccgccagctgctcctccaaaggatgataagcctgaggaaacagcagaaactgaagagaagaaaccagctgtggcaatttcagctgcattggtaaagcaactccgagacgaaactggtgctggtatgatggactgcaagaaagcactagctgagacaggcggcgacattcagcaggctcaggagttcctcaggaagaagggcctgtcatctgcagacaagaagtcctctcgcctaaccgccgaaggcctaattggcgcctacatccatgacaatcggattggttgcatgattgagatcaattccgagaccgacttcgtggctcgcaacgagaagttcaaggagctggtgaacgacctcgcgatgcaggtggtggcatgtccacaggttgagtatgtctccatagaggacatcccagagagtgttgtcatcaaggagaaagagattgagatgcagagagaggaccttcagtccaaacctgagaacatcagggagaagatcgtcgaaggccggatatcgaagaggctcggcgtgctggccctcctggagcagcctttcatcaaggatgacagcaagacggtgaaggatcttgtgaaggagacgatcgccacccttggggagaacatcaaggtacggaggttcacccggtacacccttggtgagaactga

SEQ ID NO: 448 - DNA, 2652 bp, Oryza sativa
  misc_feature (2491)..(2491): n = any nucleotide
atgccgctcctccacatctccctcccgccgcaccgcctcctcctcgtcgccggcggccgccgccgccgccgccggctgctactcctcccgccgtctccccgccgcgtctgcgtaagggcggcggcgtcggtggagttggaggtggccgcggccgcgggggagtacgggctccccttcccgtcggagcgcgccgcccaccaccgcgagctcgccgcggccgccgccgccgtcgagcgcgcctgccgcctctgcgtaaacgtcaagagatcactgctttcaggtgagaagaaaattttcgaaaagaatgaccaaactcttgtcacagttgcggattttggagtgcaagcccttattagtttagagctccagcgatcgtttccatcaattcctcttgtggcagaagaggattcagcttctttaaggtcatctaatgctgataacagtagcaatgtgcttgttgagtcaatttcaagtgctgttgccgacaatgtgagtaacaccgattcacttttaactcatgatgatgtgctgagagctattgacaaaggaggcaaggatagtgcatcctttgattcaaatcccgctacttattgggtacttgatccaattgatggtacacaaggtttctcgaaagtggatgatactctgtatgtggtgggcttggctcttgtggtgaatggaaaagtagtagcaggagtcatgggaagtcctaattgggccagtgataccatagccaacagaaaagatgacagcattgcttcccgttatgatcgtgggatccttatgattgctcatgagggttgtggtgcttggactaagcgcctgtatgatgagtttggccagttcactacgtcaaaggatacttggaacagatgcttcgtggattcttgttctgttgtacacaaggcacgctattgcctttccgataaccaaacctggaatatgataccactatctgttgtgttcaactcaacgacggatgaatcgaaacctagagatgagaatgaacttcttacttcatatgttttctctggcagacttttctgtatgaacctgaaagaaagtggcgagcaatgggccgaaatctcaggcccaaacaagcgaggatttggaaagaacgcaatgcaagggtgtttgagcagcgaaccagaaggccagaccaactcgtggaggctattaaggaagagattatggtctggaaggaagcctgatatttctcctaccaaggattgcagtcctgacaaccttttcatgtacccactagctttggtagaacaattcaataagtttgttttctctaagtgttacacttatggtttgtctttgcttcaagtgaagagaacgctgctttcgggtgacaagaagattcttgaaaagaatgaccaaactcctgtcacagttgcagattttggagtacaagctcttattagtttagagctccagcgattgtttccgtcaatacctctggtggcagaagaggattcagcttctctgaggtcatccaatactgatgataacagtagtaatgttcttgttgagtcaatttcaagtgctgttgcagaaaaagtgagtaacgccaattcacttttaactcatgatgatgtgctgagagctattgatagaggaggcaagaatgctgtatcctttgattcaaatcctgctagttattgggtacttgatccaattgatggcacaaaaggtttcttgggaggggacgatgctctgtatgtggtggggctggctcttgtggtaaatgaaaaggtagtagcaggagtgatgggatgtcctaattggtctaatgctaccatagccagcagaaaagaagacagcgctgctgcccaacctgatcatgggatccttatgattgctcatgtgggctgtggaacttggtctaggcatttgtctgtcgatattggccagttcactacggcacagagtacttggaatagatgcttagtggattcttgttcagttgtgaacatggcacgcttttgcattcctgatagccaaacctggaatatgataccgctatctgttctcttcaactcaacaatggatgaatccaatcctagagatgagaatgaaattctcctcttatctgtttactgtggcagcttgtgcaagtacctaactgtagcttctgggagagcctccgtttttgtacttcgagcacggacgaaaaatctcaagtcttgggatcatgctgtcggagtaatttgtgtacaggaagctggaggtcagattagtgactggagtgggaaaccgttggatcttgcagctgacctaactgggcgcagagacatttacccttcaggtggtgttctcgtcaccaacggtgctctgcacggcaagctgcatccacacacacctgaagcttgtgaggaggagaaaacttggaccaatctgacagcagtgcaccatgcagtgaatcaggatgctttcggtttggccaccaattcaagccgaagaaaaggacacccaaaagcattantaagagctactgatctactcgagaacaagaaaaattcagatgatctcctgctctgctctcctcacgccaaaagccgcaattacgcgttgatgatcagagataattctgctatgaaagcaagcaagcaagcaagcacggtgaaattaattcctggaccatga

SEQ ID NO: 449 - DNA, 2127 bp, Oryza sativa
  misc_feature (776)..(776): n = any nucleotide
atggcggccgccgtctccgcgccccttctccggttccaccaccaccaccgctgcctcctccgccactcctcctcgccgcgccgctacccagccggcttctcgcgtgggctcagctccgtctcgttcggcctcccgcgcagcaccaccaccgccgcgcgctccaccgcctcgccctcggcgccgtcggcggcggcggccgaggccacggatgcggcttccgcccaggcgggatccgacggcaagggggatgggattggggaggaggagcgcgtcgtgctccccaccaacgagtcctccgaccgcctgctccgcatccgccacaccgtacttgctttttgctgcctcccattcctcacttctctacctgtcattaatctgtgtgcgcatgtgatggccatggccgtccagaagctgttccccaactccaaggtgacaataggtccctggatagacaacggcttctactacgacttcgacatggagcccctcacggacaaggacctcaagaggatcaagaaagagatggatcggatcatccggaagaatctcccattggtgagggaggaggtgtccagggaagaggcccaaaagaggattgaagcgcttaatgagccatataagttggaaattttggagggcatcaaggaagatcctatcacaatctatcacattggagaagagtggtgggatctctgtgccggacctcatgtcgagtctactggcaaaatcgatagaagagctgttgagcttgagtctgttgctggtgcttactgganaggtgacgaaagtaatcaaatgctacaaagaatatacgggactgcatgggagactgaagaccaattgaaggcttacatccacttcaaggaagaggccaagcgccgtgatcatcggcgattaggtctggatcttgatctattctccatacaggaagatgctggtggcggtttagtattctggcatccaaaaggtgctattatcagacatgttttagaagactcatggaaacagattcacttgcaacgtggttatgatctattatacactccccacgttgcaaaggctgaactttggaaggttagtgggcatatcgatttctacaaagagaacatgtacaatcaaatggatgttgaagatgagctatatcaacttcggcccatgaattgcccttaccacattttagtatacaagagaaagctacattcatacagggattttcccattcgagtggcagagcttggaactgtctacagatatgagctatctggtagtttgcatgggctgttccgtgtcagaggatttacgcagatttcattaagtactactactacctccgtttcaggtctatttgtgcaggatgatgcccacatattttgtctggaggaccagataaaagatgaaattagaggtgttcttgatctgactgagcaaatactgggccaatttggctttcggtattatgagataaacctttcaacaaggccagaaaaatctgttggcagtgatgacatatgggaaaaagcaacacttgcactaaaagatgcactagaagacaaaggttgggagtacaaggttgatgaaggtggaggcgctttctatggcccaaaaattgatttgaaaattgaggatgctcttggaagaaaatggcaatgttccactgtgcaggtcgatttcaatttacctgagcggtttgacattacttatgtcaattcaaatagcgagaagaaacggcctatcatgattcatagagctatccttgggtctttggaacgattttttggtgtcctcattgaacactatgctggtgattttccactttggcttgcaccaatccaagctcgtattctacctgtgacagacaatgagctgcaatactgtaacgaggtggcttcagaactgaaatcaaaaggcattcgagctgaggtatgtcatggcgagcgtctaccaaagctaatacggaatgccgaaacgaagaaagtgccgctcatggcggtcgttgggcctaaagaagttcaagccaggaccctcactatcaggtccaggcatagtggggagattggtactatgcctgtggatgaattctttcgcagaatccaacttgctattgcgaacaaatcttcttcactatga

SEQ ID NO: 450 - DNA, 2046 bp, Oryza sativa
atggagacgacgacgacggagaggcggcggctgttcgcgacggagaaggtgggcggcagggcggtgtacaggctgcaggcggcgacggtggccgccgggatactgctggtgctctactacagggcgacgcgcgtgccggccgccggcgaagggcgggcggcgtggctggggatggcggcggcggagctctggttcgccgtctactgggtcatcacgcagtccgtccggtggtgccccgtccgccgccgcaccttcaagaacaggctcgccgagagatacaaagaaaatctacctggtgtggatgtttttgtatgcactgcagacccacacgcagagccaccaagccttgtcatctctaccatcctatcagtcatggcatacaattacccatcagaaaaaataagtgtgtatctttctgatgatggtggttcaattcttactttctacgctctatgggaggcatccatgtttgcaaagaaatggctaccattctgcagaagatataacattgagccaaggtccccagctgcttacttctcggaatcagaagggcatcacaatctgtgctccccaaaagaatggtcatttatcaaggttctgatagatgggaaaagccaaaatgcagttgatgacgacggaaatgtgctaccaacactggtatacatggcgcgcgagaagagccctcagtatcaccataacttcaaagccggggcattgaacgctttgataagggtatcagcactgataagtgacagccctgttatcttgaatgtggactgtgacatgtattccaacaatagtgattcaatcagagatgcgttgtgcttcttccttgatgaagaaatgagccacaaaattggatttgtccagtatcctcagaactacaacaatatgaccaaaaataatatatatgggaactctctcaatgttatcaatcatgtggagatgcgtggtttggacagtgctggtggatgtctctatattggcacaggatgcttccatagaagagagatcctttgtggtaagaaattcagcaaagattacaaggaagactggggcagaggaataaaggaaagaggacatgagaacatagatgagattgaagagaaggcaaaatctttagcaacctgcacttatgaacttaggacacaatggggcaatgagattggagtgaaatatggttgcccagtagaggatgtcatcactggattggcaatacattgccgaggatgggagtcagtctacatggaacctcaaagggcagcatttgtgggtgtagctccagcaacacttgcccagacaatactgcaacacaagagatggagtgagggcaatttcacaatttttctttcaaagcacaacaccttcctgtttggacatggaaaaatcagcttgcagttacagatgggctactgcatatatggattatgggcagccaattcactgcctacaatctactatgttatgattccagcactaggtcttgtcaaaggcactcccctatttccagagattatgagtccatgggctacacccttcatatatgtattttgtgtgaagaccctctacagtctttatgaggcattattatctggggatacattgaaaggatggtggaatggacaaaggatgtggatggtgaaaagaattacctcatatctatatggcttcattgacaccatccgaaaattgttaggattgtcaaagatgtcatttgaaattacagcaaaggtaagtgatggcgatgaagcaaagaggtatgagcaagaaatccttgagtttgggtcatcatctcctgaatttgtgatcatcgcaactgtcgcattactgaacttcgtctgcctagttgcagggctaagcaaaataatggcaggtgtgtggaatgtgtttttaccccaggtcattctatgtggactgatagtgatcactaatatcccaatttatgaggcaatgtttgtgagaaaggataaggggagaataccattaccagtcacactagcttcaattggctttgtaatgttggcattcctgttaccaatagtttga

SEQ ID NO: 451 - DNA, 1746 bp, Oryza sativa
atggcggcggcggagcgcccgagcaggtccgacgtcgacttcgccgacgtcttcggcggcccgccccgccgctcgtccgggcacgacagcctgaggcgctcgtcgatggactcgtcgttcggctcagcgacgaaggggaggagcggggcagaggagaggcccgtgttcggggaccgcacgagctccgaccggaggaggcagctcgggcaggaattctacaaggacatattcgccgggagcgagtcgatgtcacctaggcggggaggcgcggcgggggatctggatgtgtttggtgcgcaggcctcacccggttccaccagccgcctgcattcgagcttctccatgaagttcaacggaggcctggacagttctgtccctacttctccatctcggcatacatccaacaaaaacgatgatggaatatcatatgcttacagtgttccaacttcacctaattcatccatgaacagctttctagcccaaggggcaccccaacaagattccacaaagaatcctttttcatggcatcgctatcccttcttatcccggtttcgctctaacagtggagataagaaggacacctcccattatgtcagctctatggacagtgaatacgaagggactcctgttagcttggaaagtagcattgccaataacaagttccatttttcattctataaatggggagggaaaggtgccgttttggtattgccaactactgcacaggaaaatgctggtgatattgttggagtaaggagtttccctcaagtgattgtgcaaggtatggacctaattgatgaagaagatagcacgtcaactgccactggagcatcaaagagtcagactgattacgaagactacaaatctgggaaagatgtctcgttaggggcactcttaaaaaccaaggatggagcccttcctttagcttttgatgactacgtgctaggcgataaatctgaagaatcaggaacaaaacataacaccaataatgcaaagaacaatgtattaggagctagccccagctctaaaagttctcggtcaccttcaggagagaaaagtcgtggcagcagagtgaaaggaaaagtaaaggacttcatgaaaatatttagtcctgagagttcaccgaagagcaaacgagatcggacatccagtgggaaaaacggaagcaaaagtggtcctgaagataaatttagcatatccaattcggaggtcgatgacaatgtcagaacagccaatatgaacaagcagaatgtgttccctcctgtaccctctccaatcagcgaagcacaagacaggacggagataccggtttttacagtggataatgaaatggattcaaaggcagattttggaagaaaagaagttacacctccctcttttgatgagtcaagcgatgcccaaacaaaatataaggtagatgagataacagatcttgcggaaggtccagtggaagatcttgaagaatgtgtggttgaggatgtctctgaagattttattcttcgtaataatgaggaaaaagagcaaataaaggttctatggcctgagagtggatggaaaccagtcccccttgttgatataattgaaggagcagctgttaagaaggcctatcagaaggcattgttatgccttcatccagataagttgcaacaacgaggagctgctatgcatcagaagtatatagcagaaaaggtttttgacattctacaggaggcatggaaagaattcaatacagttacttttggatag

SEQ ID NO: 452 - DNA, 1167 bp, Oryza sativa
atggcggccctccgcccccgcgccgccgccgcctccgccgcagtcgcccgcccggtcgccgtacgccgaggcggcgtctcctcctcatcccgctggaagctgcagggaagtatgttgaattggaaatctaaatgcagtaccagaagtccacggactacagttgctggtgcaaagcctgatgactctgaatttgaaagtgtcaatgcaccactcgagccccaaacgtgggaaggaagcttcttgtgtggtttgttgaagaaccagccacaagtactcccagttgctgcggcaaagcaacttcaagaactatctaatcaaagaaaggacaccttgatccgctgggaacatagcatcggttctcctgaggactgccttcacaggaggattgctgaaatgaaggagcatgagtgccagactgctattgaggatatcatgtacactttgattgtttataaatttttcaagattgaagttccattggttccaaatctatcaaagcttatcagcaataaaagactacaaatatggccaccaagggaggcagaactagaatcaattcatggacctgaggtgctaggtttaattagggaacacttgaccagtattatcagatgggtacatagaaatggtcccaagatcaatcgctcaacacttagaatcaaaagaatgcaatttagtcggatttattctgcttcaataatgtacggatactttctgaaatctgtcactacaaggcatcgtttggagctgattcttgctcagtcacaagaattttgcccaccaattcagtttctgaatgcacaatttaatagcacccagaaacaagaacaggaagagtccattggaggttctgcagaaatatcatcttcctcaaaaccgagttctgttgttgatctgcatgacttgaagagttacatgatgggctttgatccaaagaccttggagttatgcgcaaggctgcgctcatgcgaagcttctaatctcattgagaagcacagttgggcactgttcagagaaagcatgaaagatttcctagagcctgatgaggcagtgatactcgatccgtcatccctaaagagattgttgcttgaagccattgcatttggttcctttctttgggatgttgaggattatgttgacgagatttacaagttgcatgatagctga

SEQ ID NO: 453 - DNA, 1020 bp, Oryza sativa
  misc_feature (100)..(100): n = any nucleotide
atggacatgttgcaaccaaactcagtacgtgcctgcgtacgaagcgacctagattttgacatggcggggcagcaggagcaaccggagattgcgccgcctncgccgcggcggcgcgtcgtgtgcgtcaccggcgccggcgggttcgtcggctcgtggctcgtcgagctcctcctctcccgcggctacgccgtccatgccacggtccgtgacccagctgctgactctattgcagtcacgttggctacttacagccgtcaaatcaagtttgatgccgagatcaatcgctacagtaattccaataaacactactcacaattcactgttcccctctgccatttaccccctgatgcgaacccaccaaacagaccctctggtggttaccattactgtacacaaacagtaaacccaattaccgtgggtaaccgacgtggcatctctttgtgtcaccctgttggtttgttggaaccatacgatcccaagaacgcgtttctgaagcaactggagaatgctccggagaatctgcaactgttcgaggccgacgtgctcgactgcggctcactgacggcggcgttcgccggctgcgagggtgtcttccatctggccactccggtgccggaagaaaagatcgttgatccacaggcaatatatattcagaaggagatgatggctcctaccgtggaaggcaccagaaatgtactcgaggcttgctcagctgcgagcgttcagaaactcgtcgtggcctcctccattgctactgtttgccttaacccgagctggcctcaagatatgccgaaagatgagacttcctggtcagacaagaagctctgcattgaaaatgaggattggtactctgttgccaaaatcgaagctgaagagatggccctggaatacggaaagaaaaatgggcttcatgtacttacgatttgtcctggaattgtttttggcccaatgttgcagacagtggaaatcaacacaagcagcaaagtgctcctctatatgattaagggttcaccattttaa

SEQ ID NO: 454 - DNA, 630 bp, Oryza sativa
atggccggggtggcggcgttgcagggcgcgatggcgtccctctccatctctgcgccgggggcggcgagcaccagcagcttctggggccacccgctctccaccttcgccgccgcgccggctggggagttcaggctcaggacctcaactagccaacaaccaacgttgtgtcaaaattttgtggttaaatttatgatcaagacatgcccaattcaaatgaggcttaagcgatgggagaggaagaagtgtaaaccaaacagtcttcctgtcctgcacaagatgcatgttaggattggcgatacagtacaagtcattgcaggccgtgagaaaggtaaagttggagaagttacgcggctttttaagcacaacagcactgtaatagtgaaggacttgaacttgaagtccaagcacaagaaaggaacagaagatgaaccgggtgaaatcgtcatgattgaaggccccattcacagctcaaatgtgatgctctactcaaaggaaaagaatgtggcgagtagggttggacacaaattccttgaggatggaacgaaggttcggtacctggtcaagactggtgaaataattgacagtgctgagaattgggtcaaggtgttcaaggaaggaagttcggagtga

SEQ ID NO: 455 - DNA, 543 bp, Oryza sativa
atggtgggagcaacagtctgtggacaggccctcgcccttctgtccatccgcttcaacagctcgacggcgaggagcgtgttgagggtgcccacgggggtcgaggccgtggctgtctcggagcagcaattcgtcgaacagcggctagcactcccaccgcctcatccattccaaccacaaccccgccgcccctccaactccaacccccttctccacccactgcctgcctcccctatcctccccacccccgtgatggaggtcgagatcaagctccgcatcctcgatgctgccgcggactgcagcctctcctccttcctcgcgccctgcctccgccacaccagcgccgcgcgtcccctctccgccgccaccgccgcgctccgcgtccatctctacggcctcaacgacccacattgttctcgtgctcaatgcagcatgtgcatcgaggccggtgtcagccgcgtcgaggaggtcgaggagcctctcgaccccaccatcaccctcgaggatgaggaggcgttggtggcgagtgcgggagacggtggttga

SEQ ID NO: 456 - DNA, 504 bp, Oryza sativa
atggcgcttgccctcgtctcgccaatggcggctctctcactccactccgggaggatctcagcggcggctatcggcggcggcctccgctctcgcagggcatccccgatgggcgccgccgccaccccgttcctccggagctccttcgtctcctcctcctccacgtcatccgcctccgcctcccccgccgcgctctctgccgcggtctcggcgtcgctgaccttcacctctgcctcctcatttgctggttcatctttgggaattgaattcagctacaacagagttacaacaggaagatcccggattctgcagattagggctggaaaggctgctctgtgcatgaccaagagaaatagatctaggaagtcgcttgcccgtacacatggttttcgcagacggatgaggactactgccggaagaaaggtcctgaagcgcagacgcgccaaaggaagaagggttctctgcacaaagacgaactcccccactgggaagaaacgaatgttctga

SEQ ID NO: 457 - DNA, 870 bp, Oryza sativa
ctatatgctaacgaagattacgacaaagagatgttctgggacaacttggatgcggatttgcgctactggaccagatccctgcgcccagtgcagcagtggtatcctggtcatattgcgaaaacggagaaggaactgaaagaacagctaaagcttatggatgttgtcatagaggtccgcgacgcaaggattcccttggcaaccagccatcctaagatggatgcctggctaggcaatcggaaaaggatcatagtcatgaatcgcgaagacatggtgtcaaatgaggacagaaatgcatgggcctcttactttgctaatcagggtaccaaagttgtttactcaaacgggcagctgggcatgcttggtcagggtacaatgaaattaggtaggatggcaaaatcactagcatctactgtgaacacaaagcgcagagagaaggggttacttcctcgtgcggttcgagctggaatagttggatatccaaatgttggcaaatcttccttaattaatcgcttgctaaaacgaagaatgtgtccagcagcgcctagaccaggtgttacaagagagctgaaggaagtgatttagagctattagattcacctggcattttgccaatgcgaataagtgaccagacagctgcaatcaaacttgctatatgtgatgatataggagaaaggtcgtatgactttgctgatgtggcagcgattctcgtacagttattagtgagacatccagctgtagttgttcaatggagatgccagccaagcagccttccgcatcttgtctgactaccggaaaggcaaatttggctgcgtggccctggagagacccccaacatgagcaatggagatctcagatattcttagatgttaa

SEQ ID NO: 458 - DNA, 786 bp, Oryza sativa
atggacccggcgctcaagaccgacgccaaccgcgtccggggatgcgtctcccaggtctgggtccacgctgcgccggaggagggcggcgcgccgggcagggtcagcttccaggccgactccgacgcgcagctcaccaagggcctcgccgcgctgctcgtgctcggcctctccggcgcgccggcgcgggatgtcgccatggtgcccgtcgagttcatcgagctgcttgggatcaggcagagcctctcgccgtccaggaacagcggcctgctcaacatgctcagcctcatgaagcgcaaggccctggaggttgccaccggtgaggtaaccactgaggaaattggcagccaagaagtggtccaagaggtcgctgaacggcctgctgcgaaggagaaggaacccgagtttgcggctttcggtgcgcgagaagaagagggttcagaggtgcatagcccacaggaggaacaattggaggaaatgccagctgatgtgatggaagggaatggtggtttggggggtgggaggcaggagaggataaaggagagccttgagcgcgggctttcgccggtgcagctccagatcgaggacatatcgcacctccataagggtcatgctggggtgtcaggaagcaatggcgagacgcattttaatgttcgggtggtctcagaggcgtttcaggggaagagcctgctcaagaggcacagggctgtgtatgatcttctgcaagatgagctcaagaatgggttgcatgcgctctccattgatgcaaagacaccatcagaagtctag

SEQ ID NO: 459 - DNA, 730 bp, Oryza sativa
atgatattcagcgtcacagccaagaagttaattagctatgactccttggcctcagatggaaagatgtggaaacaatttgatgctttcattcgaggtctactggcatttccaattggcattcctggcaccgcattctacaaatgtatgcagttgcaggggcgaaagaatatcatgaagatgctgtgcgctggatttgatcttcttgctgctatttgccagcttcgagaccacggcatccgctataaccgcagtggtcagatttctaacggataatcccgaggcattgcaagaattagcattacaggaggagcatgataacattcagaaaagaagggtcgacctgaactctgaaatcacatgggaggaatacaaatctatgaaatttacatctcataggcttgctaacattgctccagtgatgtttagaaaagccacagaggatgttcatataaaagtgtccttccacggttcacctaaaccctatgatttataaggatccaaatatattcaatccttggagatggaaggcctccaaggatttcatggcctttggagggggactgcgcttgtgtgttggtgcagatttcgctaagctgcagacggcgatcttcctccactgcttagtcaccaagtatagagatggaaagcgatcaagggaggaacaatggtgcttggtccaggactacgattccctgaaggttttcacatccaacttttcccaaaaccttga

SEQ ID NO: 460 - DNA, 464 bp, Oryza sativa
atggcggccacctcgagcctcacggcgaccgccgcctcccctccgctcctcctcaaacccgccccttccccgctcgctgcctcctttctccggcccgtctctcgcttctccaggttccagtccgtcaagaccaagacacaggccacagaaaatgatcagaccgaaaagagtcctccgaagggaagcagccttgtctgccaggactgcgaaggaaacgggtgcaatagtgtgcaaccagtgcaagggagatggggtgaattctgtcgatcacttcaacgggccgatttaaagctggagcattatgctggctttgcagattatacagaggaaagcgggaaatcttgtgcggtagctgcaatggtgctggcttcttaggtggattcatgagtacttccgattcaactgcagagtagtgtgaatggtttatattcttcttttggtttgtgtttgtattttgtatttga

SEQ ID NO: 461 - DNA, 2100 bp, Oryza sativa
atgaacaactatccagtcaacagtgttgttttggaggtgaaagatggggaaacacagggggattggaaggttctaaaagctaaggaaatgggaagtggaggagggaataggaaaggagctgactcgccgccaccgatcgccaagccactgaggctggtcactgtactgcctcttgtgttcgatggcttgaatgagcagcaaccagcagctataagctattgctttatgtattgctctccctgggcttgcttgggccgagacttgcactgcgaatcagctatggtgaagcccaacatggtctctaacaatctactctccttgaattcggcttgcgccgccgcgccgcttccggcgatggcacggaggccgtcccgcgtggcgcccccgggatactcccccgtcggaggagggtgcgcgctggcggtggagtgctcgtcgcggccgcagaagaaggcgacgaagcaccacatgaagacgcggcccaagaagtcgcagccgtgggacaggaagcgccgccccacgcagtaccggccgctgccggctctcccgccggactggacgctcgtcgccgccggcgccacggtcgacgcgtcggcgcaggccgaggatgcggatgaggaggaaccggagccggtggccgctccggtcgtcgagatctgcagcaatgtcccatgcaattcgctgtcagatatagacaaggatggtgctcatggcactaatgcacaccccctattcgatggaatgccaagccaacatgaggtgtctgaggatgattccaggctaccagagaaatccttggatgatgctctggatcagatcatggagaagcttgagttgatggaggccaagcgtaggcaaaatgagaagattaatcggattttggagaagttcaatgagatggagaagagggaaagggaatccatgcataggagaagggacatcatggaggagcttagcaccagcatcaaagtgaccactacggtcatcatggctacatcatcttcaccaatcatagcaccgtccccttcactaactaccaattgctcgacagaatgcccctatgccagcagcccggatgtgacacttagtgatggtggggacaaggaccaagctccctacattgtcatcaaggaccttctcaatgtcacgcctgccaagtgctcgacaaattactccatccccaacatcgtacctggcctcaccgtggctgccatggttacatgtgccccgacatctatggactccatgtatttggaagttggtgaggacatcaccagcaccaccagcgttgactttattggtcatcccaaggagacacacacaaagtttttgatgatgggcctcgatgtcatggaattgaagcttgatgctatcatcagcgtgggaaacaaggtgtctatagggtgttcaatgaaatgccctcaaagcgacaacaagcaactgatggagcatcccaacaaaaatccatggccaccccctacccacaatgttgcaatggaaaatcgacaggtgttgcaactagccttgccaatcctcagctatttcaggatcaaattgcaatggatgccaccttggctgccattagttggtttgctagaagctagacaagggaagtgttgcactcctgattctactgcgaaaaatgcagaagttttgggatccgactttccaggaggacttcgcatgaaggaggacgctggcaagcttgtgatggaaatgattggattgtggacgccggcaagcttcacgaccctgggtagcgcccaccacgccctagaatactggccgacggtagatagtcgatggtggctatcagtggatggcttggatgccgccgatcacgtggaggtcgagcatcaccatcacaatgaaatacacagcaatcgcacagtgaagagccacagcagcagaatatcaacggtgaggtcaatgttgtcgtcgcgcagtccaggtcattgccactccatcgaggttgagatcgtcgttgcgtggttgagatcatcgttgccgcgtggtcacaagcggaggtcggtctgccaagtgggagagagtgggggaagtgaggtgactgggagtgggggagaggaactgtgggagtga

SEQ ID NO: 462 - DNA, 2550 bp, Oryza sativa
  misc_feature (48)..(48): n = any nucleotide
  misc_feature (128)..(128): n = any nucleotide
  misc_feature (160)..(160): n = any nucleotide
atggcgccacctgccatggccttccaagctctcgctctcggccccctncccctttccccttcccgcggcgcgtcgccgccgccgcgtgcgagtcctcgccgtggccgcagaccacaccccggcgtcgncgccgttgccgttcttcccttcccgagccggngaacagcccgagccggctcctccccgccgctcgacgacgagcgcctcacccagcggttcctcagcagcccgcagctgtcgctcaaggcgctcccgctgctatcctcctgcctcccgtcggcgccgctctccgccgcagaccggacatggatggacgagtacctcctcgaggccaagcaggcgctgggctacccgctcgccccctccgagacgctcggggacggcgacgacgacggctgccccgcgcggcacttcgacgtgctgctctacctcgcgttccagcacctggacacgtcctgcgagcgcacgcggacgcggcacgtccggagtggccactccaggctctggttcctgggccagtacgtcctggagctcgcgttctgcgagttcttcctgcagaggtacccccgggaatcccccgggccgatgcgggagcgggtgttcgcgctgatcgggaagagagcgattcccaagtggatcaaggcagctagccttcacaatttggtgttcccttatgacgatttggataagatgattcggaaggaccgggagccaccagcaaaggctgtattctgggcactgtttggagctatatatttgtgctttggaatgcctgaagtctaccgtgttctttttgaggcgtttggcatggaccctgaagatgagagctgccagccaaagctgcggcgccaactagaagatgttgactatgtatcagtggagtttgaaaagagacaactcacatggcaagatgttgctgcctatcgggtaatttccctttctgttgtttgctgccaatcttccttcttgtcttcattcttacgttgtttgtcattgcatgtcatgaggccaccaccagatgccctctttgctcaccctaggctatttcgagcatgcgtgccaccaggcatgcatcgtttcagaggaaatatttgggattttgacaatagacccaaggtcatgaacacactgggatatccattgcctatgaatgatagaattccagaaatcacagaagcaaggaacatagagcttggacttggtcttcagttgtgcttcttgcatccctcaaagcataagtttgagcatccaagattttgtttagaacgcctggagtatgttggacagaaaattcaggatctagtgatggcggagaggctgctcatgaagcatctcgatgcacccggtaggtggttggcagagaagcatcggaggttgctaatgaacaaatactgcggacgatacctccgggacaagcacctgcaccactacattatctacggggagtcggtgcaagacagatttgaacacaaccgccggctgagaaatccttccacgaccgccgtccagcaagcaatacacggccttgcttactgcgtctatggcaaaccggatgtaaggcgattgatgttcgaggtgtttgacttcgaacagatccaagcgcagacagttctgagtctgatccccgaagtcgaaaagcaggagtttgtaatagatctgcagaacatctttgcaaccaatgatacaagcagcttcatcttttacatatcagtgcgcaattcttcatcgttggtcatggaattaatcggtaatcggtttggttgcaacgaagcgagtaattctaatatgggccgtcaggcccaatttataagaggaggacgacgaggaggaggtttgcgaggcagcggcagggagaggaagatgtcttcgctgcggaacgcgatccagcggcgcgctcacaaggagcgcgcccagccggagtcgaggaagaagttcgggcttctggagaagcacaaggactacatcgttcgggcgaaggctttccaccagaaggaggaaaccatcaggaaattgaaggagaaggcatcatttagaaaccctgatgagttctattttaagatgatcaacagcaagactgttgatggaattcataggcctaagcctgaagcaaacaagtatactgaagatgaactcatgctgctaaaaactaaagatatgggatacatccttcagggtattcagagtgaaaagaagaaaattgaaaaattaagctccatgcttcatgaactagacaacaagcgaccaaacaagcatgtttactttgctgaagacagagaagaggtcaaagaaatacaatctagaatagaacaaaagagcagttcacttggtttggacaacatcccttcccgtataaagaggaaaactgcttcgtcctatagggagttagaggagaggaaacagagggttcaaaagcttgagaaactgtatgcagacatggccttgcagaaagagttgaagaaacctggacggaaaagaaaactccgtgaggatgagattgagaatcaaacatcccggcctgtttataagtggcgagcacaacggaagcggtaa

SEQ ID NO: 463 - DNA, 1488 bp, Oryza sativa
  misc_feature (825)..(825): n = any nucleotide
  misc_feature (1305)..(1305): n = any nucleotide
  misc_feature (1316)..(1316): n = any nucleotide
  misc_feature (1319)..(1319): n = any nucleotide
atgagagccgccgccatccagacccacgccctcgtatgcgcgccaccgggggccgccgccgccgcgctggccccatggccgcggcgcgctgccggcggcggcgggggaggacccctcctccaccaccaccggctgaggagcgacctgccccacacgcgctccctcccctgccgggctcgctcgccgtcgtcctcctcgtcgtcgaatgtgaattctgggagaggggacgacgcggacaacctgctcgaggatttgctcagcaagcatggcgaggtggtgtacaacgccggtggggctccgggcattgatgccgacgatgacgccgagtgcttgtcctttgctgtctccctagctaaagttgcaagcgaggtgaaggctgcggatattcgtgtactatttgtgaagccgctcgtttactggacgaggttcttcatcatcctcactgctttctcaaatgcacagattgatgctatcagctccaagatgagagacatcggtgagaagcagtttagcatagttgcatctggtgatacaaaaccaaattcatggaccttgctggacttcgactcaactgccacgggagggatggcgcagccggagaccttgtcgctggccgggcggcgggtggcgttcacgacgccgcagaccgacgccggcggcggcggctacggcggccggctccacgccatcctgcggcagcgcggcgcgcggccggtcccggtgcccaccatcgccatccgcgcgcacgacccggacatcctccgccccttcgtcgcgccgggcggcctcgacgccttcgcggcgctcgccttcacctcgcgctcnggcatctccgccttctcccgcgccctcctcccgtcctcctcctcccccgcgcggcggccgcggcaccccgtctccgacgccgccaccgcgctacccttcaccgtcgccgccctcggcagcgacgccgacctcctcgacgcggcgttcctctccaggctctgcggcgacgcgggcgggagggtgtcggtcctcgtccccgacgtccccaccccggccggcctcgtggaggcgctggggagcgggtccggcaggcgcgtgctctgccccgtgcccgacgtcgtcggcctacgcgagccgccggtcgtgccgggcttcctcgccgggctggaggcggccgggtgggtcgccgtgcgcgcgccggcgtacgtcacgtgctgggcggggccgcgctgcgcggaggctctggtggacgccgcggcgcccgacgccgtcgtgttcacctccaccgccgaggtggagggcctgctcaaggggctggangccgcggggtnganctggccgcggctgcgcgcgcgctggccccgcatggtcgtcgccgcgcatggccccgttaccgccgacggcgtcaggaggctgggcatcgaggtcgacgtcgtcggcgccaggttcagcagcttccatggtgttctcgacgccctcgccgcgaaactcgaatcagattga

SEQ ID NO: 464 - DNA, 1308 bp, Oryza sativa
atggcatctattccactggtggtagtacagctgctgctcctgctgcttccacttcccctccgagagcacctctggtcaggccaacaccggcgaaacgacgtcgatgccggcgagctccacccgatcgtcgtgttgcccggggtggcatgcagcgacctggaggcgcggctcacggaggcgtaccggccgtcggcggcgaggtgcggcgcgatgaaggggaaggggtggttcccgctgtggaagaacagctccgacctctcgacgcaccgctacaacgagtgcttcctggagcagatgagcctcatctacgaccccgtcgcgaacgactaccggaacttccccggcgtcgagacccgcgtgccctacttcggtctcgtcaaaggctaccatcagaaatggccttttgacaagccatggtgccttacaccgcttatacgagccctggaagagatgggataccgtgacggggacaacatgcacggagctccttacgatttccgtcatgttcctccagtccctggccaggaatcccaagtctactcgcgctactacgaggagttcatggagctcgtggaggccacaagcaagaggcatcgcaagaagaaggtgatcattctcgggcacagccacggaggatgcgtcgcccttgagttcgtcaggaacaccccgttggcgtggagaaaggagtacatcaagcacctcttcctggtcacgcctacgctctccgccgggctgctcgacccggtggagaaccttgccaccgggccgcacaacctgttctacgtgccagacgcgacggagctgtcgctgcggccaatgtggaggagcttcgagaccagcatcgccaacctcccgtccccggccgtgttcgggcgcgagccgatcgtggtcaccgagcggaggaactactccgcgtacgatatggaagatctccttgccgccgtcggtttcggtgacgggatcgagcctttcaggagacgaatggttgtgaggatgaactacctcgaggcgcccatggtgccgttgacgtatatcaatggagtggggaagaggacgccacggcaattggtgtactgggacggtaactttgacaaggctccggaaaaagtgtatggtgatggagatgggatagttaatctggttaccatgttagcgttcgacgaggagatgcgtcggcagccaggacagagggggcaattcaagtcaatcaaggtcgagaacgcttcccatatgggaattcttatggatgaatgggcgctaaagagggtcatgcaagagattcttgaagtgaatcaggattcttcgtag

SEQ ID NO: 465 - DNA, 3148 bp, Oryza sativa
atgcggtcgctcgcttgttgcgcggtgcttcttctcgcttcggttcttggatctacagcaggtactgatctgggtccttctcctgtggtcgctaactcgccagatgctcaagatcaaacttctagccctcctgaacctacaatcgccctcggtccagtaactcttccaacagcagcaccctctgctccatcagcaagccctcctgtggcgaagggcgctgtcagcccagctgttcccactcgaccacaaaatgcgcctactccagtaacaccccctaaagagaatataatgcgcctcctccagttgagcttacgcctcctgctcccactcatgtggcgccagtagctcccccgcaagctgcagttgaaaatcctgcaccagtgcttcctgggacacctgctttgttgccttctgttcaggctcctgctccatctgtggccaggaatcctaatctaccgatagtgcaacctccttctgtgaacaatccaccaagcagaccaattggatcagagggaatggcgtccctccgtatccaccacctcaaagaagtttacctgccattcctccttccacttcagaggagttccgcgagaaagtgtaaaacctccagttgcaccacctattattgcacaagcaccacgtcagcaagcactggcaccaagtagtgaccatagcaatgggaaactcagtgcccccagcaaatacatcacctccccataagaatagtcatattccacgtgcactgccaccaaaggaatccagtagtcaaactggcacagctcacaaaccgccaattagagaggatcagcacctgcagaaactcctttgccccagaacacaaatatgccagcagtcccaaagaatggatcatcagtttctcatgaccgacccccttcaacagtagctgctcctaaaccagcaacttctagcagataccatggtcggggtggggcaccgaagaaaggagaacaccttccatttgccccatcttatccaccatctcatgctcaagagggcctcatatttctccaaccatgccaccaatccctccccaaccagggccgaaagcaccatcagcccatcctatttgggcattacctccaccaccgcctaatctagagttggagtccgcttaagtgttgatctgtattcattctttccattggtatcgattttgcggaagaagtgtcatctggggtaaatatggcacagagacaggttcgtgttatgggtgcaaatgtagctggtgatcagcctgacaagacagtagttcttgttgacctagtaccaatgcaagtgaagtttgacaatgctactgcttttttaacgtttgaaaacttatggagcaaaaaaatttccctaaaaccatcagtttttggggactacgagattctgtatgttgtatatccagcagggcttcctccttctccaccttcagcaccggaaagtgttggtgacggggcatttggaaacaacagaaatgcaagggcaatgaagcctctcggggttgatgtaggcaggcccaaaaaaagagtcaacggcagcctaattgctattgccgtcttgtctactgttatagcattgattatttgcactctagctgcatggttgctgataatcagattcaggggttcggatggcttggctcaaagatttccacatagcgcacttccaaaattttccagatcatctgggtacaggtcaaacactgttagctggtcgctatagttcaccatcaggtccatcaggttcattgggctcaagtatcgcaacatatgcaggacaggcaaagacattcaaatttgcctgagattgagaaggccacaaacagctttgatgattcaacagtacttggagagggtggcttcggatgtgtctaccagggcacgcttgaagatggaaccagggttgcagtaaaggttctgaagaggtatgatggccaaggcgagagagagttcttggctgaggttgagatgctgggacgcttgcatcaccgaaatttggtcaagttgttaggcatatgtgtagaggagaacgcaagatgtctggtttatgaacttattccgaatggcagtgtagaatcccatttgcatgggagtggatcttgagacagcaccactcgattggaatgcccgcatgaagatagccttgggggctgcacgagctcttgcatatttacacgaagattcaagcccttgtgtgattcatcgtgattttaagtcaagcaacatcctattggagcatgatttcacaccgaaagtgtctgatttcggactggccaggactgcaaggggggaggggaaccagcacatctccactcgtgtcatgggaacatttgggatatgttgcaccggagtatgccatgacaggacatctccttgtcaagagcgatgtgtacagctatggagtagtgttgcttgagctcctcaccggtagaaagccagtggacatgtctaggcccggggggcaagaaaacctagtttcatgggctcgcccgcttctgaccaatgtggtaagcctacgtcaagctgttgatccacttcttggccctaacgtacccctggacaatgtcgcaaaagcagctgccatcgcatcaatgtgtgtacaacctgaggttgcgcatcgcccgagcatgggtgaagtagtgcaggccttaaaacttgtttgcagtgacggtgatgagggcctcggatcaggaagtttcagccaggaattggcggcacaagctgcagcaatctatgatgtaactggcatggaagctgagagggtgctgttatctgagatgtttggctcaacccctgtcttcactcccgctgcggattcaggttctttccgaaagcagtccagctcaggtccactgatgacaggcaagaacagaaagttctggcagagattgcgaagcctatcaagagggagtatgagtgagcatggtgcctcaccagattttgagacgcgctcgcagtgtagtaatagagaagaaactgccatgtaaatctgacagaattgcttctgttcttccatacctctaacccagtggatgatgctgctgcatcagcaacttgcgagagttgatatgctttcttgagaatatggcataagtgctctgtttactacaaagtattttttttcagagaaaaagccgctttag

SEQ ID NO: 466 - DNA, 2214 bp, Oryza sativa
atggggagaggagggatcggcggcgcggggctggtggcggcggtcgcgaaggcggacgtggagaacaccgactccacccgcggcttcgtcaaggacgtgaagcgcatcatcatcaagttaattcgacaggtcggcaccgctgttgtgactgggccgaatggccggttggctatgggcaggctcggtgctctgtgtgaacagctaaattttgaggggtacgaggtgattctggtcacctctggtgctgttggtgttgggaggcagaggctcaagtaccggaagctcgtcaatagcaggttgcagagagagtttcgctgatctgcagaacccacagatggacatggacgggaaggcctgcgctgccgtcggtcagagtgtgctgatggcgatctatgacacgttatttagccagcagcttgacgtaacatcatctcagcttcttgttacggatcgtgattttatggatccaagttttgggaaccagctccgcgagactgttaattctctgttagatctcaaggttataccagtatttaatgagaatgacgccatcagtaccaggaggcaaccatacgaggattcatctggcatattctgggataacgatagtttggccagactgttagcgcaagaacttaaagctgatctccttatcatgctcagtgatgtggaggggctctatagcggtccacctagcgatccacaatcgaagattatccacacatacgtccatgaacaacatgggaagttaattagctttggggagaaatctcgtgtgggaagaggtggaatgcaagctaaagtagcagctgcttttactgcttcatcaaaaggaatacctgttgtaattgccagagtggatttgcaatcgatagcattattaaggtcatgcgaggagagaaaatcggtacgcttttccatagggaagcaaaccagtggggttgttccaaggaagcaacagcgcgtgagatggccgttgctgcaagagattgctccagacatctacagcagaaattgtcgtctgaggagcgtaagaagattttgctagacatcgccgatgctctagaagcaaatgaagatctaattacatccgagaaccaagctgatctggatttggcgcaagatattggttacgataaatcattggttgctcggatgaccataaagccagaagataaaaagcctcgcaggatcaattcgtgaaatcgctgatatggaggaccctatttcccatacactgaaaagaacagagccattgggtgttctcctaattatttttgagtcccgtcctgatgccttggtacaggtacagattgcatctttagcaatccgaagtggaaatggtcttctcttgaaaggaggaaaagaagctatgagatcaaacacaatactgcataaggtattatggtcataactggtgcaattccagatgttgttggtaaaaaacttattggcctagtgaaaaacaaagatgaaattgctgatttgctcaagcttgatgatgtgattgatcttgtaataccaagaggtagcaataagctcgtttcccagatcaaagcagcaaccaagattcctgttcttggtcatgctggacggtatctgccatgtttatattgacaaatcagctgacatggacatggcaaaacgtattgtattggacgcaaaggttgattatccagcagcgtgtaatgccatggaaacgttacttgttcataaagatctgaacaggacagaaggccttgacgatttattggtggagcttgaaaaggaagggggtagttatctatggcgggcctgttgcacatgacactttgaaactaccaaaggtagattcatttcatcatgagtataactcaatggcatgcaccctcgaatttgttgatgatgtgcagtcagcaattgaccatataaatcgctatggaagcatttcagtgcacacacagattgcattatcactactgatggaaaggcagcagagacttttctacagcaagttgatagagtgctgcggtattccataatgcaagcacacggttctgtgatggggctcgctttggtctaggtgctgaggttggcataagcacagggcgcatacatgctcgggggcctgttggcgttgatggactcctaacaactcgatgcgaggaagtggacaagtagtgaacggcgacaagggagttgtttacacccacagggagctccctttgcagtgag

SEQ ID NO: 467 - DNA, 1582 bp, Oryza sativa
atggctacaactctctccaatggtgtttcacagaatggccctcagaggaactatcaggtagttgttgctgctactcgcgacatgggcattggaaaggatggggtcttgccatggaagctccttggcgaccttaaatttttcaaggagcttacagtgactacagctgatcctgtgaagaaaaatgctgttataatggggaggaaaacatgggagagtttaccccttaaggctaggccattgcctggccgtttgaacatcatattgactaggtctggtagttttgagtttgcaacagtcgaaaatgttgttatctgtggaagcatgaactctgcattggaactactatcatcaactccatactgtttatccattgagaaagtttttgttatagggggtggacaagtactaagagggaatctcttaatggaccttcatgtgaggcagtccatttaactgacattcagtcaagcattgagtgtgacacctttattcctccgattgacttatcggtgttccaaccatggtattcatctttgcctgtggtagagagcaacattaggcattcgtttgtgacctatgttcgggttagaaaaacaatggcagaaacacatgactcaaatggcaaggaatcagctaatgatggtatcaagagtgacaaatttgaaaccgagaatttctcttttctccctaagttgatatttgaccgccatgaggagtatcactatctcaatcttgttgaagatattataaggagtggtgctcagaaaaatgacagaacaggaacagggacattatcgaaatttggttgtcagtcagatgcggttcaacttaaggaatagcttcccattgttgacaacaaagagggtattttggaggggtgttgttgaagaactcctgtggttcatcagtggctcgacaagtgcaaagaggttttacaagagaaaggcattcatatttgggatggcaatgcttcgagagagtatcttgacagagtgttggcttagcacatagggaagaaggtgatctaggtccagtttatggatttcaatggcgacactttggtgctgatataccgacatgcatgctgactatactggtaaaggctttgatcagctaatggatgtgattgacaagatcaagaataatcctgacgataggcgaattatcctatctgcgtggaatccttcagatctcaagaagatggcccttcctccttgccacatgtttgcacaattcttccagttttatgttgagagcggggagctatcgtgccagatgtatcaacgctctgctgatatgggacttggtgttccattcaacattgcatcatattctcttctgacatacatgattgctcatgtttgcgtctttctcctggagagtttgtccatgttattggtgatgcccatgtctatagaacacatgtgcgagctctggaggagcaaatccagaagctacctaaaccatttccattttgaagattaaccctttgaagaaggatatagattctttcgtggcatcagacttcaagctggtcggttatgatcctcaccagaagattgaaatgaaaatggcaatataa

SEQ ID NO: 468 - DNA, 1247 bp, Oryza sativa
atggaggcggcgttcgacgcttacttccgcgccgcggatctggaccgcgacggccggatcagcgggcaggaggccgtcgccttcttcaaggcctccgctctcccccaacccgtcctagcccagctgctgcagatctggacgtatgctgataaaaatcgaactggttttcttggccgtgaagatttctacaatgctcttagacttgtcacggtagcgcagagtggccgagaactgacaccggatattgttaggtcagcgttatatggtccagctgctgcaaaaattcccgctcctaggataaatgtttcagactccaaggcattggtgcctttggggaatggacaagctccatggccgaaaatcactcaagcagatgtagacagggaccgagatggaaaaattactggtgaagaggctaggaatctgttcttaagttggaggcttccaagaggtgtgggatttgtccgaccaggataaagatgggatgctatctttccgggaattttgtactgctgtgtacttaatggagaggcacagagagcagcgtcctcttcctgatgtactaccagatggattcgagagagaagactgagttctatcgcacaaagatgcaggagcttctttacaaaagtaggtgcgataacaggtttaatgaagtttcagaaaggatgtctgctgataaacgtgaggtactgttctcctcttgcagcgaaatatgatgagagatgtaagaaggttggagatgtagcatcaaagttatcgatggatgaggccactttccgtgagattcagcgagctaaccagatacaatctgatcttgaggagcttgttaaatctttgaatgaacagtgcaagagatatgggttgagagctaagccaactactcttgtggagcttccttttgggttggcaacctggaatacaagagacagcagctgtatgggatgaagaatgggacaaatttggtgatgatggttgattcttctgttcccagcacacctgacagcttttcaagatttgattccttccggagcaacgctgatcaaggcagcaatgacacctttgttcacgaggtatgattccatgaatagcagcagcgaccatgacagaacagatgcttttgcgagatttgattcaatgaagagcacggactacaacagccgagactggaccgttcaagtcatcagacacctctagcccgacgaagcatggaaccgacagatggagtgcattttgacaggtattga

SEQ ID NO: 469 - DNA, 608 bp, Oryza sativa
aagcggaggattctatctgcagtggttaaagtatccgcctaggctttggttttttattttccttagtcaaacttgtgattgccagaacctctcccgagggaatttcccaaggatgaggatcaaagccttgtgaagaggaacaagaggatgctggggaagcttcttgtcggtacattagagctgcgtgctcgagtagctgctaaggcagaagaaaagaggttggagctgttatacatgcagtgggctgagcatcacaaaaagctgtccaatttcttaagtttgtcaggacaactgcggaaccaccaatttactacatgccagctaaaccaataattgatgatccggctattgctgaggagaacaaggaaaagtttcaagaatggaaatctgaacgcagggctgagctaactcagtttcaaaagcaagtcgaagaacagtacatgtctaatgttgagaggcagttggaaaggatgcagaatgcgcggaatgcacggaggggtaatggtccttcaaacatgcaagaaatggacaaggagctggacacgcacagggcggagcatggtccaaaaactcgacgagttcttgagggtggcaatgacgatgaggat

SEQ ID NO: 470 - DNA, 6090 bp, Oryza sativa
  misc_feature (892)..(892): n = any nucleotide
  misc_feature (3590)..(3590): n = any nucleotide
atgtccacagttgctcaattgttggagcaactccataaagaagtgacgactaaaagattgcttgaactggccaaagaaaaaaaggaagcaagggttttgataggtagccattctcaggcgattccactatttatatctatccttagaagtgggacatctatagcaaaagtaaatgctgcagcactacttagcgcactctgcaaggaagaggacctgcgtgtcaaggtcctgttaggaggttgcataccacccttgctctctcttttgaaaaaggcggctgctgaagctatttttgaagtgtcttctggtggactttcagatgatcatataggtatgaaaatatttgtgacagaaggtgttgtgccaaccctctgggacatgctcaaacctaagtcacaccaagataaagtagttgagggttttgtcactggtgccttaaggaatctctgtggagacaaagatggttattggagggccaatcttgaagctggtggagtagaaattataactggtcttatttcatctaagaatactacttcacagtcaaatgctgcctcccttttagcacggttggtatctgcctttggtgatagcatccccaaaattattgatgccggggctgttaaggctcttcttcgcctcctaaatcgagacaatgacatttcagttcgtgaaagtgcggccgatgctttggaggctctatcttccaagtctagtattgcaaagaaggctgtggtagatgctggtggcattcctgttctcattggagcagttgtagctccttcaaaagagtgcatgcgtggggatacttgtcattctctacaaagtcatgctgttcatgctttatcaaatatctgtggtggaacagtatctctgttgctttatcttgganagctctgccaggtgcccagtccacctgttcccctcgctgacattcttggtgcacttgcatatacattgatggtatttagtggcactgatgtttgatccgattgagatagaaaatattttgattgtgctcctgaagtcctatgatagtaatcttgtgcttgatcgtattcttgaggctttagccagtctatatggaaatgcatgtctgtctggtaggcttaatcactcgaatgcaaagaaggtccttgttgggctgatcactatggcttctgctgatgtgcagaaaaatcttgttcatgctttaacgagcttgtgctctgatggtattggaatatgggatgctctaggaaagagagaaggaactcaattgctgatatcatttcttgggctttctagtgagcagcatcaggagtatgctgtttcattgttggctatattgagtgatgaagtagatgacagtaaatgggcaataaccgctgctggaggtattcctccacttgtccagctactggagacaggatctcaaaaagcaaaagaagatgctgctcatatcttgtggaacttgtgttgtcacagtgatgatatcagtgcatgtgtcgagagtgctggggcagttcttgcattgctttggcttctaaagagtggtagccctcatggacaagaggcatcagctaaagcactcaagaagattatacggtctgctgattcctccacaattaatcagttacgagcactgctgcttagtgactctcttagtacaaaggcccatgccattacagttcttgggcatgtacttgtgatggcttcccagagagatctagtgcagaatggagctccagccaataaagggctcagatctcttattgatattcttgagtcatcaaatgaggaaactcaggaacaagctgcaactgtggtggctgatattttcagtacccgtcaggatatttgtgatatcttaggaactgatgaaattattcagccatgcatgaagcttttgacaagtgggaaccaagttattgcaacacaatctgctcgagctttaggagcactctcccactcggctaatgccatgttgaagaacaagatgtcatgcatagctgaaggctatgtgcaaactcttatagagatgtcaaagtcaccatccattgatgctgctgaaacaacaattgctgcattggcaaatttcctatcagatgcacatattgccaaggaagcactagacggcaacatcgtcctggctttgactagagtacttaaggaagggagcttggaaggaaagattagtgcttcacggtcgctctgtcagttgctcaaccagttccccctcaatgaagttattccagattactcgcagtgctattttataattcatgcactgctggtgtgtctatctggcatcaatttagaaaatgctactaatttggatcccttgaatgtacttgcatggatggctaggaccaaggagggcgcgcactttagttctcccttgtggtctgcctttcttgatgttccagaaagcttagagcctttagtgcgctgtatcagtgttgggcttccaccgattcaagataaggccattcaaattcttgcaagtttatgtcaggaccaaccttctctacttggtgagcatttgaacagaagtcaaggatgcattgcttcccttgctagtagagttattgaatcaacaaacatggaaataagaattggcagtgccatcaccctcatatctgcaatgagacacagcagggaacactcaattgatgttattgaagcatcagggcatctgaagaatctaatatctgcatccattgatatgatgaagcaagattctgccccaacatccctagatattgaagttacagttgcgctttggttgctctcacttatttgttcttctcatttgagtagtaaacttactgttatggacctcggtggtgttgagactatatctgataaaacttgctagctacaccactaatcaacaggcccttcttttggctactttatttcaggattcaatgcttgttcaatctccagcaataatgcgaacaataccttctttagcttcgttgctaaaatcagacaagatcattgacaaatactttgctgctcagtcactggctagccttgtttccactggaagcagaagtatacagcttgctattgcaaattctggtgcagttatgggtactatagctatgattggacagatcgaatctactatgccaaaccttgttgctatggctgaagaattcaagttggcagataacccaagtaaaataatattgagaagcctttttgagcttgaagatgtccgtacgagtgctactgctcgaaggtccattccgttgcttgtggatctacttaaaccaatgccagacagacaaggcgcacctctggttgctttgcaccttctgactcaactagcggaaggcagtgagacaaataaagtagctatggcagaggctggagtcttggatgctttaacaaagtatctatctttaagtcctcaagactcaactgaaactactataatcaatctactgcggatcctatacacaaaccctgatcttctttaccatgaatcctcaattagcacttcaaatcaattggtagctgtcttacgtctgggctcaagaaattctaggcttaatgcagcaaggacgttacagaacctctttgattcagagaatatnagagacactgaagtggcttggcaagctattccgccattacttgatatgcttgagtcaggaactgaaacagaacagcaggcagcacttggtgctctaatcaaactttcttctgggaatatctcaaaggcttcagctttgtttgatgtagaaggcactacacttgaaagcctctacaaaattttatcctcattggagcttaagaatgatgccgctcagctctgctatattctttttgagaattctactataagggcatcacccattgcctctgaatgccttcaacccctgatatcattaatgacgtcaggctctacttttgttgttgaacctgcagttcgtgctctaaataggctactggatgaggagtacaatgcagagattgctgccactagtgaagttgttgatcttcttgttagttttgttcctgggactaatcaccaactgtctgaggcatgtattggtgctctcataaaattgggtaaggaccgtcccaactgcaagcttgagatggttaaagctggcattattgaacatgtgcttgatatgattcttgatgttcctgtttctgttagttcatcgattgctgagttgcttcgcattttgacaaacaacagtggcattgctaaaagttctgctgcagcaaaaatggtagagccacttttcttgcttttacgtcgcccagatgtcactatgtgggaccagcatagcgcattgcaagctcttgtaaatattctagaaaagcctcaaagtctcgcggcattgaagttaagtcccagtcaaataattgaaccgttaatatcattccttgagtctccctctcaagcaatccagcaacttggcactgaattactgacacatcttctagagcaggagcatttccaacaggatatcactacaaaaaatgcagttgtccctctggtgcagcttgctggtattggaatcttgagtttacaacagactgcagttaaagcgcttgagagcatatctcagagttggcctaaggctgtagcagatgcaggtggaattcttgaactttcaaaggtaattgtccaagatgatcctcagccaagtcaagcattatgggactctgcagcacttgtattatgtaatgttttgcgctatagctctgataactatgtccaagtgtcaatagctgtacttgtaagactgctgaattccaccatcgagagtactgttacaatagctctgaatgctcttcttgtgcaagagaaaagtaagtcacgctgtgctttagccatggctgaggctggggctgtgcgtgctctgttaaagctccttaagagccatcgttgtgaggaatccgctgcaagattgcttgaagctctgataaacaatgcaagggtccgggagacaaaagttgccaaatattctattggtcctctctcacagtaccttttagatccccagtctaagaatcagtcagccaagttcttggttactcttgcactgggtgacattttccagcatgaagcactcgcaagagcaagtgactctgtatctgcttgccgtgctcttgtaagcgtacttgaggaccagcctacggatgatatgacaatggttgctatttgtgcactacaaagcttagttctgcacagcaggacaaataggcgtgctgttgcggaggctggaggcattttggttgtacaggaattgcttctgtctccaaatgtagatattgcaggacaggctgctcttctaatcaagtatctatttttaaaccatacacttcaagaatatgtttcgaatgagctcattcgatctctcactgctcgcagctgccttggaaagagagctactctctacatcaaccatcaatgaagttattttgaggactatacatgtgatattcaacaactttaaaaaagtccggttttctgaggcagcaaccttgtgcataccccatttggtttgtgccctgaaggatggaaatgaggctgcccaagaaagtgtgctcgacaccctttgcttgctgaaagaatcttggccacaaatgaatgaggacattgcaaaagcccaatccctgatttctgctgaggcgatacctgtactacaaatgcttatgaagacatgtcctcccagttttcacgagagagctgatagcttgctgcaatgcttacctggttgcctgacagtgaccatcttacgtgggaataacttaaagcagacaatggggagtacaaatgcattttgctgcctgcaaataggaaatgggcccccaaggcaaactaaggtggttaacaatagcatctgcccagtatggaatgagggtttcacttggttatttgatatcccaccaaaggggcagaagctatacatcttgtgcaaaagcaaaaacacgtttggaaagacactcggtcgagtcaccatccagatcgacaacgttgtcaccgagggtgtatacagtggtttcttcagcctttcgagaaccctagagatagagattgtatggtctaataggccatccaatgacaatatgtag

SEQ ID NO: 471 - DNA, 5386 bp, Oryza sativa
  misc_feature (1142)..(1142): n = any nucleotide
  misc_feature (2895)..(2895): n = any nucleotide
atgtcggggcagcaggccgggctgaaccggcgcgggtcgaggagcgcggcgatggcgacgttctccatggaggtgttcgacaacgaggtggtgccgtccacgttgagcagcatcgccccgatcctccgcgtcgccgccgagatcgagcccgagcgaccccgcgtcgcctacctctcggttttacgcgtttgagaaggcgcaccggctggatcagaactccgtcggccgtggcgtccggcagtttaagacggctctgctccaacggctggagaaggataacagtcccagtctcgcgaaacgcgtgaagaagaccgatgcccgcgaaattgagagcttctaccagcagtactacgagaactacgtccgtgccctcgacaaaggggaacaagccgacagagggctcaacttggtaaggcctaccagacagccggagttctcttcgaggttctctgcgctgtcaacaagaatgagaaggtcgaggaagttaatccggaggatgtgcaagagaagaaagacatctacacgccattcaatatccttcctcttgatgccgccagtgcatctcagtccatcatgcagatggaggagaaagcagcagttgcagcgctgcggaacacgcggggcttgacctggccttccacatttgagccagaaagacagaaggggggtgatcttgatttgctggattggttgagagctatgtttggctttcagcagagggacagcgtgagaaatcaaagggagcatttaattctcctccttgctaatgtgcacataagacttgagccaaagccagagccacttagcaagcttgatgatcgtgctgttgatgaggtgatggctaagctattcagcaattacaggaagtggtgcaactttttgtcacgaaagcatagtttgagccacaggaaattcaacaacgaaatattttgtttctaggtctttatcttctcatttggggtgaagcagcaaacatccggtttatgccagagtgcctttgctacatctttcacaatatggcatatgagttgaatgggctgcttgctggaaatgttagtattgtgacgggtgaaaatatcaggccatcttatggtggggatgaagaagctttcttgaagaaagtagtcacacctatctatcgngtcataaaaaaggaaaaacaccacactcagcgtggtgcaattacgatgatctaaacgagtacttctggattgtttctcgttgggttggccaatgcgggatgatgtctactaaaagcacagggaagatgaattttgttgaaacaagaacattttggcacatcttccgtagttttgacagaatgtggaccttctatctgttggctctgcagcaggcaatgctgatttttgcttggagcgattatacactatctcaaattcttcagaaggaccttttatattctctatcaagtatatttgtcacagcagcatttctacagttcctccaaaattttagactttgttctgaacttccctggtcatcataaatgcaagttccttgatgccatgagaaacattctgaagataatagctagtgctgcgtgggctgtgatccttccatttttctacattagcaccgcatctaaagtcaatttaccaattaaagatctggataaatggtttcaatatgttaaaggagttccacctctatatatcctagctgtggcagtgtacctgatacctaatatcctaagtgcagcactcttcctgttaccatgtttccggaggtggatagaaaactcagattggcgtattgttaggttgcttctgtggtggtctcagcagaaacgaatttatgttggccgtgggatgcatgaaagcagtgtttcactttttaatatacactattttggatcttgctgctatgctccaagtttgcattcagttattttgtccagcagataaaacctctgatcaagccaacaaaggacataatgaatgttcataatattcattatgagtggcatgaattctttccaaatgaatgttggtgctgtcatgtcgctctgggctcctgtactcttggtctatttaatggatacacagatatggtatgccatcttctctacaatatctggtggtgtgtctggagcacttggaagacttggagaaatacgaacattaggaatgctgagatcacgatttcattctttgcctggggccttcaatacatttttggtgccgtcagataaaagacgaaacaggcgcttttcactctcaaagcgcttcgctgaggtcgtttctcccagcaagagaactgaggctgctaagtttgctcagttgtggaatgaagtgatatgtagtttccgggaagaagatcttataagtgataaagggaaatggacttactggtggttccttattcgtcagaccccagtcttaaactgatgcagtggccactcttcttgcttgctagcaagatacctatagctttagacatggcagcacaatttcgaccaagagattccgatctttggaaacgtatatgcgcagacgagtatatgaaatgtgctgtactggaatgctacgagtcattcaagcttgttcttaatttactcgtaattggagaaaatgagaaaagaggattattggtattatcataaaagaaattgaagctaacatcgcaaagaacacattccttgccaattttagaatgagcgcactgccagtcctgtgcaagaaatttgtggagcttgtatctgccctgtccaaatttgacaatgtagtattgctgcttcaagacatgttagaagtaataacaagagatatgatggtcaatgaaatcaggagctagctgagtttggtcatgggaacaaggattctgtaccaagaaggcaactttttgcgggtactggtacaaagcctgcaatcgtcnttccacccccaatttcagcacagtgggatgagcagcagatcaagcgtctgtacctccttttgaccgtgaaagaatcagcgatggacgtgcctacaaatcttgaagcccgtcggaggatagcatttttcactaattctttattcatggacatgccacgtgcacctagagtacgcaaaatgctgtcattcagagcgttatgactccatactacagtgaggaaactgtatattcaaggaatgacctcgatctggaaaatgaagatggtgtctcaattatattctacctgcaaaagatttttccagatgaatggaataattttttggaaagaattggttgccaaagagagagtgaagtttggggaaatgaagaaaatgtcctacaacttcgtcattgggcttctcttagagggcagacactctgtagaacaggttagaggcatgatgtactacaagagagccttgaagcttcaagcttttcttgacatggcttctgagtctggagatattggaaggatataaagcagttgcagatccagcagaggaggagaagaaaagccaaagatctctgtcatctcaacttgaggctatagcagacatgaagtttacatatgttgcaacttgccaaatatacggcaatcagaaacaatctggtgatcgacgtgcaaccgatatcttaaacttgatggtgaacctggtttgcgcgtggcatacattgacgaagttgaagagagagacggtgaaaaggtgcagaaggtcttctattcagttttggtaaaagctcttgacaatcatgatcaggaaatataccgcataaaattgccaggaccagcaaaattaggtgaaggtaaaccagaaaaccagaatcatgcaattgtctttacacggggtgaagctctccaaacaattgatatgaaccaggacaattatttggaggaagctttaaaaatgcggaatttactggaggagtttcacgagaaccatggtgtgcgccagccaacaattcttggtgtgcgtgagcacattttcactggaagagtgtgtcctctctcgcgtggtttatgtcaaaccaggaaacaagctttgtgacaattggacagagagtactagctaatccattgaagtacgttttcactacgggcatcctgatgtatttgatagaatttttcacattacacgaggtggcattagcaaggcttcctgtggtataaatttaagtgaagacatttttgctgggtttcaactcaacactgagacgtggaaatgtcacccaccatgaatacattcaagttggcaaaggacgagatgttggtcttaatcaaatttctctctttgaagctaaagtggcatgtggtaatggagagcaaacactcagcagagacatctatcgcttgggtcaccgctttgactttttccggatgctgtcgtgctactttaccactgttggattttatatcagttcaatggttgtcataattgtctatgtcttcttgtatggaagactttacctagcattaagtggactcgagttagcaattatgaagcaagcacgaatgagaggtaacactgctcttcaggcggctatggggtctcaatctattgtgcagctaggtcttttgatggccttacccatgtttatggagattggactagaaaggggttttagaagtgccctaggggatttcatcattatgcagcttcagctctgctctgttttcttcactttctcccttggcacaaaatcacattactttggccgcacaattctgcatggtggtgccaaatataaagcgaccggcagaggctttgtagttcgccatgtaaaattccctgaaaactatagaatgtactccagaagccattttgtcaaaggacttgagctcatgttattgctagtggtttatcagatgtatggtgatgtggctacagattcgactgcatatatacttctgacatcatcaatgtggttcctggtaatcacttggctgtttgcaccattcctcttcaacccatcagggtttgagtggcaaaaaatagttgatgactgggatgactggagcaagtggattagcagccgtggtggtattggtgtgcctgctaataaagcttgggagtcctggtgggaagaggagcaggaacatttgcagtctacaggttttttcggccgcttatctgaaatcatcttgtctctccggttcttcatcttccaatatggtatcatgtatcatctgaatatctcagctggaaacaaaagcatctctgtttatggtctgtcgtggctggtaatcgttgctgtggtgatggtcctgaaggtatccatgggaagaaagaaattcagtgcagacttccagctgatgttccggcttcttaagctgttcttgttcattggatccattggaactctggccattcttttcacccttttgcatctaacagtcggtgacatattcgccagcttccttgcctttgcaccgacaggatgggccattcttcag

SEQ ID NO: 472 - DNA, 3513 bp, Oryza sativa
atgggtggcatggataaaaaccatccttttgggattggacaaatggaaaatggcaatgggagctatgcatctgaggcagttacatctgatgagaattctgcagatggcagtggcattgttgtggagccttacgggatcccatgcatggtggagatttttcatttcctctgctccctcctcaatgttgtcgagcaaattggagttgatgaagatctgccattgtttgctctgaagttgatcaattcagcaattgagcttggtggatcttcaattcgtaagcacccaaaattgctgtcattagttcaagatgagcttttccgaaacctaatgcagtttgggttgtccatgagcccacttatcctttcaatggtgtgcagcattgtgctaaatctttatcatcatctccggactgagctcaaattgcagcttgaggcattcttttcttgtataatcctaaggcttgcacaaccccgattcggagcaacatatcatcagcaggaggttgcaatggaagctcttgttgatttttgtcgacaaaagaatttcatggtggagatgtatgccaatctggactgtgacataacctgcaggaatatttttgaggaacttgcaaatcttctgtcaaagagtgcatttcctattaactgcccattgtcttccatgcacattcttgctctggaaggtctgatctctgtgatccaagggatggctgatcggattgggaatgctacttcacgccctgagctcctgcctgtggagcttgatgaatacactcccttctggactgttaagtgtgagaatttttcagatcctcagcattgggtgaagtttgtccgtcaaagaaagtatgtcaaaagaagactaatgattggtgctgatcacttcaacagagacccaaagaagggtctggaatttcttcaaggcactcatttgttgcctgagaagcttgatccccaaagtgtggcttgttttttccgctatacagctggtttggacaagaatcttgtaggagactttctaggcaatcatgatgagttttgtgttcaggtgcttcatgagtttgctcaaacctttgacttccaggagatgaaccttgatacagctctgagactatttttggagacatttcgtctgcctggagaatctcagaagatacagagggttcttgaggctttctcagacagatactatgagcagtccccacaggctttcgcaaacaaggacactgctttagtgcttgcttactcaattataatgctgaacactgatcagcataacatgcaagtaaagaagaaaatgactgaggaggacttcatcaagaacaacaggaacataaatgggggtagtgaccttccgcgtgagatgctgtctgaactataccactccatatgccgaaatgagattaagaccacaccagagcagggtatgggatattttgaaatgtctcccagccgctggatagatttaatgcggaagtcgaagtcaacatctctgtatatagttggtgattctcagccctttctggatcatgatatgtttgctatcatgtctggtcctactattgctgccattgcagtggtgtttgatcattcggaacatgaagaagttctgttggcctgtgtggatggcttcttgggtgtcgcaaaaatctcagcatttcatcatcttgaagatgttttggatgatcttgtcgtttctctctgcaaattcaccactcttttaaacacctctttggttgaggaaccagttactgcctttggggatgacctgaaggctagattggcaactgagacattgtttaccatagctaatagatatggggactacatacgtactggctggaggaatgttttggattgcatattgaggctgcataagttaggccttcttcctgcccgtgttgctagtgatgcagctgatgattcagaagtttctgctgaaactgtccaaggaaagcctactcatagctcaatttccacatctcatattccagttatgggtacgcctcggaaatcctctggacttatggggagatttagtcagctgctgtcacttgacagcgaagaaccaaggtcacagcccactgagcagcaacttgctgcccatcagagaactctacagacgattcagaaatgccgaatagatagtatatttacagagagcaaattcttgcaacctgattcactattacaacttgctagggcactgatttgggctgcaggacgacctcaaaaggttgccagctcaccagatgatgaggacacagctgtattctgtctggaactgctaatcgcaattacgcttaacaaccgagaccgaattgtgcttctctggcaaggagtttatgagcatattgccaacatagttcagtcaacagttatgccatgtgctcttgtggagaaagctatttttggacttctgcgcatatgccagaggttattaccatataaagagaaccttgcggatgagctgctgaggtcattgcaattagttctcaagctggatgcgcgtgtagcagatgcatactgtgaaaacatcactcaggaggttgcacgccttgtcaaagcaaatgctggacacgtaaaatcacaaatgggctggagaactgtagtgttactgctctccattacagctcgacaccctgatgcttcagaagtaggctttgaggctatcatgtatatcatgtccgagggtgctcacctttcactatcaaattatgctttctgtatcgaagcgtcacggcagtttgctgaatccagggttggtctaattgacagatccattcgtgccctggatctgatggctgattcagccaatagtcttgcccgatggtcacaagagacaaaagggacaggcgaggaaactgacaaagtgttggaagcaatcagggagatgtggctcaaattgctgcaagcactgaaaaagttgagtttggatcagagagaggaggtgagaaatcacgcgctaacttcgcttcagcgatgcctaacagcaacagaaggggtgtgccttcagagctccacatggtcacatgctttcgatctcgtcatattcgcgctgctggatgacttactagagatcagccagaatcactcgcagaaggactacaggaacatggaaggatcccttgtgctcgccatgaaactagtcgcgaaggtctatctgcaactactgccagatctttttgggctaagcagcttctgcaagttgtggctaggagtcctcagccggatggagaagtacatcaagatcaaggtccgtggcaagcgcagcgacaagctgcaagagctgatccctgagctgctcaagaacattctaattgcgatgaagaacagggggatcctcgcaaagaggagcaccattgggggcgacagcttgtgggagttgacatggcttcatgcgaataacatctcgacgagtttgcagtctgatgttttcccaagccaggagtatgagcagcacagcagtgccggtagcccgagaggacccaacggcgttgagtcccgggactag

SEQ ID NO: 473 - DNA, 3159 bp, Oryza sativa
atggggattcttgggagttttttggtgctgctcctgcttgctgcccctgcatttggccagctaccttcacaggacatccttgcgctccttgctttcaagaagggcatcactcatgaccctgctggattcatcaccgattcgtggaacgacgagtcgattgatttcaatggctgtccggcttcctggaacggcatcgtgtgcaatggcgcaaacgtggcaggggttgtgcttgatggccatggcatctccggtgtcgccgatctgtccgtgttcgtcaatctgactatgcttgtgaagctctctatggccaataacaatctgtctgggagcctgccgagcaatgtgggtagtctgaagagcctgaagttcatggatatctcaaacaaccggttctcggggccgattcctgataacataggcaatctccggagcctgcagaacctgtcgcttgccaggaacaacttctcagggccactgcctgactccatcgatgggcttgcgtcgcttcagtcactggatgtgagtggaaactctttgtctggtccattgccttcatctctgaaaggtctccgcagcatggttgctctgaacctctcatacaatgccttcacaaagggcatcccatctgggcttggccttcttgtgaatctccaatctttggatctaagctggaatcaattggaaggcggtgttgattggaaattcttgattgagtcaactgttgctcatgttgacttcagtgggaacttgctcaccagtaccacccccaaagagctcaagttcctggcagatatttcagagacagttctatatctcaacttgagcaacaataagttgactgggtcattgattgatggagttgagctctcgaacatttgggagattgaagggttcaattatgtctatgatcttgaagttttgcgactggcaaacaatgcattcacggggtttgtacctagtggacttctgaaaggggattctctggttctcagtgagctggacctgagtgcaaataatctgactggacacatcaatatgatcacatcgaccaccttgcaagttattaatctttcctccaatgctctctttggggatcttccaatgcttgctggaagctgcactgtgttagatctgtcaaataacaagtttaaaggaaatttgtcagttattgccaaatggagcaatgatttggagtatgttgatcttagccagaacaatctaactggaacaattcctgatgtgagctctcaattccttcgcttgaactacctgaatctttcccataattccctagctgacaccatccctgaagctgttgttcagtaccccaaactcactgtccttgatctcagctccaatcagttcagaggtcctattcctgctaatttactcacttcgtccatgctgcaagagctctacatccacgacaatatgcttagtggaggtctatcatttccaggatcatcgtcaaaaaatctgagtcttcaagttcttgatatttctggaaatcactttaatggcagcctccctgatgaaatagcatctttatctagcctccaagctcttgatatatctacaaacaatttctctggtcctttgccagcctctatcaccaagcttgcagcgctcactgctctcgacatatcaataaaccagttcactgggtcattgcctgatgcacttccagatacattgcaatcattcaatgcctcttataatgatctatctggtgttgttccagtgaacttgaggaagtttccagaatcttccttccatcctgggaactcgagactagactatcctgctagctcttctgggtctggcagttcctctggttcagctggtggcaggtcactcagtgcagcagctaaaatagcacttatagcagctagtatcgttgctcttgtcatccttatccttgttgccattgtttgccattacaagcaaatctcacggcagttccctagctcagaaaaggtttcagacaagaacctccacaagactagcaaagacatggccagtacaaaaggaaaggatgacaaaggtggtttggtggtctcagcagatgagcttggtgctcctcgaaagggctctacatctgaagcactaagccaagaagagaagctgtcaggtgtagggggattttccccatccaaaggtagccgcttctcttggtcaccagattctggagaggcatacacccaggaaggcctggcacggttggatgtcagatcacctgacaggttagcaggggagttgcacttcctggatgaaacaatcacactgacaccggaggaattgtcaagggcaccggctgaggttcttgggaggagcagccacgggacttcgtacagagcaacacttgagaatggtgtcttcctaacagtgaaatggctgagggaaggtgttgcaaggcccaagaaagagttctcgaaggaggccaagaagtttgcaaacattaggcatcccaatgttgttggcttgcgtggttactactggggtccaacagcacatgaaaaactgatcttgtcggattatgtttcaccaggaagtcttgcgagctttttgtacgcagatcgtccaggaaggagaggccctccactgacctgggcgcaacggctgaagatcgcagttgatgtcgcgcgtggcctgaactacctccattttgaccgagcgatgcctcatggaaacctcaaggctaccaacatcttgttggacggacttgacctcaatgcccgtgtcgctgactactgcctgcaccgcctgatgacccaggctggagttgttgagcagatcctcgacctgggcgtgctaggctaccgtgccccagagctagcagcgtccaagaagccatctccctcgttcaagtctgacgtgtacgccttcggtgtcgtgctgctggagctcctaactggcaggtgtgctggggatgttgtctcgggttctgaaggtggtgttgacctgactgattgggtccgtctgcgggtggctgaaggtcggggatcagattgctttgatccagccatggcttcagattctgagaaccaagtttctgtcaagggcatgaaggatgtgctgggcattgccttgagatgcatccggccggtctctgaaagacctgggatcaagtctgtgtatgaggatctttcatcaatctag

SEQ ID NO: 474 - DNA, 2689 bp, Oryza sativa
  misc_feature (121)..(121): n = any nucleotide
  misc_feature (126)..(129): n = any nucleotide
  misc_feature (134)..(135): n = any nucleotide
  misc_feature (137)..(137): n = any nucleotide
atggctgtttcaatgagggaagtggatgcggtctttcaaggggctggtcaaaaaggattggaaatatggcggattgaaaaactgcaagctgttccagttcccaaggaatcacatggggganttttnnnnggggnntncctaatgtgatattgaagacaaccgctcttaaaaatggttcttttcggcatgatatccattattggcttggtaaagataccagtcagcaggatgaagctggtacagctgcaatcaagactgtggaattggatgctgctcttggtggacgtgctgttcaataccgtgaagtacaggggaatgagacagagagatttctttcatattttaaaccttgtattataccagaggaaggtggaattgcatctggtttcaggcatactgaaatcaatgaacgggagcatgtgacaaggttatttgtctgcagaggaaagcatacagtccatgtcaaagaggttccgtttgcaagatcatcgctgaaccatgatgatatatttattttagatacaaagtccaaaatattccagttcaatggatcgaattcaagtattcaggagagggctaaagcccttgaggttgtgcaatatttgaaagacagcaaccatgagggcaaatgtgacgaggacggcaagctgatggcagatgctgacgccggtgaattctggggtctctttggtggatttgcacctcttccaagaaaaaccttttctgatcttaatggaaaagattctgctttctcttcgaagttgatctgaagggtcagacagtaccagttgattttgatgttctaacaagagagttgctagattcaacaaagtgctatctgctagactgtggatctgaaatttatgtctggatgggtagagagacaccactcgaagagaggaaacgggcaggatctgctgcagagaggccaaaatctcatattgttcgtctcatggaaggatttgagactgtcatattccgatcaaaattcagtaaatggcctaagaaagctgatgctgttgtgtctgatgagagcagaggaaaagttgcaggctcttcttaagcggcaaggatttaatgttaagggtcttgcaaaagctgctcctgtgaaggaagagcctcaacctcaaattgattgcacaggcaacctgcaggtttggcgtgtaaatggcactgaaaagacattcctttcattctctgagcaatgcaaattctacagtggggactgttatatctttcaatatagctatcctggtgaggaaggcgaggagtgtctcattggtacttggttcgggaaaaagagtgttcagcaggttcgcctttatgaaggaaaggaaccagctgagtttttctcaatatttcagaacctggttatcttcaagggtggtgttagtactgggtataagaaatttgtctcagaaaacggtattgaggatgacacatattcagaaaatggggttgcccttttccgggttcaaggctctggaccagaaaatatgcaagccattcaagttgatacggctacctcgctgaactcttcttattgttatgtactacatgatggagatacactatttacatggattgggaatttaagctcgtcaatggatcaagagcttgctgagaggcagctggatgtgatcaagccaaatcttcagtccagaatgctcaaggaagggtcagaatatgatcagttttggaagctacttggagtcaagtcagagtaccccagccagaagattgcaaaagatcaagaaagtgatcctcatttgttctcttgtactttttcaaaggttgcaggttagagaaatattcaactttactcaagatgatttgatgacagaggacgtttttattttggactgtcattcatgtgtcttcgtatgggttggacaacgtgtggacacaaaaatgcgagcacaagctttgagcgttggagagaaatttttagaacttgacattttgatggagaactcatcacaagaaacaccagtttatgtcatcactgaagggagtgagccccaatttttcaccaggttcttcacttgggactctgcaaaatcagccatgcatggaaactcatttgaaaggaggttatctatagtgaaggatggagtaaaaccaaaattagataaacctaaaagaaggccaacgacatcatcatcacacactggacgatccagtgtacctgaaaaatctcagcgctccagaagtatgtcgttcagtcctgaccgtgtaagagtcagaggaagatccccagcattcaatgcattagctgctaactttgagaacccaaatgctcggaatctatcaacacctccaccagctatcagaaaaccatctccgaagtccccctcttcagatcctacaaagccacctcaacgagctgcttcaattgctgcaatttctgcttctttcgagcgacctaggccaactctgataccaaagtcaatcaaagacgatacaggaagatctgaaggagggagaaaacgaggaagggctcccagtgtatccatacgaacgcttgaggacatcttccatcaatcctgtgacagacattgatgtgactaagcgtgagtatctatctgcggcggagttcagggaaaggtttgggatgacaaaggaagcttttgcgaagctaccaaagtggaagcagaataggttaaagattgcccttcagctgttttaa

SEQ ID NO: 475 - DNA, 2687 bp, Oryza sativa
  misc_feature (1360)..(1360): n = any nucleotide
  misc_feature (2174)..(2174): n = any nucleotide
atggcggcggcggtggcgatgcggagcggcagcggcagcgacggcggcggcggcgggtacgacaaggccgggatggactccggcaagtacgtgcggtacacgccggagcaggtggaggcgctggagagggtgtacgccgagtgccccaagcccagctcctcccgccgccagcagctgctccgcgactgtcccatcctcgccaacatcgagcccaagcagatcaaggtctggttccagaacagaagaggtgccgagataagcagcggaaggaggcatcaaggcttcaggccgtgaaccgaaaattgacggcgatgaataagcttctcatggaggagaatgagcgtcttcagaagcaggtctcccagctggtccatgagaacgcgtacatgaagcagcaacttcagaatccgtcattgggcaatgatacaagctgtgaatcaaatgtgaccactcctcagaaccctctgagagatgcaagtaacccgtctgggactccttacaattgcggaggagaccctgacagagttcctctccaaggctacagggactgctgttgattgggtgccaatgcctgggatgaagaagcctggtccggattcgtttggtattgtggccgtttcacatggttgccgtggtgttgctgcccgtgcctgtggtttggtgaatctagaaccaacaaagagatcgtggagatcttaaaagaccgcccatcttggttccgtgattgtcgaagtcttgaagtcttcacaatgtttccagctggaaatggtggcacgatcgaacttgtttacatgcagcagatgtatgctcctactactttggttcctgcacgagatttttggacacttagatacacaactacaatggaggatggcagccttgtgggtctgtgagagatcattgagtggttctggaggtggtccaagtacagcctccgcacagcaatttgtaagagctgagatgcttcctagcggctatctagtgcgcccatgcgagggtggtggctccatcgtgcatattgtggaccatctggatcttgagaggcttggagtgttccagaagtgcttcggccactctacgagtcatctagggtagttgctcagaaaatgactactgcagcactacggcacatcagacaaattgctcaagagacaagcggggaggttgtatacgctttggggaggcaacctgctgttttgcggacatttagtcagaggttgagtagtagaggcttcaatgatgctataagtggttcaatgatgatggttggtctgtcatgggtggggatggcattgaagatgtgatcattgcttgcaatgcaaagaaggttaggaatactagcacttcggccaatgctttngtaactccaggaggtgttatatgtgctaaggcatccatgctactgcagagagtgtcccacctgcagttttggttcgatttttgagggaacatcgttctgaatgggcggattataacttcgatgcatattcagcttcatctctgaagacaagctcatgttcacttcctgggttgcggcctatgagattttctgggagccagatcattatgccacttgctcacacggtggagaatgaggagagattttagaagttgtccgtcttgaaggacaagcacttacacatgatgatggtcttatgtctagagatattcacctgcttcagttcagctttgcactggaatagatgagaaatcaatgggatcctgcttccagcttgtctctgcaccaatcgatgagcttttccctgatgatgctccgttaatatcttcaggctttcgtgttataccgctggacatgaaaacagtgagtttttctcatgatggtacacctgctggtagaacattagatttggcatctagccttgaagttggttcaactgcacagcccacaggggatgcatctatggatgactgtaatctacgatcagtgctgacaattgcctttcagttcccttatgaaatgcatctccaagacagcgttgcaactatggcccggcaatatgtccgcagtattgtttcctctgttcagagagtatcaatggctatttctccttctcggtctggcttgaatgctgggcagaagataatttcaggcttccctgaagccccaacgctagctcgttggatttgccaaagctaccagttccatttggggntggagttacttaggcaggcagatgatgctggggaagcactattgaaaatgctatgggattacgaagacgctattttgtgctgttctttcaagaggaaaagcctgtgtttacttttgccaacgagatgggactaaacatgctagaaacatctctcgtcgctctccaagatctctcactggacaagatatttgatgaagccggtaggaaggccctatacaacgagatcccgaaattgatggaacagcagggttacgtgtacctgcctggtggagtgtgcttgtccgggatggggcgccatgtttctttcgagcaagctgtagcatggaaggtgctcggagaagacaacaatgtgcactgcctcgccttctgcttcgtcaactggtccttcgtgtgacccaaaatccaatccaccatgctcgcagtcatcgtcgttgtcgtcagatctccattttttgcaatctctgtagaagagaggacaccaaaccaaccacaaacctgtcagctgttagctaa

SEQ ID NO: 476 - DNA, 2634 bp, Oryza sativa
cctcttcgagtccccacgtttcatgccaggggccctggtattctgttcttgcttatgatgcttgtgttcgcttgtgccttcatgcatgggctagaggttgcatggaagctcctgtttttctggaaaatgaatgcacacttctgcgaaatacattttgctgcaaaatgtgcttctacaatcagaagaagagctcatggcaaaacggacatctgagcttgttagcgatggagttgcatccaaacccaagaaaacaattggcaagatgaaggttcaaggatgtaccatctggttgcaatttctcatcactctcctctggatgggagtcggttcgaaggatccaaactttaccacagctacctgctaacagttccttttcaaaacatagcttagcgtacatgcaagcaagtgctcagtacatcaagcaggtatctggtgtgctaaaagttggcgtgactaccctgcgcaacagctcatcctatgaaacaccgcaaggagacttactcttgccaattgaggcttaaaagtacacctgaagatgatgttgtaccgatgcagccaggatctggtgaaacacatgtcttttcccggatagccttggagatgatttgatcattgatgtttctgattcaaaagaagcttcgttggtggtcaatataccgggaacctgagcatgaactcgtaggccgcatacagctatacatacactacacaactgctgcagatgagaacaacacgaagtctgttgcagaaactgtggcttatgatattgttttggaagttgcaatgaaagcacagcacattcaacaacggaatctcatcttgcatggttcctggaaatggttgttgacagaatttgcattgtactatggcgtttcagatgcctacacaaagctgagaggtatctctcttatatcatggatgttgcaacccctactgctgattggctcaatctggttcatgaccttttgttacccgtactaatgaagacccaaggcactgctgcattgagccatcaagagaaccgcatattaggtgaagttgaggagcaaattgagcaaactttagcgatggtatttgagaattacaagtctctgaatgaatctttgccgtcgggtttagtggaagattttagacctccaactggtttggctgcttgtgctctagaaccagctataaagctttacagtcttctccatgatgtattatctccagaggctcaactcagattatgcggttatttccagtatgtccaggctgctgccaggaaacgatcaagacgatacatgcttgagactgatgaatatgtagcaggaaattccgaaggcataagagtggatctggtgacctttacaacagcttaccagaagatgaaatcattatgctgtaatctacgtaatgaaatctttacagacattgaaattcataaccagcacatacttcccagagttttgttgacctccccaatttagctgcgtccatctatagtgtggaactctcaaatagactgcgtgcttttcttgtggcatgccctccaactggcccttcatcacctgttgctgatttggtgattgcaactgctgactttcagaaggaccttgctagctggaatatatgagcccaattaaagccggtgttgacgcaaaagagctatttcatttgtacattgtcttatggatcgaagacaagcgcaggacgttgctggaaaattgcaggatggataaggttaaatggtcaggagttaggactcagcatatgaccacaccttttgtggacgagatgtatgatttgctgaagaatacattgacagagtacgaggttatcatttgccgatggccagaatacatatttgttcttgagaatgctattgcggatattgagaaagcagtgatagagtctcttgaaaaacagtacggggatgttttggctccacttaaggattgtattgccccaaagaaatttggtctcaaatatgtgcagaaactcacgaagcgcaattcagttggcccctatactgtacctgaagatctgggcattctcctgaatacaatgaaaagactattagatgttttgcggccaaggattgagagtcatctgaagtcatggagttcttgtatgcctaatggaggaaactctgcagctattggggagagacttagtgaagttacggtaacactgagggccaaattccgaaactacatgcaagctgttgtggagaagctctcagaaaatcaaaatactacaaagctcaagaagatcattcaggattcaaaagaattggtgatggagtcagatattcgaagcaggatgcaagcgttgaaggaccaacttgttgaggcaataaatcatgtacacaaggtcactgaagtccatgtgtttgtagctatatgccgaggtttttgggaccgaatgggacaggtcttgagtttcctggagaatcgcaaagaaaacagagcctggtacaaaggcgcacgtgttgcagtatctctggatgatacatttgcatcccagatgcagcagctgctgggtaattcgatccaacagaaggagctggaaccacctagatccatcatggaagttcggtcgatcctctgcaaagatgcaccccgacagaagaactctagcttctattactga

SEQ ID NO: 477 - DNA, 2610 bp, Oryza sativa
  misc_feature (1407)..(1407): n = any nucleotide
  misc_feature (1525)..(1525): n = any nucleotide
  misc_feature (2200)..(2200): n = any nucleotide
  misc_feature (2203)..(2203): n = any nucleotide
  misc_feature (2239)..(2240): n = any nucleotide
aaacataatggcaggcttatcagccatgctgtcaaaaaattggtcgaggattatgaatcagatccaaaatctgtgatgtttcagatattagcgatgctatttgagcaggcttgtggagctaggcataacttttatgcagactacctgtatgaggcagatgtggatggtgttgtgttttcccttgtcgagctagcaaaaaagcaaacagaaggatctcaagaacttcaaagaaaatcttgtttccttttgggataccttggtccatgagtgtcagaatggccctttatttgatggtagcttattccaaaaaatcaaagactatgtggttgctttgtcatgactcctccaagggtttatcgccaagtagcttcattggttgggctccagcttgtgacgtccttaatatctgttgctaagactctcagtggacagcgtgagaccactcaaagacagttgaatgcagagaagaagaagcagactgatggaccgattgttgaatctctaaacaaaaagctagctcatactcacaaaagcattacttacttggaggaactaatgcggaaaatattcagtggttattcatgcaccgctatcgtgatgttgaccctgagatccggatgtcgtgcataaaatcacttggtatttgggttgtctcgtacccatcacttttcttacaagatatatacctgaagtatctaggatggacacttaatgacaagaatgctggggttagaagaacttctattcttgccttgcaaagcctgtatgaagtggatgaaaacataccttctcttggtctctttactgagagattttacagcaggatgatccagcttgcagatgatgttgatatttcagtagctgtgtcagctatcggactcatcaagcagttactgagaggcatcaacttttgagcgatgatgatttaggtccactatatgatttgcttattgatgagcctccgctgatcaggcgtgcaattggggaattggtttatgatcatctgatagcacaaaacatcaaaacctcccagtctggagcaagagtcatcagaggttcatattggtcgaatgctgcaaatcctgagggaattttcagatgacccagtcctgagctcttatgtcattgatgatatttgggatgacatgaaggctatgattggaagtgtataatctccatgcttctggatgaaaatccattaaccgagcttactgacatggatggaaccaatctagttcggatgctgcgagcctctgcaaagaaggctgttggggaaaggatagttcctgcaacagacaatagaaagatgtactacaataaaggccagaaggtgtcaatgaaatattggaaaacagcaagcatgaaataactactgctttgctgaagaaatatccacagcttttaagnaaatacatatctgacaaagctaagatatcacctctaattgatatgatgatgcttatgaaacttgagctgtactcactaaaaaggcaagatcagaaggctgccatagatctcattgcgnatgccttctttaaacatggtgacaaggagaccttgaggtcttgcatcaaggcaattactttctgttgcactaactgtcaggcagatcttcaaaattatgctgaaaacaaactgaaggatcttgaagacgagttggttttgaaagtcaaaactgcaatcaaggaagtagagggtgatgatgaatactccctcatggttaatttgaagcgattttatgagcttcagttgtcaaaacctgtctttctcctccttaacatgtaccttcaattagcatggtgcctgaatgctattgatggtgaaaacccatctgaagcttccattgacgaacttttatccaggcaaagctctctttttgaaaaactctattattacttggtggttctgcctacttatcagaaagagtgtgtcattactgctgagatgtggtgcctgtttaagaagccaaaatattcttcaacaaggctcgagagtttgggatatctcccgcaactagatgttgtccagaatttctggaaactatgtgaagatgcaaatgaagaatatattgaagacacaaacaaggatgttgtcatgattgcagctgcaaagctagtgctagctgatacagtttcaaaggattacctgggcccagagcttgtttctcactatgcatcccctggaacaagtactacggggntantcaaacatctaatcacctcgcttcggaaaaatgctnncaacaacatgggtgccttatttttcgaggcactgaaaaggcttgctggtcggctcgcggggtcctatgttggtgcctcgcgcaataaaaacaagtctgagatcttgaagataatccaagacggtgtttcttttgcatttgtggaccttccaaagcaattgtctttcctcgaggctgctctactgccatttgtttctaaacttccatcgtcagatataccagacatgatgtacagaagaggactcaagatactaatactaatgaagatccaagtgcttggcgcccgtactttacgtttgtagagcatctacgcgataagcatgcaaagaatgaggttttgcagggtaaagcgcaggggtcggccaaggaag

SEQ ID NO: 478 - DNA, 2579 bp, Oryza sativa
atggcggcgccgcccaaggcctggaaggcggagtacgccaagtccgggcggtcctcgtgcaagtcgtgcaggtcccccatcgggaaggaccagctccggctcggcaagatggtccaggccacgcagttcgacggattaatgccgatgtggaaccatgccagttgcatcctcagttgatgatgttgaaggaatagacacactcagatgggatgaccaagagaagataagaaattatgttggaagtgcaccagctactgcaagttctgcagctgctatttcagataaatgcaccattgaggttgctaaatctgcccgtacttcctgtagacggtgtggtgaaaagataaaaaagggaacgtggtatcacgccagctgttttctggagatgtccccagctgcaactgttgagaatttctcaggctgggagatcctgtcgcatgaggataaaagagctgttcttgatcttgttaagaaagatgcccccagctcagtaagggttccaagcgcaagaaaaagcttaaagagcagagtgacacactttggaaattgaaggatgaacttaagaagcatgtgtcaactgctgaactaaggaacatgctcgaagcaaatgggcaggatacatctgggccagagcggcatctattagaccgttggtgctgatgggatgctttttggagcattgggtacttgcccagtttgttctagcttcctatactatcatggtggccagtatcattgcagtggctatgtgtcagaatggtccaagtgtacatactctacgacagaacccgtgcgcagtaaaaagaaatggaaaattcctgacgaaatggataatggttatcttacaaagagtggttcaagtctcaaaaggctaagaaaccagagagagttcttccgccaatgtcacctgagaaatcatgtagtgagcttgagagtgagaatgctgaagtcaagaaagcaagaggaggttgaagataccaattctgcgagaaggttaccttggagaatgcattagaaaaaacagagtgcttccatttgatttgtataaagtagaagctgcattggaatcttcgaaaggaggcacaatgactgttaaagttaaagggcgaagtgctgttcatgagtcctctggtttgcaagatacaggtcatattcttgaagatggaaaaagcatatacaatacaaccctgaacatgtctgacctgacacgaggtgtgaacagagctattatatacttcaggtcattgaagaggataatgggtctgattgttatgtattccgaaagtggggacgagttgggaatgaaaaaattggaggcactaagttggaggagatgtcgaaaattcatgctattcaggaatttagaagattgtttcttgagaagactggaaacccctgggaagcatgggaacaaaaaacaaatttccaaaagcagcctgggaaattttatccacttgacattaaatgaaaagttcacttcctccccagttgctggagctcatgaatatgcttttcaatattgaaacatacaggctgctatgctggaattcaaaattaacatgtctgagatgcccctgggtaaactaagcaaggaaaatatccaaaaagtttgaagcattaactgagatacagaatctattgggtaacactaataatcaagaactggcggttagagagagcttgatcgttgccgcgagcaatcgtttcttcacccttattccttctattcatcctcacattatacaagatgaggatgatttgatggtgaaagaaaatgcttgaagctctgcaagatattgaaattgcttctaaacttgttggcttcgatagtgacaatgatgagtctcttgatgacaagtacaagaaacttcgatgtgccattacgccactccctcatgattgtgaagattacaagctagttgagaagtatcttcttaacactcatgctcctacccacaaggcataaggagtggtcactggaattagaggaagtcttttcgcttgatcgagatggagaattcagcaagtactcaagatataagaataatctacataacaagatgttgttatggcatgggttcaaggttgaccaattatgttggaatacttagtcaaggactaagaatagcacctcctgaggctcccgtgacaggctatatgaaaggcctctactttgcagatttagtaagcaagagtgcacaatattgttacgtggataggaagaatccagttggtttgatgcttctttccgaggttgctctaggtgacatgtatgaactgaagaaagccacggtccatggacaaacctccaagagggaaacactcgaccaagggcttaggcaaaaccgtgccgctcgagtctgagtttgcgaaatggagggatgatgttgtggtgccatgcggaaagccagtgccagcatctatcaagacatctgagcttatgtacaatgagtatattgtctacaatacatcccaggttcagtcaaattgttatccatactcttttgcgcgcttctgttcatcagaagcaggtgaagatgcagtacttgttgaaggttaggttccatcacaagaggtga

SEQ ID NO: 479 - DNA, 2568 bp, Oryza sativa
atgcgcgcgcacgaggcgcctgtgaccgtgcggctgtggtggtggtggtggtacctctccgcctccttgtcctactcgtcggcggcgctccagctaaaccctagtcccgtcgccgccgccaccgcggttctcctgccgggccccgtgatgccgcttcttgatccaggaaagctgcctctttggcgcagctccggaggcagcagagggcttttgagaaagatgggttcttcaggttgctcagagatagtcgaattggtggatgagtcgaaggatgcccgtcctggtggtgtcacccacctgagggtgagagtgaagccggtgggtcaggagcatggagcgcggtcgtgctccgtcgaggatgatctcgataggctcattagatcgattaatgtgcgcacatccgcacgggcttctgggcagacgagcacggataggaggcttatcgcgctcgggaagtcgccgatatcgagctcggagattgttgagtctgtgagcctgaaacaggccctgaggaagatgtgcatctcgcaggcgtcggagatggccgccatgaagaggatgccgaagccgacggcggtgtcaaataccccagaagctggggcaattaagaagctttatacatctgttgtggttcaaaccaacaaggagcgggatgaaaagaataagtttggaaaagtgtccgttttgcctgagaaggatgtaataagttcatcggtgaagtcaacggaagccaagaacaaggtacggaacaaaagcccagctaagaaaaatgtgcgttcagcatctccaaccacaacaaaggtccagaaaaccagaatccaagatgtgatcagtaataagtcatctgaggcaagtgaagatttgcctgcaggtcctgcggtggctaaacagagaaagggcaaaatgaaaacatctagcccccgtgcagttcctgtgggcggttcacgcctggtgttccggagtaaaacctccaccaagaagaaggtcaaaccagaaccagctgctgcagtggtatctcacaagacttgtgaggcaaaaagttccaattctcaagctaataagaagcacgaggccctacaggatgaacccagaactccaacaccaatcaacaagaaggctgcggctagctctatcagcactgatggagctaattgtggcaccaaaggatgtggtgttggtgagatccatggttcaaagcccagtgagttgtcaagatcgaaggaaaagggtgaatgctcccaaagctcaaagagcagcatgggtgattatagcaccagcacaagcataagcgatgatagttatggtagtttcagtggcaatggctgcaggcctcacatgtcaaaagatgtgagatggggggccattaggcgcatggcaatccaacaagggagcctgggactgaagaacttcaagcttctcaaacaacttggttgtggagatattgggactgtttatctagctgaattggtgggttctgaatgcatgttcgcattgaaagttatggatatcgagtacctgataagtagaaagaagatgcttcgagcacaaactgagagggagatcctgcaaatgctcgaccacccatttcttccaactctgtattcttttttcacgaccgataatctgtcttgcctagtcatggagtattgccctggcggtgacctgcatgttctacgacagaaacagcctaccaggaccttttcagaagctgctgctaggttttatgttgctgaagttctcctagcattggaatatctacatatgttgggggtcatatatcgcgatctgaaaccagaaaacatacttgttcgtgaagatgggcacattatgctctctgatttcgatctgtccctgaggtgctcagtaaatccaatgcttgtaagggcctcatcagtaggaagagatgaacctagtagaccttctggcccttgtgcggaaagctgcattgatccactctgtatccaaccgtcatgggccaattcttcttgcttcacgcctcggctagtttcctctaccccttccaggccacggcggccgaggggtgagcctcagaagaaaccatcactgccacagcttgttgttgagccaactgatgcaaggtcaaattcgttcgtcggtacccatgaatatcttgcaccagagattatcagaggagatggccatggtagctcggtcgactggtggactcttggcatctttctctatgaattactctatggcaggacaccgttcaggggacccggcaatgaggagacactgacaaatgtggtctcgcaggggctgaagttccctgataaccctgctgtcagcttccatgcccgggatttgatcagagggttgcttgtgaaggatccggagtaccggctaggctcaacgaaaggagctgctgagatcaagcggcatcccttcttcgaaggcctgaactgggcattgatccgatggactgcaccgcctgagactccgaaaagcttcgacgcggcaagcctcacgacggcacggaagaagaaggaaggcaagtgcctggagttcaggctgaatggagacgacattgagtttgagctcttctag

SEQ ID NO: 480 - DNA, 2333 bp, Oryza sativa
atggggagggggtgcctggctgcgctgctcggcggcgcggtggcggtggccgtgctggtcgccgtcgtccactgcgcggtgacgtacgacaagaaggcggtgctcgtcgacggccagaggaggattctcttctccggatccatacattacccgaggagcacacccgaaatgtgggacgggctaattgagaaggctaaagatggaggcttggatgtgatccagacctatgtcttttggaatgggcatgaaccaactcctggatacaattttgaagggaggtacgatctggtcaggttcatcaagactgtccagaaggctggcatgtttgttcatctccgcatcggtccctacatttgtggagagtggaattttgggggatttccagtttggttgaagtatgtaccaggcatcagcttcaggacggacaatgaacctttcaaggcaatgcaggggttcacagagaaaattgtgggcatgatgaagagtgaaaacctctttgcttcacaaggcggtcctattatcctctctcagcagattgagaacgagtatgggccagaaggtaaagagtttggggctgccggcaaggcatatatcaactgggcggcaaagatggccgtgggattggacaccggtgtgccgtgggtgatgtgcaaggaggatgacgcacctgacccagtgatcaatgcatgcaatggtttctattgtgacacattttctcctaacaagccttacaagcctacgatgtggactgaagcttggagtggatgtttactgaattcggaggaaccatccgtcaacgaccagttgaagatctcgcatttggtgttgctcgcttcgtacagaagggtggttcttttatcaactactacatgtatcatggaggaacgaattttggtcgcacggctggaggtccctttatcaccacgagctatgattatgatgctccacttgatgaatatgggacttgcaagggaaccaaagtttgggcaccttaaagaactccatagagctgttaagttatgtgagcagcctttggtttctgccgatccaactgtgactacccttggaagtatgcaagaggcccatgtgttccgatcttcctctggctgtgcagctttccttgcaaactacaattctaactcgtatgccaaagttatcttcaacaatgaaaattacagccttccaccttggtcaatcagcatccttcctgattgcaaaaatgttgtttttaacactgcaacaggtctacttgagcagcttaatgtcacaagagacaccagtgattacctctggtacattacgagtctgagaagtttctacaaggtggcacgcctctgtcactcactgtgcagtctgctggccatgcgctgcatgtcttcatcaatgggcaactccaagtttgtaggttctgcctatggaaccagggaagatcggaaaatctcatatagtggcaatgctaaccttcgtgctggtacaaacaaagttgcactgttgagtgttgcttgtggactgccgaatgtcggagtgcattatgagacgtggaacactggtgttgttggtcctgttgtgattcacgggttggacgaaggttcaagagatctgacttggcagacttggtcctatcagcaggttggcctgaaaggtgaacagatgaatctaaactccttagaaggctcaggctcagttgaatggatgcaaggatcattggtagcacaaaaccaacaaccgttggcatggtatagggcatactttgatactcccagtggtgacgagccactggctctggatatgggcagcatgggtaagggtcaaatatggataaatgggcaaagcattggacggtactggacagcatatgcggaaggtgactgcaaaggttgccattacactgggtcatacagggcacccaagtgtcaggcaggttgtggtcagcctacacagcgctgtatcatgtgccaagatcctggttgcaaccaactagaaatctgctagtggtttttgaggaacttggcggtgattcttcaaagattgcccttgcgaagcggacagtctcaggtgtctgtgctgatgtatctgaatatcatccaaatatcaagaactggcagatcgagagctatggggaaccagagttccacacggcaaaggtgcatttaaaatgtgcacctgggcagaccatttctgcaatcaaatttgctagctttgggacacctcttggaacttgcggaacattccagcaaggggagtgccattcaattaactcaaactctgttcttgaaaaggtgagaacgctgtttggtcattttggtctacctgaaatttttttcttaaaataa

SEQ ID NO: 481 - DNA, 2292 bp, Oryza sativa
atgctcgcgcggtggctgctcgtgctgctcctcttgctgcctgtttcttggtgtcatcaagatcggcatggccgccgccattacccgcggcggtggaggagcagcggcagtaggagggagctgcacgagccgctgttccctctcgagaacgcgcccgcgctgccaccgccgccgccgccgccaccggcgccgttctttccgttcttgcctgactccgccccgccgcagctgccaccgccggtgaccacgcccgctcccgccggtggcgccggagatggtggtacggacgcaggcgccgccgccaccggggacgcgtcttcgtcttcgtcctcgtcggcgtcgccgcaccccacggcgccggcgaacatctcgtacatggccatgcccatctaccactccgcgccgctccgctccttcctgtcgtcgcaccgcctcctcaccgtcctcctcccggtcgccgccgtcctcgccgccgtgctagccgcggcgctcgtctacctcctcacgcgacgccgccgctgctccaagggggagccgcacgcggcgcatacgaaggccgtgctgctttccccggggaactccacggcgctctacgacggcgaccacgaccagcatggccgggggtccaccgccaccgcagcctccagcgccagctcgccggaactccggccgatgccgcctctaccccggcagttccagcagacgaggacgagcatgccgtcaacttcgcaaaccatccatgaagccggagcagaggacaagcgagcgccgccaccgcagagtgttcgaccgccgccgccaccaccaccacctcctcctccgccgccaatgccgccgagaacggacaacgcgagcacgcaagcagcgcccgcgcctcccccgccattgccgcgagccggcaacggcagcggctggctgccacggcggtacacggagcgcgccgcgccgacggtgatcagggcctcggcgggggcagtccacccggaggagtcgccggcgcgcgcctcgccggaggagaaggccgccgacgcggccgctcggccgaagctgaagccgctgcactgggacaaggtgcggccggcgagctccggccggccgacggtgtgggaccagctgaaggcgagctcattccgagtgaacgaagagatgatcgagacgctcttcgtctccaactcgacgaggagagcatccaagaatggagtcaaggaggcaaatgcagcttgctgcaaccaggagaacaaggtgctggacccgaagaaatcgcagaacatcgcgatcatgctgagggcgctcgacgcgacgaaggaggaagtctgcaaggctctcctggatggccaggcagagagccttggaactgagctgctggagacacttctaaagatggctcctagcagagaagaggaaatcaagctgaaggaattcagggaggatgccgtatctaagctcggccctgccgaaagcttcctcaaggcggtgcttgcgataccatttgcgttcaagagggtcgaagcaatgctctacatcgccaacttcgattcggaggttgactacctcaagacctccttcaaaactcttgaggcagcatgtgaagagctgaggggcagcaggttgttccacaagatcttagatgcagtgctgaagaccggtaaccgcatgaacactggcaccaaccgcggaaatgcaagcgccttcaagcttgatgccctcctcaagttagtcgacgtaaagggtgcagatggcaagacaacccttctgcattttgttatcgaagagattgtcaagtccgaaggtgccagcatcttggccactggccaaacatccaaccaggggagtgccattgcagatgatttccagtgcaagaaggttggcctcagaattgttgctagccttggtggtgagctcggcaatgtcaagaaggcagctggaatggactcagacacactggccagctgcgttgccaagctttctgctggtgttagcaagatcagtgaggccctgcagctgaaccagcagctcggttccgatgatccatggcaagagattccgcgcctcaatcgggagacgaccgagttcttccacggtgactcggtgaaggaggaagggcaccctctgagaatcttcatggtggtgcgcgacttcctcaccgttcttgatcatgtctgcaaggatgtcggcaggatgaacgaaagaacagcgattggatcttcgctccggctggagaatgcacctgttcttgcgaggttcaacgcagtccaacccagtagctccgaggaggagagctcatcgtcctag

SEQ ID NO: 482 - DNA, 2274 bp, Oryza sativa
attttcttttcccccaaaaaaccgaataaagagaaatctctccgagcgaattcgacgagatcggaggctcggatcgagaggtattctccttctgatttgattggattcgggatctgctggcggggatccatctttaggtaggatttcataattttatggactttgattgcaaaacagcaagaggagactcttcatctgtgaatcgttcatgcattgtcactgaaggcactgtcgtccaggcaaagcccgtttctcacaacgggaaagctaaacactggaatagcctcagtacattgaataaccagaagtgcagttatgaattactttccgacccaaagaaaaatgttgaaacaagtgatggtgagaccgcctcaaagtgtgactcatggtgcttcactgatttgccatccgcattggtctgtgaagtgcttgaacacctcgatccaaaggaacttggcattgtatcttgcgtctccaccctactgcataccctagccacagatcatcaggggtggaagaagttctactgtgaaaggtgggggattcctactcctccagtcaccctcaatgggcccttggttccaggaggaacttcagattggaagtcttggaaaacattatttgtggagcgggagtttcgaagtaaatcattcatgggaagattcagtgtggatgttctccgtgaccacagtgaggatgtacgcactgtgttccttctagcatcagtaaatctgatatttactggtggtaatgactctgtgatccgaatgtgggacttggaggaagggcttttgattgataagtcccgcccactttgttgcaccatccgggccattgcagctgacactaggcttttggtcactgcaggaaccaatgcctttattcattgttggagggctgttgaaggtaattcttaccctttccacatctctgggaatggcactgaccagagtcctgagtttcgcctttgggggcatgaaggacctgtgacttgtcttgccttggattcattgaggattttcagtggtagctgggatatgactgtccgtgtttgggacagatccgaaatgaaatgtgttcagaagttcatgcatgcagattgggtttggagcgtggcacctcatggaaatactgttgccagtacagctggtagggatgcctatgtatgggatatcaggagtggtgagttggaaaatgttatttccaatgcccattatggtaatgcattttctttagctcgaacacacctagctgatgtgctgtttaccggaggagaggatggggcaattcgcctgttcaatgtttctgaggtctctgatgatgaagatattaagccagctgctacttgggttccacataccggccctgttcattccctcgcttttgagtatccatggcttgtctcagcctctagtgatggcagggttgcactgattgatttgaggaagcttctgaccccaagaaagtcatcaaaacaaccattcagggttaagaactttgatccaagttccattgaacctccacagagaatgcttcatggctttgggtgcgatcttttttctgtcgccattggtgcagacaggattgtctgtggaggcgaggatggcgctgtcaaagtctggaacttctcagaagcactggagattgagaagagggcacaagctctaagaagtatgaggcaggagaaccgcatgaggcgaaaaaaggcacaagtagagatgaatgcaaatggtagaaggtctgaccaatgtggctcaatagccatgaaaagaaaccaactgaagggtgataagagtgtcacttggcacagcaagcgtgccatcaatgataaggtcaagtcttagattaggatttgtacccttcacaactttacactctacagtagccatgagttgatagttcttttcttggaagtacctttgctgatcccaattaggcttgctgtgtaggttaacattggcattttcactattgaattttataaggttaccaatgcagtgtagccatgcatgaaatccgcatatgcaattcttattcgatatggcatatattgatctaacagaagctctcattgtcttactgttttgagctctagttgcatttgggttttgttcgtatctttctgctggtagctgttatgaatgggaatctacattgaactattccaggaataataagcttctgtaattatgtcactgctggattcttagaacattacttttgctgttacgtggtctgcaataagaaaatcctgcattccgactcatattttga

SEQ ID NO: 483 - DNA, 2169 bp, Oryza sativa
  misc_feature (149)..(149): n = any nucleotide
  misc_feature (173)..(173): n = any nucleotide
  misc_feature (276)..(276): n = any nucleotide
atggctgaggaaaccagcaacgacaacctggtggttcaaggcaacgagattgttccaagcaatggggaagctctagctgaggaagttcagggtgatgaattggtccttgcggaggacttaattcaaggtgacgaggtccaaggaaatgnattggtcagtgctgagatgagtanccctccaacatcaaggcgccgtaggaagaagtctctagtgtgggagcacttcactattgaagctgtctctggaggggctacacgggcgtgctgcaaactgtgnaagcaaacttttgcttacagctctggttcaaaaattgcgggcactagccatctcaagaggcacattaccttgggttcatgtcctaaaattaagaaccaagagcacaagctattactgactccagctggagggactgacaatgatggtgagggtactgtggagcgcccgtctaagaggcgttacagatatactggttatgcaaatgctgcttttgatcaagaacgcagttgctcatatctggcgaagatgatcattttgcatgactatccacttcacattgttcaacagccagccttcactacctttattgacagtctgcagccacgtttcagggttgtagatgttgagacaatggagtgggaggtgtatgctgtttaccagaaagaaaaggaaaacctcatgcaagcattcaacactatgcctggaaggatcagcctcgctattggattgtggacaactagccaaactcttggctatgtttcacttgctgggcagtttattgactctgagtggaagatgcatcgaagaatgctaaacttcatgatggtgtcttctcctcattcagagaatgcacttagtgaagctattagtacaagcctttcagactggaatatgaaggacaaactattcaccatcacattggacaatgattgctcatcacatgatatatacagtgcgaatctgagggattatctctccaacaagaacaacctcatgctcaagggccaactatttgttgtaaggtgttatgcccatatcctgaatgcagttgctcaggatgtcattgcttcaattcatggtgtcatctataatatccgcgaaagcattaagttcataaaagcttctcctagctgtgaggagaagtttgcagagattgctctgcaactagagatcccaagtaccaagaccctttgtctggatgttacgacacagtggaacactacctatctcatgctgctggctgccttggattataagcaggccttttctactctagagacaagtgatgataactacaacgaggcaccgtccgctgaggactggaaaaaagttgaggctgcctgcaattacttgaagctattgtatgactcagcacatagcatcatggctgcagcaaatccaacttcaaatctctttttccatgaggcatggaaacttcagctcgagctgtcaaatgccacagggcgtgaagaccctgttttcagcagcattgccaaggatatgcacgagagatttgacaagtactggaaagattgcaaccttgtgttagctattgctgttgtgatggatccgcgcttcaagatgaagctcgttgagttcagctactcgaaaatttatggtgttgaagctgcgaaatatgttaaggtggtggatgatgctgttcatgagctctacaacgagtatgttgcacagcccctccccttaacgccggcttacgttgagcaagggggaggtaataatgcacctgctagcgagaatagtactcaagcaactgctccttcaaccggcgatggacttgtggacttcgatatgtacctttctgagatagctacaagccagccaacaaaatctgaactggaacagtacctggatgagtccctcactccgcgcatccaggaatttgacattctgaactggtggaagctcaacactctcaagtaccctactctctcaaagatggcccgggatatcttggccattccgatgtcgatggtgagcagcggcaactctattttctctgctggaactggaactcgcatgcttgatgactacagaagctcatcgcgtccagaaattgtggaggcgctcgtttgtgccaaagactggcttcagtatttaccagctaccccggaggcaccgagtacagcgctggtcaaggtggatgcagcatag

SEQ ID NO: 484 - DNA, 2122 bp, Oryza sativa
atgggccccaaggccaacgccgccgccgccggcgacctcccggagtacgccgaggtcgatcccaccggccggtacggacgggtacaacgacgttcttggcaagggcgcgtccaagaccgtgtaaggtacagggcgttcgacgagtaccaggggatggaggtggcgtggaaccaggtgaagctgcacgacttcctgcagagcccagaggacctggagcggctctactgcgagatccacctcctcaagacgctcaagcaccgcaacatcatgaagttctacacctcctgggtcgacgtctcccgccgcaacatcaacttcatcaccgagatgttcacctccggcaccctccgccagtataggcagaagcacatgagggtgaacatatgggcggtgaagcactggtgcaggcagattctgagtggattgctgtacttgcatagccatgatccacccatcatccaccgggacctgaagtgtgacaacatcttcgtgaatgggaaccagggggaggtcaagatcggtgaccttggccttgccgccatcctccgcaagtcccacgccgtccactgcgtagtaggcacgccggagttcatggcgccagaggtgtacgaggaggagtacaacgagctggtggacatatactcgttcgggatgtgcgtgcttgagatggtcaccttcgagtacccgtatagcgagtgcacgcacccggtgcagatctacaagaaagtgatctctggtactaagccggaagcgttgtacaaggtcaaagatccgatggtgaggcagttcgtcgagaaatgcctggccactgcatcccggaggctctcagcgagagagctgctcaaggacccattcctgcaggttgacgatttggtcttttgtccgggtgatggagattacagcctgatgaactatctgcggcagccttatttagaacacgcttatagtaatgtctccatgatgagtaatggattatctgaaagcattgacgaggatacaccaacggaagatagatgggattgtgaagatgatgacattaaagctgatggtattgacttgttcaatgggcatgaagatgagcctcttggcaatgtggatatcacaatcaaagggagaaaaagtgaggatggaagcatattcctcagattacggattgcagataatgatggggcatgtacggaacatctattttccttttgacatagaggccgataccgcattgagtgttgcaactgagatggtagccgagctagatataactgaccatgaggttactcgaattgctgagatgattgatggcgaggttagtgcactggtgccagattggaggcctggcccaggcatagaggaatctcaagacactacatactgccataactgcggatcaaatgtatcgtcatgtggttcactttatgcctacatgtcatctgctgctcgaggttgccagtgtgcagagctacatgggcggtttgaggagataacattccaagccaatggagagcagaccgatttgcaggactccggaggcagctctgatgatggaggtggccaaacacaacatgtcaaagatcaggaagccgtacacagtaatgggtttgtacaaatgggtagaagaggtcctcgtgaccagttttgttttagttcattccaggaacagtcttgctcacctcggcactatgagtatgacactagcctccaagcaaaagggttcgacatgaagcatgaagtaaagatggccaaatacaaagcacggaaaatggcacatctaaggagagctattcatccatctctggactttgacaacttgaatggagaaaggaggatgaagtcttcactgaacaagttacagtcttttcatattggtaagaatcacaatttccgcataccgacctgcgagcgaagcccaggcgctagagacgctgaggaggaccctgacatttttaatctagcgtaccatagccggcaccccgatccaggagcccaaagggcccggcattgtgaggttgatgcacagagcagtccagatctcatgtttacagctaggagttactacacaggagctcagctgccaacaaatctcccaagaacaaaatctgtaaccctaaatgctgttgatgcctga

SEQ ID NO: 485 - DNA, 2073 bp, Oryza sativa
atgacgaagcaccaggccgcgcacatcgcggaccaccctggtgtcctcgccatctaccccgacgagcatctccaactgcacaccactcagtctccctccttcctccgtctctcaccgtccgttggcctcgtacaggcatcaaacggcggcggcacgggcgcggtgatcgcgatcttggacactggcatttatcccaagggccgcaaatccttcaccgctgactcgtcgtttcctccaccacctcgcaccttccgtggtcattgtgtctccactcgctcgtttaatgccaccgcctactgcaacaacaagctcgtcggcgcaaagtttttctataaagggcacgaggccaagatgggtcacctgatcaatgagacacaagagtccaagtcacctctcgacaccgaaggccacggcacgcacactgcatctaccgccgctggttcagcggtccctggcgctaactttgttggctatgccaatggcaccgcccaaggcatggctatacgtgcacacattgcatcctacaaagtatgctggagagatgatggaaatgcatcgtgcgctacctctgacattctcgccggaatgaatgaggcaattgcagatggagtagatgtcatatccctttccttgggtggtctaaagccacaactctacaacgaacccacctcccttggcgcattcaatgccatccgtagaggcatagtcgtgtccacctccgctggaaatgatggccctggcacgtatactgctaataacctcgcaccatgggtgataacggttggcgcatcaagcattgaccgtcggttcccagctcacgttgtccttggacataatcgcggaacctacatcggcacctcgctgtatttcggccaaaacacagccggttcatttctacctctagtgtacggtggtgatgctggttctgctctgtgtgaatacgggatgctttccagcaacatggtcaccggaaagattgtcctctgctatggcacaaaaaatactaccaaccccatagtgcaagaagctgctgtccaacaagccggtggtgttggtgccatcatttcaattgctccagaatatggtgatttcttacagagcttcgctgatatcttgccaacgtcgacgattaccttcaaggacaccgaaacgatccattcgtacacacagtcggtggccgacccggttgcaagaatcgacttcttaggcactgtgatcaaccaatcaccgtctgctccaagggtcgcagccttctcaagtcgtggaccgaaccgctttgctccagagatcctcaagcccgacatgattgcccccggtgtcgacatcctcgctgcatggaccggagaaatgtcgcctaccatggccaatgtcatcgacaataggcgcgtcgagttcaacatcatctccggcacgtccatggcgtgcctgcacatgagcggcatcgccgctatgcttaaggtggcacaaccgagttggagcccagcggcaatcaagtcggccatgatgacgacggcctacaatgtggacaatgatggcaatgccatcaaggacatggccacgggccaggcagccaggccgttcgagcttgggtctggccacgtcgaccccaaccgtgccctcgaccctggattggtgaacaacaccaccgccgacgattacataacattcctctgcagcctcggctacaacagtagtcagatcgcgctcttcacaaatgacggttcgacgacagactgctcgaccaggccacggaggtccgtgggcgacctcaactacccggcgttctcggtggtgttcgtgaggtccggagagcaggtcacgcagcgccgcgccgtgaccaacgtcggggcgaacaccaatgtcatgtacaacgttaccatcaccgcaccgcccggcaccactctcacggtgacgccaacgaggctcgcgttcgacgcgcagcgcagaacgctggattactccatcaccgtgtcggcaggggcgaccagctcgtccgagcaccagtggggatcgatcgtctggagcgatggccaacatacggtgaggagccccgtcgtggccacctggcaataa

SEQ ID NO: 486 - DNA, 1966 bp, Oryza sativa
atggcgggtgcaagccatcacctggtcgtcttcttggcagcgctgctcgcgttgctcccgggaagctcgcagctgcagtactcgcagacatggacgctgttcaagatccagcagatgctgaaccacccgccggtgctgagccactggcgccggaccaccgacttctgcggcggcggcggcacggcggcgccgtcggcggccgtggtgtgctacggcgacacggtgacgcagctgcacatcgccggcgtccgcggcgcgccgccgctcccgatgaacttctccatcggcgcgctcgtcatggcgctgtcgaggctccccgacctcaaggtgctcacgctgtccgggctcgggctctggggccccctgccggacaagatcggccgcctcgccgcgctggagatcgtcaacatgagcacgctgatcctcgacgacaacggcgagctcccggcgtggatcggcgagctgccgcagctggccgtgctgagcctgcggaacaactcgctgggcggcgccgtgccggcgtccgtgggtcgcatggagtcgctgaggtcgctggtgctcgcgtcgaacaacctgacggggaacctgccggacatgagcggcctcaccaacctccaggtgatcgacgtcggcgacaactggctcggcccggcgttcccggcgctggggcggaaggtggtcacggtggtgctcagccggaacaggttcctcgacgtgtcgtggaaccgcttcgtcggcccgttcatgccggcgctgctgtccctgccggccatccgctacctcaacgtcgccggcaacaggttcaccggcgtgctctccgacaaggttgcctgcggcgacaatctccagttcgtcgacctgtcctccaacctcctcaccggcagcgagccggcctgcctgaggccggacaagaagccggcgacggtggtgctcgtcaatgccaattgcctcttctgccagaaccaagccttggccgtggggataactcacggcggcaagaaaatttcaccaaatttgatgtcaaaattcactaagatttgatttcctactggtgtctgcgacaaaatcaaaacaggctacatatcacagacagtgaagctgggagctctgggaattccaccatacagaacattttctttggttgagcttgaagctgccactgacaactttgagaactctttgctactggggcaagattctttcggcgagcagatgtacagggggagactaggcaatggcacactagtggccatcaggagcctgaaggttaagaggaatcagtcttccctaagcttcagtcgccacattgaaacaatttctaggctcagacaccggaacttggtcagcgctctcgggcactgcttcgagtatgatcttgatgattctactgtcactcagctgtacctcgtgttcgaatacgtgcaaaacgggaacctacggagcaggatttcgcggaaggaagcttacatgggcacagagaatatcagctgccatcggcatcgccaacggcattcagttcttgcatgctgggaacaatctgaagatcaacaacattcttctcgatcagaatcatgtcgcgaagatcagcagctacaatatcccaatcctaggagaggccatgaaatctgaggataaaaccgacatcttcgatttcggggtgatccttcttgagaggaggagctttgccgaccaggaggtgagcaagggatgctctgacgagtcgctgaggacgatcatgcagatctgcctgaggtgcctggccaaggaggctgtgcagcggccgtccatcgaggacgtcctctggaacctgcagttcgctgcacaggtgcaggacgactgggaaggagataaccggagcagcgacggttcaatggtgtcgtcgtcgtcccggatcacgaaatcctccagattccagaatgagcaaaccaggtgtgccatacatccaaatcaatcaagtatcctctga

SEQ ID NO: 487 - DNA, 1766 bp, Oryza sativa
atggagagcaacggcggaggaggaggatctcccaaggaggcagcggtggtggtgccgtcctccggcgacgccaccctgggcgggcacctggctcggcgcctcgtgcaggtgggcgtgagcgacgtgttcgccgtgccgggggacttcaacctgacgcttctggaccacctgatcgccgagcccgggctccgcgtggtgggctgctgcaacgagctgaacgccggatacgcggccgacgggtacgcgcgggcccgtggcgtgggcgcctgcgccgtgaccttcaccgtgggcgggctgagcgtgctgaacgccatcggcggggcgtacagcgagaacctgccgctgatctgcatcgtggggggccccaactccaacgactacggcaccaaccgcatcctccaccacaccatcggcctcccggacttctcccaggagctccgctgcttccaacccctcacctgctaccaggccgtcgtcaacaacctcgacgaacgcccacgaccagatcgaccgcgccatctccaccgccattcagggagagcaagcccgtctacatcagcgtcagctgcaacctccccgccgtcccccaccccaccttctcccgcgacccggtgccctacttcctctccccgaggctctccaaccaggccagcctccacgccgcgctcgacgccaccctcgccttcctcgacaaggccgtcaagcccgtcctcgtcgcggggcccaagctccgcgtcgccaaggccggaggggccttcgtggacctcgccgacgccagcggccacgcggtggccgccatgccgtccgccaaggggctggtgccggagacgctgccgcgcttcatcgggacctactggggcgcggtcagcacggccttctgcgcggagatcgtggagtccgcggacgcctacctgttcgcggggcccatcttcaacgactacagctccgtggggtactcgtgcctgctgaagaaggagaaggcggtggtggtgcagcccgaccgcgtgaccgtcggcaatggccccgcgttcgggtgcgtgatgatgagggacttcctgtcggagctggccaagcgcgtccggaagaacacgacggcgttcgacaactacaagaggatcttcgtgccggagggacagctgccggagtgcgaggccggggaggcgctgcgggtgaacgtgctgttcaagcacatacagaggatgatcggtggcacggagatcggggcggtgatggcggagacgggggactcgtggttcaactgccagaagctgcggctgcccgagggttgcgggtacgagttccagatgcagtacggctccatcgggtggtcggtgggggcgctgctgggctacgcgcaggctgtccaaaaacgggtggtggcttgcatcggcgacggcagcttccaggtgacggcgcaggacgtgtcgacgatgctgcgttgcgggcagcggagcatcatcttcctcatcaacaacggcgggtacaccatcgaggtggagatccacgacgggccgtacaacgtgatcaagaactgggactacgtgggcctcgtcaacgccatccacaacggcgaggggcggtgctgggccacccgggtgcggtgcgaggaggagctggaggcggccatcgcgacggccacgggggacaaggcggacagcctctgcttcatcgaggtggtggcgcacaaggacgacaccagcaaggagctcctcgaatggggctccagagtctccgccgccaactccaggccgcccaacccgcagtag

SEQ ID NO: 488 - DNA, 1727 bp, Oryza sativa
atgaaggacgagctcgacgaggagggggactcctcctcccccgtggcaatgaaggtcggggaggagaaggagatcgggaagcaggggctcaggaagaggctcctcaaggaaggggaaggatgggatcgccccgaatccggcgacgaggtccaaggttcactacaccggcactctcctcgacggaaccaagttcgattccagccgcgatcgtggaacccccttcaaattcagcctcggccaagggggaggtgatcaaggggtgggatgagggtatcaagacgatgaagaagggggagcaggcggtgttcaccgttccgccggagctcgcctacggcgaggccggctcgccgccggcgatcccgcccaacgccacgctgcggttcgacgtcgagctgctctcctgggccagcgtcaaggacatctgcaaggacggcggaatcttcaagaaggtgctcgccgagggacacaagtgggagaatcccaaggacctcgacgaggtgctcggtcaagtacgaagcgaggctcgaagacggaactgtggtatcgaaatctgacggtgttgagtttgctgtcaaagatgggctatttctgcccggcgctttcaaaggctgtcaagacgatgaagaagggcgagaaggtcctcctcactgtcaagccacaatggctttggtgagcaaggcaaaccagcttctggagctgaagctgctgtgccgccaaatgctaccctgtacgtcgatcttgagttgctctcctggaagacggtcactctgatcggcgacgataagcgcatcctgaagaaagtcctcaaggaaggggagggctatgagcgccctaacgatggagcagtagttagagtatcggcaagttggaggacggcactgtgttttccaagaaagggcatgatggtgatgagccatttgagttcaggacagatgaggagcaagtcatcgaagggctggacagaactgtggtcaccatgaagaaaggagaggttgcattggtgagattaccacctcaacatgctttcggatccactgagactaagcaggatcttgctgttgttcctgcaaactccacagtctggtatgaagttgagcttgtctcattcgagaagaggagaaagaatcatgggatttgaaggacaatgctgagaagattgaagcagctgccaagaagaaagatgaagggaatgtgtggttcaagatgggcaagtatgctaaggcctccaagagatacgaaaagaggctgcgaagtacatcgagtatgacagctccttcactgatgatgagaagaagcaatcgaaagcactcaaggttagttgcaagctcaacaatgctgcttgcaaactgaagctgaaggaatacagggaagcagagaagctctgcaccaagaggttttggaactggagagcacaaatgtaaaggccttgtacagaaggacgcaggcatacattgagcttgctgatctggaactagcagagttggatgtcaagaaagcactggagattgatcctgacaacaggtgaagatggtgtataagacattgaaggagaagatcaaggagtacaacaagagagacgccaagttctacggcaacatgttcgcgaaatggaggaagctggaacacatggagaacaagtgggaagcaggaggcacagcctatggccattgacagtgccgcttgaggattagctctgctttcttttttctgaacctggttactgctag

SEQ ID NO: 489 - DNA, 1724 bp, Oryza sativa
atgcctggtcaagcggcaaagccgaagggcactggggaacagggaggtgatgctgaggtggtttccgaggagcgaacaccatctgaccagcatcaaggttctccggcatctacgctggacaaggagctttcaggcctctcttcggagtctgggatcctggatgattcgttagtcgcggaggaggaagattccggcgaactgaaggagatccaaaacttggattgtaatgggaatcaggagaagaagacgtcacagaagagtagtacgagcgatagttttgcttctgctaaagtgagtgatgggacgaatagtttgaggaagaccagtggtagtgctaagacaagtgacagggctaatttcactgagagtgggaagagcagcatgtgtcgcgcgagcacgagcagcgacataagtgatgagagctcacgcagcagcatgagcagcgccaccacaaagccgcacaaagggaatgattcaaggtgggaagcgatccagacggtcaaaaccaaggatggcattcttggtttaaaccattttagattgcttaagaagttaggttcgggagatattggcagcgtgtatctctcagaattgagtggtactaggagttactttgcaatgaaggtcatggataaggcatctttggcaagtcggaagaagcttcttcgatcgcagactgagcttgagatactgcagtcgcttgatcatccatttctaccaaccctatatactcacttcgaaacagataaattttcatgtctggtgatggaattctgccctggaggggacctccacactcttcgacaaaggcagcctggaaaacatttttcagagcaagcagcaaattctatgtagcagaggttctcctagcgttggagtacctgcatatgcttggtatcatataccgtgatctgaagccagaaaatgtcctagttcgggaggacggccacatcatgctttccgactttgacctctctcttcgctgttcagtgagcccaactgtgatcaagtctgcaaatcctggtttagatgcactgcagaggaataatgcagcgtactgtgtccagcctgcttgcatagagccatcgtgcattcagccatcatgtgttgctccaaccacatgctttggaccacggttcttcaagtctaagtccaaatcgaagtccaagaaagagaaatcaaagcctgaagctgcaaaccaagctagcttgttccctgagctcatcgctgaaccaactgatgctcggtccatgtccttcgtcggcacccatgagtacttggccccagaaataattaaaggcgagggccatggcagtgcggtggattggtggacctttggcatattcttgtatgagctattgtttggcaagacccctttcaagggttcaggcaatcgagcgacgctcttcaatgtcgttggccagcccttgcggttcccagaatccccaatagtgagcttctcggcaagggacatgataaggggattgctggtcaaggaccctcagcaccgacttggctacaagcgtggggctactgagataaaacagcatccattctttgagggtgtcaactgggcgctcataagatgcgcgagccctccagacattcctaagcccgttgagctcgattgtcgcccgaagcaggtgccgtcaacgaatggcaaggttgcaccagcttccaaccagaagggctcagacaattatctagagtttgaatttttctag

SEQ ID NO: 490 - DNA, 1705 bp, Oryza sativa
  misc_feature (305)..(305): n = any nucleotide
atgcgatcttcatgggctgactcagctgcgaacgccgaggaatcggcgcccgcggctgctgctaaccacggcaactcgcgcctcccgcgcagctcatacgttcccccgcacctccgcggaggaggtggtggtggcggtggtgcatggaactcccgccctgggggttgggaccgaagagaccgtgaaccggatccttttgccaatagtgaggctgcggaagttgactttgagggcgagaacactggcatcaattttgaagcctatgaagacatccctgttgagacaagtggccatgatgtgccccnaccagccaatacatttgcggagattgatttgggtgacgcgctgaatgagaatatcagaaggtgcaaatatgtgaagccgacaccagtgcagcgttatgccatcccaatctccattgcaggacgggatctcatggcctgtgcacaaacaggatctggaaagacagcagccttttgtttccctatcatcagtggaatcatgaggtcaaggccaccccccaggtcacggggttccaggaccgcatatcctcttgcactaatcctatctcccactcgtgagctgttcggtccaaatccatgaagaagcaaggaagtttgcataccagactggtgttaaagtggtcgttgcatacggaggagcgccaattactcagcagctgagggagttagaaagaggtgttgaaatccttgtggcaactcctggccgcttaatggatttgttggagagggctagagtctcactgcagatgataaagtatttagctcttgatgaagctgatcgaatgcttgatatgggatttgagccccagatacgtaaaatagttgagcagatggacatgcctccacgtggagagaggcagacgatgttgtttagtgctacatttccaaaggagatacagcagagaatggcttcagatttcctcgccgattacatatttcttgctgtcgggagagttggttcaagtactgatttaattgtccagagggttgagtttgtccttgatgctgacaaaagaagctacctcatggaccttcttcatgcacaaagggcaaatggtacacatgggaagacaaagaggggagctgatgccctggagaactggctttataacaatgggttcccagcaactagcattcatggagacagaacacaacagcaggaaagagagtatgccctgagatccttcaagagtggagcaactcccatcctcgtggcaactgatgttgctgctcgtggactggatatacctcatgttgcccacgtcattaattttgacctcccaaatgatatagacgactatgtccatcggataggaaggacagggcgtgcagggaaatctggtctggcaactgcatttttcaacgagagcaacaccccactggcaaggccgctgagtgagctcatgcaggaggctaaccaggaggttcctcaatggcttgagaggtatgctgcccgttcatcgtttggaggcggcggcgggagaaaccgcaggtcaggtggtggtgctaggtttggtggccgggacttccgacgagacagaggcagtggtggtggagggtatggtggtggaggtggaggttatggaggtggcggatatggtggtggtggcggtggaggcggctatggtggcggtagcagctacggaggtggcgggcaaggtttttctagtgcttgggactga

SEQ ID NO: 491 - DNA, 1626 bp, Oryza sativa
atggagggagctggcagagatgggaaccctcttggcggttaccggattggcaaaaccctagggattgggtcatttggcaaagtgaagatcgcggagcatatattgactggtcacaaggtggcaatcaagatcctcaatcgccgtaagatcaagagcatggagatggaagagaaaggttggtactgatccctttgacccttttgttcaagatgtttgtagaatatatacgaaatgatagatacttggagttaaaagagaaatcaagatacttagattatttatgcacccacatatcattcgcctttatgaggtgatagacaccccagctgatatttatgttgttatggagtatgtcaaatctggagagttgtttgattacatcgttgagaagggaagactgcaagaggaagaagctcgacgctttttccagcagagatcatatctggtgttgaatattgccatagaaacatggtggttcatcgtgatcttaagccagagaaccttcttttggactccaaatgcaatgttaagattgcagactttggcttgagtaatgttatgcgtgatggtcactttctgaagacaagttgtggtagcccaaattatgcagcacctgagaggtgatatctggtaaactatatgctggccctgaagttgatgtgtggagttgtggtgttattctttatgctcttctttgtggtacccttccatttgatgacgagaatattcccaacctttttaagaaaataaagagggtggcatatatacccttcccagtcatttgtcacctttggcaagggatttgattcccagaatgcttgttgttgatcccatgaagaggatcaccatacgtgaaatccgtgaacatcagtggttcacagttggtcttccgcgttatttagctgtgccacctcctgacactgcacaacaggttaaaaagagctcgacgatgaaactctgaatgatgttatcaatatggggtttgacaagaatcagctaatcgaatcacttcacaagagactgcaaaacgagaggcgacagttgcctactatttactattggacaataggctgcgcacaaccagtggctaccttggagctgagttccatgaatctatgatcttctctcgctcaagtaactccagctgagacaccaaactcagccactgatcatcggcagcatgggcatatggaatctcctgggtttggcttgaggcatcatttcgcagctgacaggaaatgggcccttggtcttcaggttttatgctgttactataagcagtctcgagcacatccacgagaaataataactgaagttcttaaagctctgcaagagctaaatgtttgctggaagaagattggacattataacatgaaatgcagatggagtcctagttttcccagtcatgagagtatgatgcataacaaccatggctttggtgcagaatctgctataattgaaactgatgacagtgagaaatcaacccacactgtgaaatttgaaattcagcagctttacaaaacaagggatgaaaaataccttcttgacttgcaaagggtcagtggaccacagcttctctttctggacctgtgctctgcctttctaactcagctgagagtcctttaa

SEQ ID NO: 492 - DNA, 1575 bp, Oryza sativa
tacgactacattgtcgtcggcgggggcaccgccggttgccccctggcggcgacattgtcgctcaagtacaaggtgctcctgctggagaggggagggtctccgtatggcaaccgcaacgtctcctacatggagaacttccacattggcctgagcaatatggcgccggactcggcgtctcaggccttcatctccactgacggcgtcatcaatgcccgagcgagggtgttgggaggtggcacctgcatcaatgccggcttctacagccgggccagctcaaaggctgggatgaagacctggtgaatgagtccttcccttgggtggaggacaagatcgtccagtggcctaagatcgcaccttggcaggctgcactaagggatgggctactccaagcaggtgtatctcctttcaatggctacacatatgaccatgtttctgggaccaaagttggtggcaccatctttgatgagactggctaccgccacacagcagccgacttacttgcagctggagaccctaacaacctaagggtgctgcttcatgctagtgtgaacaggatagtctttaactcgcagagagccaagagcaaccggagttcagttcaccgatgagaatggaggactccaccaggcattcctcaacagcaactgtgatagtgaaatcattgtctctgctggcgcaattggcagcccccagctgctattgctcagtgggattggacccaagaatgaccttaggagccataaaattcctgtagttctccataacaagtatgtgggtaaagggatggctgataaccccatgaactccatattcataccgacgaaaagcccccctcgccagtccctgattgagactgttggaataactgaagctggtgtgttcattgaggccagtagtggttttggccagtcaccagaaagcatccattgccaccatggaatcatgtccgctgagctgtccacaattcctccgaaggaaagaagcctggaaaaagcacagaagtatgcaaataccaaacttaatctacccaaagagatattccatggtggttttatcctcgagaagattgatggtccactgtctacgggacatcttgccctgatagacactgatgtcaagaagaaccctgcggttaccttcaactacttcagtcatccacaggatctcactcgttgcgtctatggtatcaagaccattgaacgaatactgaagacaaaccgtttctctgaactgtctgccaacactgatggacattcaatggaaagagtgctcaatatgagtgtgcaggctaatgtgaacttgatacccaagcatacaaatgacacagaatccctagagcaattttgcagggatacagtaataaccatctggcactaccatggtggatgccatgtagggaaggtggttgatcagcaacaccgtgtgcttggagtttcaggcgtccgtgtagtcgatggctcaacattttctagatcaccagggacgaaccctcaagccacggtcatgatgatgggcagcagatattttggagtgatgatcctaaggggaagactaggtcgagcagctggagtgtaa

SEQ ID NO: 493 - DNA, 1573 bp, Oryza sativa
  misc_feature (844)..(844): n = any nucleotide
  misc_feature (1286)..(1286): n = any nucleotide
  misc_feature (1289)..(1289): n = any nucleotide
  misc_feature (1523)..(1523): n = any nucleotide
atgagctcctcctctcatcagtcatcactacactcacttagctagtggcaaaaagatagatagctctagctcgtactgcatcaaacgggcggtagttgcactgcccgtttcaagggaactccagtgacaaccagcttcttgccaattcagaacgtgaccgtgtggtacgtacggccaaggcagtggctagctcgcgatggcgtcggagtgggaaatggccatgggcgtcgacctcggcatggggatgagcacgtaccacaacgcctccggtggcatcgccgccgcgccgatgatgggccaccacggcggaggaggcggcggcggcgggtactccgccgcgcaccaccaccaccaccattactacgggatgcctcatcaggcggcgatgggcgacgccatgcgcgtcgacgacctcctcgacctctccaacactcccggcgcccacgacttcttcccggcctccgctgccgccgccgccgcaggtgaccacgggcaccaccaccaccaccacatcggcggcatgggcgagccgtcgggcgccacgccgtcggccacgtcgtcagatcaccagacgtcgatgctctccttcgccgacgacttctacatacccaccgaggacgctgccgagctggagtggctatccaagttcgtcgacgactcctactccgacatgccgaattaccagtcgtccgcgcacgccgcaatggcggcggcggctgcttccgcggccaacaacggcggcggcagctcggccggccaagacagctgcctcacggcggcgcctggccgcggcgcccgtagcaagaggtcgcgcgcgacggccgcggccgccgccgcgtggcantccctcgtcccggggcccgccgtcccagtcgtcgccgtcgtcgtcgtgctcgtcgtccgacttcccgtcctcgaacaagccatcgggcaccgcgaggccgaacggctcaggaggcggcagccgcggcaagaagagccccggccccgcgggggccgaggtgggcatggaggccggcgtgcggcggtgcacgcactgcgcgtcggagaagacgccgcagtggcggacggggcccctgggccccaagaccctgtgcaacgcgtgcggcgtgaggttcaagtccgggcggctgatgccggagtacaggccggcggcgagccccacgttcgtgctgacgcagcactccaactcccaccgcaaggtcatggagctgcgccgccagaaggagctcctcatcatccgcggcagccaccgcgacgccgccgcggccgcagcagcagccgcngcngccgccgccgcgggatccgccgcggcgaccgggaggccggagctcatgttccgcgactacggcgtgtgctgatcaagcggcgcacgcggcgtccagagcgagccatgcaggcgcagctacgcatcacatcgcatgcatggatggatgcatgcacagcacagacgcgcgggcttagatccttttgcgaaattctcccgtctccctttctctcgtttatttcctctcccttttttntccttttttgccttattccagatatttttcaatgcttttttgttaattaa

SEQ ID NO: 494 - DNA, 1561 bp, Oryza sativa
gttcggttccattatggtcatcctgatattttcgatagactcttccatattactagaggtggcataagtaaagcctcaaagactataaatctaagtgaagatatattttcagggttttaattcaacaatgagagaagggaatgtcacacatcatgagtatatgcaagttggtaaggggcgtgatgtgggaatgaatcaaatttcaagctttgaagctaaggtggcaaatggcaatggtgaacaaacattgagtcgtgatatctatcggctggggcgcagattcgatttttatagaatgctatccttctactttactacagttgggttttactttagtagcatggtacttacagtttatgtgtttctatatgggaggttatatctagttatgagtggtctggaaaggtctattttgctggatccacgtatcgagcagaacattaagcctcttgaaaacgcactggcctcgcagtcttttttccagctaggtttgctgcttgttctccctatggtaatggaagttggcttagaaaagggattccgcacagcattaggagagtttgttatcatgcagcttcagctggcatctgtgtttttcacattccagcttggcaccaaaacgcactactacggaagaacaatactgcatggcggggctaaatacagacctacaggtcgtggatttgttgtctaccatgcaaagtttgctgacaattaccgcatgtactcccgcagccactttgttaaaggacttgaactgttgatacttctggtggtttatttagtgtatggaagttcctaccgcagctcaagcatgtacctatttgtcaccttctccatatggttcctggttgcatcttggctcttcgcaccctttatcttcaatccgtcatgcttcgaatggcagaagacagttgatgactggacagattggaggaagtggatggggaaccgtgggggtatcggcatgtctgtggatcaaagctgggaggcttggtggataagtgagcaggagcaccttaggaagactagcattcgctctctcctcttggaaatcattctttcgctccgcttcttgatctatcagtacggtattgtgtaccatctgaacatagcacgccgcagcaaaagcattctggtttcgattgggcgacagaagtttggaacagatctgcagcttatgttccgcattctcaagggcctcctgttccttggttttgtctctgtgatggctgtattattcgtcgtttgtaacctcacaatttcggatgtttttgctagtattcttgggttcatgcctactggttggtgcattcttctgcagattgggcaggcatgttcgccgttggtgaagaaggcaatgctgtgggattccatcatggagctcgggaggtcgtacgagaacctgatgggactcgtcctcttcctccccatcggcctcttgtcatggttccccttcgtgtccgagttccagacacgactgctcttcaaccaggccttcagccgtggcctccagatctcaaggatcctcgccgggcaaaaggacattggagaggaatga

SEQ ID NO: 495 - DNA, 1555 bp, Oryza sativa
atggccggcggctcgtcgccggcgatacggccgatcggcaagtcggcggtgcaccggatctgctccggccaggtcatcttcgacctctcctccgccgtcaaggagctcgtcgagaacagcctcgacgccggcgccaccaccgtcgaggtcaccctccgctcctacggcgaggactccttcaccgtcgccgacaacggcaccggcatctcccccaccaatttcctcgctctgaagcaccacacctccaagatctcggacttcggcgacctcgcctccgtcgccaccttcgggttccgcggggaggcgctcagctcgctctgcgcgctggggaagctgacggtcgagacgaggaccaaggacgagcccgtcgggacgcgcctggagttcgcgcactcgggcgtggtgaccggcgagaggaagatggcgcggccggtcgggaccgccgtgaccgtcgagaagctgttctccacgctgccggtccggagcaaggagttcagcaggaacattcggaaggagtacgggaaagtgatctccttgctgaatgcctatgcgttgattgccaaaggggtcagattagtttgcacaaatactgttggcaagaattctaaatcggcggtgcttaggactcaagggagcagttcactgaaagataatatcattaccgtatttggtctgaacactttcaagtgcctgcagccccctggtagtggtcgcaattcaggggatagacagttcttctatgttaatggcagacctgtggatatgccaaaggtttccaaacttgtcaatgagctgtacagaagctcaaatgccaagcaataccctgtggctgtattgaatttctgtattccaaccacatcttatgatgtgaatgttgcgcctgataagagaaaaattttcttctcatctgagcatgccattttgctatctttacgggaaggttgttgggcagtttaatcttggttttatcattggaaagctggaccaggacctatttattgttgatcagcatgctgctgatgagaagtacaactttgagaacctttcacagtcaacaactttaaacatacagcctctccttcagtgaccactgagacttgacctatcaccagaggaagaagttatcgtttctatgaacatgagcactatcagagaaagaacggttttgttttagcagaagatctgcatgcttcaccttgcaaccgctattttataaaagccgttcccttcagcaagaatattacatttggtgctcaaggatgtgaaggagttaatctccatgcttgctgacagtcaaggtgactgttcaataatcagcagttacaagctcgacagaactgattctatttgtccttcaagggttcgtgctatgttggcttcgagggcttgccgaatgtctaccatgataggtgatccattgacaaaaactgagatgaagaagttgaggtccccttggaattgccctcatgggaggccaacaatgcgccatctagcagatctccatgctataaaaactgaaggtaagagattgtcggccaacactcatattctctag

SEQ ID NO: 496 - DNA, 1308 bp, Oryza sativa
atgaccaaagatgaggatttcaagctggtcaagatccagcagacccatgtactgagggtgaacatacactgtgatggctgtaagcacaaggtgaagaagctgcttcagaagattgaagaggcgtgtactcggtggccttagatgtagacaaccataaggtcacagtgactggcaatgtggactccgatacattgattaggaagctcaccagaggaggtaagcatgcagagctgtggtcacagcagaagggtggcagcaaccagggccacaagggcagcaacaaccagcagaagcagcagcagcagcaagggcagcagcagcatggacagcagcatcagaagcaaggtgccaacccaagcaaggatggcaacaagaacaacaacatcctcaaggaccagggcaagcaaggaggtgttggaggcctcatccagggcctcaaggccttcaagaaccagcacagcaagaaccagctccctgagcttgattcagaggatgatgacttgtatgatgacgaagacgatgagtttgatgatgactatgaggacgatctccgctttcttggagacaagatgagccagcttggtttcctcaggcagcaagctgcagctgcagcggcggccaatgtcaagaacaagaatgccaacactgccaccgtcaacaaccaccacaacaacgtcaatggcaagaaaggtggtggcggcggtggcagtgctggaggtggaaatcaccatcagaacaaccaccaccagaaccagaagaatcccaatgtgatcaacatggcagcagccaatgccaagatggccaatggtgcccagaagaacactggcgccatcaatggaatgatgggcctcaaccatggcctcggaacagccggtgccactcctggttttcagggctacaccggcttcaaccacccgtcctatgcttctgccggctatggagggcttcaacaacagcacctccagcaacaacagcagagcaacaatctcatggcaagcatgcagggttaccatcatcacccagcagccacggcggcgatgatgaacaacctgaggggtctaaacaacaacatgatgatgatgcatcagccacaacagcagccacagatgatgtaccaccggtctcctcagattagcccttacaccgcctactacaacccttacagctactactaccaccctggcgccgccggttatcatcccgccagcaatggcgatgtggagaccatgttcagcgatgagaataccaagggttgtgttgtcatgtagtagggatgctgttacagtgttacaatgtagaggttggtga

SEQ ID NO: 497 - DNA, 1281 bp, Oryza sativa
atggagaacatgagatctgagaactttaaccaagaaggtgtttcaatggagggcgtcaagcatgcgcccgagatggcaaacaccaacaggagggctctgcgggacatcaagaacatcatcggagcacctcaccagcacatggctgtgagcaagaggggtttgctagataaacctgccgctaagaaccaagctggacaccgtcctatgacgagcaggaaatttgctgcaacactggcaaaccaaccctccagtgctcccctgggcacccattggaagtgagaggcaaaaaaggacagcagattctgcatttcatggtccagcagatatggagtgcaccaagatcacatctgatgatttgccattgccaatgatgtctgagatggacgaagtggatgggttctgaactgaaagaaattgagatggaagacattgaggaggcagcacctgatattgacagctgtgatgcaaataactcccttgcagtagttgaatatgttgatgaaatttacagcttctacaggaggagtgagcagggtttgagctgtgtctctcctaattacatgttgagccaaaatgacataaatgagaagatgcgcggcattctcatcgattggctgatagagaggtgcattacaagttagagctattggatgagaccctcttccttactgtgaatatcatagaccgattcttggctcgcgaaaatgtggtgcgaaagaagcttcagttggttggcgtgactgccatgctgctcgcctgcaagtatgaagaagtgagcgttcctgtagtggaggatcttatcctaatctgcgaccgcgcctacacaagaacagatattctcgaaatgggagaggatgattgtaaacactcttcagtttgatatgtcagttccaactccatactgtttcatgagaaggttcctcaaggctgcacaatctgacaagaagaaacagcttgagctcatgtctttcttcataattgagctgagccttgtcgagtatgagatgctcaaattccagccgtcaatgctggcggctgctgccatctacactgctcagtgcaccattaatgggttcaagtcctggaacaaatgctgtgagctgcatacaaaatactctgaagaacagctgatgggagtgctccaagatgatggttgagctccaccaaaaagcaggacatgggaagcttactggagttcatagaaagtacagcacatttaggtatggttgcgccgcaaaatcggagcccgccgtcttcttgctcaagagcgtggcactgtaa

SEQ ID NO: 498 - DNA, 1248 bp, Oryza sativa
gcaagaagtggcaagcactggaggcaaaacagagcatcctccagcactctgctgcgaagaaaagggaaagccgccaccgccgctgcctccattgctgccgccaccacagccaccagcagcccaatcacagaacacagtcttcaatgtggttgattttggggcccgtggagatggagttacagatgatacgcagcaggcttttgaagaagcatgggcagcagcatgcaaggtggaggcatctacagttcttgtaccatctgaacttgagtttgtcgttggcccaatctcattttctgggccttactgcaaaccaaacattctgttccagcagctagatggaactattttagctcaaaccagtacaagagtgtggggttctggtttgcttcaatggcttgaattcacaaaacttagtggaatatcaattcaaggaagtggtgtcataaatggcattgaggttttatggtagttccaatgtcacagtaactggtatcaccattgttaacagctcacagtgccatctcaagtttgatagctgtcaaggagtaatggttcatgacctgaccatctcatcgcctgagaacagtcccaacactgatggaatacacctgcaaaattccaaacaagtcagcattcaccactctaacctcgcttgcgggcgatgattgtgtttccatccagacaggctgcagtgacataaacatacataatgtgaactgtggaccagggcatgggatcagcattggtggtctaggaaggtacaacacaaaagcatgtgtatccaatgtcaccgtaagagatgtcaacatgttcaaaacaatgactggtgtcagaatcaaaacttggcagcagggaggttcagggttggttcaaggcataaggttctcaaacatacaagtgtcagaagttcaaacacctatcataatagaccaattttactgtgacagaacaacttgcagaaaccaaacatcagcagtggcggttttaggtgttcagtacgagaatatcagggggaccttcacaatcaagcctgcccattttgcatgcagtgatagctcgccttgttcagagatcactcttactggaatacagctcaaacccctgatagtgccacagtatcacctgtacaacccattctgctggcaagcctttggagagttgtccacccccaccatccctcccatatcctgcttgcagatcggcaaaccatctgggaacaacgtgatgtcagattatgatctatgttga

SEQ ID NO: 499 - DNA, 1242 bp, Oryza sativa
atggggcgcgggaagatcgagatcaagaggatcgagaactccaccaaccgccaggtgaccttctccaagcgcaggagcgggatcctcaagaaggcccgcgagatcagcgtcctgtgcgacgccgaggtcggcgtcgtcatcttctccagcgccggcaagctctacgactactgctcccccaagacctcggctatcaagaatcttggagaagtaccagaccaattccggaaagatactgtgggatgagaagcacaagagagccttagcgcggagattgatcgaatcaagaaagagaacgataatatgcagattgagctcagcaggcacttgaaaggtgaagatctaaactctctgcagcccaaagagctcatcatgattgaggaggcacttgacaatgggatagtgaacgtgaatgataaactgagatggaccactgggaaaggcacgtgagaactgtatgataagatgctggaagacgagaacaagctgctggcttttaaactggtgggcaccagcaagatatagcgctgagcgggagcatgagggatcttgagcttgggtaccatccagacagggactttgcggcccagatgccgatcaccttccgcgtgcagcccagccaccccaacctgcaggagaacaattaagctgctaggttgccccgccacttcgatcagttatctcatccactgatccaccactggattgaatgtcctagtgcattgtcaactgtatccctgttttcatgtctgtttcgatgaactattgagcatgtcatatgtgagttgctttgtgtgccaatatatagtctgtctctagtacaagctctgtgcttgccattctgcctcgctgtagatagcaccagcaatggagctagctcagatatcagtaacttcgtgcaagctgcaaggtatgcttgtgttatcaccgcatttgtcagatggtgaatagtagtttgtgattgtaacaaacaatttatgcaagcttggtttcatgctaatgtcgtttcacttgcatttcaacacatgatatactgtcagttactgagttacatgactctgaggctctgagcatcagttagctaccacttacaaattaaagtacagtatatattatgcataatatcattagcattccaacacaaagacagtgatacactgtcatttacatcaactattggtgttgactaactctgaacatcagttggtctgcattcgttgcaattttacatgctgcaataaa

SEQ ID NO: 500 - DNA, 1232 bp, Oryza sativa
  misc_feature (82)..(82): n = any nucleotide
  misc_feature (159)..(159): n = any nucleotide
  misc_feature (432)..(432): n = any nucleotide
  misc_feature (529)..(529): n = any nucleotide
atgctgcggaggatggtggtgtcggacacggacgccggcggcggccgccgggaagccgggaaggttcaaggtggtggcggcngcggcgcggcgctgttcgccgtgccgaggttgtttgttgggctggccgcgaagcccggggccggggatggccggganccggcgtcgaggagcccgacgtcgccgctggaccccaaggcgctcctgctccggtcgccgcggtcgccgaggacgtggtgggacgccgagccggtcggcctcgccctcgccgccgccgccgacgacgacgccgccaagaactgcctcctcctcagcccgcgcgtcgggccgctgaagtcgttcgcctcgctgcccaaggactgcggcggcgggcactcgccgcgcccgggggagctcgccaaggcgatgtcctgcgccgcggcggccaccgcnaccgcctccgccgccggcggtatgtccgtgccgtgcggcgtgttcttctacggggatctgaagtctggtccggaggccactcgatccggtggcgctnaccccaatgccaagcgccgctccttcgatctcggcggcggcaagatccctgggccgggctctctgccggcgtcgatcggcggcgtccggcggttcatcggctcggtctcggcgagcgagatcgagcagtcggaggactacacctgcatcatcgctcgcggccctaatcccaagacgacccacatatttggggactgcatcttggagccccagacgatggacgcctccgcctccgccgccgccatggatgtgacggaagcacccaccgagtcctactgggtggtgaagtgcgacgccggcgccgccccggcctccggcggcggcgacttcttgagctcctgcttcacttgcaagaagaagctggagggaaatgacatttacatttaccggtggtgagaaagcattctgcagcgccaattgccgggaccaacaaatcccgatcgaagaggaagccgagaacaacaccaccatcgtctcctccccgccctcatcctgctcctccctccacgaggacatcttcatggccggcatgttcgtcgcgacatgacctgacccttcccgtggcctggaccgaccgattgaacctgtcctcgcctccgcaagttgtccaaatttttttccccctggtcttctaccaggggatagatcaagatgatcgaatcaccagctcacattgctatctatcatcagtctgttgtttttga

SEQ ID NO: 501 - DNA, 1149 bp, Oryza sativa
atggggtcgtggcggcgcaaggcctacggcgccctcaaggactccaccaaggtcggcctcgccaaggtcaacagcgacttcaagttggatattgcaattgtgaaggccaccaaccatgtagaatgccctcccaaggacaggcacgttagaaatattcgtggcgacctccattaaccgccctcgagcggacgttcaatactgcatctatgccttgtcaaggagattgtccaagacaaagaattggacagttgttgcattgaagacattgatagtggtacataggctcttgagagaaggtgatcctacattcaaagaagagttcctggcctactcatacaagggaagcgttttgcagagagcaaacttcaaggacgattcaagccaattaggcttgggattgctctgcgtgggttcgcgcctacgcgctcttcctagaagaacggctcgagtgtttcaggatcttgaaattcgacatcgaaaccgagcgtctgatgagatctcctgagtgttccagcaagagaactagaaccctgccttgcattgaacttctggagcagttgcctgccttgcagcagctacttttcaggctaattggctgccagcagcctgaaggtgcagcaggcacgaactaccttatccaatatgcattagccctggttttgaaggagagcttcaagatctactgtgcaatcaatgatggtatcatcaatcttgttgatatggtaaagatgctatcaaggctcttgttgtctataaacgagctggccagcagcagccaccatcatcattcattgcaacaatggaagagtacatccgagaagcaccccgtccctcgattaacagcgtggctggaggctttgacaagctgctactcgacagcctctacgaagacgagacgaggcggcggcagatcgccggagtcacctacaccggtagcattggaggaggagcacccaaccctttcgacaccaacgatccatttgctacgtcgagcagcttcttgcccccatccaatgtccagtttgcaatgctgaaccagcagcagcatcagtactaccagtctcaacaccagcaacaatactaccagcctcatcatttccaggatcatcaacatcaccataacattccaatccgtttggtgaccctttc

SEQ ID NO: 502 - DNA, 1124 bp, Oryza sativa
  misc_feature (96)..(96): n = any nucleotide
  misc_feature (103)..(103): n = any nucleotide
  misc_feature (275)..(275): n = any nucleotide
  misc_feature (286)..(286): n = any nucleotide
  misc_feature (313)..(313): n = any nucleotide
  misc_feature (316)..(316): n = any nucleotide
  misc_feature (319)..(319): n = any nucleotide
  misc_feature (340)..(340): n = any nucleotide
atgaacagggagaaatccccgatcccgggagacggcggcgacgggttgccgccgcaggccacccgccgggcgggccctccggcggcggcggcggcngcgcgantacgacatcagccgcatgccggatttcccgacgaggaaccccggccacaggcgcgcccactccgagatcctgagcctccccgaggacctcgacctgtgcgcggccggcggcggcgacgggccgtcgctgtcggacgagaacgacgaggagctcttctccatgttcctcgacntggagaagctnaacagcacgtgcggggcgtcgtcggangcngangcggagtcgtcgtccgccggngccgcagcccatggagcgaggccgaagcaccagcacagcctgtccatggatgagtcgatgtcgatcaaggctgaggagctcgtcggggcgtcgcccgggacggaggggatgtcgtcggcggaggccaagaaggccgtgtccgcggccaagctcgccgagcttgctctcgtcgatcccaaagagggcgaaaaggtaggatttgggctaacagacaatctgcggcaagatcaaaggaaaggaaaatgcgatatattgctgaacttgagcgcaaggtgcaaaccctgcaaacagaagcaacaacactgtcagcccagttggcactgctacagacagagagataccagtgggctaactactgagaatagtgaactgaagctacgtctgcagaccatggagcagcaagtccacttgcaagatggctttgaatgacaccctgaagtctgaggttcagcggcttaaggttgcaaccggtcaaatggcgaatggtggagggatgatgatgaacttcggtggcatgccacaccaattcggaggcaaccagcagatgttccagaacaaccaggccatgcaatctatgctggcagcacaccagctgcaacagctccagcttcatcctcaggctcagcagcagcaggtgctgcaccctcagcatcagcagcagcagccattgcaccctctacaagcgcagcagctccagcaggcggcacgagacctcaagatgaaatcgccgatgggcggccagagccagtggggagatggcaagtcaggaagcagcggcaactga

SEQ ID NO: 503 - DNA, 1034 bp, Oryza sativa
atggcggctgctgcggcggcgctcttggccttcgtcgccgtcgccggcgccttggttgcgcaggccaccgacccctacgtcttcttcgactgggacgtctccttcatcaccgcttccccgctaggccttccccagaagaggttatcgcaatcaacaagcagttccctggccccgtcatgaacctcaccaccaactacaatgtggtcgtcaatgtgctcaacagcttggatgagccattactcatcacttgagggatgggatccagcaaagaaagaattgctggcaggatggtgttcttggcacaacctgccccatacctccaggttggaactggacctacaatttccaagtcaaggaccagattgggagcttcttttacttcccaccccttagcctgcagcgtgctgctggtggtttcggaggtattactgtcaacaaccgcgccgtcatttctgtcccattcgacacaccagatggagatatcaccttgttcattggggactggtacaagaagagccacacggggacctgaggaagatgctcgatgatggaaaagagctcgggatgcctgatggagttctgatgaatggcaaggggccgtataggtacaatgattccctcgtccctgctggcattgaacatgagactatcaaagttgaaccagcaggaaaaacataccgtttccgtgtccacaatgtgggtatatcgacgagcttgaacttcaggattcagaaccacaatttggcccttgttgaaactgagggatcatacacaatgaagcagaatttcacaaatcttgacatccatgtgggacagtcctactcatttttgatcaccatggatcagaatgcaagcagtgactactacattgtggccagtgctaggtttgttaatgaatcactgtggaccaaagttaccggtgttgcaatcttgcagtattcaaattcaaagggaaaagcttctggccctcttcctgatccaccaaatgatgagtacgacaaaactttctcaatgaaccaggcacgctccatcag

SEQ ID NO: 504 - DNA, 1016 bp, Oryza sativa
atggaggagcaccagaactggaagaagaacgcgccggtgctctacgacctcgtcatctcccagccgctcgagtggccgtcgctcaccgtccagtggctccccctcggcacccacacctccgacgagacgcccaaccacctcctactcgccaaccgcgcccgctgcatgccgcagaggccgtacacggtggctaccaagacctgcgtggatgaggtgcacgtgtaccatcttggcgacggcggcgagaagggcggcgccgatgtggtgctcagggggcatgaagcggaggggtatgggctggcgtggagtccgatgaaggaggggttgctgctgagcggctcgtatgataagaagatttgcctttgggatctcgctgctgggagtggagcttcgtctctggatgcacatcatgtgttcgaggctcatgacgatgttgttgaagatgttgcatggcacctgaaagatgaaaacctatttggatctgctggggatgactgcaagctgatgatgtgggacttgcgtactaataaaccaggacaatctatagtagcacaccaaaaagaagtaaactctttgtccttcaatccgtttaatgagtggatcttggcttcagcatctggagatgcaactattaagctatttgacttgcgaaaactgtcaagaagcctgcatgtattcgacagccatgaggtttttcaggttgagtggaatcctaatttggagactgtgttagcatcctcagctgcagacaaaagggtgatgatatgggatgttagcagaggatcggagacgagcaggcagaggaggatgcaaacgatggtccaccggagctgctgttcgtgcatggaggccacacagccaagatatcagagttgtcgtggaaccccacccagaaatgggtcatggccagcgtggccgaggataacatcctgcagatctgggagatggcagaaagcatatactgtgatgacaattatctccatgacaatgatgatgactcgtgcccagccacataa

SEQ ID NO: 505 - DNA, 1004 bp, Oryza sativa
atgacgacggaggtggcgctcctccgtggcccgaccaacctcgcttcccccacaagctccaccctgcgctatttagccaatggcgacagcgatgtctcgctcccaaggagaagcagccgcgaggaggagagccctgcaggactccaagaggaggaggaggaggaggaggaggagaggtggtcgttcttggcgctgctgcttgagctgctgcggaagtcgctgctccggtgcagtacggtgcaggagggcggcggcgagtgcgggatggagattgggtggccgacggatgtgcagcacgtggcacacgtcaccttcgacaggttccatggattcctcggcctccccgtggagctcgagcccgaggttccccgccgggctcccagtgcgagagtgcaagtgtctttggcgtttcaacagaatcaatgcaatgttcctacgattccagaggaaacagtgtaccaacgattctcttgatgatgcaaagacgtctttatgaacaaggcggtcttcgggtggaaggtatttttcgtataaatgcagagaatagccaggaggagtttgtgagagatcagttaaatagtggaattgtgccggatggcattgatattcactgtttgtcaggtctaatcaaagcctggtttagggaactgccgagtggggtgctggattctatcccacctgaacaggtgatgcaatgccaatctgaagaggattgtgctcgagtcgccaaatgccttccaccagctgaagcagctttacttgagtgggcagttaatttaatggctgatgttgtccaagaagaacagataaacaagatgaatgctcgtaacattgctatggtttttgcaccaaatatgactcagcagatgtcagatccattgaccgcactgatgtatgcggtgcaagtgatgaattttctcaagatgctaatacagaagaccctcaagggtagacaagagtccaatctggaggacacatctctgccccataaggacccatctgat

SEQ ID NO: 506 - DNA, 957 bp, Oryza sativa
caacaaattattgatgcaattttggttttgaacattgatgatcctccctgcactattggtgcagctgctcttctattcgttttggcaagtgatgagattctcttaagctgtcaagagatcaagtcgctcgacaaagatgacaagaaaacaacaaggccagaactgtgtccaaagtggcttgctttgttgacaatggaaaaggcatgcttgtctgctgtttcagtggaggacttctgacactgtgtccagagtcggaggaaattttaaagagacattaagggagttgggcggtcttgatagtatttttgacgttatgatggattgccattcaacattggagcaaagtgccgctctcctcttgaaatgtttgaaaatattggaaaatgccacatttctaagcgatgataacaagtcctcgctttcttttgttggtgtcattatcagtattattgagttattatcagcttttggaagactgcctcttggcatcagttaaggttcttatgaacttagcaaatgacaacccatctggttgtgaattgattgcgtcatgtggtggacttaacaccatggcctccttgatcatgaagcatttcccctcattttgttttgtcgtggacaacaactataacacgagagatttgcgagatcatgaacttgattttctggttgccatattgggcttgcttgttaaccttgtagagaaggatagccttaataggatgtcatagcactcctctgttctgtattcttagcaagtcaaggtgctagtgaagcttctggaactatatcaccggatgatgaggagtctttgatgcaaggagcacgggaagctgaaatgatgatcgtagaggcctatgcagcccttcttcttgcgtttctttcaactgaaagatgatcacagaggaaacgcactcagctgtcacagaagttatcgagaaatgcaaactttcatag

SEQ ID NO: 507 - DNA, 926 bp, Oryza sativa
atggcggcgattccccgggaggcatgggagggctgcagcgtcctcctcgacatcaacgacggcgaccgcctcgccttcttccgcctctcgctgcagccgctcgtcggtcgccccttcggctccctcttcagcgtcggcccctccggcctcgtcccctgcgccgacgccccatcttctcgcgagggacaatagatctcttgtcgataataatacagcacagaatttatctagcgatgacatagaggcaatgaagagggtgatgagattgtagaagctttgatagcaaatagctccacatttgggaagaagacccttttttcccaacaggagaaatacaaactaaagaaacagaagaaatatgcacccaaagtgcttttacggcgcccctctacccgaagtttatgcgagttgatgcactgtccctcttgttgtctatggcaaatgttggtccatattcggatgtccttgtggttgatatggttggaggtttagtagttggagctgtagctgaacgcttaggagggtactgggtatgtttgcagcacatatcttggatctgctgctagctccatagacattataaggatgtataatttgagcagtgacatgactaccagagtttgattgttgctgctccggggcatgatgttgaaagttttgttgctgatctgcttcccctcttgtcttattcagctccatttgctatctatcaccaataccttcagcagcctctcgcaacatgcatgcacagcttgcaagtatcaaaaatggctctcggattacaaatttctgaaccctggcttcgtgaataccagcaggtccttccatcacgaactcatccacacatgcaaatgaatgcatttggtggttatattttgagtggcattaggatacacaatggcgatgcatgtaatggaagcaagtga

SEQ ID NO: 508 - DNA, 857 bp, Oryza sativa
ctggatgctgtgcttgatgttggtggtgtctatgatcccagccggcatcgctacgatcatcaccagaagggctttaatgaggtctttggacatggctttaacacaaaacttagcagtgccgggcttgtttacaagcactttggtaaggagataattgcaaaggagcttgaagttagtgaagaccatgaagatgttcatcggttgtatcttgcaatatataaaagctttgttgaggcgcttgatgcagtcgacaacggaatcaatcaatatgacacagaccaacccccaaagtatgtgaacaacacacacttgtcttcacgcgttgggcgtcttaatccagactggaccgatccagaccagtcacctgagaaggaaaatgctgcatttcaacaggcaatgatgcttgctggaagtgaatttatggaggtataatagtctctgttcgctttcatgttaagtcatggttacctgcgagatctattgtcttggagtgtttgttgtcaagaggaaaggttgatccaagtgaagaaattatggttttggatagattctgcccatggaaacttcatctgtttgagcttgaagaggagctgaagattgatcccctcacgaagtatgtgttgtaccagcaggatgagaggagcaaaagttggagagtacaagctgttggcgttgctccggatagatttgagagccgaaagcctctgccggaaaagtggaggggcttgagagatgatgaactgtcaaacgatattggcattccaggatgtgtctttgttcatatgagcggcttcattggcggcaataagacgtatgagggagcgttggaaatggcaagagctgctatcaagtgttga

SEQ ID NO: 509 - DNA, 806 bp, Oryza sativa
aacctgtcgctcaacgcgtcctgctcctcggatgcctccgtggagtcgctccgcggccgggactcctccggtgggaggctggagaggagctggtccaagaggaggtgcgcgtgggtgactccgaccagtgtcagatccttgctatgtcatcttccatgatgaggagtggggtgttccagttcatgatgacagagattgtttgagctgcttgtactgtctggtgcattggccgagctcacatggcctgaaattcttaaaaggaggcaacttttcagagggaaattttcgtggacttcgatcctgttgctatctctaaaataaatgagaagaagcttgtagcaccaggaagtgttgccaactcccttctgtcagagcaaaaactccgagcagttgttgaaaatgctcgacagatacttaaggaatttggatccttcgatcgatactgttggggctttttgaaccacaagccaatagtgagcaaattccgatatccaaggcaagtccctgtcaagagccccaaggcagacatgatcagcaaagacatggtccgaaggggtttccgaggcgtgggcccaacaatcatatattccttcatgcaggcagcagggctgaccaatgatcaccttgtcagttgctttcggttcaaagaatgcaatgaagctccaactctttgcacgagtgatactagcaatgcaaattcagaggcagatctaagtgcagatgaactgagaacaaaaatctgcagcaaggagatggctgcaaaagcagagctgttgaggacgatcggtacgcttatcatttcatag

SEQ ID NO: 510 - DNA, 732 bp, Oryza sativa
gtgaatagttgtactgggaaaatggggaaggctgttgctgaagcagctgtatctgctggtcttcagttagttcctgtatcattcagtgctattgaggttcctgatggaaaggttgaaatttgtgatagggaaatttatattcgtgacccatctgaaggagaaagtattctcccttcgattgctaaggattacccagatatgatagttgttgactacactgttcctgatgctgttaatgaatgctgagctttactgtaaacttggattgccatttgttatgggcacaacaggtggaaataggcaactgttgcacaaaacagttgaggacgcaaacgtgtatgctgtgatatccccacagatggggaagcaggttgtcgcgtttcttgctgccatggaaatcatggcagagcaattccccggtgcattttcaggttacaaactagaggtcatggagtctcatcaagctacaaaattggacatttctggcacggccaaagctgttatctcttgctttcagaagttgggtgtgtcatttaacttgaacgagcgggatcctcaggaacagcttacattggttggtgtcccagaagaacatctttctggtcacgcatttcacatgtaccatctcacttcaccggatgagacgtttcatttgagtttcaacacaatgtatgtggccgttcaatttacgcagagggaactgtggatgctgccctgtttctccataaaaag

SEQ ID NO: 511 - DNA, 698 bp, Oryza sativa
atgcaaagctcgccgggcgcccccaagctccggccaccccctataaaacccgccgctcctcaccgtcaccggcaagcacagcaaagcagcagcagcaaaggtaaggtaatatttgcagcatcgtctgaagaagcacaggagcaggggagatatggcggcgagcaaggggaacgcggcggcggcggcgtgcgcgctcgtgctggtgctgctggccgtgggcgcggaggcgcagggcggcggcgggggggagtgcgtgccgcagctgaacaggctgctggcgtgccgcgcgtacgcggtgcccggcgccggtgaccccagcgccgagtgctgcagcgcgctcagctccatctcccagggctgcgcctgcagcgccatcagcatcatgaacagcctgccttccagatgccacctcagccagatcaactgctgtatctgcctaagacgagacgagagttaaccccggacgccatggaagaagaataatcaaggtgttgacgaagccgtcgttgtcttcgtgtctcgtttagtaaaatcttcagattgtactgcagttgctattgatgtcgatgaataataccagtaagtactatggaacaatcatgtaatgcccggttgctggttcattaacgatgacctcctttggctatcgtgcccctctttgttttccttgtgtgttttcctttctcagcttatgttaa

SEQ ID NO: 512 - DNA, 582 bp, Oryza sativa
gcggcgtcaggggcggtgcagtgccagttgatggatatggttcaccctggggtggtgccaatgcacaagtttgatgctaagaccgagtatgacatgatccagaactacaagattcttcaagatgtgttcaacaagctgcggttgagcaaggaggtcaacaagcttgtcaagggacgtccattggataacctggagtttctgcaatggttgaaaagatattgtgattctgtaaatggtggaatcatgaatgaaactacaatcctgtagagaggaggtctaagggttgcaaagaacgcagtctcaaaggttccaacaagtcgtccaaatcactacaagctaatagattgtctagtgcaaattcagctgatggagctgaaaatttctatggatagcgcggagaaagaaagagacttctacttttctaagctgcgcgacattgagatactgtgtcaaagaccagagttggagcatcttccggctgtacagaagatactttatgcggctgatgcaagagattcgccattgcctgaggctaatgaaataatcacccggtcaccaagcatgttcccagatgaagcctag

SEQ ID NO: 513 - DNA, 488 bp, Oryza sativa
gacttagtttgggagatagcagcccttgaggaggaagttgttcgcaaggaactgcatttgctttccctctacagggcagcatttgatcaacacctagaatctcagatcgctgataaaacgacttgagaaaattgacccaacaaaaatggcacatgaagagcagctctgtttttggatcaacatccacaacgctttggtgatgcatgctgcatataatgtgggtgggctttcagtaaacgcccaaattatccagaactcaattattggatgccaatcccatcgcacttcagtgactctatttactccactgaaaaaatcggcatcagggagctccatacatccatatgctcttcatcctccagagccacttgctcattttgctctttccactggagcaatttcagatccacctatcttcctacctaaagttctccatcattatgcgaaggatgctgctctcgagttgcctgacttggttgagatggcat

SEQ ID NO: 514 - DNA, 462 bp, Oryza sativa
atggcgcccaaggcggagaagaagccggccgcgaagaagcccgcggaggaggagcccgcagcggagaaggccgagaaggcccccgcggggaagaagcccaaggcggagaagcgtctccccgccggcaaggccgagaagggcagcggcgaggggaagaaggcggggaggaagaaggcgaagaagagcgtcgagacctacaagatctacatcttcaaggtgctcaagcaggttcaccccgacatcggcatctcctccaaggccatgtccatcatgaactccttcatcaatgacatcttcgagaagctcgccggagagtccgccaagctcgcccgctacaacaagaagcccaccatcacctcccgggagatccagacctccgtccgcctcgtcctccccggcgagctcgccaagcacgccgtctctgagggcaccaaggccgtcactaaattcacctccgcttag

SEQ ID NO: 515 - DNA, 441 bp, Oryza sativa
aagcgggtgatggtggtggtggaccagagctccggtgccaagcacgccatgatgtgggcgctcacccacgtcgccagcaagggggacttcctcaccctgctccacgtcctcccccacggcggcggcgacgcctccgcgctcgccaactccctcggctcactctgcaaggcctgcaagcccgaggtggaggttgaggcgcttgtgatccaagggcccaagctgggcaccgtcctcagccaggtgaagaagctggatgcatctgtgctggtgctgagccaatgcaagccatctcctttctgctggagcagcggcgaggagttcgtggaggagtgcatcaacagggcggactgcctgacgctggcggtgaggcggcagagcaagggcgtcggcggctacctcatcagcacccggtggcagaagaacttctggctgctggcttga

SEQ ID NO: 516 - DNA, 420 bp, Oryza sativa
atggcgggcaagggaggcaaggggctcctcgcggccaagaccacggcggcaaagagcgccgacaaggacaaggacaagaagaaggcccccgtctcccgctcctcccgcgccggcctccagcagttcccggtggggcgtatccacaggcagctcaagtcgagggcgtcggctcatggccgcgtcggcgccaccgccgccgtgtactccgcggcgattctcgagtacctaaccgccgaggtcctggagctggccggcaacgcgagcaaggatctcaaggtgaagcgtatcaccccgcgccatctccagctagccatccgcggggatgaggagctcgacacgctcatcaagggcaccatcgccggcggtggcgtcatcccccatatccacaagtcgctcatcaacaagacctccaaagagtga

SEQ ID NO: 517 - DNA, 1836 bp, Oryza sativa
  misc_feature (522)..(522): n = any nucleotide
  misc_feature (1515)..(1515): n = any nucleotide
  misc_feature (1612)..(1612): n = any nucleotide
atggtcatctacctaccggtcgttaagctctccaaagaacttgacatgcatcgcgtgatgctgatgcagttgcagcttaagtccaaggagaatttatcagagaggacaccagaaaaaacactaattaacagtctgaaaaacttgctaatagaaatcgacatctcttcatccaaaaataatttaaatcatagctatgaatcgggacaaacatttacccagtgcagtggcgaggccagtgacacagcgagagtgacaagtggtggcgaggcgaggaggcagctcgcggcgccggtcatggccgacgcgaacaggcgcatcgacctcgccgcgccgctcgtctccgtgcggcgccatggcggttgcgccgccggcgaggcggcgacgcggacggatggcacgcggcccggtcatcccaagagcgtccgcacccggcgcgcgacgatggtgcacgccacggcgagggacgaggagcccgcgcgcgacgccatggcggtggtcgccgtcgccgcgccggtgcgggancgggatcaggaggcgcggttctccgacgcgctctccgtggcggacagctgcctcaccgtgaactgcagcagcgccagcggcctcagcgacgccgtcgcccagcctccgcgcggcgtcggcgtcggcggcggcgtcatgatggaccgcttcctgccggcggcgcacgccgtggctgtcctctcgccgcaatgcagctcccggaaggccagcgtcgccgcggcggccgcgcgcaacggccacggcgccgacgcgttgctgcctcctcccgagccaacgccgacgattcgaacactgtgcatcgttccgagggagaagaccgacgacgccgacgccgccgtcgacgacaacggcggcggcggcgagtgggacgcgcacagtacgcggggcgtctcgtcgaggaggttcgggctgcttcttcccacgcggtgcatgaagagcaccttgctcctcctcaaaccagcgcccgccatgagacgccgcggcggttgccggcggcgaaaaccgcggcgcgcccctcctctccaagatcggcaggagccaaagcttggggaacccactcgtccggagcgcgcacgacacgggcatcatggtaagcagcaacaaacatctcctccacctccacctgctgccgcgcgacgaatcaaaacgcgagcgattctcacttgttcgtccggtgcgtcgttgcagcgatcctgggaggaagtgtatatcaactccctccggcgatcaggccgcggcggccggaagggtatcggcgcgttgctgtcgccggagctggacacgacaatgccgtcggtgcgcgagctttacctggaacaaggagacggcgccgtccaccccaaggctacccacctcggcttcctcctggtgttagacagaagccacgaccaatgccacgacagccacgacgatcccaagctgctgccgcctcctcgcttcccaaggccggcgccgcccaaggtgttcgacggcgggaagaaacaaaggcgcgangccgccggcgccggcggaggcggcggcggcggcggctacgggtggccgctgctattggaggacaaggccgcggcgagccgtgacatggtgcctccgntcccgccgctgccgtcgatgaagtcgccgtcggagtcctggctctcgcgggcgctgccgtccgtgtcgagcaaccctccggcgacctccttcctcggcatccacgtgcagcacaagaagcagtctccacctccaaggtgttcgtcccgagctccggccaagctcgtggccgacggccatgccaggccacggcaaatgcgaatacatgatctacagaaatcatag

SEQ ID NO: 518 - DNA, 999 bp, Oryza sativa
atgctcccaaaactagtccaaaatgcagatccagtttttctcaaacggttcgtgaacggtgaatcatcggaggacgtggtccggctgactgtccgagctcctgctggctgctgcaatcctgcactgcagccctccctctgccgctttcctctcctgcgtgagggtgacaacacgggcatggattacgatgcgacacctgggtcgacctggcaggaatctctcgagtgcggacagcggcggccgagcaaagcagcggcaacgcggccagtaggactagagtgcatctcaacgatcgaccatcataacgagttccacgtagctattcgtacatacgctagacctaataatactgcccacgagttcacctaccctgttcaatcgagagccagagcattcaccgaaaacaaatcatgggaatttgaaggaggggcctggaggaggaggaggaggcagcaacatgccaatggcgacggcaagctgctgctgccatccatcggcatgcccaagaaaggcgaccagtctagtggccctggcgctcattcctcgttgcccccacaatctgctaaagcgaagccatttcctagtcaagaagaggcagagaagagtgaagagcaaagagggcggcctccgccgaggacagttctacgcatgcatgccgtcggcggcgacctggagaaggggttcgagatcaagtacccggtgatgaagccgatggcgagctcccgcgccatgatccacgacatcgacgacggcttcgagatcaagttcaccccagggaaacctgcagcatggaagaacgacagcaagggagacggcaaagggcatcagcagcaacatcaacaacaccaacaccaacaccatccacagcagcatggcatgccccaacaccatccgcagcacggcatgcccatgcccccaggtttcaggtaccctgcaaatgtggtcaggcaagggcagataagaggtggaacattcatttctgcgaagcccagtacgtga

SEQ ID NO: 519 - DNA, 915 bp, Oryza sativa
atggtttcgttactatgttggaagcacaacctacgctcgtggagcaagatagccgaactcaagaagattatgcgggttggtaaagcccgcgattttcctgaagaggagcaaggaacaatctggatgggagaaagattgtgtgtgcctgataatgaggaattgaaggatttgattcttagtgaagctcatcagacccacgagttaaagcagaacatcacagcaggtttgttgcaacctctccaaattccggaatggaaatgggaagaaattgtttgcgcccttgattttggtggatcttgggataagaatttgccgtatgcagagttctcttataataacagctatcaagccagtttgcagatggcaccgaaaaagttaagagcaatcagagagagattgaggattgcacaatctcatcagaagagttatgctgacaatcgtcgccgagagcttagttttgaagccagagatcatgtttatcttcgagtcatgccgctcagaggggtgcacagttttcaaaccaagggaaaattggcaccacgttacgtgggaccatatagaattcttgaacgaagaggagaagtcgcgtatcagttggaacttccacccaatatggcgagtatccatgatgtgtttcatgtgtcacaattgaagaaatgcttaagagtacttgagttacaggcaagtcccgacagaattgagatacatgaggatttaacttatgttgaaaagcctacgcgtattcttgagaccagtgagaggagaaccaggaataaagtgatcaagttctgcagagttcaatggagtcatcatttggaagatgaggcgacatggaaaagagaagatgagttgaaagccgcccatccgcatctcttcgcaagttcttccgaatctcaaggacgagattccgtttaa

SEQ ID NO: 520 - DNA, 717 bp, Oryza sativa
atgtacgcggaccagatctccaccggccggaagcgctccatccacgaccgcatcgacggcgaccagcccgccgcccgcgctggcgccggcgccggcggccggggggcccgtaacccgccgtccaagaggcaacggcaaactgatgaaaaatggaagcatgatctttaccgggaagacgatgaaccagcttcaaaatcaattgatccacgggatttgcgattgaagcttcagaagaaaagctctcagcaaagctttgctggccaaaggggttctggtgtacgtgatctacgtgagatgctttctggaacaatgcacccacagccagtcaatgcggaccctccaaaggcaaagccatcatcagagatcgtgaaagtcacaaggcgtgaaaatgcagatgtaatgcctgtacgtcaaagtaagaaagtaccaaaaccgacgtcatcgaagaagacatctcagccgaaggctgacagtccacttgatattttcctgaaatctcttggacttgagaagtactcgattaccttccaggcagaagaggttgacatggcagccctaagacacatgactgacagtgatcttaaagctttgggcattccgatggatataggtggcaccaaactaatatggaaacttaaggtgggtgttctttcagggtccccggaagaagatcatgcttgccttggaatcgagagcgtagggagggctggcgtgtaa

SEQ ID NO: 521 - DNA, 516 bp, Oryza sativa
atgaaagaagaaggtgcgacggggctacccgggttcgatgtgccaccgagggtagaggaggacgacgtcgctgatgtcggtgatggcaaggagctagtggacaaacgcatcttgggctccgagagctgccggttgacggcgaatggtggcggcgaacatgttggcactcgcttcttcctcaacatcctgaagggccatgctgctcctctgccggtgtatctgcctgcgccgcttctcccacttgacctcccgggttgtctccttcatggacagctgcttggacagtatcctcttcttgccactgctgctggtggcgacctgctggagcatcctcgtcgtcgccagcgcctgaccagccatgatgacctcaccttgctccctctcgatgtagagcgacaacggcggatccttcctggtgcgatagatatcgcagcagctgtcgtgccacgacttacgacagctgctgcaggaggaaggagaaggaaatggcagggcaaagaggggacagggagatga

SEQ ID NO: 522 - DNA, 465 bp, Oryza sativa
atggagcatttcacaagaggagtggtgctcgggatgccttccatccaaagatgccattcactgtcatgtcaaatgggccaggcagagcgcccacagattgatgtgcggaaggcagtgatccagtgtaaagaggaatcacggtgctcaaaatgctgccatcctgcagatatgccgatcattcctgagcaggcaatggagttcctctctcgaacatggagcccctcatcatcagatttcttccaacaactcaacgctggctacatgaaagcaattcttcgaggtcatttcttgagtgctgtttcggtcactggacgccagcgaaagaagaggaaagaagagctcaggctgcacgcagcacaggcccgcgcggctgtctcggttgctcagctcgccgcagcaatcgcaggcattcgtgtcggtgtgcgaactgaggccggacaacctgaagtatgtcgaggctgctga

SEQ ID NO: 523 - DNA, 378 bp, Oryza sativa
atgaggagagctgagaacgtgagagaagagaaagaatgcgaagcggcgctcggtgatgcgggatacggcgtgatgcgagagagagaggagccgatggatcgtgtcgtcgcctcaggcttgccgatgggctgcgccacgcacgcatggaccctgatcgatcgccgatcgatggatcgcaacgtggccgtggacatcaatcgcgatcgagcgacggcgcccgtggacgtcgatcgaatcgctgccgtcgacgccgagttgtcgaaggatctcgccgtcagctccgacttgctgatggactacaccgtggatgccgagtcgccgattggtctcgccatcgccgctgccaccgaatcatccgtagatcgcgttctcacctag

SEQ ID NO: 524 - DNA, 303 bp, Oryza sativa
atgagaaaaataccaacaaggaggtgcaataataaaggacaacaacgatcaagtgaggcagctctcgaggacgacaaatgcaagcctcacctgaaaggaaacaaactacggagagaattaagcggagtcaggatgttcctcggcgcgatcccgcggcggccgagcaaggaggtggcgtacaagcagctgcgctcccacctcatcgtcatggcctcctgcgttgccgccatccgcgccgccccctacatcctccacttcctcaaccgcgacgcggaccgcctcgagctcaccctggagctctag

SEQ ID NO: 525 - DNA, 4269 bp, Oryza sativa
atggggggatttcggggcgtgacacagaccgacatcctcgtaatcgtatgccggaaccaagcgacccatcgtcatcgtcagacagacatccacgaaggacacacgatcgccgacaacccaccgcccccaacgctgggtgtagggctttcagtcgctccctacgtgatgtccgatggcctgagagattccgaccctggagcaatagaaaagtacgatgggagcaccgacccagaggagttccttcaagtctactccacagtgctctacgctgccggagcaaacgataatgcgttggcgaattatttgccaactgcgttaaaaggttctgcacgttcatggctgatgcatcttccgctctactcaatctcttcgtgggcagacctgtggcaacagttcgtcgctaatttccaaggaacatacaagcgccacgcgatcgaagacgacctacacgcgttgacacagaactcgggtgaatcattgagagatcgctatactacccaggagttggcgacaagacgcatcacaaccactcggagattgtttgagattgttgagcgatgcgtccacgcagatgatgcgctaagacgcaagaacgataagccgaagaccgagggagagaagaaactagccacgaagcatcagagtcaagcaagaagaaaaaacgcaaaagtgggaaaaggaaagctcaagcggaagtcatcgcagcagaatacgcgaaccctcccaagcgcccaaacccacaaaaagcacattgcatttgaaaaaggcaagcgagtacgcgtggtcgagaaagacaaggaggtggttcctcacgaatcagattcaggatatccagactccgacctccacgtttcacacatcttcggaggttccacaacgtactcctcaaagcgagaatacaagaaggtggagcgcgaagtctgttcgacatggcagggggctgcacccaagatgaagtggtctgagcagaagatagagttctcagaagaagaccaccccaagacagccgccatcccaggacgatatccgatcgtggttgaacccaccattcggaacatcaaggtagccactttggacgcgatgggaattccgcaaagcgagttgacaccaaccgaccaacctttccatggaattactccccaatcatcgtccagactattgggcaagattacgttgcccgtgactttcggccaagccaacaacttccgaacagagcagatcacctttgatgtcgctgaattcgatacagcttacaacgctatcatcggaagaactgcacttgcaaagttcatggccgcatctcactacgcgtatcaagtgcttaagatgccgggaccgaagggaacaatcactattcaagggaacgcaaagctggcggtgcagtgcgacaaatggagccttgacatggtcgagcaaacgcccagcccacccgccacgactgagccacccaagaaagtgagcaagacaaacaagacgccgaaaccagacgtcgccatcaagatcgttccactctccagtgccaaccccgacaagaccgtcaagatcggggaactcgcgctcatcaccttcctccgcgataatgctgacgtgttcgcttggcaactgtccgacatgccgggggtcccttgggaggtgattgagcacaaactaatggtgcaacccgatgccaagccagtaaagcaaagactgcggagatttgcaccagaccgaaaacaagccatacgagaagagctcgacaaacttctcaaagctggcttcatcagagaagtgcttcatctagagtggctagccaatccagtcatggtgcggaaggccaacggaaaatggagaatatcaactggtggactcaacagccggctgcgagctattgagcttcctcgacgcttactctggctaccaccaaatcagcatggcaaaagagaacgagagagaagacagcattcatcacgccggaataccttccagcgcacggtccagggcgcagttagcgaccagctcggcaacaatgtcgaggcatacgtcgacgacatcgttctcaagaccaagacaaagaagtgcacgttcggagtactgtcgggcaagcttcttggattccttgtttctggcagaggaatagaagcaaatcccgagaagatcaaggcaatcgagaacatgaagtcgcccacaagactcaaggaggtacaaaagctaaccggatgcatggcggcactgagcaggttcgtcgctaggatgggagaacgagaacaacctttcttcgctctgctgaaaaaacaagacaaattagtatggacacaggaagccgaagaggcattcgttgcactcaagcattacctatcaaacccccctgtacttgttgttccccaacctaatgaagaattattcctctatatcgccgccacgccgtattccgttagcaccgtcattgttgtcgagagagagaaaacaagatacccacagatccaaaagctgctttacgcggtcatcatgacatcaaggaagctacgccactactttcaagcccacagagtcatagttgtctcctctttccctctcggcgaagttgtgagaaacaaagacgttgtcggccgcattgcgaaatgggtagtcgagctgagccagtttgatgtccactttgtgccacgaacagccatcaagtcccaggtactcaccgatttcgttgccgattggactatgcctgataacaaatcagacaaccaagtcgacaataaaacatggacaatggcgttcgatggcgcactcaaaagccaaggagcaggggcaggatttatcttgacgtctccctccggagatcaattcaagcacgcaatccacctcaactttagggtgactaataacacagcagaatacgagggactactcgccaggataagagctgcagccgcacttggggtcaagcgactaatcgtcaaaggggactccgagctagtcgcgaaccaggtgcacaaagattataaatgctctagccccgagttatccaaatatctcgcagaagtcaggaagctagagaaaaggttcgatgggatcgaggtccgacacatctactgcaaggacaatatcgagccagacgacctagcacgacgtgcgtccagacgagaaccgctcgagcccggcactttactcgacatcctgacgaagccatcagtaaaagaggttagcggcgaagtcagcccagccacccccgacattagctcggaggccacaaaggcagaacacgccgttgccgacatcgagactacagacgactggcacaccccactaatcaaattcatcaacagcgaggagttgcccgaggacgatacagaggccgagaaaataaaccgtaaagcaaaaatctactgtatggtcggcaacgatctatacaagaaagcgccaaagggggtacttctcaaatgcgtcttgtccgatgacggcagacacctcctccttgatatacatgaaggcatctgtgggtcacacgctgccggtcgaacattggtcgggaaagcttttcgacaaggatttttctggccaaccgccctcaaagatgcatgcgacatggtccagcgatgtgaagcctgtcaattccccagtaaacacacaaagctactcgcgcaagcacttcatactatccctcttacttggccgttctcgtgctgggggctagacatattcgggccattcccacgaggacaaggcggctacagattcctattcgtggcgatcgacaaattcactaaatggatcgaagcagtacccacgggggaaatcaaggccgacaacgccatcgaattcatcaaagggatattttgcagatatggactaccgcaccgcatcataaccgactacggctcccagttcatcagcgccgatttccagtattactgcatcgggctgggggaaacacccttcttcctcgtgtacggctccgaggccatgctccccagcgagctacgacatcagagtacacgagtacagaagtactccgacgaggaccaggtggaacagcgagacatcgatgtaaatcttctcgaggaacatcatgaaacgagttgcccgttcgagcagctagctatcaacaggccctccgccgttatcacgagaagcgaatccgagcatgcatactttcgatcggcgactatgtcctccgacgggttcaaagccaagcagggcggaacaagctctcacgcaaatgagaaggaccttacacgatcacacaagtcttgcggccagccgcattcaaaattgcagacggcgaaggtcgcgagttag

SEQ ID NO: 526 - DNA, 3993 bp, Oryza sativa
  misc_feature (195)..(195): n = any nucleotide
  misc_feature (215)..(215): n = any nucleotide
  misc_feature (225)..(225): n = any nucleotide
  misc_feature (237)..(237): n = any nucleotide
atgccgccccagcctccgccggcggcgtcggcgtcggccagtgccccggatcccgccgtcccggcttggctcagggggctcccccgcgcgcccgagtaccgcccgacggagtccgagttcgccgaccccatcgccttcctctcccgcgtggagcgcgaggccgccgcctacggcatctgcaaggagctcggcaanccgcggcgtggacgcccgangccgcaggtncttaagcaggtntggcagagtggggagcggtacacgctcgaccagtttgagtccaagtcccgcgccttctcaaagacgcacctcgctggactccacgaaccgactgcgctcgcggtggaatcactcttctggaaggcgtcggcggaccgtcctatctatattgagtacgccaatgatgtccctggctctgggtttgctgcacccgtgcagttgcaacgcaagaagaagcagaaaagagagactgccccgatggacgaatgggagaagagttcaggctggaggctgtcaaatagcccatggaacctgcaagcaattgcgcgggctcctggttcgctcacacggtttatgcctgacgatgttcctggggtgacttctccaatggtttacattggcatgctgttcagctggtttgcgtggcatgtggaggatcatgatctgcatagtctcaacttcctccacactggcgcacctaagacgtggtatgcggttcctggtgatagggctgttgagcttgaggaagttatccgtgtacatggctatggaggcaacactgatcggatcgcgtcactagcagtgcttggtgagaaaacaacactaatgtccccagaggtccttatagacaatggtgtgccctgctgtagattggtgcaatatcctggtgagtttgtggtgacattcccaagggcttaccatgtcgggtttagccatgaaggattacgcataaccgcaaaggtgaagttgtcatggtgctcctgggagacgccgcattacaggatcaccacaatgctaggtaagaagccaaaaggtccaaaatatatgctttatcgaaacaaaagaaatggaagaaccctagagaactactgtctggaatcccgaacttctcgtctaagagatcgtaaaaaagaagaccgagaactgttggtcaaacaggaattcttgcaggatatgattagtgaaaatgaacttatatgttcatttcttggaaaaaaatcggttgataatgttgttctatgggagcctgacttgctgccatcgcttaccgctctacacccctgctcgtcttgctcaaaagctcctgaaaagaagggtgaagatggtcccagaattggatctacccaatccagctcaaaagatgacagctcatctgatggtactgcatgtatgactgggacacaatctaaaggcttgtctatggatagcaaacaagctcctgagggagaaaagcttgataccgatgacggagatgacctgccttttgatttgagcattgattctggttcattgacatgtgttgcatgtgggattcttggctatccatttatggcgattttgcaaccttccagaaaagcactggaagaaatttcccttgttgataaggaaagatataaactgagttgtgaaaaagagatttgttcaaatgtgcttccgtgctctcctaatgatggtagctccggatgcccactcatcgccaatagatcgtccagccctgtggaaaatgctaacctcagtcatcaggatgtgaagccaattagaagtgacatttctttgatgggaaaggagtttaatggaaccctagggaaacatattggcacttcctgttcttgtagcagtgaaaataccattcatccttacggtgacacagaaacccctgagaagaaaataccaagtgattgccctggctcagagttgagtaaacaatcaggcagaggtgatgttaatgtaccagatgtcgaaggtagtgaggaaactatcagctggaatacaggctgtgcatttgcacggcctcggatcttttgcttacaacatgcccttgagattgaggagttgcttgcgagcaaaggtggagttcatgccctcatcatatgccatgcagattatgtcaaactaaaagcacttgcaatatcaatagctgaggaaattgagtttcagtttgactataaagatgttgcactagcaaatgcgtccaagtctaatttgcatctaattaatatttcaattgatgatgagggatatgaggaagagggaacagattggacatcacggatgggtctaaacctcaaacatagttccaagattaggaaagaaacaccagagagtcaagaacagcctcctttatcattttggggattattttccaagccatcacctatttcagttgtttcaaacttgaaatggctttgcaggaaagcacggactccatataaggtcattggttatgcttccagccctgatgttgtggcaactccagacaaagttaagcccgcagttacaaaaactcagatagacacttctggaaatgctcatgaaaacattggaagtgaacaaactctgcaacaagattgtgtcctgcaagaatccaatgatgtagctgatatgtgcaagcgtcccaaggattcacccacaactgttgcagtgtcagctggcaaacctaccagagaacaatgtggtgctgaatcaactgagttgagtactgtaaaacagttcctggacaatgggcttatcgctgagggaggcagcatgaacttcataagtaatcatgagcacttagaatctgacaatgcaacttcagtgtgcaaagatgaacaattgcaagttcaacagaacagcgaacctgatacagatgatcaacctgaaacatgtgatcgtagtgttgttcttgtaacaccaaagtcgagctgtgaccagatgatttctagcagtgacagaagttgcagtctgaccttggactgccctgtctccactgatgctgccttttcaagcgaaaagctgtctatggctcatgatttgatgggcagtgagttgcaggcagtccataattcaaaggctgaggttgtggccagtttgactgatgtcaagggtgctaagctcaatagcattcataccacacaattacctcatgaatctccaagcagtgatttcatcatttcagaaggtgcgcaatctgcttcaacaactgcaattcccagaaaaaatggaacatccatgcacacagagtcaaattcaattgatattttacttggagttctagccgatgaatctaaggtctcttctggaaaggatgaggttggcaaagcttccttgacattgatgacactggctggcaatgaccaatctgcagatgatgtaactcaggatgaagttgcagagatcactgatccgtcgcatggcttctgctcatcagacatagtgtctagaagcattggaagttcaaacagaacaaatatcatatgttatgccagacgcaaacacaaaagaaagagcggatctgagttcaatattaatagtccccaaagcttggggagctttgtccgctctccatgtgaaagcttgagaccaaggactagacctgcgattgttgaagacatgacaaacgaaacaaaaactgcagaagcttcaactgcaaataagaggaagaaggcaaaggtggaagcatttcagtgtgacatagaattttgtgacatgacatttgagactaaagctgaacttcgtgctcaccaacgcaatatctgcaccgacgagtcttgtggcaagcgcttcagctctcacaaatacctgaagcgtcatcagtgtgtacacagagatgagaggccattcaaatgcccctgggatggttgtccaatgactttcaagtggttgtgggcgcaaactgagcatatcagagtccatacaggcgagcgaccgtacaagtgctcggctcctgactgtggccagagtttcagatatgtctcagattatagtcgccatagaaagaagtttaatcattattga

SEQ ID NO: 527 - DNA, 2883 bp, Oryza sativa
atggcggagccggacctactcgcgcccttcgccgacctccccttcccccccggcgacgatttccccgacttcccgaccctcggggatgacgccttcgcgctggaggatttcgatctcgacgatctggacttcgacttcgatgtggatctcttcccgccggatgcgccgccgccggtgacgacgtcgtcgtcgtcctcggccgccggatcgccggaagcggggacgtcgtcggccggcgacgggggttccaagaacgaggagtccgcggattcgtcgtcgccgtcgaggagcgggagtgacggcggcggcggcaaggatgggaaggatgatgaggcgaagcggcgcgcgcggctggtgcgcaaccgggagagcgcgcaccagtcgcggcagaggaagaagcagtacgtggaggagctggaggggaaggtgaaggtgatgcaggccaccatcgccgacctcaccgccaggatctcctgcgtcacggccgagaacgccgccctcaagcagcaattgggtggcgccgccggtgctggtgccgccgcgccaccgccgccaatgcccatgtaccctgcggtttacccattgccgatgccatggatccacccagcctacgcaatgcgtggctcgcaggtgccgcttgtgccgataccccggctcaagacgcagcagcctgcgtccacaccggagccaccggccaagaaggcccggaagaccaagaaggttgcaggtgttagcctgcttggattgctgttcttgatgatggtctgcgggtgtttggttcctgcggtaaatcggatgtatggtgcagcgtacactggggaaggcgctgcgattgttccgtcacatcatgggagaattctggctgttgaagggccacaaaatagtgtctcaaatggtgttgatccgaaggtacctcagaatggaagcgaaacgctgccagctttgttatatttgccgaggaatgggaagcatgtgaagatcaatggaaatctggttattaagtccattgttgcgagtgagaaagcctcttcccgtttgtctaactatggcgagaagggttctggaaaccaaggaaaggaggagactagcttagcaatccctggctatgtagctccgttagaagctggagaagtcatggattctgctaaaggaatgaatgaactgatggctctggctcctggagatggaagcatatacagggaggatgatgggatgctgccgcagtggtttagtgaagcaatgtcaggtcccatgttgaactccgggatgtgcactgaagtattccaatttgatttatctccaacaacagctgatgcaaatggcattgtgcctgtctactctgggtcagtgactaacacgtcacaaaattatactgaaaatcttccttctggccctgttcagaaggtgaagaacagaaggatttcgtactcagaagccatccctttacgaggttcgacatccaatgacacggatcatttcaaagcaccccccaagaaccatagtcagagccatgctggtcgtaagccagtttcgtccgttgtagtctctgtcctggctgatccaagggaagcgagcgatagggatggtgaggggaggatctcctcaaattctctgtcccgcatcttcgttgtcgttcttatagatagtgtaaatgtttttgctggatggaacactctgttgtcggtcagattattggaagaaatagcagcgctcctggttcaggctgctgtcatagtgctgcctgaacttgcaacatttaggcccggatgcaaatcgtctgctggaccgcacctgcaaaatgaaacccatgcaaaaataatagaaggccccttaaatgccataggaaaaatgaagaaaaataataaagaaaagcatccatattcacttaaaagttccaagggagcaccgtttccaccgcgaccgattcttgtcttcctcattgcaatatttggattctatgtatgctacatctcctttaaccagataacactagagaatagatctgaggagaacagtggagaagtgcaggcagaaattcattgccgaaagcctcatcttcctcatgaggagctgcgttatgtgcactttccgaaacctgagagttatagcaggggagagtgttcctgcaatctggttcgatcctttgtgcttgtatctatgcaacggtcgggaagtggatggtttgagactttgctgaacagccaccctaacatcagctcaaatggtgaaatatttaacagggtggatagaagagagaatatctcatctatcttacagacccttgacaaattgtataatttggattggttcaccagtgcagcaaagaatgagtgcacggctgcatttggattgaagtggatgctaaatcaggggtttatggaccatcatgatgatatagctagttatttaaacaagaagggtgtttccgtgatatttctcttcaggagaaatacattgcgcaggcttatctctgttttggctaatgattacgacagagatgcgaagcagctgaatggaacccacaaatcccatgtacactcaaaagaagaggctgagatattagcgaaattcaagccggtgctggatgtgtcaaatctgattccaaacatcagaaatgccgagaaatacatcagagattgcttggaccacttcaacaccacacggcacatgatcctctactacgaggatattgtccgcaacagaaatgcattgttccaggtacaagaattcctcggagttccggtgagaaagctggtcagcaggcaggtgaaaattcacactagtcctcttccaggccttgtcaggaactgggatgatgtgagcaacaaactgaatgggacacagtatgctcattttcttgacggtgcagattatgtcaggtga

SEQ ID NO: 528 - DNA, 2451 bp, Oryza sativa
atggaggcattgggagatatggagggggaaggaggggcagcggcggcagcagcagatacgggtggtgcggtgccccaagtgcgagaagttcttgccggagctccccaactactccgtctacgtctgcggcggatgcggcgccactctccaagactatctccagcaaagaagaactcagcatctgagaattcctcagagaaatctgatggtggacatgtgaagtaccttgaagtgctggagagttcaccagataacaaaggagctgcatctaaagacacttgtgaggctgcccaagaaggagaagccaaaaatggagaagctaaagcagaagagagacagatgacagcagggaaattcggggaggccaagtaccggcgcatccgcagtgaggacaaaggagaagcaaaacacacagtgagagccagagacagatcgccaagatcagttgttgatgccatccctccgaatgcatatcctgcagaaggcccgtctgactaccatattaagtcaagattcagacataccaatggtgagcaagctgatatgagaaatttggagggcctaaacagagtcaatggtcttgaaaaagaccgtgctgatctgttacggatgcttgatgagctgagggatcaggtgcagagatcctgtgagatcaccaacaagccaagtggaagtacttctacagataaagcggtggatgcctcagggttatataatcctcgtgagcggttgagtcggttacgacatggttcacctcagttgcagcggagtggttctcagcagtcaccatccttgaatgggcaagctccttgcattccgcaagcttatgctccaggaactgctcagcaagatcttcatggatacggggagccaatggcacacatgggggctccaagctatcctgttggcacatatccatggagaaattttgataattatttttatggacagtatgatcctgaccctctgatctcttaccaccatgatggcttctaccatcagcctgcctgttcttgtctacattgctaccaccgtgagttcttacctgttcaggggcctcctctgggtttcaaccatcgcagggtaccaccgtatgttatgaataatcctagagtttacccggttgatggtcctgcaatgtttggcacacagaattacaattcaagagtcaacgcttcaatgcagcgcaatcacatgagggccgctatgagtaaaaaacctgcacagacttgtgaaccgattgcatgtggtgccccattcactatatgctacaactgctatgaagtactgcaacttccgaagaaatcccccgtgccagggaaggatgagtacaaattacgttgcgggtcatgctcacatgcgcttgtggtcaagcttgatggaagcaggcttgatgtttcagcaccttcacctatttcacacatatctggcggcagcaaaattagttccaatgatggccaaggaagcaatgcgaattctgctccacatgagagggtgcttccactttatagtttttctgcagcaagtcatggttctcaagacctaccctcgaactcaagtgaagctgaaaaaatgcaagggatatcgtcttcttgcagcatttctgaagatgagaacagccctgcgagatctaattcccagagggacacccctgggtctagggatcttcatcctgaagctgaggtgtctacccgtgttccaagtttacatcttcgtgatcattttggatactcgccatctgagaaggtagttgatggatcagggaaaggaagcagaagtactcgatctgaacatgagaaggctgtgttgacagaaagtttcaagcagaacactgtaaaagatgtatcagtagtgaacataatggacttgtcggatgatgagtatgatgatcctgactacatgcaagatcgaggtgatgtggcacaacctgtagatcaccctcgggccgtgaaaacgggtgattcatttttcaccaatctcataaagaagagcttcaaaattaacaacggaatgggcaatggcagagcaaaggttttcattaatggctatcccatctctgatcgggcggtcaggaaggctgagaagatagctggaccaatctatcctggtgaatactggtatgattaccgtgctggtttctggggtgtaatgggacagtcttgcctcggcatgataccgccatatattccagaactcaattatcctatgcccaagaaatgcgctgctggaaatacaggtgtatttgttaatgggagagaacttcaccagaaggatttggatttacttgtgggtcgaggactcccagattctcccggtagatcatacagagttgagatgtccggtaaagtgtcggatgaagtctctggtgaggagctgtattgtctcggcaaacttgcaccaacagctgctgtcagaaaattcatttcttctgagtatttgcttggctggtga

SEQ ID NO: 529 - DNA, 2238 bp, Oryza sativa
atggtagctccaagaaaggccctccaggtcgtcgcactagaaaggccaaacctggaacagtcaaagccaattgatgaagaattgatgaagagactgaaggtcaacttgatcacctggaaaaatacccaatgtctttttgacagacacatgactttgtttgtctattttctatggaggaagaagaagccattccacatcacaagagcggttcctcttgatgctattccaggatttttatacgacgatgaggatgatgatgacgacgacgacgatgagggcgataacaatgttgaattagaggagattcgaccaagttcaactgaatgtgaatcttccatccatccagcagaagagctgaatttactcttgccaaaatctcttccgttgccaagaatatccgctgcagttgaaaggaatggaaaagccagggacaaggaggtgaaagaaggatccaacttgaaagaattgccacaaggatatttgggcaaaatggtggtgtacaagagcggcaagatcaagatgaagttgggggatgtcatgtttgatgtgaacccaggagaagagtgtaggatggcacaacatgtggctgctatcaacaccaaagagaagcattgttgtttacttggcgagatcgagagccggcatgtcgttgtgactccagatgtggactcgctgctgttgaatgacaatagagcatataatgctctacaccaggggatcagattcctagggatgaaaatggtaggaattgatagcatatttgaaacgattaccgtagatttaaaaatggtcaaaatcgatagcatctatcgttggaatgattatcgggcggcacgcattattgcccatgccgcaattcctgcgagagagaatgcatatggacgcgcggagcgaatccgcatcggagatcgagcacagatcgagcaaaaccctagttcgatcccacttgcttctcctgctcgatcgatcatggtggaggatcaggagaagtccagcagcagccctcccgttcctccgccaccggaggaggaggagatggaggagggggagattcatccgggtggtggtggtggtggtgggtactacgattcgggctccgagaccgaggacgacgacgatcggtacgtgttccagtctcgccgcgacgacgaggaggaggaggagggcgtgaacccggcgagcaagcgccgccgcctcgaggacatcctcgcggagacacggggagcgctcccgctgccttcgccgacgccgtcgtcgtccggttcggaggggacgatcagcgacgaccacggcgacgggatcgccggcgccgccgccgccgccgatgcacccgtggcgcgcgtggcgttcccgtgccacgtctgcagcaaggagttcggcagcaggaaggcggtgcacgggcacatgagggtccatcaggcggacaaggacaaggagaaggagccgtcgctgcacctcgccctcggctggacctcgacggggaagcgcgggcgccaacggcaacgcccgtgctgtcaccgtcgccttcgcccccatggaacaagcggtggcgacgacgacggcgaacgcccgcgccatcgtgctcgcaccggcggcgcagccgcagccgcagcccatgaagctgccaatcctcctaaccaggtcgccgacgacaaccaccgcctgccagtgccagctgccgtgccgtacgtcggcgccgccgccgcccccgcccgccgccgcgctcggccgaagcgtaacgccggacagggtggaccgtacaggtgcagttacccgggttgcaagggggagtacaggacgcaccaggggctaggcggccacgtggctggccacatcaacagggagaagcaggcggccgccgccgcccagggcggcagcggcgccaggccggagggcaatcacccatgcaaaacgtgcgggaaagagttctcgacgggagtggcgctcggcggccacatgaggaagcactacgaccccaagaagaagaagaagcatgctggccttgtccttaccctctccgtcgcgccgcctacgcctgcacctgctccgtccatcgccggagcggcattgccaccggcggaggtaaaagcggacgtggatgaacatgaagcagagcaagtgccaatggcgccggtgtctccgccagctgaagcgaggggaaatatcgtgcggatttttggcgtggatatagagaagccggcagacgaagaggagcaagaaggtggcagcgatgtctag

SEQ ID NO: 530 - DNA, 2007 bp, Oryza sativa
atggaggtggaggcggcgacggcggcggccatggacttccacgcgctctcccgccgcgagctgcaggcgctgtgcaagcgcaacggcgtccgcgccaacatgaccaacgccgccatggccgatgccctccagtcgctccccacggtggatggggtcgacgagatcggcacggcggcgctctgcctcccgacgccgagcaggtcgacgatgaagtcggctttgaaggccgccgcggcgatcggcgaggagcagcagcacgggagcccgctcccccgcggccgccgcgtgtcggtgatgtcgccggaggccatccggttggacgtcgaggagggcgaggacgagatgaagcgggatctcgtcaaggagatcgtgaggaccccgggcgtggcgctgcgcagcaccagccgccgcgcgagggccacgccagcgccgatcccgacccctgcgaccactaggcggaccgccgctgcgcgcaaggtggaggaggctgcgcctaccccagctactctgcggaggagccagaggacggctgctcggaaggccgctgctccggtggtggaggaggtcacggcaactaagacaacaactaggaggtctgcgagatcgaaggtgatggttgatttggagcaggaggtggaggacatggcggtggcgttgcaggaggtgaaggttcaggaagaggatccaaaagatgttgcttccgatgagaaatgtgatgaggaagaggaagctacgaaaattctgggaggaaacagtaaagaggtggaatcagaggagggtgaggaagttgtttcttctgctgcaccaactgaacttgcagtaatttcagttatgagctgtgatgaccctaaggaggaggaaatagttgcaactggggaggaaccagctaaaacccaagaagtcatggaggattcaccaatcctaggagtcctgtcaaagccagaacctgtggaaccactcagcgagaagatagaagatgcctctgttggtgatggtctgggctttggtaaactgtccgcattgaaggagataactggtgagatgaatgataaggaagttgatgccgatgaggttccagaagagaagcttccagctgatgtgaccgatgacaagaccagcgaggaagatgacctcaacgaagttgagaaattatctgccgttgagataccacaggctgatctaacaggtgataaaaccagtgaggaagaggatctgaatgaagtgaaggaagggtcggcctatgagaatccgcaggctgatcggatagacgctgagagcagtgaggaagatgatcttgatggggattacagtgaagaatctgatattgatgaggagtccaatgaggaaggtatgcttgatgaggaattcgccgctgaggaatatgcctccagtgaggagactgatgatgagagtgacccctctgaagtggccactgattctgatgaagtggaagtagaaaagctgcaggtcgcaatggaggatggattgactgccgaggccaatcaggttgatgatgaagaggatgatttcagcggtgacctaccatcggatttcgacaatgccgacaacttcagtgatgatgaaactgagagcgatgccactgttgtgatctcatctgcttccaaggccgctgttgtgaagaccctggatgactcctccgtcactgaagcatccagtgaggaggaggtttctcaacaggaggtggaagcctcagttaactccatcgtgaagtccctggatgagtttactttcacggtggagggcacccagaaggatgagctgactgaagagatgaagagcacagatgatgctgaggatgtgggagcaaaggagttgaagaaagagaagaagaaaaagaagccgactgtccaggaacttaacgccacgagcatgaggaagctcaaaaccatgctcaaggaagagctaattgccaaggctgccgctggggaagggaagaggctggcgcttgcagagctggacgacaacgccggtggcgtcgactgctga

SEQ ID NO: 531 - DNA, 1770 bp, Oryza sativa
atgcttgatatcaacctcttccgcaccggtcgttgcgtgcagttcgatctggataatatccgaaaggagctcaacgccaccagccgaaatacgggcaagctgaagatggtcactgctgctcaacatcctatgcaattaaggcagttagaagtctcgggcagtggtaaccaggtcttgcccagcctcacctcccaagctttgagattcgggcaggggcagtggaggccgagggtgccgccgtccacaactgacatcgtctcaagcagtcaagcatccccagcagcgcaaagaaagtgctggccagatcgagaaggactactgaggggtagccgggaggggaagaagctctcgggagggaagtggagcaataaatctgttcccatgaccaagccagaagccctgcaacttcaccatctgcccgatgatgtcctgcaccgcatactgtctcgattaacattcagagagtcctcacggatgggccttctttctcgcaagtggcagaaactgtggagaagctgctgcccgaaattgatcttcaccagggccaccatgttcaagcctgggaataaaaccataagacgtacaaggaccaactttgccaggagagtcaacagtcttttgcggcagctatgtgcacctcctaccctgaataagtttgttgttaagtttgggctgcgcaggaaacatacctgccatgtcaacagatgggttggcttctgctccaagttgagagcaaggcacatcacttttgatttcactcctggagtgaagggtattttcaggggcttagctgatgaaaagtacatcttccacctgcatgttttcagtgtccctgaccgctcccctgctcatatcaaatcccttcatctgagctacgtctggttgaacacagcaaccactggtttcactggctttgcaaacctcaagaagctcaccctgcacaaagtttcctttttaaatgacttccaacatctgatgctgtcggagtgcactgctcttgagtggctgagcatcagctgctcttccttcactgagctaaccttgtgcaagccactgcgccgtctgcgttatctttctttgcactactgctacatggaaaaggttgagctggaagctccaaacctcacatcggtcgatttgaccaatcggccaattccgttggcactaagtgaatctctgaaggtgatggaggcaaacattaaactgctacataagagcgtgctttatggtgataatctggactacatctgcaccgagcttcctgccgctcttccgcatgtgcagaaactctccattacctcgacactctgcatctacgatgagttgcaaagttttgccaaaacctcagtgagattcatcaatttgaggcatctgagcttgtatttgcctctttatggggacggcaggtcagttggtgggattcttcgtttggcctacctcttggagctcgctccagttctagaggaactggaactgcactttcgcttctctgatttcgtcatcagacaggcgatcagagtggatatgctaccgtatcggcatgacaagctcaagagggtggtcatgtctggagcctgtcattggcaggggctgatcgagctagcacaccacattcgtcgttgtgctagtagacttgactgtatgatcatggatccgatggttagaattaagggtctcccgacggttgattggttggaggaaagaggccgcaggattgccaaagagcttcttaagaggcaggagtttcagggtgtcctcactgttttgtga

SEQ ID NO: 532 - DNA, 1296 bp, Oryza sativa
  misc_feature (151)..(151): n = any nucleotide
atggcgctccgccgcatcaacctccggaagaagccgctcctcctcttcccgcggcccttctcctcgtcctcctcacccaaccctcccttccctcctcccccgccaccgcccaacgaccgcgacgacgcctcaccaaagcccagcgaggggnaggggcgcaacccggcggcctcgctcttccaggacttgcgcgaccggctcatgtccaccccctcgcatctgccgtcgcgccggatcccgaccgctccgccgccccgcccctcggggaacgccgagccggtggcctctatcgacgacatccgccgccagctcgagtcctaccgcggatccctcgccgcgaaggggcgcccctcctggctcctcccccgacggcgccgccccctccttgctcgacctgacttgcgcaatctcccctctggacggcagccgcaacagcggaggcagcctcgttcgacaaccccgtttttgtcccccactgcgcatcccatcttcgggagggagctcggggagaacgcgagaaaggcggaggggaaagaggagaattctgccattgagcttaagaaggaatacagctacgcagagctcgggaagaagctcggccaactgcgaccgtccggcgcagggaacgatggaaaggagtggttctcgcttgaggagctgcagggacggatcgccaagctcgcaaatttggacattgctgatgacatgcggttaggcgggcatgcagggattgtcatttttggcgaacattggtgggccggcaacgccgcaatacttgcagcatcctccacaggaggagttgctagagaggaatttgctcctaaggttttgattggttactgcttttctcagtatttccatccagaccacatgtcgtcggaagagaagatgaagttagagctccagagggaaatgaacgttaccattgttttggagatactgaaagatgatctttgctcaagtagaatagtcatgaaaacaagtcaggctgatggaatattttgtctcgaattgaatcatttagttgcccaattgaccgtgaaaatcaagcatctgtcaactgttctacacaaaaaggataaacattcgagaaaggggcttcaggatatggtccaaaggaggaagaagtacctcaagtacctgcgtagaactgactgggattcatattgtcttgtcctgtcgaagctgggtcttcgtgatgtaccggagtacaaagctcctgattacaagaacaaatccaccagtaaagccaaatctaagaagagcaagagcaagaaaagaaagatgaaagcataa

SEQ ID NO: 533 - DNA, 612 bp, Oryza sativa
atggcggggaaatccggcgcacgcacgaggaagcgcgtggaggcgacggattccgccgtcctgaagcgcgcgcgcgacggcagcgccttcacccgctgcgaggcttgcggcaagagcgtctccgtggtcctcatcgacatgcacaactgcagcctcgacgacaagatccgcatcagcctagaggctcaggtggtggagcaggccgtggaggtggcaagcgagcaagaagaagagcggcaagacaccaacaacaatggcgagggggccaaaaagggcaagcgcccacccactgcctttttcctcttcatgagtgacttcaggaaggagtacaaggcggagcaccctgacaacaagagcgtctccgctgtcgccaaggaaggaggggagaggtggaaatccatgtctgacgaggacaagaagccttacttggacaaggctgcagagctcaaggccgagtaccacaatggcgagcgcagcgacgagaacaatgttggtggcaacgcaggcgagcaggaggtagatcagccacccaagaaaggcactgatgaagacgaccaagaagatgaagatggtgcagaggaagagaagaacgagctagacgacgacatctag

SEQ ID NO: 534 - DNA, 585 bp, Oryza sativa
atgggcacagtgcttgcttccgctgctgcgctggtggccaccgtctgcgcagaggctgcagagctcgctgggaccaacaggtccggcgtgacttccgccgtgaaaactggagtcgagagctgctcctctgctgaactgctcaccctcacggccactgctgctacatgtctgagaggagctgcagcactgaaactgagggcagacgtcaggggaatcggtagcaacaacaactcagttggcaccagcactactagcatccacaaagacacaactctcagggttaggctgccttgtgggagcgtgcgactgaggaaggtggctgtctttccacagtgcgacagagtagtactgaggctggggaagaaacatctgcacggggcattctcaacctacaaaaattatgaggtgcttgacgtctccagcaacggcggcgattttgttggtggacggcatggtgttgttcccgctggtgctcagaacggccgctggtgtggtacagctgctgttggacagtcagatgcactgcaaggtctggaagaatgccatcgagggcattctgtccgaccaaaacgtcaaacacgctaa

SEQ ID NO: 535 - DNA, 354 bp, Oryza sativa
atggcctcgttgtcctccttccggctcgccgtggcagtggcggcattgttggtcgtcggctcatgcgccactgaggtcaccttcaaggtcggtgagggctctagcggaaaaagtctagagctcgtcaccaacgtcgccatctctgaggtggagatcaaggagaagggcggcaaggactgggtggcgctcaaggagtcgtcgactaacacctggtcgctcaagagtgaggcggcgctcaagggccccttctccgtccgcttccttgtcaagaacggtggctaccgtgtcgtcgacgacgtcatccccgaaagctttacggccggctctgaatacaagagtggtatcaacgtctaa

SEQ ID NO: 536 - DNA, 5508 bp, Oryza sativa
atggcttccccggcggcggcgccgccgcctaccccgccggagtccgacccgcggctcgtggaggccttcgtgcccttcctcgagaagctcatcaaaaacgcctcgtggcgcaacaaggcgcactccaagctctcccacactgccaagtccatcctcgaccgcctccagaacccgccgccgccgtcgtcgtcctcgcagccgggcccgctccgcagcctctcgctcgcggactcggagctgctgctcggcccgatcaactccgcgctcggctccggcagcgccaagctcgccgaggccgggctcgagctgctccacaggctgatcgcgcactcctacatccatggcgaggccgacccgtccgccgacccctcggcccagctcgtcgcgtccctcctcgatgccgcctgcaacgcgctttacctcgacgacgagcacatcgagctcctcctactcaagacgctcctctcggcggtcacctccacgtcggtgcgcctccatggagattgcctgcttcgcgccgtgcgcgcttgctatgatatgtacctgggaagccgcagcgtggtgaaccaggccactgccaaggcgtcactcgtgcaaatgttggtgatcgttttccgccgcatggaggcagactcctccacagtgcccgtgcaacccatcgttgtggctgatgtgatcgagctgcctgaagctgcttctggtgcttcgcctgccgctgatgccaactttgtacagggattcatctcgaagatcattggagacattgatggtgcaatcacacctctggcacggacaacttcttcagcagctgcaggcgcaggtggagcagcggctcatgatggtgcatttgagacaagagcagcagaggaaggggcacatccagcagatttgcttgattcaacagacaaggacatgctagacgccaagtactgggagatcaacatgtacaaatctgctcttgagggtcgtaaggatgagattggtgtggagggggcagtggtgggcgctttggatgatgatgctgatgtgaggattgggaataaactgcgaagagacgctttcttggttttccgggcattgtgcaagctctccatgaagacaccacccaaggatgctccagctgatcccattgtgatgcgtgggaagatccttgctcttgaacttctcaagatattgcttgaaaatgctggggctgttttccggaccagcgagagatcaagcagtatctatgcctctcgcttttgaagaactgtgcctcggcacatatgatagtctttcagctatcttgttcaatttttattagcttggtttcaagattcagaccaggattgaaggcagaaattggagtattctttcccatgattattctgagagttttggaaaatattgctcaaccaaattatcaagcaaagttgattgttcttcgtttcctggaaaaactctgtgctgattctcaaatcttggtagacatttttctcaattatgattgtgatgtacactcatcaaacatatttgagagatggttaatggtctactaaaaacagcacaagggcctccagcaggcgtgtctaccacattggttccgcctcaggacaccacaatgaaaagtgaagccatgaaatgcttggttgctattctgagatccatgggagattggatgaataagcagctacgcattccagatcctgactctcctaaagtagagtcggagcaaaatgataatgatggaggacacgagatttcccacacagaggataatggagacgaatgtagtgaagcatctgattctcattcagaaatgtcaaatggggtttcagaggctgcatctttggagcagcgccgagcttacaagatggaacttcaggtggatgagggtatctctctatttaatcgaaagcccaggaagggaattgagttcctaataaatgccaacaaggtgggggaatcacctgaggaaattgctgctttcttaaaaagttcttctggtttgaacaagactatgattggagattatttaggggagagggaagatttatccctcaaagtcatgcattcatatgtggattcatttgattttcaaggcatggagtttgatgaagccattagagcctttcttcaaggtttcagattgcctggagaagctcaaaagattgatcggattatggaaaaatttgctgagcgttactgcaaatgcaacccaaaggccttttccagtgcagatacagcttatgtccttgcttattcagtcataatgctcaacaccgatgcacataatccaatggtaaaaaataagatgtcaccagaagatttcattagaaacaatcgaggtattgacgatgggaaagacctgcctgaagaatttatgaggtccttatatgaaaggatttggaaaaaagagattaagatgaaagaagaagaatttgttccccagcagcaaaaatcaacaagctcgaacaaaattcttggattggataacattcttaatattgtcgtacgcaaacgagattcacgtatggaaacaagcgatgatctcattaagcatatgcaggagcaattcaaagaaaaggctcgtatgtccgatatccagcaacagatgtagtagttttgaaattcatggtcgaggtttgctgggctcctatgcttgctgccttcagtgttccacttgaccagagtgatgatgagattgtcatatcccagtgccttgaaggatttcgcagtgcaatccatgttactgcagctatgtcgatgaagactcaaagggatgcatttgtcacttcacttgctaagtttacatcacttcactcggctgcggatattaagcagaaaaatattgaagccattaaggcaattctattaattgcagatgaagatggaaattacttgcaagaagcatgggagcatatattgacctgtgtttctcgttttgaaaatctacatctcgtaggagaaggtgctcctccagatgctactttctttgcactgcaacagccggacctcgataaatcaaaacaggctaagtcatccattcttcctgttttgaaaaagaagtctccaaatactgttccagcttctaaacgaggttcctatgatagtgctggtgtgggtggcaaagcttctggggttgatcaaatgaacaatgtggtgacaagcctcttagaacaagttgacatggctgaaatgaatcgtgtatttgtaagaagtcaaaaactcaacagtgagggcataattgattttgtaaaggctctctgtaaagtttccatggaggaattgcgatctgcttctgatccacgggtttttagtctgacaaagattgttgagattgccactacaatatgaatcgcatcaggcttgtctggtcaagcatatggcatgtcttgtctgatttttttgttacaattggctgctcagagaatctctcaattgcaatatttgctatggattcattgaggcagctggcaatgaagttcctggaacgagaagagctggctaactacaatttccagaatgaatttatgaagccttttgttgttgtaatgaggaagagccgagctgttgagataagagaactaatcatcagatgtgtctctcaaatggtcttggcacgtgttagtcatgtgaaatcagggtggaagagtatgtttatgtttcaggtctttgcaacagcttcatatgatgaccataaaaatattgtactcctggcgtttgaaattatcgagaagattttgcgggagtactttccctacattactgagaccgagtcgacaactttcactgattgtgtgaactgtcttattgcatttactaacagtaggtttaacaaggatataagcctcaatgcaattggttttcttcgattctgtgcggcaaagctagcggaaggtgacattggatcctcttcaaggttgaaggagaatcctccttctcctcgcttgaccaaggatggaaagcaggaaagtgcagttcttgttgataaggatgatactatacacttttggtttcctttattagcagcttgcaggattatctgaacttaccttcgacctacgacctgaaatcaggaaaagtgccttgcaggtgttatttgacacattaagaaaccatggtcatctcttctccttgcctttgtgggagaagcttttcccaatatttgattacgtacggcatgccattgatccatcaagtggttctccacaaggacagaatgtggaaagtgatccttcagaacttgatcaagatgcatggatgtacgagacatgcactttggccctgcagctagttgtggacctctttgttaagttctatgacacagtaaaccctcttcttagaaaaattctgttgctcttgacaagtttcataaagcgtccccaccagagccttgccggtataggtattgccgcatttgttcgtttgatgagcagtgccggatctgtcttcgttgatgaaaaatggttagaggtggttttatcgttgaaagaagctgccactgagacccttcctgatttttcttatattgcatccggagcttaccttgagaatgtaccaatagaaaatgggggctcttcagaaaagacagaagacgagtctcgaccattggaggatggcactggagaagcttctagatcaaggaacttgtattttgcaattggtgatgccaagtgccgggctgctgtccaactcctattgattcaggctgtgatggagatatataacatgtacagagctcggttatcatcacagaacactgtgatcctctttgaggcattgcacactgttgctactcatgctcataaaataaacagtgataatgacctgcgatccaagttgcaggagttgggctcgatgacccaaatgcaggacccacctttgttacgcctggagaacgagtcgtatcagttgtgcttgactatcctgcagaacatttgcttggacagatctcccaatgagaggagtgtagaggtggaaagccaccttgttggcttatgtaaggaggtccttgaggtgtacctgagcactgcaaacccatctcagctttctggtgctccgcagccacttggtcattggcttattccggtcggttcttcaaagcggagagagcttgcagcccgggcacctcttgttgtctcaaccttgcaagctatcagtggccttggtgactcatctttcgagaagaaccttggccagttcttcccccttcttgctggtctgataagttgcgaacatggttcaagcgaagtgcaggtggcattgagtgatatgtttagcacttgggttggcccggttgttcttcaaacctgctgatgctgagccccatatctgttatatagtatatctccacatgtaagttattatttgctttattgccatttcttgatgttttgccattccccattttgttctgtttatcattctagttactgggggaggttgtctcttgcagagctgagcactgtagttctttttacattaatttcttttagctttggggagtgtatgttacaagatgactga

SEQ ID NO: 537 - DNA, 4405 bp, Oryza sativa
  misc_feature (101)..(101): n = any nucleotide
  misc_feature (124)..(124): n = any nucleotide
  misc_feature (3395)..(3395): n = any nucleotide
atggatgcgccgcggaaggaaccggaggcaccaacaccaccaccggaaggcggcggctcaggttcaggctgcacctgctattgccgctgtgggggtgggancgggagggaatggggcggcggcncgggcggcgtacggggacgtgtcgggggcccgccgaggttcgccgcgccgttcgggggcgcgccggcggactacgccgaggtgttcgggggcgtggcggccacctgctccatcccgttcctcgacctgccccccgtgcccgccgtgggcgccgactacggcttcttcggccgcgccggggccggggactacggggagatcttcggccgcttcgacttcggggacttcgcgctgccgtacgaggagctgttcgccgaggcggaggcggaggcggtgggggagattggggcggaggagatcgcctcgtcgactgggagctcctccagcagttttgtgacagccagcctcacggccatgttggctcaaagatggtacaaattggcaaggtattggcagacgagaggtcatcgatgataaaagagtctagccaaccagatgcgcagtcatttatgcttcctcaacatttcaaggagcatgagtcttctgtaatttccttccctccagacaatcagcagtttgtcatgtcatataacaagactacccagagatctgacgatctagttgagatgactactgatccttcaatggattatgtggttgattcttgcgaatttcctcacgtgccaacaactaatcatgttgcaacaatggatagtggtatagaagctaatggagaaaaaaggaagaagtccaccacaacctctgcaagtgtcagtctaaggagctctgagagtgatttcacagttgatcagaagcagcacattccagcatatccacctatttctgaaaaagtttctgcaaatgagaatcacaagaactccaatagtatttcaacatccagtaatggaacaccttctcctgattatgcctttctaagggtttctgatgtcaacgtgcaaacacaaacagtaaaaccaccacctcctctgaagcagacatctaaattgcttaagaggagagagattttagcaaaaggagatgtccatcttgaaaatcacagctgccctccagcctcttctgctcatgccccttcaaacaccagcacatctcaggctgaaagaagagacgatactgctttgtttaataatgaggccaatcccagttctgctgcagctgctatgaaggaagcaatggaatatgcagaagctaggttaagagctgcgaaagaactgatggagagaaaaggggacagttttaaacttcgtaagaaaccaagccatcatagaagcacaagatctacagaaataaaggttcctacagagtcagacacattcgatgagaacctctccgtgaagaagtcaacaaaggaggaaatgaactctgaggattcgttgctggacaagcaccagaaggctagtgcagttagaacagatcattgtgatgacagtggaaaaagggcattgtcgctggagaaacctcagcatatgcaaagctgcactgcacccaatcaaacttccagtaaactaggtaagttaggcaactggacatcaggtgatgaattttatgagctgactggagaagatcagaaacagaaaacagatgcagctgtaggggaggaagataagtgtgaggtaacaaatcctgtcaccaagctcagcaaggaacaaaaatgcgaagttactgcagcggactctgatttggaaaggtatgaaaagctgtgggaggttaatgatggcagggatgcaggagtgaaacatgtcaatccgagagaagataatacatctccaatggggaaagatagggtgtctatgattctggaagcttctacagaaaatatagaccatgaaaaaatttataactctcattttgagggtcctaaagttgtggaaacttctaatgaaagccatgatggtgaggatggggctgttgagattccttgtaagagtggaatcactatttcagaaccaaacttgatgaaggacatgcacggttcattcatggaggcttcttcacctggagagtatgtggccgattttggtaaaggcactacagaggaaagtccagtagcaggaatatcgctggagcctaaaaccactaaagaggaacttgaggcagcatgtgatgctgagatgcaatgcaccacaggggatagtgaaaaattacaagaatcttcagaagtcaccagcattgataactcactggcaagacaaattaaatcattgattctagaagatctcgagggatcttctgaaactcaagctttcccaggggaccccggtactgctgggtcagaagctgaaacttatgggaggaaccttggtacaactgggttggaaactgaaagttatgggagggaaaagttcagttttgttgaagaatcattcatgcataatgcaaacaggaatgtaactgaatcacccgtagaaactccaatccctgaacaagtagagaatgttgagattgaagatagagttggttcatgtgcacattctgaagaatcaaccgtggataaagattccgagtgtcctgaagagggaagtgatattacttcacaaaacaacaatctgccagatcatgaagattcaactatgctaaatgtatttgaggtggccagcaaattgattaaaagagacctagatcaagaaaagcaagatacactacagcctggtgaagtagaaactagaactgtcttggatagtaatgacaaagatacaaaagaaaacccttcagaaaatagtaacacgataggtagtgaagaagtcttgagtcacggtaaccaggaggaccagaaggtgcctgaaatggataaaaccaaaggacgaagtgatgcaaatgcacaagttaaattaagtggtgtaaacttttatgaagatggagatgttacaagtgctgctaataatgttacaactagattgactacaaattcaaaaggccaggcgtcttcctcttcagaaatgctaactggcagacagcacttgcctcaagatgctggacctgctatttctcagacatctaacggaactttccctagtcttgaaaagaccgaagaagtttgcaaagaagctgggagagaattaccaacagataaatctgctgcatttgaagatgagaatagcagggcatgcaaatcaaaggcagagctaaagcagcaacaatttcattctgagaagagtagcagtttacctaaatctgcagaaggtcatatcccatcttctgctgatatatcaagaaaagaaacacctggggttcagagactcaaagagcagggaagtctaagaacagaaagggaaagagagaaggacaaagaggcttctcggagactggaagaaacnaaagaaagggataaaaaatttgagaaggaaagggaaattgctgaagagagggaaagaaaaaaactagaagaacaggaaagggagagggaacgggaaaaggatagacttgctgttgaaagagctacaagagaagcacatgagagagcatttgctgaggctcgtgaaagggcagaaaaaatagcattggaaagggttactgcagcacggcaacgggcttctgctgaggcccgagaaaaagaagagagagcgagtactgaagcagctgctgagagggctgctaggataaaagcagaacgtgcagcggttgaacgagcaactgcagaagctcgagagagggcaattgaaaaggctaaggctgaaaaggctgccgcagaggcaagagaacggagagaacggtacagatcctctttcaaggagagttttaagtccagcaatctgaggataatcgacaggacacacagtttcagagagcggtttccagtaacttaatgagaaacccagattcatatagcaaagagggcttgaggttgaatcagctttaaggcataaagcaagattagagaggcatcaacgcacagctgagcgtgtggacaaaagcactagctgagaagaacatgcgtgacctgctggcgcaaagagagcaagcagagaaacatgaggttgtctgagtacctagatcctgagatcaagagatggtcaaacggaaaggaaggaaatctgcgagccttgttatccacattgcaatatattcttggagctgacagtggttggcagccagtgccacttacagagctaattacagctgctgctgtgaagaaagcctacaggaaggcaaccctttgtgtccatccagataaattacagcaaaggggtgctacaatcagacagaaatacatatgcgagaaggtttttgatcttcttaagaggatgcttggaacaagttcacttcggaggagcgctaggatggatgctgaaacagccgatttattttcgagacaggaaattcgtta

SEQ ID NO: 538 - DNA, 4069 bp, Oryza sativa
atgccgaaggtctacggcaccggcgtcttcgagttccgccacccgcgcgccgccgagtacccgctctccaccatcacgctcctcgacatccagcgcgaccgcctcaccgtcagggagatctacgcgaccgagctccgggtcggccgcaagaccgtcccgctccaccgcgtcatgatcctcgaggtcagccagtacctcgagaactacctctggccaaacttcgacccggccggcgcctccttcgagcacgtcatgtccatgatcctcatggtcaacgagaagttccgggagaatgtggcggcgtggacctgcttccatgaccggaaggatgctttcaagggatttttatggcgggttctcaagctaaaggaagaggccgagaaaacaaactacctgttgttcatgataaatgcgtttcagcagagtttggaggatgaactagttcgagaaaccatacttcagttagtaagcctaaagttgtggcatactctttcttttggacggcttcagcagatggagctttgccttaaccctgaattgattaagaagtggaccaaaatcaaaagaaaagaagctaaagaagcaaaaaaggcaggtcaaacctgtgatgcttcagaaatgctcgagaatagattccttaggaacttaatagaagaattcctggaggttgatgattattgtgtcttgtactgtgagagattcatggagtttttgattgatatgttgagccagcttcctactagacgagatttttaaggccccttgttgccgatgtagctgttgttgctaagtgtcacttaagtgcactgtatacccatgaaaaggggcgtctttttgcgcagttggttgatttgctgcagttttatgaaggctttgagattaatgatcattctggaacacagctcagtgatgatgatgtcttgcaagctcattattcccgtttccaagcctttcagctgctggccttcaaacaagtgcctaagttgagagatttttccttgtgtaatattggttcaatccataagcgtgcggacttagcaaagaagctgcttgtcttgacagatgtagaactgcaagatctggtttgtaataagctcaagttaatttcagaggaggacccatgcagtggaagacgtgattttcttattgaggtcctggttgccttttttgagaagcgtcagtcacagaaagatgcagtaaatgcacttcctctttatccaaatgaacagatcatgtgggatgaaagccttgttcctagcattaattattctggagagggctgccttgctctcccaaaactcaatctccagtttttaacacttcatgattatttattgaggaatttcaatcttttccgccttgaatcaacatatgaaattcgtgaagacatccaggaagctgttcctcatctgcatgcctatattaacaatgagggagacactgcctttcgtggttggtccaggatggctgttccaatcaaggaatttaggattactgaagtgaagcagccaaacattggagaagttaagccatctgctgtaactgctgatgtcactttcagcatctcaagctacaagccacagatcaaatctgaatgggatgctttgaaggaacatgatgttttatttttgttgtcgatccgtccatcttttgaaccccttagccctgaggaggctgcaaaatcaactgtgccagaaaggcttggattacaatgtgtacgtggatgtgaggttattgaaattcgtgatgaggaaggatctcttatgaatgattttacagggaggataaagagagaggaatggaaacctcccaagggtgagattcgtactgttaaaattgctttggatacagctcagtatcatattgatgttactgaggtagcagagaagggtgcagagaatgtgtatgggacatttaacattctaatgagaaggaaacccaaggagaataatttcaaagcgatattggaatctatacgtgatctaatgaatgaaacatgtgtagttcctgaatggttgcataacatattcttgggttatgggaacccttctgccgcacagtggataaatatgcctgatcttctggaaaatatagattttaaggacacttttcttgatgcggaccatgttgtacaaagctttccagattaccaggtcacatttatcaattcagatggaacagaaaacctgaatccgagccctccttttaagattaagttgtccaagaaaatgaggaaagaaaaaataatggttgagacttatattcctgctgatccagggccgtatcctcaagataaacctaaacagaactcagtgaggtttacacctactcagggtgctataatatctggtattcaacctgggttgacaatggttgttggtcctcctggtacgggaaaaacagatacagctgtgcagatattgaatgttttatatcacaactgtccttcccaaagaactctaattataactcattccaatcaagctttgaatgatttgtttgagaagataatgcaggtactagagatgtgcctgctaggtaccttcttcgtcttggtcagggtgaacaagagttggcaactgatctcgattttagccgtcaaggtcgtgtcaatgctatgctggttcggcgattagagctgctaggtgaagttgcaaaattggcaagttcccttcatcttcctgaagatgtgagctacacatgtgaaacggctgcatacttttggttattacatgtttatgctcgctgggaacaatttttagctgcctgtgcgcaaaaccaagacaagccctcatttgttaaagaccgcttccctttctcagagttcttctcagatactccacaacctaccttcactggtgagtcctttgagaaagatatgcatgcagccaaaggttgtttcaaacatcttttgacaatatttcaagagctggaagaatgtagggcttttgagctacttaagtcaacagcagagagggcaaattatctaatgaccaaacaagccaagattgttgccatgacttgtactcatgcggcattgaagaggagagactttcttcagttagggttcaaatacgataatttgctgatggaagaaagtgcacagatattagagatagagactttcataccgatgctgctgcaacggcaggaagatggctatgctcgtctgaaacgttgcattttaattggtgatcaccatcagttaccccctgtcgtgaagaacatggcttttcagaagtacagccacatggaccaaagtctctttacaagatttgttcgtcttggtgtcccttacattgagctcaatgctcaggggcgtgccagacctagcatcgccgaactatataactggagatacagagaacttggagatctaccttacgtccgtgaggaggctatcttccacaaagctaattctggcttctcttatgactatcagttggttgatgttcctgatttccgtggcagaggtgagtctgccccttctccttggttctaccagaatgaaggggaggctgagtttatagttagtgtctacatctacatgcgcctgattggataccctgccaataagatttcgatattgaccacttacaatggtcagaagcttcttattcgcgatgttattaacagaagatgcaagccatggaatatcgaaccacctagcaaggttaccacagtggacaagttccagggtcaacaaaatgatttcattttattatctcttgtccgcacccgttttgtggggcatcttcgtgatgtcagaagacttattgtggcaatgtcccgtgctcgtctgggcctgtatgtgttctgccgtcgttcactttttgaacagtgctacgaattgcagccaacattccagcttctcctccagaggcctgataagcttggcttgaatcttgaagagtgcacaccatttacagagcgacctttagaggaaactggaaatattcattatgttgctggtattgaagatattggtcatctagtgaatttcagattagaacatcttcgtcaggtacatacagcactgttccagtaccaagtctcttgcaaaacttaa

SEQ ID NO: 539 - DNA, 3723 bp, Oryza sativa
atggcgccgacggcggcggcggcggggcccagcgacgacgggctccggaagctggagtacctctcgctggtctccaaggtgtgctcggagctggagacccacattggcgtcggcgacaaggtgctcgccgagttcatcaccgagctcggccgcgactccgcctccgtcgccgacttcgacaccaagctcaaggccaacggcgccgacctcccggactacttcgtccgcaccctcctcaccatcatccacgccatcctcccgccgccctccgactcccgcaaccctagctccgcgtcgcagcccgccgcggggggctccaagttccccggcctctcccgccccgacgaccccgaccgcgcccgcaacctccgcctcgagctcgagcgggacgccgaagaggccgccgcgacggcagcccccgcccccgccagggacgaccgcggccgccgccgtgatgagcgaggacgggaccggggtcgagatgaccgcggccgcgacgacggtgggcgtgaccgcgactatgaacgcggcggccgtgaccatgaccgcagccatggccgggatcgtgaccatggccgtgacagagaccgagatcgagcctgtgatggggatcgacaacgtggccgtgactatggccgtgatagagaccaagacagagatcacgacagggatcgtgaaggtgaacggcggagggaccgagataaggataggggtagagacattgacagagatatggacagggaccataggcgaggcaggaggtatgatgatgaggaagaaccagaacagtttggtggaaggaaagaaggcgctcttgtgaattccagtggcgagccagagttgtaccaggtgtaccggggtagggtgacacgggtaatggacaccggttgctttgtcaggcttgaggatgttcgtggaggacgtgagggtcttgttcacatctcacaaatggcaaccaggcgagtggccaatgcgaaagagatggtgaagcgtgatcaggaggtgtatgttaaggtggtttccgtgaagggccagaaattgagtttatcaatgagggacgtagatcaggatacagggagagatctcctgccaatacaacgtggtggggatgatgcaccaagggcgaacccatctggtggtagtgctagtggtgttggtgtgggctctggcaagaggctgggtctctctgggattatgattgcagaggaggatgaggttgcacctccttcacgtcggccacttaagcggatgagctctccagagaggtgggaggcgaagcagctgattgcttcaggtgttctggatgtgagggattacccaatgtttgatgaggatggggatggtatgttgtaccaggaggaaggggcagaagaggagcaggagattgagcttaatgaagatgaacctgctttcttgcagggacagagtagattttcgattgacatgtcacctgttaagattttcaagaatccagagggctcattgagccgagcagctgctctccaaactgctctcataaaggagcggcgtgaggttcgggaacaggaacagagagcaatgttggattcaatccccaaggatctgaatcggccatgggaggaccctatgcctgatactggggaacggcaccttgcgcaggagctgaggggtgttggactttcagcttatgacatgcctgaatggaagaaagaagcctatggaaaggctctgacatttgggcaaaggtctaagctttcaatacaagaccagaggcaaagtcttccaatatacaagttgaagaaagagctgatacaagctgtgcatgataaccaagtcttggttgttattggagagactggttctggtaaaacaacacaggtgacacaatatttggccgaagcaggctacacgaccagaggtaagattggttgcactcaacctcgtcgtgtggctgcaatgtctgttgctaagagagtagcagaagaatttggttgtcgacttggagaggaagttggttatgccatccgctttgaggattgcactgggcctgacacggtaatcaaatacatgactgatggcatgcttttgcgtgagattcttgtcgatgagaacctttcccagtattctgtaattatgcttgatgaagcgcatgaaaggaccatacacacagatgttctctttggcttgctgaaacagcttattaagcgcagatctgacatgaggcttattgttacttctgctaccctggacgcagagaagttctcagggtattttttcaattgcaacatcttcacaattcctggaaggacgttcccggtagagatactctacaccaaacaaccagaaagtgactatttggatgcagcattgatcaccgtgcttcaaatacacttgactgagccagaaggtgatatcctcctttttttgactggtcaagaggagattgatcatgcttgtcaatgtctttatgagaggatgaaagggctagggaaggatgttcctgagctcataatattgcctgtttatagtgctcttccgagtgaaatgcagtcgaagatctttgacccagctcctccagggaagaggaaggttgttgtggccaccaatatcgctgaagcttctctaaccattgacggcatatattatgtcgtcgatcctggttttgccaaaattaatgtttataattcaaaacaaggactcgattcattggtcatcactccaatctctcaagcatcagcgaagcagagggcagggcgtgctgggcgtactggccctggcaaatgctatcgtctatacactgaaagtgcataccgcaatgaaatgtctcccacaacaatcccagaaattcaaaggattaacttggggtctacagttctcaacatgaaggcgatgggaatcaatgacctattatcctttgatttcatggaccctcctgcacctcaagcacttatatctgcaatggagcaattgtacagcctaggtgctcttgatgaagaagggctccttaccaaactggggaggaaaatggctgaatttccactggatccaccactttcgaagatgcttctagccagcgttgaccttggatgcagtgatgagatactaactattatagctatgatacaaactgggaacattttctataggccaagagaaaaacaggctcaggctgatcaaaagagggccaagtttttccagccagagggggatcatctaactctgcttgctgtatatgaggcgtggaaggcaaaaaacttttcagggccctggtgttttgagaactttgttcaatcaagatccttaaggagagctcaagatgtgaggaagcagcttctcactatcatggacagatataaattggatgttgtctcagctgggaggaacttcacaaaaataaggaaagcaatcactgccggcttctttttccacgctgccaggaaggatccccaggagggatacagaaccttggtagagaaccagccggtgtacatacacccgagcagcgcattgttccagcggcagccagactgggtcatctaccacgaacttgtaatgacgacgaaggagtacatgcgggaggttaccgtgatcgacccgaagtggcttactgagctagccccgagattctacaagtcagcagacccaaccaagatgagcaagaggaagaggcaggagaggattgaacccctgtacgacaggtaccatgagcccaactcctggcgtctcagcaagcgccgagcttga

SEQ ID NO: 540 - DNA, 3514 bp, Oryza sativa
  misc_feature (186)..(186): n = any nucleotide
  misc_feature (201)..(201): n = any nucleotide
  misc_feature (203)..(203): n = any nucleotide
  misc_feature (214)..(214): n = any nucleotide
atgccgctggactacaggtactcggcggcgggtggtaggaaggcggcgaacggcgtcggggcacgggcggcggtggcgccggaggaggaggaggaggagggggtggaggtgggggtggtggggtttgagggggacgcggactcgccgtacagctcacaggcggcgacgacggaggaggtggaggangagggggatgggganangggtggaggtnacgcggaggtggattcggcggctgctgctactccacggaggcagtctccggcgggagctgggagcccctcgcagcgcgacgcgcggtggggtgacacgagctcctacggtgctagaaagaagcacagggttttttgccagcttccaaatagtgattgggccttatgcactgtaattacaacctccggtgacgattccgtactaaagcttcctgaaggaaaaaaggtactgaggttgaaaacagagagccttgaagctgcaaatcctgaaattcttgacggggtggatgatcttatgcagctaagttatctaagtgagccatccgttctgtacaatttgcagtacagatactctcaagacttgatatatactaaagcaggtccagttttggtggcggtcaatccttttaagaaagttcctctatatggtaatgagtacattgatgcatatagaaataaaacaaaggatagcccacacgtttatgcaatagcagattcagccctccgtgaaatgaaaagaggatgaagttaaccagtctatcatcataagatatatagtggtgagagtggagcaggaaagacagaaactgcaaagattgctatgcagtatttggcttctcttggaggtgggggtggcatagaatatgagatcctacaaaccaacccaatactcgaggcttttggcaacgcaaagacactaagaaatgacaactcaagtcgctttgtaaggaaagctcattgaaattcattttagtacaactggaaggatttgtggtgccatgattcaaacattcaagggttgtacaatgtgcagttggcgagcgctcctaccatattttttatcaactatgtgccggtgctcctgcgtccctcagagaagttgaatatgaagaaagcggatgaatacaaatatttgaagcagagttgctgctattcaattgccggtgtggatgatgctcaaatgttccgtactgtaacgaagctatgaacatcgttcatatcagcaaagaggaccaagataatgttttcacgatggtttctgcaattctatggctaggagatgtctctttcacggtcattgacaacgaaaaccatgttgagattgttgtagatgaagacggtcgcaagacttcttggctgcagtattgaagatctcaatttagctttgtcgaagaggcacatgaaagttaataatgaaaatattgtacagaaactcaccctttcacagcaggcaatcgacacaagagatgcgttggccaagtcactctatgccagtttgtttgagtggcttgttgaacaaattaacaagtctctttcagttggcaagcgtcgaactgggagatcaatcagcattcttgatatctatggctttgaatcattcgatgtaatgaacagttttgaacagttctgtattaactatgctaatgaaaggctccaacaacatttcaatcgccatttgtttaagcttgaacaagagaggaatacgttgaagatggcattgactgggcaaaggttgagtttgaggacaatcagaactgtttgaatctctttgagaaaaagccactggggttgttgtctctgctagatgaagaatctaccttccccaatgccacagatcttacttttgcgaacaagcttaagcaacatctgaacaataattcttgcttccgaggagaaagaggcaaggcttttgcagtccgtcactatgcaggagagaggtggcttatgacacgtcaggttttctagagaagaatagagatttattgcacatggactcaattcagttccttgccaaatgcaaatcctcactaccacaaatgtttgcatccaaaatgctttctcaatctgataatccgttacctgttccatatagaaatagtgctgctgactcacagaagttaagtgttgcgatgaagtttaagaagggacaattgttccaacttatgcaaagactcgaaagtacaacaccacactttatacgttgtattaagccaaacaatttgcaactccctgcaatttatgaacaaggacttgtgcttcaacaactcaaatgttgtggggttcttgaggttgtccgaatttcaagatctggatatccaacaagaatgactcatcagaaatttgctcgacgaggtatggctttcttcttcttgaggatgtcgcatctcaagacccacttagtgtttcggttgcaattcttcaccagtttaacattttgcctgagatgtatcaagttgggtacacaaaattgttctttcgaactggccagagattggcaaacttgaagacactcggaaccgtactctgcatggtattttaagggttcaaagctgtttcagagggcatcaagcccgtcgccatgcaagggaacgaataagaggagttttggctcttcaatcatattcgaggtgagaatgcaagaaaaatgtattcgtctctggcaaggaaacacagggcagccattattttacagagaaatctaaaatgctggcttgcaagaagatatttcgttaacatacggaaggcttcagtagtaatacaatctgggcattcgtggttgtcttgttcgaagatgtgctggcaatgttgatctattgaatgtgctaagagaattcgaatcaaagaagcaggaggcagagggtgaccaaattttgattaaggcatcattcctggctgagctacaaaggcgaatattaaaggccgaggcgacagtccgagaaaaggatgaagagaacgagatgcttcagcagcgacttcagcaatatgaaaaccgatggtcagaatacgagcagaaaatgaaagcgatggaggaaatgtggcagaagcaaatgcggtcattacaatcaagcctatccgtagcaaagaagagccttgctcttgatgagacgcctaggatgtccgactcatcggtcgaccagagctgggagagcaatggggttcacattggcagcgcgtcgcagctggttccacgcaccgttggacgggagatgaatgccagcatcagcgtcatcagccgcttggccgaagagttcgagcagcgcagccaggtcttcgctgatgatgccaagttcttggttgaggtcaagtccggacaggccgatgccagcctgaaccctgacatggagctccgcaggctgaagcagaacttcgactcatggaagaaggacttcggctcgcgcataagggagacgaaggtgatcctcaacaagctggggagcggcaacgaatcgtcgcccaactcggtgaagcgaaaatggtgggggaggctgaacacatccaagttttcatgagctaccatgtaa

SEQ ID NO: 541 - DNA, 3463 bp, Oryza sativa
  misc_feature (69)..(69): n = any nucleotide
  misc_feature (79)..(79): n = any nucleotide
  misc_feature (107)..(107): n = any nucleotide
  misc_feature (173)..(173): n = any nucleotide
  misc_feature (185)..(185): n = any nucleotide
  misc_feature (187)..(187): n = any nucleotide
  misc_feature (227)..(227): n = any nucleotide
  misc_feature (235)..(235): n = any nucleotide
atgagctcaggcggacgcggcggcaagcggcgaggggcgccgcccccggggccatccggggcggcggcnaagcgggccnaccccggtggcaccccgcagccgcttcngcgccgcgacggcggcggcgcccgtgcgaggaggaggacatgatggacgaggacgtcttcctcgangagaccatcctngncgaggacgagaggcgttgctgctgctcgacgggcacgagncctagttnacgcctttcccgctggaggcgccccgggctccccgccgacctagcgtccggctgctcgcgcaatgttggcttttcagcagctggagatagattatgttattggtgagagccacaaagtactgctccccaactcatctggtcctgcagctatactcaggatatttggcgtaactagagaagaggtcacagtgtatgctgccaagtgcatggatttgagccatatttctacatcagttgtccaatggggatgggccctgatgatatttcacgcttccaccaaacactagagttacaggggaggatgaaggattcaaataggaacagcaacgtgccaaggtttgtgaagagaatcgaacttgtgcagaagcagacaatcatgcattaccaaccacagcaatctcagcctttcctcaagatagtggttgctttgccaacaatggttgctagttgtcgcgggcatcctggaaaggggcataacaattgaaggccttggttcgaagagttttctgacatatgaaagcaacattctttttgcacttcgcttcatgattgactgcaatattgttggtggtaattggattgaagttcctgccggaaagtatatgaaggcagctcgtatcatgtcctattgtcagctagagttggattgcctgtatccttttatactaaatattcggatttggtaagccatgctgctgaaggagaacattctaagatggctccatttcgcatattaagttttgatattgaatgtgccggtcgcaaaggtcacttcccagaaccaactcatgatcccgttattcagagatagctaacttggtcacccttcaaggagaaggacaaccttttgtacgcaatgttatgacgcttaaatcatgttctcccattgttggagttgatgttatgtcatttgacacagagagggatgttctacttgcttggaggggatttcatacgtgaaagtggaccctgatattattattggatacaatatctgcaaatttgacttaccctatcttattgaggtacaggattttagagagctgaagttcttaagatagtagagtttccaatacttggacgaatcagaaatagtcgtgttcgtgtccgtgacacaactttctcttcaagtccaggcaatatggtatgcgtgaaagtaaagatgtagcagtggaaggaagagtacaatttgatcttctgcagtgcaggctatgcaacgggattacaagcttagttcttattcattaaactctgtatctgcacatttcctcggggagcaacagaaagaggatgttcatcactcaattatatctgatcttcaaaatgggaattcagagacacgaagacggcttgcggtttattgtttgaagaggatgcctatcttccacaacgactgctagataagttgatgtatatctacaactatgtggaaatggcaagagtcactggagttcccatttcatttcttctttcaaggggacagagcattaagaggtcctctcacagctactcaggaaagcaaaacagaaaaaccttgttataccaaatataaagggtcaagcgtctggacaggatacctttgaaggtgcaactgttttggaggcaagggctggattttatgagaaacccattgcgactttggactttgcttcgttgtatccatccatcatgatggcatataacctatgctactgtactttgtactgtttgaaggtcccccctgaggatgcccgcaaactcaacctgcctccagaaagtgtcaacaaaaccccatctggtgaaacatttgtgaaaccagatgtgcaaaagagggtatacttcctgaaatccttgaagaattgttggctgctcggaaaagggcgaaagcagatttgaagaggaagcaaaggatccatttgaaagggccgttcttgatggtcgtcagcttgccctaaaaataagcgcaaactctgtctatggttttactggagcgactgttggtcaattaccttgtttagaaatttcttcaagtgtgaccagctatgggtcgacagatgattgaacatacaaaaaagcttgttgaagataaattcacgacacttggaggctatgagcacaatgcagagaggtcatctatggagatactgattctgtaatggtacagttcggtgtttctactgttgaggacgcaatgaagctaggaagagaagctgcagactacattagtggaacatttattaagagcccatcaagcttgagtttgagaagatctatttcccttatctactgattagcaagaagagatatgctggtttgtactggacaaatcctgagaaatttgacaaaatggacacgaaagaggtattgaaacagtgagaagggacaactgtttattagtaaagaacctggttactgagtgccttcataaaatactagtggacagagatgttcctggtgcagttcaatatgtcaagaacaccatttctgatctactaatgaaccgtgtagacttatctcttctagttataacaaagagggtttgactaaaacaggagaggattatgctgtcaaagctgcccatgtggagcttgctgagagaatgcgaaagagagggacgctgctactgctcctactgttggtgaccgggttccttatgttataatcaaagcagcaaaaggggcaaagaggcatatgagaggtcagaagatcctatttatgttttggataataacataccaatagatccccaatactaccttgagaaccaaatcagcaaaccacttttgaggatctttgagccgattctgaagaatgccagtagagagctgcttcatggaagtcacaccagggctgtttcaatctcaactccttcaaatagtggaataatgaaatttgcaaagaaacaattgacatgcctcggatgcaaagcagttataagagtggttccaatcaaacgctttgctttcattgcaagggaagagaagcagagttatactgcaaaactgtaggaaacggtttctgagctggagatgctctttgggaggctctggacgcagtgccaggagtgccaaggctcccttcatcaggacgttctctgcacaagccgggattgtcctattttctaccgccgaagaaaggcgcagaaggatatggctgaagctagagtacagcttcaacgttgggacttctgagtcctctcatactgacggagtactactttccccaaatattgcgaaaccattactgtga

SEQ ID NO: 542 - DNA, 3258 bp, Oryza sativa
atgggcgacctcaccacctcgtcgccggcgagcgaggtgccgttccgcgtcagcttctccggccatggcggccacctccgcctcgaccccacgcccaatccgcccagccctatacccgagttcgtcctgtgggatttggattggttcgagttggctaggccgccgctggagccctccgccccgcgcaccatgctcgtgcccgcctgggagccgcccttccgccgctgggatcctgagtccgtgcagatggatatgagcgacgtgtttgattcgggcaccggtgggataacgccgcggatgcctggccctgcgaaggatttcgtgagggggagcgtgaacagccgcccgttccgcccagggggcctgcatgatgatgcggctgcggctgctgctttggagaaggcatttccagagggtgcacgcaatggggattgggtgcgcgagcttatgagcggagggccagctcaggttaatcctccaggattccgcaagggattggacctgggcaatttgaagttctataaacttgttccagatatggcaattgagtatccatttgaactagacaaattccagaaggagcttcagaagggtgaatcagtctttgtggcagctcatacatcagcaggaaagacggttgttgcagagtatgcattcgctttagcaacaaaacattgcacccgggctgtctatactgctcccattaaaactatcagcaatcaaaaataccgagatttctgtgggaagtttgacgtgggacttctcacaggagatgtcagtatcagaccagaggcaacttgcttaattatgaccacagaaatattacgttcaatgctctacagaggtgctgacatcatacgtgatattgaatgggtaatttttgatgaagtgcattatgtaaatgatgcagagagaggtgtagtttgggaggaagttattataatgctcccgaagcacatcaacattgtccttctttcggcaacgggttccaaacacagttgaatttgctgactggattggtcgaacaaagcagaagaaaattcatgtcacatcaccaacaaaaggcctgttcccctggagcactgtttgttctactccggagaagtgttcaaaatatgtgagaaggatgcatttcttactcaaggatatagagaagccaaggagcggagatcagagtcttcattctggatgcccctcataaataaccttctgaagaaatccctcgtgcctgtatgtggtaattttttgcttctcaaaaaatcgatgtgatagatcagcagagagcatgtttggtgcagatctcaccagtaactcagagaaaagtgaaatccgcctcttctgtgacaaggccttttcacgccttaaaggatctgataggaaccttccacagcaaagccttctacgtagagggattggagtacaccatgctggacttcttcctatcgtcaaagaagttgttgaaatgctgttttgtcgtggcgtcatcaaggtgttattttccactgagacatttgcgatgggcgttaatgctccagcaaggacggtcgtgtttgattccttaagaaagtttgatggaaaagaacatcggaagttacttccaggggagtatattcaaatggccgggcgagctggtaggagagggcttgataacattggtacagtgatcgttatgtgtcgtgatgaaattcccgaagaaagtgatttgaagaatttgattgttggaaaaccaactcgactagaatctcaatttcggttaacatacactatgatactgcatcttctacgtgtggaggaactcaaggtggaggacatgctaaagagaagttttgcagaattccatgcacaaaagaatttgcctgagaaggaaaagttgcttctgcagatgcttcgtcaacccacgaagacaattgagtgagacaggtgcataaaaggagagccggctattgaagaatactacgagatggtcttagaagctgaggcacacagggagtctattacggaagcaattatgcagttgcctgcttctcaacagtcccttacacctggccgtctggttgttgttaaatcccaatcagatcacttgctcggtgtaattgtgaaaactccatctgctgcactaaagcaatatgttgttcttgtactgaccgcaaggatactttgttatcccgaaaggaaaacgtagcatggaagatgaatatttctcttctgtcagtacacggaaaggttcaggtgtcatcaatatcaagctaccatacaagggagatgcatctggaatgggttttgaagttagagcaatagagaataaagagattatgaatatatgcgccagcaaaataaagattgatcaagtcagactccttgaggatccaagcaaaacagtttactctaaaactgtccagatgcttataaaagagcaaccagacggaaacaagtatcctgctgctttagatgcaataaaaggatctaaaaatgaaagacatgcttctcgttgagaactactatgcttaccagagattactgcaaaaaatgtctgaaaataagtgccatggttgtataaaattaaaggagcatattgcattgatgaaggagcaaaaggtgtacaaggatcagctgaatgatttgaaatatgaaatgtcagatgaggcacttcaacagatgccggagtttcaaggcagaatcgatgtactaaaagaaatccattacattgattctgatctagtggtgcaacttaagggccgagtggcctgcgaaatgaattccggcgaggagttgatatcaaccgaatgtctgtttgagaatcagttggatgacctagaacctgaagaagccgtagctattatgtctgcattggtcttccaacaaaggaatacatcagaaccatctcttaccccgaaactagcagatgccagaaagagaggatttatgatacagcaatcagattaggaaagctccagagagagttcaaggtgcctgtagatcccgaggaatatgcccgtgataatctcaagttcggtcttgttgaagtcgtctacgaatgggcaaagggggaccccatttgcagacatctgtgagctgacagatgtatctgaaggtctcattgtaagaacaatcgtgcggttggatgaaacttgcagggagttcaggaatgcagcttccataatggggaactccgcgttgcataagaaaatggagactgcgtccaatgccattaagcgtgacatcgtctttgcagcaagcttgtatgtcacagggatatga

SEQ ID NO: 543 - DNA, 3078 bp, Oryza sativa
atgcacatcaaggagatatgcctggaggggttcaagtcgtacgccgggcggacggtggtgtcggggttcgacccgctgttcaacgccatcaccgggctcaacggctccggcaagtccaacatcctcgactccatctgcttcgtgctcggcatcaccgacctccgccaggtgcgcgccgcctcgctccaggagctcgtctacaagcagggccaggccggcgtcaccaaggccaccgtctccatcgtcttcgacaactccgaccgctcccgctcgccgctcggctatgaggattcacccgagattaccgtcacgcgccagcagattgtagttggtgggcgaaacaagtatcttatcaatggccatcttgcacaaccttcccgagtgcagactcttttccattctgtgcagctaaatgtgaacaatccccattttctaattatgcaaggacgcataacaaaagtgctgaacatgaagcctccagaaattctctccatgttggaagaggcagcaggtacaaggatgtatgaaatgaagaaggaagctgctctgaaaacactcgagaagaagcagaataaagtggatgagattaataaactccttgatgaagaaatccttcctgcattagagaagcttaggaaagagcggtgtcagtacatgaaatgggccaatggcaatgctgacttagatcggctcaaaagattctgcatcgcttatgagtttgttcaagctgagcgagtgagagatggtgcactcaatgatgtcaaacaaatcagggcaaagattgttgagctggatgaaagcacagagaaggaagctaaactaggtggtgagatgaaaactttgtcagagaaagtggataagctctcacatgcacttatcaaggaaacttctgtgatgaataatcaagaggaaacaataaagtcagaggaaaagggtgctgaaaagcagggtgtactagcaggaaaaagcaatgcaaatgaaaagaaatgcctagaagatcaactaagagatgcaaaagctgctgtcggagaggcagaatctggactaaagcagctgacgacaaaaataagccattctgagaaggagctaaaagataagaaagcccagttggtatctaagcgtgatgaagctactgcggctgagaatgagctgaaagctagggaaaaggacttggaaactgtcaaggcatccatgcaatctgtaaattatgaagaaggacagatggaagctttgcaaaaggatcgatctattgagttagacgccgtccagaaactgaaggacaaaattcgtgctctctctggtgaactagcaaatgttcacttcaattatcgagaccctgttaagaattttgacagatcaaaagtgaaaggagtagttgcacggcttatcaaaataaaggatagctcaactgcaacagcgctggagctgcaggttgctgctggtggaaggctatacaatgtggttgttgatactgaaaccactggaaagcaactcctacaaaatggagatctcaaaagaagggtaaccatcataccattgaataagatccagacaggtaccatacctgagagagttcggcaggcagctcgtagactgttgcagaatgctatgacttatgtctttggttcaacatttgtgtgtcgaaatatggaatccgcgaaagaggtaatactgcattcaggaaatttttttgcttcagtttttactgagggctgtcaattgaagttgcatttaacagagaagttggcagtacaagtgtgacccttgaaggtgacatttttcagcccagtggccttttgactggaggtagtcgcagggtggtggggacttgctaaggcaactacatgaattagctaaagctgaggctgatcttgccaatcatgagaaaagactttctgttattgaacaaaagcttttgcctctgcagaagaagttcacagagttgaaatcacagtttgaactcaaatcatatgacctgtcattatttcagaaccgtgttgagcaaaatgaacatcacaagcatgaaagtgagagggagaggcttattatggagaaagatgctgttgccaatgagcttgccatgcttgaagagcaactgacagatcaagctgaatctgagctcaacattgggcgttctaaactgaaggaatgtgactcacagataaatagcatggccaaggagcagcaaaaactgcagcagcaactaagtgattcaaatgttgaaaggaagaaaatggaaaacgaggttaagaggatggagattgagcagaaggattgctcttcaaaggttgataagttagtagagaagtacagttggattgcaactgaaaaacagttgtttggaaaaagtggcactgattatgactttgtatcatgtgaacctcataaagcacgagaagaacttgaaaatctccaagctcaacaatccagcagtcttgagaagagggtcaataagaaagttatggcaatgtttgagaaggcagaggatgagtataatgatttgatgtcaaagaaaaacatcattgaggacaagtcaaaaatcaagacagtgatagaagagttggatgagaagaagaaagagaccttgaaagtcacatggcttaaagtaaacaagattttggatctatattcagtacacttttacctggcacaatggccaaacttgatcctcctgaaggtggtacttttttggatggtcttgaagttcgggtggcatttggaacagtttggaaacaatctttatctgaacttagtggagggcaacggtccctcctcgctcttagtcttatcctggcgctacttcttttcaaacctgcaccactttatatattagatgaggttgatgctgccctagatctgagccatacacaaaacattggtagaatgatcaaggcgcattttccgcactcccagcattttcagttcatagttgtctcactaaaagagggcatgttcaacaacgcaaatgtgatattccgaacgaaatttgttgatggggtgtccactgtgacacgaacggtcccttcaaagcaaagatgattggattcattcatcacttcgtctgaaggtattctctga

SEQ ID NO: 544 - DNA, 2756 bp, Oryza sativa
  misc_feature (264)..(264): n = any nucleotide
atgcgggctctggtggtgctggttggcttggcctgcctcgccttcgtggcggaggccaagggcggcggcgcggcctcggcggcggcgctggacgacgacgtgctggggctgatcgtgttcaaggccgacgtggtggacccggaggggcggctcgcgacgtggagcgaggacgacgagcggccgtgcgcttgggccggtgtcacctgcgacccgctctccctcgccggcttcggcctctccggcaagctcggccgcggcctcctncgcctcgagtcgctccagtccctctcgctctccggcaacaacttctccggcgacctccccgccgacctcgcccgcctcccggacctccagtcgctggacctcagcgccaacgctttctcgggcgccatcccggacggcttcttcggccactgccgcaacctccgcgacgtctccctggccaacaacgccttctccggcgacgtcccgcgcgacgtcggcgcgtgcgccacgctcgcgtcgctgaacctgtcctccaaccgcctcgccggcgcgctgccgagcgatatctggtcactgaacgccctgcgcacgctggacctctccggcaacgccatcaccggcgacttgccggtcggcgttagcaggatgttcaacctgcggtcgctgaacctgcggagcaaccgcctcgcaggcagcctccccgacgacattggggattgcccgctgctgaggtcagtggacctcggctccaacaacatctctggcaacctgccggagtcgctgcggaggctctccacttgcacataccttgacctgagctcaaacgcgctcaccggcaatgttccaacttgggttggagaaatggcaagcttggagacgcttgatttgtccgggaacaagttttccggggagatcccggggtcgattggcgggttgatgtcattgaaggagctgaggctgtcggggaatgggttcaccggtggcttgccggagtcaattggtggatgcaagagcctagtgcatgttgatgatttgtcgagcaatgcgttttcaggaatgatcccatctgaaatctcccaggtgatcaccttgcagtcactgaacatgtcctggaactcgctgtctgggagtattccgccgagcattgtgcagatgaagtcacttgaggtgcttgatttgactgcgaacaggctcaatggaagcattccagctactgttggaggagagtcattgagagagttgaggctggcgaagaactcccttactggagaaatcccagcacagattggcaatctctctgcccttgcatcactgatctctcacacaacaacctgacaggcgcaattccggcaacaatagccaacatcaccaacctgcagactgttgatctttctcggaacaagctcactggtggtctaccaaagcagctctctgacctgcctcaccttgtacgcttcaatatttcacataatcagctctctggggatctccctcctgggagcttttttgacactatccccctctcatcagtgtctgacaatcctggcctttgtggtgcaaagctaaattcttcttgtcctggtgtgttaccaaagccaattgtgctgaacccagactcttcttcggatccactatcacaacccgagcctacaccaaatggcctacgtcacaagaaaactatactaagcatctcagcccttgtcgcaattggtgctgctgttctcattactgttggtgtcataaccattacagttctcaaccttcgagtgcgcactccaggctctcattctgctgctgagctagaactctctgatggatatctcagccagtcccccacaactgatgtgaattcaggcaagcttgtcatgtttggaggcggtaatccagaattcagtgctagtacccacgctctcctgaacaaggactgtgagcttggtcgtggtgggtttggcactgtctataagactactctgcgagatggccaacctgttgccatcaagaaactgactgtgtctagcttggttaaatctcaagatgagtttgagagagaagtgaagatgctaggcaagctacgccaccgcaaccttgttgcgctcaagggatattattggacaccatcacttcagcttcttatatatgagtttgtttctgggggtaacttacataaacaactgcatgaatcatccactgcaaattgtctctcatggaaagagaggtttgatatagttcttggcattgcaagaagcctggcccatctccaccgccatgacattatccactacaatctgaagtcaagcaacattctgcttgatggatcaggcgatgccaaggtgggggactacggattggcaaagcttctgccgatgttggatcggtatgttctaagcagtaaggtccagagtgcacttggttacatggcaccagagtttgcgtgcaggactgtgaagatcactgaaaagtgtgacgtgtatggatttggagttcttgcccttgagatattgacagggaggacaccggtgcagtacatggaagatgatgttattgtgctttgcgatgtggtaagggctgctttggatgaagggaaggtggaagagtgtgttgatgagaggctctgcggaaaatttccgctagaggaggctgttccaatcatgaaacttggtctagtgtgcacttctcaggttccttccaataggccagacatgagtgaggtggtgaacatactggagttgatcagatgcccccaggatagccctgaaactgaattaggttaa

SEQ ID NO: 545 - DNA, 2687 bp, Oryza sativa
atggggatcttcgagccgttccgcgccatcgggtacatcacggccggcggcgtgcccttctccgtgcagcgcctcggcaccgagaccttcgtcgccgtcagcgtcggcaaggccttccacgtctacaaccctcaattgcccaagaagatccgtgctcttgcatcgtacaaggattatacatttgctgcgtatggaagtgatatcgctgttttcaaacgaactgatcagcaggtggttacttggagcaaacatgaagaaaagatcaatatattatacccatttggagaatacattctaagtgcagatattaaggggaatgtatttatatggtccttcagaggatcagagccaaatagtgagcctgttgggaacatatcattgggagacaagtttacaccaacttgcattatgcatcctgatacttatctaaataagggaagcgaagagggtcccttgcagctttggaatatcagcactaagaagaaactttatgagtttaagggttggaactcatcagtatgttgttgtgtttcttcacctgcccttgatgttgttgcagtcggatgttctgatggaacaattcatgttcataatatacgatatgatgaagagttgatgtctttcaatcatcaaattcgtggtgctgtgactgcattgtcatttcgaacaggatgggcaacctcttctggcctctggaggatcgtcaggtgttattagtatatggaatcttgagaaaaggcgccttcattctgttatccgggaggcccatgatgcttctatagtttcacttcattttttcgcgaatgagcctattttgatgagctcggcttctgataattcaataaagatgtggatatttgatactaatgatggagatgctcgtttgttacgatttcgaagtggccatagtgctccaccacggtgcattagagattctacggcaatggaaaatgcatcttatctgctggtcaagatcgtgcctttcgccttttttcagttgtccagcaggatcaacaaagcagagaactttctcaaagacatgtgtcaaaaagggcaaaaaagcttggattaaaggaggaagagatcaagctgaaaccagttattgcatttgattgtgctgagatacgctcacgtgattggtgtaacgttgttacctgccatacggatactccacaagcgtatgtatggcgtctacagaactttgtcattggggagcatattctgacaccgtcatcaggcagcaagtcaccaattaaggcttgtgcaataagtgcatgtggaaattttactttcttgggcactgaaggtggctggatcgaaaaatttaacctgcaatcggggattagtcgtggcagttatattgatacatcgttggcaattaagcgtgcacatgacggagaagttgttggattagcgtgtgatgctacaaatggctctcttattagtgctggatacggtggtgatattaaggttccatgctctcttgctttttaattctattgtaaatcctgtggcatgctaattgcaggtttgggattttaaaagttgcaagctaaaatccagactggatattgggtcttcttgctactgtagcagatgatatggtgcttatattgtttgatacagtagcaatgaaaatggtccgtagattcgaaggccatacggaccgtgttactgatttgtgtttcagtgaggatggaaaatggctcatctcatcgagtatggatgggactcttagaatatgggatatcagtttagcaaggcagattgatgcaatgcatgtcgatgtatctataacatctctctctatgtctcctaatatggatgtgttggcaaccacccatgttgatcaaaatggtgtctatctttggttaatcaagctttgttctcaccatcaacaaatgttgataattattcaagtggtaaacatgtcagaaataccctctctttgcttcccaagagtcaatggcaaagtctggcgaatcttgacattataaagcggaataaaccaattgagccaccaaagaaacctgagaaggcgccttttttcttgcccacagttccatccctttcgggggagatattatttgagcctgcggcgaacagtaaagaaacagacagcagtactgaggacacaagtcacaaaaaaatggctgacctctcctctcactttagtcggctgttacaatcctgtggagatacaaagaatttttactgactacctaaaaggcttatcaccatcatctttagatatggaactacgagtgctacagttaatcgatgatgagccacaaaatttggagcagagacctgaacttcaatccatttcattgctgttggactacttcatacatgagctttcctgcaggaataactttgagtttgttcaggctgttctcaaattgtttttgaagatacatggtgaaacgatacggcgtcactcaatgcttcaggacaaagtgaagaagcttctagatgtccagagcttagtttggcagaagatagacaaagtgtttcagagtgcacgatgcatggttacattcctcagcaactcacagttttagtagcaggtgatttctttttcatttgatatgccaaatggtttcgtctctttcaccgatactgcttgttttgatctttgcttttgccaaaagatttactattttgtattaattagttggtgctaa

SEQ ID NO: 546 - DNA, 2676 bp, Oryza sativa
atgaggcagacgcgctcgctggcggcggcggcggccgttctggtggtgggtgtggtgctgcattgggtgggggtggtggacgcggcgacggcggcggagagggggatactgctggagttcaaggccgccgtgaccgacccgaacggcgcgctcgcgtcgtggacggcgggaggggacccctgcgtggacttcgccggggtgacgtgcgacccgtcgtcccgcgccgtgcagcgcctgcgcgtccacggcgcgggcatcgccgggaagctcaccccgtcgctggcgcggctggcgtcgctcgagtccgtctcgctcttcggcaacggcctctccggcggcatcccctccagcttcagcgcgctcggccccacgctccacaagctcaacctcagccgcaacgcgctctccggcgagatcccgccgttcctcggcgcgttcccgtggctccgcctgctcgacctctcctacaatgcgttctccggcgagatccccgcctcgctgttcgacccatgcctccgcctccggtacgtctccctcgcgcacaacgccctcacggggccagtcccgaccgccattaccaactgctcgcgcctcgccgggtttgacttctcctacaaccgcctctccggcgagctcccggatcagctctgcgcgccgccggaaattagctacatctccgtccgaagcaactcgctctccggcgccattgccggaaagctcaacgcttgccggagcattgacctgctcgacgtcgggagcaaccatttcgccggaccggcacctttcggccttcttggcctggtaaacatcacctacttcaacgtctcgtccaacgccttcgatggtgaaatccccaacattgcaacgtgcggcaccaagttctcctacttcgacgcctcagggaaccggctcactgggccggtgccggagagtgtggccaattgccgcagcctgagggttctggatttggggacgaatgctcttgctggagacataccaccaagcattgggaaattgaggtcgctttcagtgctcaggctcgcaggaaatgcaggcattgccggttcaatccctgccgagctcggaggaattgagatgcttgtcacactagatcttgctggtcttgctctcatcggagacatcccggtgtccctgagccaatgccagttcttgcttgagctgaatttgtctggcaaccaattgcaaggagtgatcccggacacgcttaacaacttgacttacctcaagttgctcgatcttcatcggaaccatcttgtaggggggattccagtgacacttgcacagctcacaaaccttgatcttctagacctctcagagaaccaactgactggaccaatcccctcagagcttgggaacctgtctaacctgacccatttcaatgtgtcctacaatggactctcgggcatgatccctgccttgccagttctacagagtttcggtagctccgccttcatgggtaacccattactatgtggacctccactgaacaatctgtgtggggctagccggagggcgaaacaattggctgtgtctgtcataattgtcatagtcgcagcagcgcttatacttattggagtttgcattgtttgtgctatgaacataaaggcttacatgaggaggagtaaagaggagcaagaggggaaggaggaggatgaggtgctggagtccgagagcacaccgatgcttgcatctcctggcagacaaggctcaaatgccattattggaaagttggtgcttttcagcaagagcttgccttcaaggtatgaagattgggaggcaggaactaaggcactgcttgacaaagactgccttgttggtggtgggtcagttggtacagtttacaaggccacctttgagaatggtttatccattgctgtgaagaagttggaaacactgggaagggtgagaagtcaggatgagtttgagcaggagatgggccagcttggtaaccttagccaccccaatctggttgcttttcagggttactactggtcatcatcaacgcaattgattctgtcagagttcatggttaacgggagcttgtacgaccaccttcacgggagtcctcatacattttccggaagcagcagcagagttggtctctcctgggagcagaggttcaaggttgcactcggtacagcacgggcacttgcataccttcaccatgactgccgaccacaagtcctgcatctcaacatcaagtcctccaacataatgttagataaagactttgaggctaaattatctgattatggatttggaaagcttttgcctattctaggtagctatgaattgagtagattgcatgctgccattgggtacattgccccggagttagcatctccaagcttgagatatagtgataagagtgatgtatttagctttggtgtggtgttgcttgagattgtgacagggaggaaaccagtggagagccctggggtggcgacagcagtggttctgcgtgattatgttagggcgatattggaggatgggactgtgtcagactgctttgatcggagcatgaagggatttgttgaggctgaattagtccaagtgctcaaattaggtctggtatgcacttcgaacacaccatctgcccgaccaaacatggcagaggtggtacagtacctggagtctgttagaactaattcatga

SEQ ID NO: 547 - DNA, 2658 bp, Oryza sativa
  misc_feature (33)..(33): n = any nucleotide
atggcgacgcgcggggaggcggcggcggcggcngcggcggaccgggacatggagctcttccggagcgggtccgcgccgccgacggtggagggcgcgatggccagcgccgccgcggccgccggcgacgtgttcctggacgatgagctccgggccgacccggtgtaccagagctactactactccaatgcgcacctcaacccgcgcctcccgccgccgctgctctccaaggaggactggcgctcggcgcagcaccgcctccgctcctccgccctcggcgggatcggcgacggcaggaggcagccggccgcggcggcgcagggggatgggctcgtggggttgcccgggatcgacctcgatcggcaggggagcttctccagtatcttccagtttcatcttatccaatccaaggagagctcgtatcagctggacatgggtaagcagggcgccgaccgcaacattagtgactttctggattcttctcggccacagtatgctctgcatcgtgagactagtagagctatgggtggtctgcagagtgacagcaatatacaaagcttggctgaagttcagaacaatgattcatcagcacatacatatgcctctcttttaggatcatctctttctagaagcgcatctccagatcctgagcttgttaggagggtccccagtccttgcctccctccaattggtgtgaaagtcagtgctgatgataagaagaacaatggtggttcatcttccttccgtcgaagttcgtctgctattggtgaatctgataatctgatagctgctttatctgggatgaatttatcatcatctggagcagctagtggacagcaaactgtgacccagtctgagctctaccaggatgttgataatgtccgtaagtttctatttgatcgtcagggtgatcaatcaaatggcaaccagcaacactcctatatgaaacatcccgaacaaggacattttaaggcacctgatggttactctgcaaactcgcctaattcttctatgataagaaatcaaattaatgctgctagtttcacatcgtttgacaatctgtctgctggatcaggctttgcttctcctaggatcggttctaggtccccaggtgggactttatcttcaaggcagaatttggttggtggatctaactttctgaattacaatggaattggaagtccaaatgcagcaacttctcttcaaacagccattgatccgtcatatattcagtaccttcaggcagctgagattgctgcccaactcgcagctagctgtgatgatcctctcatggccagtggccatctgggaagttcttatatggatttacttggtcctcagaaagcttatgctagtccattgcttcagtcacagaagaactgtggctactatggaaaccttggatttggccttggttattctggaagtcctttgatgagtcctgttcttccctcttcccctgctgcacctggtagtccacttaggcatggtgaacgcagcatgcgcatgcaatcaggtataagaaactttggtggttcctttggttcatggaatcctgacctaggtggaaagatgaacatcaatatgatgccttcactcctggaggaattcaagagcaacaaaagcaaatcttatgagctctcagaaattgctggtcatgttgttgagttcagtgctgatcaatatggaagccgattcatacagcaaaagctagaaacggccagtactgaagagaaggacatggtcttttcagaaatcatgcctcaagctctcacgttgatgaccgatgtatttggaaattatgttgttcagaagttctttgagcacggaagccctacccagataaaggaattggccgaccagcttattggacgtgttcttgctctcagtcttcagatgtatggatgccgggttatacagaaggctatagaggttgttggtttagatcagcagactaaaatggttgctgagctggatggacacgtcatgcgctgtgtacgtgatcaaaatgggaaccatgtaatacagaaatgcatagaatgcatccctcaacatgctatccagttcattgtctcaacattctatggtcaagttgtgatgttatccactcatccatatggttgtcgggttatacagagggtgctggagcattgtgatgatcctacaacacagcaaataatgatggatgagattctccagtccgtttgcttgctggctcaagatcaatacggcaactacgttgttcagcatgtactggagcacggaaaaccacatgagagatctgctattatcgagaagttaattggacaaatagttcaaatgagccagcaaaagtttgcctcaaatgtcattgagaagtgcttagcctttgggaatcctgtagaacgacagattttgatcagtgaaatgcttggatccactaatgagagtgaacaccttgaggtaatgatgaaagatcagtttgcaaactatgtggtgcagaaggtgctagagacttgtgatgatcagcagagggaggcgatccttacaaggataaaagcacatctgaacacgctgaagaagtatacctatgggaagcacatagtagcacgcgtagagaagcttgttgctgctggagagaagcgactagggcttcaaccagcatgcaccagtgccgcctga

SEQ ID NO: 548 - DNA, 2521 bp, Oryza sativa
  misc_feature (141)..(141): n = any nucleotide
atgaagcgcgccgccgacgggatggagaagcccaagttcctcacgcgggaggagcgggagaagctggcgctcgagcgccgccaggccgccgtcaccgaccagcgccgctccgccctcgacctgctccagtcgctcccccgnccccctccgccgccgccgcctcccctttccaacccccctcgcgactcctcctcctcccaccaccgcgactcctccgaccgtgaccgtgaccgtgaccgggaccgggatcgggacagggaccgggaccgtgaccgggagcgccgccgcgacgacgactcccgccgcgaccgagatcgggatcgggaccgcgaccgaggcgactcctcccgccgcgaccgcgacagggagcgcggtgaccgcgaccgcgaccgtgaccgggagcgcggggacagggacagggagcgaggggacagggagaaagatcggctggagaagatggcggagagggagcgggagaaggagctggacgcgatcaaggagcagtacctgggttccaagaagcccaagaagcgggtcatcaagccgtctgagaagttccgcttctcgttcgactgggagaacacggaggacaccagccgcgacatgaactcgctctaccagtcgccccacgaggcccgcctgctctacggccggggattcctggctggcattgatcgccgcgagcagaagaaggtggccgccgcgcatgagaaggagacccgtgccgagcagcggcgcaaggccggtctggatgaccgccctgaggacgacgcagttgataagaaggaggctgatgctgcagcgaagtatgatgccttcgacatgcgcgtggacaggcactggactcagaagtctcttgatgagatgacggagcgggattggcgtatattccgtgaggacttcaatatatcctataagggttctaaggtaccccgtcccatgcggaagtggtctgagagcaagcttggtactgagctgcttcgtgctgtcgagaaagctgggtacaaggaaccttcgccgattcagatggcttccattccacttggtctccagcagcgtgatgttattggtattgctgaaacaggctctggcaagactgctgcttttgtgctccctatgctttcgtacattacccgcctcccacccataagtgaggaaaatgaggctgagggtccttatgctgttgttatggcacctactcgtgagcttgctcaacagattgaggaagagactgtgaaatttgcgacctatcttggcattaaggttgtgtctatcgttggtggtcaatccattgaagagcagggttttaagattaggcagggctgtgaggttgttattgcaactcctggtcggcttcttgattgcttggagaggaggtatgctgtgctcaaccagtgcaactatgtggttctggatgaggctgataggatgattgatatgggcttcgagccgcaggttgttggagtccttgatgctatgccatcgagtaacttgaaacctgagaatgaggatgaggagcttgatgcaaaaacgatctataggactacctatatgttcagcgccactatgccacctgctgtggagcggcttgctaggaagtacctgcggaacccagtcgttgtcacaattggtacagctggcaaggccacagatctcatcacacagaacgtgatcatgacgaaggagtcagagaagatgtcaaggctccagaagatactcacagatcttggggataagccagccattgtgttctgcaacacaaagaaatcagcagatgctcgtgcgaaggatctagacaaggcaggcttccgcgtcacaacactacatggtgggaagtcacaggagcagagagagacgagccttgatggatttagaaaccggcggttcactgttcttgtggcaactgatgttgccgggcgtggtattgatattcccgatgttgctcatgtcatcaactatgagatgcctagttcaatcgatacatacacacatcgtattggaagaactggacgtgcaggaaagaagggattggcaacttcgtttttaactctggagaacactgacattttctttgatctgaaacagatgcttatacagagcaacagtcctgtgccacctgaacttgcaaggcatgaagcatccaaatttaagccaggctcagttcctgatagacctccaagacgaaatgacacagtctatgcaactcactgaagcatctactgcagaatgggccaaagatcctccagtattacaagggaacttttggaaacagaaggatctaattctagattagtacttcgaggtacaaacattatgatgattactcgttttttattatatgtctgaaaactatgccctatattgtcatgaatttaggatatgtttatgatggtttagttctggacttatgtatcttttcttattgttggtgatcaatgcaaactctactatggcccatgtagtgcattattttaccgcctaaatatatatcatattttgttatgtttgttgtttacagtag

SEQ ID NO: 549 - DNA, 2511 bp, Oryza sativa
atggaggcggaggacgacgagcgagccgaggcggaggcggaggcgcggcgggagaaggaggccggcaacgccgcctaccgcaagctctacctcgagacggccgtgcgccactacacccgcggcgccctcctcgacccccgcgacatctccttcctcaccaaccgcgccgccgcctacctcctcatgtccaaggtcaggctctcagtctcagccatgcccccaaacccctcctctctctccgattgtttaacctcgcggcgatggcgattggtttctccgttgcagtacaaggagtgcgtgagggattgcgacgaggcggtggagaaggggcgggagctacgcgccgacaacaagctggtcgcgcgggcgctggcgaggaaggcgtcggcgctgctcaagctcgccgcctgcgccgcggactacgacccggcgatcagggcgctgcagcagtcgctggccgagcactacagcgaggagacgctcgccaagctgggcgaggcggaggaagccaggaaggagattgaggagcgggagcggcttgatcaggaagctgccgatcaccaccgagacagaggcaacgatttcttcaagcagaaaaggtaccaggaagcagcaatgcactatactgaagccatgaaaaagaacccaaaagatcccagggtttttagcaacagagcccaatgccacatctacctaggagcattgcctgaaggtcttgaagatgcagataaatgcatagcgttggatcctacttttctgaaaggctatctgcgtaaagctaaagttcagttacttatgggcaattatgaaattgctctggcaacttatgtagagggtttgaagtgtgacccaaacaacctcgaagttcttgatggcttaaggagatgtgcagcatgcattaaaagagctaatggcggtgattctagagcagaggacttgagagagatactgggagatttgcatttgaatgatgatctgtgtaataaacttcaaaaaagcatggatgaagctgcggtgttgaagaaggaagcatccgacgagcgcttaaagcggattgaatctgaacgattggccaggacattggaagatttgtatttaagccaggtccaacaaaggaaagaaacagaggaatctctttcaagggtacaacaagagtttgaacaacttaaaatacagcaagatgaggtcaccgtggaacttcagagagtcaatgagcagaatgagaatctactaggtcaactctcagactccagagagcattttgaatggcttctatctgagcatgaccaattgctacgtgaacgagataatgcagttcgagaggttgaagaactacgtcagaaaagaggacagatgctttcagttttggttacagcgatgcactgtgaattttcatcatctgaagtggaatctgcaacagaaaattttagtaattcattgaagattggagaaggtgggtttggctgcgtatacaaaggtatcctccggaacatgacagttgcaataaaggtgctgagacctgatagtttacagggacaatcacagttcgaacaagaggtttctatcctcagtagagtgagacaccctcaccttgtgactctcttaggagcttgctcagagtcttcaacactcgtatacgagttcctgccaaatggaagcctagaagattttcttatgtgttcagataagaggcaaactctgacgtggcaggctcggattcgaattattgctgagatatgttcagcactaatctttctgcataagaataaacctcacccagttgttcatggagatctcaagcctgctaacattctccttggtgttaacttagtcagtaagcttagtgactttggtatttctcgcctcctaatccagtccagcaccaataacaccaccctgtaccgcaccatgcatcctgtgggcacccctctgtacatggacccagaatttctttccactggagagttgacacctcagtctgatgtttattcatttggtattgtagtcttgcgtcttttaacaggaaagcctcctgttggtataaagaatatcgtggaggatgcaatggagaaaggtgacttgaactcagtaattgatacctcagtgggagagtggcctcatctgcacatcgagcagctggcataccttgctctcagatgcactgagttaagcaggaggtgccgccctgatctttcaggtgaggtgtgggcaatagttgaggctataagggatgctgcattatcttcaccttcatcctctagatcagcacaggatcaaaacagtccaccgtcatatttcatctgtcctatatctcaggatatcatggatgatcctcacattgcagcagatggattcacctatgaagctgaggcaatcaggagttggctctgcaatggccatgacacgtctccaatgaccaacttgctacttgaacatgaggagctcattccgaatcgcgcactgcgttctgctattcaggagtggctccagcagcacagcatgtcgctgtag

SEQ ID NO: 550 - DNA, 2506 bp, Oryza sativa
gcttgtccaaagttaatcgaacggtttagggaaagagaggaaaatgtaaagatggacatctttaacacatttattgagttgttacgccaaactggtaacatgacaaaaggataaggtgacattgatgagtctagagccctagatggttgctgaaacaagaagtacctaaggttgtcaaatccatcaataggcagttgcgtgaaaaatcaatcaagacaaaggttggagcattctctgtattgaaggagcttgttgttgtactgccagactgtcttgctgatcatattgggtcacttgttcctgggattgagaaggctttgaatgttggataagtcatctacctccaacctgaagattgaagcccttgtatttacaagacttgttatggcttcacattccccagctgtgtttcatccatacatacaggccctttctggcccaatattgtctgctattggagacagatattacaaagtcaccgctgaggctttaagagtctgcggagagctagttcgtgtacttcgtccaaattttgagccaatctataaggctatcttggcccgcttggcaaatcaggatcaggatcagcaggaagttaaagagtgtgccatatcttgcatgagccttgtggtattcacgtttggtgatggtctccaaagggaactgccggcatgccttcccattcttgttgatagaatgggtaatgaaataactagacttacagcagttaaggcaaacagagctctaaggcaggctacattgggaacactaaattctcttgttgttgcgtatggtggtcaaattggatcctcttatgaaactattattgctgaactttctacgctcattaggatttgcacatgactgctcttgcgctggaactttgttgcacgatcatggtcgatagaaaatccatccaaaatgttggtcttgcagtgaggtacaaggttttgccccaggcccttattttgatcaggagtgctctcttgcaagggcaggcactactgcagagattttttgcttcactggtccagtctgcaaatacaagctttgacactttgttggattctcttatttctactgctaaaccatcgcagtcaggtggacttgccaaacaggcattgtcttccattgcacagtgtgttgctgtgttgtgcttagcagctggggatcagaagtgtgcctcaactattgaaatgcttaaaggcattttaaaagatgacagcactactaattctgctaaacagcacatggccttgttatgtttgggagaaattggaagaaggaaggacctcagcaatcatgctcaaattgagaatattgtcattgagtcatttcagtcaccttttgaggagatcaaatctgcagcgtcatatgctctcggaaacattgctgttggaaatttatcgaagtatttgccttttatcttgaatcagattgacaaccaacagaagaaacagtatctattgcttcattcactgaaagaggtaattgcacggcagtctgttgaccatactggccagagtgagctccaggattcaaacattgagaagattttggcattgctctttaatcactgtgaaagtgaggaggaaggagttcggaatgtagttgcagaatgcttaggcaaaattgctctgattgaacctaggaaattaatccctgctctaaagcgcacatctagtcctgctgcaaacacaagagctacagttgccattgctataaaatattcaattgttgaacggcctggaaaaatagatgaaattatgtactccgagatttctaccttcctgatgttgattaaagacagtgacaggcacgtgaggcgtgcagctgtgctggccttgagtacagctgcccacaacaagccaaatttgattaagggtcttcttcctgaattattgcctcttttgtatgaccaaactgttgttaaggaattgatcagaacagttgaccttgggcctttcaagcatgttgtggacgatggtcttgaactcaggaaagctgcctttgaatgtgtggatacattgctggatagctgtcttgatcaagtgaacccatcatcatttatcgttcctttcctcttatctggtttaggtgtcttgtttatgcttagtatacacacgctgtaataactgcttttttgttgtcttatggaaccactttgtagatcattatgatgtaaaaatgccttgccatctgattctctcaaagctagcagacaagtgcccttctgctgttctggcaggttttggactcattagttgaccccattgagaaaactataaatcacaaacccaagggcgatgcagtgaagcaagaggttgatcgcaatgaagacatgattcgaagtgctcttcgagcaatcgctgctctaagccgcataaggtcaggcatcattctgtcctgccccgaacactttttttctggtttaaccacacttttaactgtgctgtcatctttctcgttattagtgaatcgccacatctttattctttgcccttga

SEQ ID NO: 551 - DNA, 2472 bp, Oryza sativa
atgtacgtggtgaagcgggacgggcggcaggagacggtgcacttcgacaagatcacggcgcggctgaagaagctcagctacggcctcagccaggagcactgcgacccggtgctcgtcgcgcagaaggtatgcgcgggtgtgtacaagggcgtcaccaccagccagctcgacgagctcgctgccgagactgccgccgccatgaccgcgtcccaccccgactacgcctcggtaacagccactgaacttcaccgttgttggtttttttgttccccattcggtagtaccttgtctcctcctgacatgtggattgctgttgtgaagctcgcggcgaggattgcggtttccaacctgcacaagaacaccaagaagtccttctcggagacaaggacatgtatggacatttcaacgagagatctgggctgaatgctcctttggttgcccacgatgtatatgaagtcatcatgaagagaatgcttctcgcttggacagcgagataatttatgatagggactcgattcgattatgattatttgggtttcaagactctggagaggtcttacctcctgaaacttggcgggaaggttgttgaaaggccgcaacacatgttaatgagagtttcagtaggtatacacaaggatgacattgagtctgctatcaagacctaccatctgatgtctcagcgctggtttactcatgcttcaccgacccttttcaatgctggcactccaaggccccaattaagcagctgtttccttatctgcatgaaagatgacagcattgagggaatctatgatactttgaaggaatgtgctgtcataagcaaatctgctggaggaattggtgtatcagttcacaatattcgagctactgggagctatatccgtggaacaaatggaacctccaatgggattgttcctatgctacgtgttttcaatgatactgcccgttatgttgatcaaggtggaggcaagagaaaggagttccttgatctgagaaagaatcatgggaagaggaggagcatcgtgcaagggatcttttctatgcactctgggttcctgatctattcatgcaaagagtccaaaataaccaagaatggtcattgttttgtcccaatgaagctccagggttagctgattgctggggtgatgagtttgagaaactgtacacaaaatatgagagagagagtttattgaagttggaaaagattacaataacatagctttgtactttcagggcaaggcaaagaaaattgtcccagctcagaccctctggtttgacattttaaaggcacagatagaaactggtacaccatatatgctttacaagaggatacatgcaataggaaaagtaaccagcagaatttgggcacaattaaatcttcaaacttatgcactgagataattgagtacacaagccctactgaaactgctgtctgcaatctggcatctattgctttaccacgttttgtaagggaaaagaggttacttcaactgtcacatacaatctcaacaaaataattgatattaattattaccctgttgaaaccgcaaaaagatcaaatatgcggcacaggccaattggcattggtgttcaagggttggcagatactttcatattacttggcatgccatttgattcaccagagaggctcagcaattgaataaggatatcttcgaaactatttactttcattctctgaaagcttccgctgagcttgctggtaaagaaggtccctatgaaacatatgaagggagccctgtcagcaagagggcattctccaacctgatatgtggaatgtagttccatctgacagatggaactggccatctctacggagtactatttctaaagttggattaagaaactctcttcttgttgctccaatgcctactgcttccactagtcagattcttggcaacaatgaatgctttgaaccttatacatctaacatatacagccggcgggttctaagagtggggagtttgttgtggttaacaagcatcttctccatgatttgactgaaatgggtgtttggactccagctctgaaaaataagataatttatgaagatggttctgttcaaaagatgacagtgatcccagatgatctaaaagcaatttacaaaacggtttgggagataaagcagaaaacgcttgttgacatggctgttgatcgtggatgctacattgatcagagccagagtcttaatgttcacatggaacaaccaaactttgggaagctgacttctctgcatttccatgcttggtccaagagggcctgaaaactgggatgtattatctacgaacacgagcagctgctgacgcaatcaagttcacagttgatactgcccttttgaaggccaatggagaaaacggcaccaaggctgcagaggaagaggacgtggaagctaaaatggctcaaatggtttgttccttgaacaaccgggaggagtgcttggcgtgtggaagttag

SEQ ID NO: 552 - DNA, 2394 bp, Oryza sativa
  misc_feature (223)..(223): n = any nucleotide
  misc_feature (824)..(825): n = any nucleotide
  misc_feature (828)..(828): n = any nucleotide
atgacaagcgataacggaaaggctccagataaggatggagagccttctggacctccgtcggctcctcaagaaggagaaatcagcaatgaaccaaaaaggcgacgacctctcaatggggaggaccaccggtccgacacggcgttccaccaaaggaaattggacccctgaagagaggatgccatattgtccagagctgttcagacatacaacgggaagaactggnaaaaaatagagcggaatgctttccggatagaaccgatgtacaatgcttgcacaggtggcaaaaggttctaaaccctgaattagtcaaagggccatggtccaaagaagaagatgaaatcattgttcagatggtaaacaaacttggaccaaagaaatggtcaaccattgctcaagctttgcctggacgtataggaaagcaatgtcgagaacgggtggtacaaccatcttaaccctggcataaacaaggaggcatggacacaagaagaggaaattaccctcatacatgctcatcgaatgtatggaaataaatgggccgagctgacaaaatttttaccaggaagaggacggacaattcaattaaaaatcactggaacagttcagtaaagaagaaagtcaattcatacatgtcatcaggtttacttacccaagtttcgtgtctccctctaaatgaatattctgcaaattgtaattcctcaccagcgatgacccaacaaaacagtgaagatagtggttgttttgctgtccgagaggttgaaaattcatcagggtgtagtcatcatcacttgccaaggttcttgctcccaagtgcatgatactattgnnccnttgggctgtgatttgcaagtaaacgcgaattttgacaagaatgaagcacatgattctcaatcttccatgggtccccaagcatgctatacttctgcggaggctgttgcatctgctttgcctgctgtgcattgccatgtttcttcctctaacttggatccagatcaacacttgcaagaggactttgctcaaggactgaatttggacatgactatagatgaaatgccaactgttcctagttttgcagacaaccagactgtttgtagtatagaaaatcatgaaagatctctggagccatatgatgtagcaatggaggtgcctctctctatgttatcaagtgattctggagctgagcaaaaactacatttcatgtctgaggctgacttcaacagtcctaactgtctgaaatctgaactctggcaggatatttccttacagggccttctttctggacctgatgcagttgaagctgattcaatttcaagatcaaatcaccaatcggatgtatattcctctgaagcagatacccattttttagcaccaccctacatgccacagacatcaaattcttcaagtgtgatggggcttgctgatgaccagagtccacagatgtcagtacctccatctcttatttgttcaaatgctatgactgatgatgcacctttcgataatagaccagggcggaaggaaatgccactttctcaggcagaagtggttacccaatcttccagttcttctggtgatgctgaaatgtttgctaaccctggttgtagcaatgacagacatgttccttcttcaacgatggaaagcatacctgaatgtggggaccaacaggttactaatgcggaagaacctgaagccagtctagagaaagaaccatcgcttacacagagtgtgactgcaccagatgaacaggacaagggagccctcttctacgaacctcctcgttttccaagcctggatgttccatttgtcagttgcgatcttgtaacctctggtgatctccaagagtttagtccccttggcattcggcagttaatgcattcaaccatgaatgtctgcacgccaatgagattgtggggctcccctactcatgatgaaagcacgggcgttttgctgaagagtgctgccaaaagcttcatatgcacgccatcaatactgaagaaacgtcacagagatctcttgtctcctattccagataaaagaatcgagaagaaatatgggactgaaaaggatcgtggggtatcagacacatcctccaccggcattcaaacaagttgtatcaatgccactaaagatgatgcacttataactacagttttgcgtattgagcgatctgcttcttctaaatctctggaaaagaaacttgttttctctgatgaaaacaaggaaaatttgggctacacaactgaacagacaaaagatggacagagtgctggaaatgacgaacacatggacgagcagacaacaggggaacgcagttctgcaacaaatgtagctactaatgatgacctgtcaggcaatttagtaagtacttccagtttctgatgatatttagcttgtcagtag

SEQ ID NO: 553 - DNA, 2332 bp, Oryza sativa
  misc_feature (171)..(171): n = any nucleotide
atggcgccaagggaccagtcatgtggggacggcggcgaggtggatccggagggtggcatcgaggcgccactcctctcctccggctcctcgttcttccaggacccggcgcacgaggacggcgatggcgacgaggaggcgcgacggcggcggcggaggttcctcctcgccggncgctcccagtccaacaccacctcccaggtggccctcgtcggcgtcggcgtgtgccccatcgagagcctcgactacgagaacgaagtgttcaagcaggactggagggcgcgggggcggggtcacatcctgcgctacgtggcgctcaagtgggccctctgcttcctcgtcggcgtcctctccgccgccgccggattcgtcgccaacctcggcgtcgagaacgtcgccggcgccaagttcgtcgtcacctccaatctcatgctcgccggcaggcgtttgcggtgttcctggtttcgaatttcgcccttacgatgttagcaacggtgctgacggtgtatgtggcgccggcggcggccgggtcgggcatccctgaggtgaaggcttacttgaacggggttgatgcccccgacatattttctctaaagaccctggtggtgaaggtgggaaaagctggtcctctagtacacacaggtgcatgcattgcatctatacttggacaaggtgggtcaagtaaatatcacctgacatgtaaatggctaaggtacttcaagaatgatagggaccgaagggaccttgttacttgtggtgctggtgctggtattgctgctgctttccgggcaccagttggtggagtcctgtttgctcttgaagcagtgtcttcatgtggaggagtgccctactctggcgagcatttttcacaacagcaatggttgctgttgtgcttagggcattgatagacttctgcaaaagtgacaagtgtggcttgtttgggaaaggtggacttataatgtttgatgtgacttcagattacatcacctaccatttggtcgatttaccgccagtaatcactctaggagttcttggtggagtactaggaagcttgcacaactttttcctggacaaggttcttcgtctctacaatttttattaacgagtcaccatttgtacatcctgttgtctcttcggcttgccatggattgcttcttgcaaaccttgtccaagtgacaccgaagaagcctgtccatccataggaagatctggtaattttaagaagtatcagtgtgcaatgaatgagtacaatgacttagctagcctgttcttcaacaccaacgatgacaccattagaaacctttacagtgctggcactgatgatgaattccatatctcttcaatacttgtcttcttcttcacatcgtatttcctgggcattttcagctatggccttgctttaccatccggcctttttgtgccagttattttgacaggtgcaacttatggccgccttgttggcatgttaattgggtcccaatcaacattagatcatggcctttttgcagttcttggctctgctgcccttctaggaggatcaatgagaatgactgtctcagtttgtgtcgtcatcctagagctgactaataatttacttatgcttcctttggttatgctggtccttctcatatcgaagacagtggcagatgcttttaatgcaaatatttatgatttgcttgttaaattgaaaggatttccttatctcgaaggccatgttgaaccttacatgaggcaattgtctgtcagtgatgttgtaactggtcctctacaggcattcaatggcatagagaaggttggccatatagtgcatgtcttaaggacaactggacataatggttttcctgttgttgatgagccaccattttcagattctcctgtcttatttggtctagttcttagagcccacttgcttgttctgctgagaaagaaagatttcattcctaactgctcagcttcagcactggatgcttccaagcaattcttgcctcatgattttgctaaacctggctcaggaaagcatgacagaatagaggaaatagaattcagtgcagaagaactggaaatgttcgtagatttgcatccgttcacaaacacgtctccttacactgtggtcgagactatgtctttggctaaggcccatgtgcttttccgcgaagttggattgaggcatcttttggttctaccaaaatcgtctaagagagcgcctgttgtaggcatactgacaaggcacgacttcatgcctgagcatatattgggtcttcatcctttcctcttcaagactagatggaagaaggtgcggtttggcaagtcagcattcaccaacctcgtcttctga

SEQ ID NO: 554 - DNA, 2325 bp, Oryza sativa
  misc_feature (218)..(218): n = any nucleotide
atgatgcagaggccgttccgtccggaggagtactccttgaaggagacttctcctcaccttggtggtggagctgctggtgacaagctcaccaccacctatgacttggttgagcagatgcagtatctttatgtccgggtagtaaaagctaaggaccttccaagcaaggacatcactggaagctgtgacccatatgttgaggtgaagcttgggaattatangggtacaactcggcatttcgagaagaagactaatcctgagtggaaccaggtctttgccttttctaaggagcgcattcagtcatcagtggttgagatcattgtcaaggataaggactttgtcaaggatgacttcatcgggcgggtgttgtttgacctgaatgaggtcccaaaacgagtgccacctgacagcccattggctccacagtggtatcggttggaagagcggaatggacacaaggtgaagggagagttgatgttggccgtttggatgggtactcaagcagatgaagcattccctgaagcttggcactctgatgcagcgtcgatcccaggagatggacttgcaagtattagatcaaaagtttaccttactccaaagctttggtatctgagagtcaatgtcattgaggcacaagatcttataccaaatgacaggaccaggttccctgatgtttatgtcaaagccatgctaggtaaccaagctcttagaacccgggtatcaccaagccggacgctgaatccaatgtggaatgaggatttaatgtttgttgctgctgaaccattcgaggaacacctgattctgagtgtagaagataggattgccccagggaaggatgatgtacttggaaggacaatcatttctctgcagcacgtacctcggaggctggatcacaagttgctgaacagccagtggtacaatcttgagaagcatgtaattgtggatggcgagcagaagaaagagaccaaattttcaagccggattcacttgagaatatgcctcgaaggtggatatcatgtcttggatgagtcaacacattacagcagtgatttgaggccaactgctaaacagttatggaagcacagcattggcattcttgagttgggtatcttgacagcacagggcctgttgccgatgaagaccaaggatgggcgtggaacaactgatgcttattgtgttgctaagtatgggcagaagtgggtgcggacaaggactattattgatagtttcacacccaagtggaatgaacaatacacttgggaggtgtatgatccctgcactgtgatcactattggtgtatttgacaattgccacttgaatggtggggaaaaagccaacggtgcccgggataccagaattgggaaggtccgcatccgcctctctacgctagaaactgatcgagtatatactcatgcttaccctctgattgttctgacacctgctggtgttaagaaaatgggggaggtgcagcttgctgtcaggttcacatgctcatcactgctgaacatgatgcatctgtattcacaaccattgctgcccaagatgcactatgtacacccattgtccgtgatgcaggtagacaatctaaggcgccaagccaccaacattgtatcaacaaggctgagccgtgcagaaccaccactgcggaaggaaattgtggagtacatgctggatgttgactctcatatgtggagcatgcggaagagcaaggcaaactttttccgtatcatgggtgtcctaagccctctgattgcggtggccaagtggtttgatcagatctgccattggagaaatccgctgaccaccatactgatccacattctctttgtgattttagtcttgtatcctgagctgatactgccaacaatcttcctctacctgttcctgattggagtgtggtactaccgctggcggccaaggcagccacctcacatggacactcgcctctcacatgcggagagtgctcatcctgatgagcttgatgaagagtttgacacattccctacttctcgtccgcctgacattgtgaggatgcgttatgaccggctacggagtgttgctgggaggatacagaccgtagtcggcgatctcgcgacacaaggagaaaggctgcagtccctgctaagctggagagacccaagagccacggcgctctttgtgaccttctgctttgttgctgccattgtcctctacgtgactccattccgtgttgtggtcttccttgcaggcctgtacaccttgagacacccaaggttccgccacaagatgccctctgttcctctgaacttcttcaggaggctccctgcaagaactgatagcatgttgtaa

SEQ ID NO: 555 - DNA, 2314 bp, Oryza sativa
atggacgtcaacgaggaggcaatggcggcgcacaagcgcgcgttcctcgacttcctcgaccaggatgtcgggaagggggtgtacatgcaggccgtgcgcgacatggtgcagaacaagcgcaaccggctcatcatcggcatggacgacctccggaaccacagcctcgatctcgcccgcagagggtgatacggagccccgcggagtacatgcagccggcgtcggacgcggtgacggaggtggcgaggaacctggaccccaagttcttgaaggaagggcagcgcgtgctggtgggattctcggggccttcggcttccacagggtcacgcccagggacctcatgtcgtccttcatcgggactatggtctgcgtcgagggcatcgtcacgaaattcactagtaaggccgaaagttgttaagagtgttcactattgccctgctactggaggtactctctcacgtgaatacagggacatcacatctttcgtaggcctacctactggttcggtttatccaacaaggacttaggatgaaaatggtaacttgttggtcactgagtacgggatgtgtgaatacaaggatcaccaaacactctccatgcaagaagtgcctgaaaattctgcccctggacagctcccaagaacagtggacattattgtagaagatgacctagtagattcttgcaagccaggtgaccgagtatcaattgttggtgtttacaaggctcttccagggaaaagcaagggcagtgttagtggtgtgttcagaggactgtccttattgcaaacaatgtttcacttatgaacaaagaagcaaatgcacctgtctatactcgggaggatttgaagaggatgaaagaaatatcaaggagaaatgacacatttgacttactaggaaattcacttgctccatctatatatggccatctgtggataaagaaagcagtagttctattaatgcttggtggtgtagagaagaatctgaagaatggaactcacttgagagggagatataaacatgatgatgttaggagatccttcagttgccaagtcccagctcctaagagcggttatgaacattgccccttgggctatttcaactactggaaggggttcatctggtgttggtttgaccgctgctgtcacttctgatcaagagactgggtgagagaaggctggaggctggtgccatggttcttgctgatcgtggtgttgtctgcattgatgagtttgataagatgaatgatcaggaccgagtggctattcatgaagttatggaacagcaaactgtgacgattgcaaaggcaggaattcatgcgtcactaaatgcgagatgtagtgtgattgctgcagcaaatccaatatatggaacttatgaccgttcattgacaccaaccaagaacattgggcttccagattcattactctcacgttttgatttgctttttattgttcttgatcaaatggatcctgagattgatcgtcaaatttctgaacatgttgcacggatgcatagatattgcactgatgatggagaggagcaagatctcttgataaaacaggatatgctgaagaagatgatggtgatgttaatgcagccatatttgttaaatatgatagaatgctccatgggcaggacagaaggagaggcaagaaatccaaacaggacagactgactgtcaaattcctgaagaaatatattcattatgcaaagaaccttattcagccaagactaactgatgagaggcatctgatcatattgcaacttcatatgctgagctcagggatggtggtgcaaatgcaaagagtctggtggaggtacacttccgatcacagcgaggacactggaaaccataattcgtctatctactgctcatgccaagatgaaattgagacatgagaggttctaaaaactgacgttgaagctgcactgcaagttctgaattttgcaatataccacaaagagttaactgagatggaagagcgtgaacagagagagatggaaatgaaacaacaagctgatcatgatgcaggtgcaagtggtgagttctggaaacgacccaatggatgtggatgtaggaaatgcatcgaatgatcaggatgttcctgcggagagagaattgaagcatttgaggcgattcttggtcagcatgtgttggcaaatcatctcgatcaaatatcaattgacgaaattgagcaaactgttaatagagaggcagctgcaccttacaatagacgtcaagtagaattcattttggagagaggatgcaagatgcaaacaggataatgatacgagatggcatcgttcggataatctaa

SEQ ID NO: 556 - DNA, 2239 bp, Oryza sativa
gatccgaagttgttgaaagctttagttgaaaaccacaaaagatctttcccatatgctggggcctttcttgtcaagaatgaggaagatactgacagtaacactgtcacacgttcagatccaaagaaaagcattcatggtctgaaagggaaagaattattgaagcatcttcatgaaattggcactcttgctaagataacaagcattcaaggagatcaggtgttgctacttggtcactgccgtttacggataactgaaatggttgaggaggacccacttacagttaaagttgaccatctaaagaaggcaatatatttcgaacttctatcgactttaagggatgttctaaaaacaagttccctttggaaggatcatgctcaaatctacacccagcagcatatggttgatttcaactaccaaagactagcagattttggcgctgctatttcagtcaccaacaagttgctatgccagggagttcttgaggaactagatgtgtctaagcgtttgatgttgacccttgaattagtaaagagggaattggagattactaagttgcagatagcaaaagcaattgaagaaaaagtaactggcgagcagcgccgctacttattgaatgagcaacttaaagcaatcaagaagaaatttaggaaaaggattgaatcgagaaaagagaaatgcccatctcatatcttacaagtcattgaagaagagctcactaaacttcaattactggaagctagttctagcgagttcagtgttaccagcaattatttagactggctaacagtattgccatggggggattacagagtgatgaaaactttgatgttcttcgtgctcaacgcattcttgatgaagatcactatggtctaactgatgtaaaagaaagaatattggagtttatagcagttggaaaattaagaggaagctcacaaggttccataattctatcctgtttttattttctgtgtattttctatgtattatttatggtaaaattatatgtctctgtggaccacctggcgttggtaaaactagtattggacgatcagttgcacgtgcattaaaccggaagttctacagattttctgttggggggtcatcgacggacctatgttggggcaatgccagggaagatggttcagtgtctgaaatcagtcggaacttcaaatcctctggttttgatagatgagatcgacaaggtattcatctagggagagggtattctggtgatccagccagtgcactgttggaacttcttgatcctgaacagaatgctaactttcttgatcattatcttgatgttcctattgacctctccaaggttctgtttgtttgcactgcaaatgtcatagagatgataccaggccctctactggacaggatggagatcattactattgccggttatataaccgatgagaagatgcatattgcacgggattacctagaaaagaacacaagggaggcttgtggcatcatgcctgaacagcaggttgaggttacggatagtgctcttcttgctcttattgaaaactattgccgggaagccggtgtgcgtaaccttcaaaaacagattgaaaaagtttaccggaaggatgcatcaaatctggataactttgttgggaaggctgtattccaaccagagcgtatatacgatcaaactcctgttggggtagtcatgggtttagcttggaatgctatgggtggttctaccttgtatattgagacagcaaaagttgaggacggcgaaaaaaaaggtgcacttgtggtgacaggccagcttggagatgtcatgaaagagagtgctcaaattgcacatacaatttgcagatctatattacatgagaaagaaccaaataacaccttttttacaaagtcaaagcttcacttacatgttcctgcaggggctactccaaaggatggccccagtgctggatgcacgatggttacatcgatgctgtctttagccatgggaaagctggtaaagaaagacctcgcaatgactggggaagtaacattgactggacgaattctcccaattggtggggtgaaggagaaaaccatcgctgccaggagaagtgggataaagacgatcatattcccagcagcgaacagaagagatttcgacgagcttgctcctaatgtaaaagaaggtcttgaagtccactttgttgacaaatacagtgaaatatatgatttagcttttccaagtgatagtcaggcattagcaagctag

SEQ ID NO: 557 - DNA, 2185 bp, Oryza sativa
ctgagaggagagcgctatataaagctctacagctaccgctatctgattaatggttttgctgttgtcatcactcctcagcagaaggcagagaggctatctatgacgaaagaagtggcaaatgtaatgttggacttctcagttaggacggcaacaactcatacccctgaattccttggtttgccacaaggagcatgggttcaagagggtggcccacaatgtgctggtcagggtgttgttgttggcctcatcgacacaggaatcgatccaactcatcccagcttcgcagacgacttgataactgacagttatcctgttcctgctcattactctggcatttgcgaggttacaaatgattttccatctggatcctgcaacagaaaacttgtgggagctaggcattttgcagcctctgcaataaccaggggagtgttcaatgcctctcaagatcatgcttcaccttctgatagtgatggtcatgggaccatacagcatccatagcagctggtaatcatggaattcctgttgttgtggctgggcatcattttgggaatgcaagtggaatggctcctcgtgcacaattgctgtctataaagctctgtacaaaagctttggagggtttgctgctgatgtagtagctgcaatagatcagatattgcaggcagctgaagataatgttgatataatcagcttatccattaccccaaatagaaggcctcctggactagccaccttctttaatccaattgacatggctcttctttcagctgtaaaagctggcatatttgtcgtgcaagctgcaggaaatacaggtccttcccccaagagcatgtcatcatacagtccatggatttttactgtaggagcatctgcccatgacagggaatacaacaactatgttgtacttggcaacaatctgaccattacaggagttggccttgctcctagttgctgcacctcatgcactgaaaaacaatgtagccagtcctactgaaatgtccctaggggagtgccaagattcaagccaccttgatgaagatctgataaggggaaagatactggtctgcagctattccatacgatttgtacttggcctgtcgtctgtgaagcaagctttagatactgcaaagaatgtcagtgctgcaggagttatattctatctggatccatttgtcattggattccagctgaatccaactccaatggatatgcctggacttataataccatcatctgatgactctaagctaaattattacaatgagtcccttgtgagagatgagacctcaaacaaaatcgtcagctttggtgcaattgcaaaaatactaggaggccaaaatccaaattatggtatttctgccccaaaagtaatgttttattctgccaggggtcctgatcctgaggacaactcactggccaatgctgatatcctgaagccaaatctgatagcacctggcagttccatttggggtgcttggagttctcttggattggactctgctgaatttgctgggtgaaagttttgcaataatttccggtacaagtatggctgcaccacacgttgctgggcttgctgctctagtcaagcagaagttcccttattttagccctgcagctataggttctgcattatcgactactacaagtctcagtgacagggaggggaatccaatcatggcacagagaacatacggcaatccaaattcaactcaatctccagctacaccttttgacatgggaaatggatttgtcaatgctactgctgctttggatcctgggctcatatttgattccatttctatgtggcataaacggctctgctccagtagtgatgaattacaccggcaacagctgcagctcctccgccatgacaggggctgatctgaaccttccctccatcaccattgcagtgctcaaccagtcaagaacgataacaagaactgtaaccaacgtggcgagcgacgagcgctacacggtcagttacagcgccccttacggggtcgccgtctccgcgtcgccggcccagttcttcatccccagcgggcagaggcagcaggtgaccttcgtcgtcaacgccaccatgaacggcacctccgcgagcttcggcagcgtcggcttctacggcgacaagggccaccgggtgatgatcccgttctcagttatctccaaggttgtgcaccgttcatga

SEQ ID NO: 558 - DNA, 2180 bp, Oryza sativa
gcaagactcttgccgtgttgagactgcagaaacgagagctagctagccagaggctgcaagaagattctgcacccatagatcgtctaccatggccacaaacccaggactcttcacggagtggccatggaagaagcttggcagcttcaagagtacgtgttgctggcgccgtgggtagcgcacgggtggtatgaggtggcgaccaaggggtggcgggaggtggatctcgggtacatcgccatcctcccgtcgttgctgctgcggatgctgcacaaccaagcctggatcaccatctcccgcctccaaaacgcccgtggccgccgccagattgttcgccgcggcatcgagttcgaccaggttgaccgcgagaggaactggggacgaccagatcatcctgagcggtatcctactatacctcggcgcactgtacgtaccgggcgggcaacacttaccgctgtggaggacggatggcgcggggctgatcgccttgctgcatgcggggccagtggagttcctctactactggttccatcgtgcgttgcaccaccactttctctacacccactaccactcgcaccaccactcttcaatcgtcactgagcccatcacatgtacccgtcatccatccgtttgctgagctcgttgcctacgaattgctcttctcgatcccactgatcgcctgtgccttgactggaactgcttccataattgcattcgagatgtatttgatttacattgatttcatgaacaacatggggcactgcaacttcgagttggtacccagctggctcttcacatggttccctcctctcaagtatctcatgtacacgccatcgtttcattctctgcaccacactcagtttcggacaaactactcccttttcatgccgttctacgattatatctacaacaccatggacaagtcatcagacactctgtatgagaactcactgaaaaacaatgaggaagaagaagcagtggatgtggttcaccttacacacctgaccaccctgcattccatctaccacatgaggcccggtttcgccgaatttgcgtccaggccctacgtttccaggtggtacatgaggatgatgtggcctctgtcatggctctccatggtgctgacatggacgtacggttcttcattcactgttgagaggaatgtcatgaagaagatcaggatgcagtcatgggccataccaagatacagtttccattatggattggattgggagaaggaagctatcaatgatcttatcgaaaaggcggtatgtgaagctgacaagaatggggctaaagttgtaagccttggactcctgaatcagaggcacataccctgaataaaagtggagaacaatatctgctgaaatacccaaagttgggagcaagaattgtcgatggaaccagcttagctgctgcagtggttgtcaacagtatcccccaaggcacagaccaagtaattcttgcaggaaatgtttccaaggtggcgcgtgctgtagcgcaagcattatgcaagaaaaatatcaaagtcacgatgacaaacaagcaagattatcatttactcaagccagaaataccagaaactgtagctgacaatctttcgttttcgaaaacaggcaccgcaaagaggtttggttaattggtgatggtctagattctgctgaacaattcagagcacagaaaggaactctgtttatcccatactcacaatttcctccaaagatggtacgcaaggacagctgcagctactcgacaactcctgcaatggctgtaccaaaaacgctgcagaatgtgcattcatgcgagagaattggctgccaaggagggttatgagcgcatggcgaatcgcgggaattcttcatgcgttggagggatggaatgagcatgaatgtggtgacaaggtgcttgatatggacaaagtttggtctgctgcaattatgcatgggttctgcccagttgctcaaggttgatgattcagttgcaaagtatcagaataagttttagctggattatgctatgtggtcaccgtatcagaaagagagatgttctgttggcaagaagagatatagtatctgagtaatttcatctgccatggtttttaaaacattgttcatcatctcctttgatcaaagactggccatggctactttctgtataagtatctgtcctttttagtccatagt

SEQ ID NO: 559 - DNA, 2176 bp, Oryza sativa
atgggttctgttgccggcgacgccgcccgcctttcttatccacccactcgccgtgacaattccgtcgtcgacatgtaccatggcgtccctgtcgccgacccttaccgttgcgtaggctggaggacccagagtcggaagataccaaagaatttgtggcaagtcaggtggagctagcagagtctgtgcttgcgggctgcttcgacagggagaaccttcgccgtgaggtcactcgcctcttcgaccacccgcgccacggggcgccgttccgtcgcggcaacaagtacttctactttcacaactccggactccaagcccagagcgtgctctacgtgcaggaggcggaggttcttctggatccaaatgcactaagcaaggatgggacagttgctctttcgacgtattctgttagcaaggatggcaaatacatagcttatggcctaagtgaaagtggcagtgattgggtcactattcgtgtgatgaacattgctgataagcagactttgtctgacaaattgtcttgggtgagcagatgcagcttgtgaaattctcatctatcagttggacccatgatggaaaaggttttttctatggtcgataccctgcaccccggatgctggaactgaaacaaacattaatcttaatcatgagatatattaccatgtcgtgggatctgatcagtccgaagatatattatgctggaaagatcctgaacaccctaagtattcctttggtgcatcggtcacagaggatggaaaggaaggttgcgatcctgtcaataagctatactactgtgaaatttgtactcttcctcaagggatagaggggttcaaagagacaaaggggatgcttccatttgtcaagcttatagataactttgatgcccaatatcatgttgtggcaaatgatggtgatgaatttacatttttgaccaatagaaatgctcctaagaacaagcttgtaagagtagatatcaagaagccagaattgtggactgatattcttcctgaacatgaaagagatgtgctcgaatcagctgacgcggttaatggtaaccagttattggtatgttatatgtcagatgttaagcatattctgcagataagagaccttgtaactgggaacttgcttcataagttgcctctagaaattggttctgtttcagagatctcctgtagacgggaagacatggacgtctttattggcttcacaagctttctttcccctggtattatttacaggtgtaacctcacatctgcgatcccagaaatgaagatatttcgtgaaatttcagttcctggatttgatcgaacaaattttgaggttaagcagagtaaggatggaaccaaaattcctatgttcataatgtcaaagagagatattgaacttgatggatcacatccaactttgctatatggttatggtggattcaacataagtcttactccttctttcagtgttagtcgtgttgttttatgcaagaacatgggttttgttgtctgtgttgcaaatattcggggtggtggggaatatggggaagagtggcacaaagctggagcacgtgcaatgaaacaaaattgttttgacgacttcattgcttgtgctgaactcctcatttctgctggttatacgagttacaggcagttatgtattgaaggtggaagcaatggtggtcttctgattgctgcttgcgttaatcagcagcggcctgatctctttgggtgtgctcttgctcatgttggtgttatggacatgctccgttttcacaagttcaccattgaggtcatgcctggactaccgactatggttgttcagacaatgaagaggaattccactggcttatcaatattccccccttcataatgtgaggagaccttgggagcaaagttttgttaactgttgtcagtacccagcaatcatgctgttgactgctgatcatgatgatcgtgttgtgccattgcactcattgaagttgttagcaacactgcagtatgtcttgtgcactagcattgaggatacaccacaggtcaatccaataattggtcgcattgacgtcaagtcagggcatggagctggcagaccaactaaaaaaatggtttgcaatctattgcagattgatgaggttgctgatcggtatagcttcatggcgaacatgttagatgcgtcatggacggagtga

SEQ ID NO: 560 - DNA, 2141 bp, Oryza sativa
  misc_feature (355)..(355): n = any nucleotide
  misc_feature (576)..(576): n = any nucleotide
  misc_feature (893)..(893): n = any nucleotide
  misc_feature (899)..(899): n = any nucleotide
  misc_feature (956)..(956): n = any nucleotide
  misc_feature (1474)..(1474): n = any nucleotide
  misc_feature (1488)..(1488): n = any nucleotide
  misc_feature (1497)..(1497): n = any nucleotide
  misc_feature (1499)..(1499): n = any nucleotide
  misc_feature (1507)..(1508): n = any nucleotide
  misc_feature (1599)..(1599): n = any nucleotide
atgccattctcctacgccgccgcggcctctggctccgcgtcctcttctcgcaagccggttcccgtcgccgcggccgccgcccgccgacccgcgccctcgccggcagcggcggcggcacccgcgccctcgccgtcaaaccctagcgcggtctccgattccgacccctcctcgtactcctcctccggggaggagaccgacctcaccgcctccgatccggcggccgcctccgtcatctcctcctacctctccgttgcgggggatggcgccgacctctccaaggtcgggatcttcctctagctccgcggcgcgccgccgatcgccgccgtgcctgatatgcttcgatcccatccgcccntccgaccccgtctggtcctgctccgcctcctgcttcgccctcctccacctccactgcatccagtcatgggcacatcagtcatcctctgccgcgccttctcccacctggggttgccccaaatgccgcttcccctatcccaaatcccagactcccacctcctacctctgcttctgctccaagacggtagacccagctccggacccctggatcctcccccactnctgcggcgacgtctgtggccgacgtctcaatgcagaccgtgactctggctgtgagcacaactgcctcctgctttgccaccctgggccatgtccaccgtgcccggcaattgttccaaatgctatgtgcttttgcggctcacatcgtgagacgcgtcgatgctcacatcagcgttattcttgctcggggaaatgcaataaacgcctcggctgtggaatccaccggtgtcctgtggattgccatgatgggccttgcccgccttgtgcggtgcgaggaaagcacaaatgtgagtgtggagaaacaatggaggagaggctantgctcntgaaagggtgttccagtgcaagagggagtgtggtgggatgttgcagtgtgggaagcnatagttgtgagaggggttgccatgctggaaagtgtggaggatgcccactccaagggcgacgaacttgcccatgtgggaagaaagattatccaagtttggactgtgatgcagaggctgccacatgtggatcaacttgcgagaaggtgcttgggtgcgggcggcacaaatgcccagagcggtgtcatcgtggttcatgcgttgagacatgtcggcttgtgatcacaaaatcgtgccgctgtgggggtctcaagaaggagaggtgccttgctaccaagaattgacatgcgaaaggaagtgtcagcgtttgcgaaactgtggccgccatgcttgtagacgacgttgctgcgagggtgattgtgcaccctgcccagagagccccacaagtgccactatggagcttgcccaccttgcaaactaatctgcggagaagaactttcttgtggccacaggtgtaagctgagaggtgtcatggccccattgctcctccaaatcctgagttcacacgaaaccaataaaanggaaaaggggaaangcatatggnantctacacnnggaacaccatgcccgccatgccaagaagttgttttggtgccatgctttggacatcatcttggccaagaacgtgcaatacttggctccaaanggaggcagtttccatgtcagaatttatgtggaaaattaccgaattgtccccatctgtgctcagaaatatgtcaccctgggtcaatgtccgttgtgcatgcaacaaccttaaaaaagagtggatatgtcaagatgttctgaaggaataccgtcagtctggtcgtgacccaaaacaaatacctaaaaatcaatatgcagttggcctacttgcctgtggtgaagattgtgttaaaaaggttaaagctgcagattctgagttgcatctccggaaaattcaggagatcaagagacccctgctgtggaagttgaaaatgtgcccaagcgcaggaagaggcgtaaccgtggccaagaaagtgttgaaagctcaaaattccagcaggaaatcaaagctgttgcgttgaaatttctcctggttatttttctgtgcataatcgttgtagctggattgtaccttttgtggaaaggtgtttaccggctttctgattggatgaatgacatggaggagcagagggccaggcagaggcatttgaagcctggaagatt

SEQ ID NO: 561 - DNA, 2138 bp, Oryza sativa
  misc_feature (358)..(358): n = any nucleotide
  misc_feature (1545)..(1545): n = any nucleotide
tcggacatcaggaaatggttcatgaaggcgagaaggaagactagcaagtactttgcatccaaaacagaaaaggaggaagacaccagtgcaggaaaaggtaccgggagaggtttgcctaaaagaaaacttcagaaagtcagtgatgagcttgaggatgacatgaagcctttgccagcaaaggaagtccataaagaagaagaagatgatgatgacgacgactttgtggcaccttcaaaaaggaaaactccggtgaagccaccaccatcaaagaagttgaaggaagatgccaagaccccttccaaagcagctggaaggggaaggggaggagcctctgggggaagagggagaggagggggtnggagaggcttcatgaactttggtgaaaggaaggatcctcctcacaaaggggagaaggaagtcccggagggtgcccctgactgtttaactggtttgacatttgtcataagtggcactcttgacagagtcttgaacgtgaggaggcaactgatctaatcaagcgttatggaggccgtgtgaccggctctattagcaaaaagacgtacctattggctgatgaagacgttggtggagtgaaatcaaataaagcgaaagaactggggttcctaactgaagatggtttatttgatatgattcggaaatcaaagcctgcaaaggctactgtggcaaaacatcaaagcgacaaaaattcagaaaagcagcaaaaatcaccaatgaagagttctccagttaaagttgaaagaagagtctttgcaatggactgaaaagtatcggcccaaagttccaaatgacatagttgggaaccaatcaatggttaaacagcttcatgattggttgagaagttgggaggaccaattccttcattctggccagaagggtaagggaaagaagcaggctgatagtggagctaaaaaggctgtgttgttgagtggacctccaggtattggtaagaccacaactgctaaagttgtcagtcagatgcttggattgcaggctattgagaatgcaagtgatagccgtggtaaggcagactctaagattgagaaaggtgttgggggcagtacatcaaattctatcaaagagcttattagtaatgcaactctgaattatagtaacaaccgaattttgacagattaaaacgacccaaggctgtactagtcatggatgaagttgatggtatgtctgctggagatcgtggtggtgttgctgatcttattgctagcattaagatgtccaagattcctataatttgcatttgcaatgaccgttatagccagaaattgaagagccttgtaaattactgcttgctactcaacttcagaaaaccaaccaagcaacagcagatgggtaagaggttgatggaaattgccaagaaggaaggtcttcaagctcaagaggaacttgcagaaagagtacacggggatattcgcatggctcttaaccatttgcaatatatgagcctctcccagtccgtggtcaaatatgatgatataagacagcgacttaatagtaacacaaaaaatgaanatatttcccccttcacggctgttgacaactgtttggttttaatggtgggagactacggatggatgagagaattgatttgagcatgagcgatcctgatttagtccctctgattatccaggaaaactatatcaattatcggcctatcactgttgggaaggatgacagtggagttaaaagaatgaattttcttgctcgtgctgctgaatctatagcggacgctgatattgttaatgtacaaataagaagatatcgacagtggcaattgtcccaagctgcttgtttgtcttcatctatagttccggtgagcgaaacttcaataggtttggtggatggttgggaaagtactcgaccacaaataaaaacataaggctactggaagatgcccatagtcatattcttgcctcccagcaagcaaatttggacagagggagtcattgaggctggattacctcactcttctcttgagacaattgactgatccactgaagacaatgcccaaggatgaagctgtgcaaaaagtggtggagtttatggatacctactctttaagccaggaagactttgacacaattgttgaattatcaaaatttaag

SEQ ID NO: 562 - DNA, 2133 bp, Oryza sativa
atgcggcaccgcctccgcctcctcctcgtcgtgctcgtcgccgccgcctatgccgccggcgacgtcgcctcgtcgtactcgcagcctacgctgcccgctgttcccccggtgcaggccgtacggccgccgcccgcggcggtaggcggcgggtcgcactcgcagcccacgttccctcctcgcgcgccggtgcgggccgtgccaccgcccgccacgctggtctcgacggcgaccccgggggcgctgcttgcggcattcctcgccaaggcggatccctccgcgcatctgcggttccctctggcggtgtcgccgtgttcgcacccggccgtctcctgcagcgccgacggccagatcacccgcctggtgctcgagtcgtccgggctgaacgggacgttcgcgcccgccacgctctcccgcctcgtcgagctccgggtgctcagcctcaagagcaacgcgctccacggccccatcccggacctctccccgctcgagaacctcaaggcgctcttcctcgccggcaaccgcttctccgggccgttccccgcctcggtcgcgtcgctccgccggctccgctccatcgacctcgccgggaacaggctctccggcgcgctccctcccggcattgaggtcgcgttcccgcatctgacgttcctacggctcgacgccaaccactttaatggctccctcccggcgtggaaccagtcttcgctcaagctgctgaacgtgtcgtacaacaacttctccgggcccgtgccggtcacccccgtcatggcgcagatgggcgccgccgcgttcgcgggcaatccagagctctgcggcgaggttctccgccgtgagtgccggggctcccacctcctcttctttcacggtcctggcaacaacggctccgctgctcccccggtgcagagcgccgcggccaccggcgacggaccgcaacgcgacgacatcagcttgcccgattcatccacgccgcgttcgcggaaactgaggaggcgggccgccatcgccgttgcggctaccgccgcagcgttcgtggccgtgcttctactttgtgccatgattgcaatgaaaaggggcaagaagcgtcggcggccgagctccgcggcatacccgagccccaagaagagcgcggccatgtcggaggtgagcagggacaacaccgatctcggctatgtggagtgcgtgccggacgaggagacggcggcgatgatgatgccggaggagaaggcgcggcggctggagcggagcggctgcctaacgttctgcgcgggcgagggcgcgagctacagcctcgagcagctgatgcgcgcgtcggcggaggtgctcggccgcgggagcgtggggacgacgtacaaggcggtgctcgacggccgcctcgtggtcatcgtgaagaggctggacgcggccaagatcggcgccgcggcgctggaggcagaggcgttcgagcagaacatggacgccgttggccggctgcggcatcccaacctcgtctcgctccgggcgttcttccaggcgaaggaggagcggctgctcgtctatgactaccagcccaatggcagcctctactctctcatccatggttcaaggtcatctcgagcaaaaccacttcactggacttcctgcctaaagatagctgaagacatcgggcagggccttgcttacattcaccaagcatcccgacttgttcatggaaacatcaagtcttccaatgtcctgcttggttctgactttgaggcttgtcttacggacaattgcttggcattccttttggaatcatcagaagtcaaagacgatgctgcttatagagcaccagaaaacatgaagtccaacagaaggctaactccaaagtcagacatatatgctttcggcatcctcctccttgaacttatcagtgggaagcctccgcttcagcactcagtattggttgcaactaatcttcagacctatgtccagtctgcgagggacgatggagtggacgtcgaacgtctctctatgattgttgacatagcatctgcctgtgttcgatcctcgcctgaaagtcggccaactgcctggcaagtcctcaagatgattcaggaagtgaaggaagcagatactgccggagacaatgacagcgatcttactagcaattcctag

SEQ ID NO: 563 - DNA, 2041 bp, Oryza sativa
  misc_feature (326)..(326): n = any nucleotide
  misc_feature (328)..(328): n = any nucleotide
  misc_feature (1854)..(1854): n = any nucleotide
atggttctcgaacccctccccgccgcgaaccttcgcggagggaggatcccactcgttcgggtggttcggctctctctccgccccctggcggagggagaccgcgacgcgtcagggcacgccgccgactcgactatggagacggcggttcaccccaaggcgcgcttcaggcagcaggcacccttctacggcatcccccggtaaacccggagccggagactcctgttcagcgctggctggacgacgtggccaacttggtcactgctgcccagcggtagttggctacgggtggccgatccactgccactggtacatcacgtacctcggtnancctctcctcgtcggcgaggagaagggctcgtcgatcggccacgatctcgaggcggtccacggttccaacatcgtcgggggcctcgggaagccgaaggcatcatgacggcctctacgggacgcaggacgctcgagtaaacatcgagcgacgccgggacgagcgccgagctgcccgtatgggggaaggcgcctcctcatctggagcgccacgctcctcttcacgaggcggccctcctcccaaacttacccctggggggacgggttgtagggccttcgtggcgagtctccggaatgtccggtggcccccgaagtttcgccccaaccttacggagaagtatgatggtagcatcaatccctccgagttcctccagatctacaccacggttatcatggcggcagggggtgacgaccgggtcatggcgaattactttcccatggccctcaagggtcagtgtcaggtccgcaacactattccgtgcattccagcccacgcggttgtatatgcattctggaacagcgtgcgacataatcgtatgctggagaagatcgcctccaaggagcccgagaccactgccgagcttttcgggctggcagacaaggtggcccggaaggaggaggcgtgggcctggaactctcccagcaccggtgcggcggccgcggctacccccgagtctgccccccgctctaagcggcgagataggagaggcaaaaggaaaccagcccgctccgatgacgagggccatgtccttgcagcagacgggctcacgcaggccccgcgcaaaggaaaggccaccggcgataagccgagcctcaccgttccctatggcgagggccggttggcggacaagtggtgttcggtacacaacacctaccgccacagtctcgccgactgccgctcggtcaggaatttggccgagtggtttcgaaaggctgatgaggagaagcggcagggtcgacgggaggcaaagccccccgcgacctcgaccggcgaccggcttcaaggccatgagacgagagcttctggccactgttcccacgcatgaggtggtccggaaggcgcgctggtcagaggtgaagctcacattcgaccagagcgaccatccgacgatgctcgctcgggggggaaagttggccctggtggtctccccgaccatctacaacgtcaagatgaagcgtgtgctggtggatggcggggccagtctgagcatcatctccccggctgcctttgacgtgctcaaagccccggggatgaagctccagccgtcgctcctaatcattggcgttactccggggcacacatggccgcttggccacgtagagcttccggtgaccttcggtgactccaccaacttccgcaccgagcggattgacttcgatgtggcggatctcaatctgccctacaacgcggttctaggcagacccgcgttggtgaagttcatggccgccacccattacgcctacctccagatgaagatgccgggtcctgctggtcccatcaccatttttggtgatgtcaaggttgccctngcctgcgcggagcagcgtgcagacaacctggcggtggccacggagccacaggcccccgaggcctctggcgtcccgcgcttccaagaagcacctcacctcggctgacgaggtgcccgtcaaggaaatgccccttggcgacgatccgtccaagaccgccaagattggcggaaccttggacgccaaatag

SEQ ID NO: 564 - DNA, 1930 bp, Oryza sativa
  misc_feature (1177)..(1177): n = any nucleotide
  misc_feature (1690)..(1690): n = any nucleotide
atgcagggagcggcgtcgaatcttctggacgccggagctcaggcgttctaccctgccgtcggcgcgccgttcccgttccagcagcttccgcaccagctgtactgcccgcagccgccgccgccgccgtaccaggtcatgccggtgccgccgccgccgccgccggtgggcttgcctgtaccgccgctgccggcgacgatggcgccgcagccgggctactgcgtgccggcggccgcgacggtggtggacggtccggccagccgcgccgtcgtgctgagcctggtgccgccgcacgcgccggaggacgagatcgcccgcgcgatggctccgttcggtgcggtgcgcgccgtggacgcgtcggcggtggcgtccgagggcgtcgcgaccgtctacttcttcgatctccgctccgccgagcacgccgtcacgggggtccgcgagcagcacatccggcagcagtgccggctcggccagctctacgccgccgccgccgccgccgccgcctcgtccccgacctggcccccgccggcgtgggactggccccacgacgacaaccgcgggctcgtcctcggccaggccgtctgggcccacttcgccgccgcctccaccgtccccgacgacggcgccagccgcggctccctcgtcgtgctcaattccctccccgccatgtccgtgttcgaactccgcgaaatcttccaagcatacgaggtgacgtgaaggacgtgagggagtcggcgctgcggccgagcaacaagttcgtcgagttcttcgacacgcgcgacgccgaccgcgcgctccacgagctcaacggcaaggagctcttcggccgccgcctcgtcgtcgagtacacgcgcccttccctccccggcccacgcagcccttggccccgacgccgccgaggctgcaggcggcttggcggccggcgccggcgccgtcgcagtctgcgcagccgtcgtcgtctggctccggcaaggcgagggaaggcgtggtgcttctgcgcaggagctccgggaaaggtagctcgggtagccagtccaagggcggtggcaatgctggccacgagcggaagagcaagggcggcaagagcgccgcggcggcgtgttcgacggcggcttcagcatcgtcgtctaccgcaacggcgcccagcaagcaaagccagaaaggcggcggctggcggganctggagaggccagaagagcgggttggaggctcgcttcctgttcaaagaacccgaggcggacacgagaaccaccgtgatgatcaggaacatcccaaacaagtacagagccagaagctgctgctcaacatgctggacaaccactgcatcctctccaaccagcagatcgaggcgagctgcgaagacgaagcccagccattctcctcctacgatttcctctacctccccatagatttcaaaacaagtgcaacgtgggctatggcttcgtcaacctcacctcgccggaggctgccgtgcggctgtacaaggcgttccacaagcaaccgtgggaggtgttcaactcgcgcaagatttgccaagtgacatacgcacgcgtgcaagcagggcctggacgcgctcaaggagcacttcaagaactccaagttcccgtgcgacagcgacgagtacctgcccgtggtgttctcgccgccgcgggacggcaagctgctcacggagccggtgccgctggtcggccgntcgccggcaccgtcgtcggcgtccggggcgtcgtcgccgcccaagagctgcgccgcgagcgtcgacccactcgcgcaggagctcatgacagcgccgtcttcctccggcgacggcgcctcctccgcctcctcgtccaatgcccacgccgacgaggatgacgtccatggcgaaaccggtggtgaccgtggcgacgacgcggggctcgatctggagctacagcgcctaggctacactgactag

SEQ ID NO: 565 - DNA, 1926 bp, Oryza sativa
  misc_feature (261)..(261): n = any nucleotide
  misc_feature (291)..(291): n = any nucleotide
  misc_feature (486)..(486): n = any nucleotide
atgatcacggtggtggacctgtaccacgtcctgacggcggtggtgccgctgtacgtggcgatgacgctggcgtacgcctccgtccggtggtggcgcatcttctccccggaccagtgctccggcatcaaccgcttcgtcgcgctcttcgccgtcccgctcctctccttccacttcatctccaccaacaaccccttcgccatgaacctccgcttcctcgccgccgacacgctccagaagctcatcgtcctcgccctcctcgcnctctggtgccgcctctccgcgcgcgggtcnctcgactggctcatcaccctcttctccctctccaccctccccaacaccctcgtcatgggcatcccgctgctcaaggggatgtacgccgccgccggcgccgcagccggcgccgactccggcagcctcatggtgcagatcgtcgtgctccagtgcatcatctggtacacgctcatgctgttcctcttcgagtaccgnggcgcgcggcttcttgtcatggagcagttcccggacaccgccgcctccatcgtctccttccgggtggattccgacgtcgtctcgctcgccggcggcggtggtggagccgcggagctgcaggcggaggcggaggtcggggacgatggcaggatgcgggtcaccgtgcgcaagtcgacgagctcgcgctccgaggcggcgtgctcgcacgggacgcagtcacactcgcagtccatgcagccgcgcgtctccaacctctccggcgtcgagatttactcgctgcagtcgtcgcggaacccgacgccgcgtggctccagcttcaaccacgccgagttcttcaacatcgtcggcaacggcaagcagggcgacgaggagaagggcgccgccggtggcgggggccactcgccgcagccggtggtggggaagaggaaggacctgcacatgttcgtgtggagctcaagcgcctcgccggtgtcggagcgcgccgccgcagcagcagctggcgcggtgcacgtcttcggcggtggtggcgccgaccacggcgacgccaaaggagctcaggcctatgatgagtacagtttcgggaacaagaacgagaaggacgggccgacgctgtccaagctggggtccaactcgacggcgcagctccggccaaaggacgacggcgaggggatggcggcggcgatgccgccggcgagcgtgatgacgaggctcatcctgatcatggtttggaggaagctgatcaggaaccccaacacttactccagcctccttggtgtcatctggtccctcgtctcctacaggtgggggattgagatgccagccatcatcgcccggtcgatttcgatcctgtcagatgcagggcttggaatggccatgttcagcctaggattgttcatggcattgcagccacggatcattgcctgtgggaactcccttgcttcgtatgccatggccgtcaggttcctcgtgggtccggccgtcatggctgccgcctccatcgccgtcggacttcgcggggtgcttctgcacattgccattgttcaggtaagctgcaagttcaggcttctgcaccaaaatgcatccttaactgcaaaagaatctatcgtaactcaacaattgtcattgaattctcaggccgctcttcctcaaggaatcgtgccctttgtgtttgccaaggagtacaatgttcatcctaacattctgagcacagcgtatgatctctttaccatcttttctttttcagtattggaaaaatgtccccattttgagcgtgatattcgggatgctgattgctctccccatcacattggtctactacatactgctggggctctgaagagctctccaagtctcaactcaactgtgcaagaacttgatgttactgacagtttgattaggatttatggttctgttttagttgctcagattttgtttggatga

SEQ ID NO: 566 - DNA, 1926 bp, Oryza sativa
  misc_feature (1835)..(1835): n = any nucleotide
atgtggaagctcaagattgccgagggaggaccatggctaaagagtggaaacagtcatgttggaagagaaacatgggaatttgacccaaattttggaacaagtgaagagcgggaggcggttgaggctgcacggatagagttccagaagaataggttcagaacaagacacacctccgatgttttggctcgcatgcaggtataatgaaaacgatgggcactggccaggggatttcccaggcccactgtttaccactgcaaccatggaacatcacaaggagatctgtcgatatctgtacaatcgtcagaccagaacatcgatggaggatggggactacatgcagaaggtgaaagttccatgcttagcacagctctcaattatactgctctgagactacttggggagaatgttgatgatggaccagatatatccatgcataaagcaagaaaatggatacatgaccatggaggtgcaacaatgataccgatcttgggaaaagtgtggctctcgcttggagtttttgactggtcaggtgtaaatcctattcccccagaattatttcttcttccatctttcgttcctatccaaccagcccatgtcttatttgtatggaaaaaagtttgtcggtcctataacaagattggttatatcattaagggaagagctacatattcatccctataaaaagattgactggaaggaggcacgcaaattatgtgcaaaggaagatgcctataatccacatatgtggctacaagagtgcctatctgactgcctttatagttttggtgagccgtttcttacacgttggccaatttcctacatgagaaaaagagctctataccaaattgctgagttcttgaagtatgaagatgaaaattctcagtatatctgcattggtgctgcacagaagttatccatgttgtgctgttggattgaaaatcccaattcagatgcattcaagcgtcatttggctagagtagctgattttctatgggttggcgaagatggcatgaaagttcggtgggatgttgctttcgcagtccaagcgatattagcgtgtagcatcgcagaagaatttggaagtacccttaagaaagcacatggtttcataaaaacttcccagaatccttctggtgacttcagcagaaagtaccgtcacatatctaaaggaggatgggccttccaggttgcagatcaggggtggcaggtttcagattgcacagcagaagctcttaagacagagatatatgcagacatcattgtggagcattacgtagagtgtacctcatcagtcatccaagcattggcattgttccgggagaagtaccctgggcatcggaaagatgaaatagatcaatgcatcaggaaagcaacagaattcatcgagaagttacagaatgatgatggatcatgggatcatggggtatttgcttcacgtatggaacatggtttgcaatagagggtctgtcagccgtggggcagtgttatgatgacagcacctgcattcggaaagcctgtaagtttctgttatcaaagcaactaacaaatggtggatggggggagagtcatctttcatccagaaccaaggtcaatactgcatgggcaatgttggcactcatgaaagctggacaggtattacttctctcacaggtagagagagaccccgctcctctgcacaaagcagcaagacttatcatgagcatgcagctcagtgatggtgactttccacaagagggaagtttcttgaaaaatggccccttgtgttatatggcttatcgcaatatattcccaatatgggctcttggagagtatcagaaattagtatttcagaactntcagacctctagcatcaagcaaacaaatatagctccatctgctggcaatgctgctctgaagaattcagcaagtacaacagcgccaacttga

SEQ ID NO: 567 - DNA, 1920 bp, Oryza sativa
  misc_feature (22)..(22): n = any nucleotide
  misc_feature (107)..(107): n = any nucleotide
  misc_feature (125)..(125): n = any nucleotide
  misc_feature (153)..(153): n = any nucleotide
  misc_feature (156)..(156): n = any nucleotide
atggcggcgagcagcgccgatntcgccgacgacggcttcccgggccgggcctcttctcgcagggcgtttcctaaacctacgacgacgtcatcttcctcccgggctanatcgggttcccggccgangccgtggacctttccacccgcctttccngcngcatccccctttccatcccctgcgtggcctcccccatggacaccgtctccgaggccgccatggccgccgccatggcatccctcggcgccgccgccgtcgtccactgcaacaccgagccccacctccaggcctccatcgtccgcgccgccaagtcccgccgcctcccgttcgtctcctccgtccccttattctcccccgcctccaccccatccctctccgacttcgctggccacgactacggcctggtcacggagcgcggcgattcgctctccaagctcgtcggcgtcgctgttgcagccgagacctcctctcgtcaggctcccctccctgtctccgagtacatgcgccccgccccgcgctcggtgtccgcctcttttgatttcgagcaggcggccgcctttctagcggacgagggtttggattatgcccctcttgtatccgatgatagcgaggtaatcgacctcatcactgtcaatgatgtggagcgcatccggagctatccgaagctaggcaagccgtctcttggagcggacgggaagtttgttgttgcggcttccattgggacccgtgaggatgacaagcgaaggctggagcagctagttaaggcaggggcaaatgcgattgttgtagatagctcgcaggggaactctatctaccagattgatatgatcaagtatgcaaagaagatgtacccggaagtggacttgattggaggtaatgtggtgacgattgcgcaggcacagaatttagttgcttctggggtggatggattgcgtgttgggatgggctctggctcaatttgcactacccaggaggtttgtgccgtgggccgaggacaggacaggctacagcagtgtataaggttgcatcttatgccaaagatcacaatgtgccagtcattgcggatggtggaatttcaaactctggacatattgtgaaggctttgtctctgggggcatccactgttatgatgggtagcttcttggctggcagccatgaagctcctggtacttacgagtacaagaggatggccaccgtgttaaaaaataccgaggcatgggctctctcgaagcaatgacaaaggggagtgacgccaggtacctaggcgataccctcaagcttaaagtcgcccagggagttgttggagcagttgctgataaaggttctgtgctgaggttcattccttatacaatgcaagctgttaagcaagggttccaagatcttggtgcgtcatctttgcagtcagctcatgagctgctgcgatcggagactatcaaattagagaggtgaggactggcgccgcgcaagttgaaggggggatacatgggctagtgtcgtacgagaagaaggcattctagttccagatttaatcaagcatcaggacaaagcggctattgcatcctaaggaaacaactgttccctatctttacctgatcaatgattttcaagaacagctcgtctgcttgatgaacctggcatgctgtttcatcggtcggtagcatcaccatccgtttaccatcgcaacgacatgatcgattgtgctttaacttcagttttgctagaggggaagctatcccatgatttgcctcaaccggttgatgctgatgtactttgcctttttgtgcaaacttccaaccgcaaactcatcctgttgtagcgaattcggcttatgtttttttttcatgaataagaataaataagtttggtttgtactttcggccaattcggccccagatgttatcgttgcttgcttttgtttcctga

SEQ ID NO: 568 - DNA, 1912 bp, Oryza sativa
atggccgcctcctccgcgcagctcatcttcctcctcctcctcgccgttcttgccgccgcctcatcgcgcaacgacgaggaggcccgcgcgctgatggcgctcaaggagagcctggacccggcggggcgggtgctgggctcgtgggcccgctccggcgagccctgcgggggctcgttcgtcggcgtgacgtgcgacagcggcggccgcgtgacggccatctcgctgcagggccgcgggctctccgggaccctccctccggcgatcgccgggctccggcggctcaccgggctgtacctccactacaacggcatcaagggggctatacccagggagattgggagcctctcggagctcaccgacctttacctcgacgtcaaccacctgaccgggccactgcccgtggagattgccgccatggagaatctccaaggttttgcagctgggttacaatcagttgacaggcagcataccaccccagttaggcaagctcaacaagcttgctgttcttgcacttcagtccaaccagctgactggggccattccagcaacactcggcgacctaacacagcttgcacggcttgatttgagcttcaacagtctttttggttccatcccttcaaagattgctgaggttccattgctcgaggtctttgatgttcgcaataattccctttctgggagtgtcccagcagttgagaagactgaatggtgggttccagtatgtgaacaacaaagcctcaatcagcgaatacggacaatcactgtgagggatctggttgctcgaaatcttcgaatgcatctgtgggagtgcttgttgttggtgtggttgcagtggtgattggcgccgcattctgcggaatatttgcattctcatattaccgccggcaaaagcagaagattggcagctcactggaggtttctgatagcaggctcagcactgaccattaccaacagaaggaagtttgccgaagaagtgcttccccacttatcagtgttgagtactcgaatggatgggaccctttgtctggtggaggcgttgggtcatccggcgaggttggtgatagctttaggttcaaccttgaggaggttgaatgtgcaactcagtacttttctgaggttaatttgctgggtaaaagtggctttgctgcgacatacaagggaattctacgagatggatctgttgtcgctgttaagagtctcaacaagacaagctgcaagcaagaagagtcagatttcttgcgtggcctcaagatgctcaccgtgctgcgacatgagaaccttgttggcttgaggggtttctgctgctccagggggaggggagagtgcttccttgtctatgattacatggttaatggttgcttgtcacagtatctggatgttaaggagggttctggtgctaatgtccttgattggccaacaagagtttccataatcagaggcattgcaaaagtacatgcacagtaagaaagctaacaagccatcagtagtgcaccagaacatatcggccgagaagatccttctcgaccaccacttaacgccacgcttgtcggtcccagggctgcacaagctccttgctgatgatgttgtcttctcgaccctgaaggccagcgcagcaatgggataccttgcccctgagtacgccactacgggccgattcactgagaagagtgatgttttcgcatttggtatcgtcgttctccaagtcatcacaggcaggagggctgtctcacagctgaaggtcagcacagttgccaatgaccttgatagcctgatcgatgagaacctcaatggtgtcttctcaagaactgaggcagctaagcttgctgccattgctgcactttgcacaagcgagacggcgagccagcgtccaacaatggaagctgtggttcagcaactcagcaactgccactga

SEQ ID NO: 569 - DNA, 1875 bp, Oryza sativa
  misc_feature (14)..(14): n = any nucleotide
atggagaaaatgcnaaagacgcaatcaaggaaatccagctcatggtggtgggatagccatattagtccaaaaagttctaagtggctctccgataacttagaagtgatggagacacagataaaagaaacgctggagcttattgaggaaggagaaccctctgcagaaaaggctggggttcttattactcacgtacagaactttcagcagatgtatcgtgttcttgccaagcgatatggcaatgtgactggagaattgcgcaaaaatatcccatcatctctgcaatcatctgtctcctttggcatctcagaatcagattctgaggcacagtctccttcatcaccagagcgtgacttgcaagagaagatgtcacaaaagcaaaaaccgcgatcagattgctttgatgtttctattggctctggtatgagttctgacgtatccaagaaggggagtgatgggtcttcatcatcttcagaatctgatttagagcttgatgaggctaaagaagaaaatggcaatagcattttttatgccctaagtcaaaaaattattgagcttgaggatgagcttcatgaagtaaggggtaaacttgatgcttccgaggaaaagaacatgcgttgccattgtaattttggtgctaactcagaactgtctgaacatgaggaaaagcaacaggtttcagatgtggaaaccagtagccttcagaaggatcttgatgaagtcaaaagtgaaaaggaagcattggaagctgttgtattggtgaacaaagatgaaattgataggctgaaggaatcaatggtatcggcagccaagcagtttgaagttgaacttgcgcatcgtgatactgaaattgataagtgcaaacaggagcttgaggtactttcggagaagtatctgcatgatatatctgctcttgaggctgaaattggaaagctccagggagtcatcaaaacctttgaagacgactttgcaaaaatatcacaggagaaattgatgctcgaatctcgggttgaagagcttgagcagtcagttaacagctcaaattattcggtttctgagatggttaatctgcaagaactaatgaaggatacacaagcagaattagaaaaggtttcacaggagaaagaagtgctcagagaacgtgttcttgaatttgagcaacttttgggggactttgagaattcaggcatggaggttgcaaagctaccagaaaccatcaagaacttgggagcccagatagagggaacactacaggagaaatcagtactccaggacaggattaaggagctggagcaggctgtccatgattcattgcagaaccattcactggagaagtcctctctgagtgctgagctttcaaaattatctgaagccaatgcttctcttgaagccaagttggcatccgtggaggcagagctcaaacaagtttacgacgaaaaggctaatgaatccctcaacagcgagaaggaaatctccaggctgaatcaagaactggccaatgtcaaaaccgatctggaattgctgttatccgagaaatccctggtggacaacaaagtaaccactctactaaccgacatcacaactcgcgatgaaaagatgaagcagatggatgatcaactgaatcagcttcagcttgagcattccaagctaatggcacaggccgatcttgcccgcaagtccctgtcagaactgcatgctcgggtatgcgagctcgagaaagaggtagagatgcagaagcttgtgatctctgagagcgccgaggggaagcgcgaggcgatcaggcaactgtgcttctcactcgagcactaccgcagcggctaccaggagctgcggcagctgctgcatgaccagaagagaccactggtgatggcaacatga

SEQ ID NO: 570 - DNA, 1865 bp, Oryza sativa
  misc_feature (1133)..(1133): n = any nucleotide
  misc_feature (1196)..(1196): n = any nucleotide
  misc_feature (1463)..(1463): n = any nucleotide
aggcttacctatgaactagactacaaagggaacatttgtggcagtaggcatggtgacccggatttgcatgagcttgatgttagatattggatgaacccaaaccaggtgtaccaaagtggggtcaaggacaacaagattaaccttgctgatgccaaagccatctgcctgatggagtgccccattccagcagcagacggattaaactttgtttgtgattatccagaaggggacattcgcctctctatcgatgattggatcaacagggactatgattattttgagtttctcgcaccagatatgagaaatagttctcttcagctgcagggtccatgctaccctgtcatatttccaagtgtgaatggtctactggagctgccaatttattgcgcgagcatccaatgtctctttgaagcattggcagcagatgggtggtatcaacatcgacgaaaatattctcatagataaaacaatacacaaggccatcaattctaaatcttcagtcttgaagctgcagagatacgttgctgacattgggaagtcatggcctgtgttaattgtttgcggtggactgctccctcttttcttgtcagttatctggttgcttctgattcgttattttgttgctgccatgccatggataactgtagtgctcttcaatgctctagtaatctccgttactatgtttttttatattaaaggctggctggttaggcaatgatcccttgacagttgtaattggtgaaagtgatccatatgtgcatataactggacgggcatttctgtcctccatagctattatccggcgtatactgatagcaacacctgtcctgaagcttcaggttgctgcgaaggtcattggtgaagttcaggcactaattattttcccagttgtgccatactttatcttcgctatcttttatatgttctggttttctgccacactccatctcttcagctctggtcaagttctccgaaatgactgcaatacagattgttgctcatatgatctgaagttgggcaaagtaaactgtgacaactgctgtgggtacagcatccattacacccctcatattggtattgccattcttttccacttatttggctgttactgggcaacccaattctttattgcntgctcttcaaccgtgattgctggatcagttgcttcatactattgggcacgtggtgaaatatcnataccatttgttacagttgtttcttcaatgaagcggttgttgcgttacagccttggttcagttgctataggttcacttgttgtatctgctgttgagtgggtgcggtttatactagaatgcctcagacgcaagttgaagctagttgattccgctcgcgaaagctgctttgggaaaatgacatcatcctcttctcaatgctgcctgggctgcatagactggaccctcaagtctgtgaatcgaaatgcctatataatgatagccattacngggaaagggttcttcaaagcttctgttctcgcaactggtttgatcatgaataacatactgcgcattggaaaagttaacgtcattggagacgtcatcctctttctggggaagctctgtgtgagcttgttctgtgcgctctttgccttccttatgttagacactcacaagtacaagtctgcacataacaagatatcatctcctcttgttcctgtagtgtgggcacttggttttatagtcgccaagcttttcttccaagtcgtcgagatgtcgatcgacaccataatcctctccttctgtcaagattcagaagagcaccaagggaacgcgcagtacgctccccctctcctagtggagacactggatgaacagagtgaactccatagactaactcaagggccttga

SEQ ID NO: 571 - DNA, 1854 bp, Oryza sativa
atgaacgtgttcgcgggggtgggcgggggcgcggcggggaaggaggcggggacggtgggcggcggggcgctgctggagctgacgccgcacaagctggcgctgtgccacctcgtgcaggtgttcgcgccgccgccgcaggccggggtctcggcccccgcgctgcccttccccttcgagtccgtcgcccaccacaaccgcctcggcctcttcctcttcgccctcacccgcgaacctccactggaagagcttctaaggcagctgaaggcagttgatgctttggttaatggctggctctgtgagcagcttacaagtaccctttcagcgcttacttcaccggatgatctgttcaacttctttgataagctacgagctggatccaaatagtcagcttggagtttttcttcgttgctgtatactttccttcaatacctgtcaggtccaatttttgcagtatttgaatgctcttacccatgatgactacgttgctgcattagataatcttcaccgctattttgattacagtatgagagtgctttgctctgcttaggtaacttgcactgttattttggacatccgaagaaagccttagaggtaatgtaagacagaagcagtgcgtgtttcccaaatggattcatgcctggcctatatattaggagctatttccaatctgttatcaaagataggcatgtcaagcacagttggaacaattggttctccttattcacttggaaataacatcggattaggcacaccgctgtccattcagcaacagctgcttgttcttttaaagagatcacttaagcgagctgataccttgaaacttacaagcttgctgtcctttgatcacctttctcttgcaaaatttgatctgaagatacctgcatcagtattgcaattagctggctcagcttatttgctgagggccactgcttgggaacactacgggagagtgctccgatggttcgaatgaattcgttggtctatgcaacctgctttgctgatgctgcaagtcttgcagttcatcagagctgtcgctagcatatgtcaagctaattcagcatttagcaactttcaaagggtattcaggcattctctgctctcaagcttgctgaagagaagttcccgttgtcagcaaattcacatatccagcttcttaaaatgcaattattgcacgagcgtgctctgcatcgtgtagaggacacctgaaagttgcgcaacagatctgtgatgagtttgctgtgttgtcatcttctgttagtggagtcgacattgagctcaagacagaagctaggttacggcatgctcgcacgcttcttgccgcaaaacaatttagtcaggcagcaaatgtggcaaattctcttttctctacttgctacaagtacaacatgcaggtggagaatgcaagtgttcttttattacttgcagagatacagaaatctgacaatgcagtccttgggcttccttacgcattagctagtcaatcattctgcaaatcatttaacttagatctgcttgaagcctcggctacactaactcttactgaattatggctggctcttggatcaacccatgcaaagagggccttgagtcttgtttgccaaagccttccaatgatccttggtcatggtggacttgagctgcgcgctcgagctcacatagttcttgcaaaatgctatctgtccgatccaaaattctcagtaccacgaaatggcggcagaagcatactacctaaaggcaatggtctacaacaatctaggaaaactggatgagagggaggaagctgcagcttctttcaaggagcacacactcgcccttgaaaacccatataacgaagaggattcacttgcttgctga

SEQ ID NO: 572 - DNA, 1831 bp, Oryza sativa
ccaaatggggacatctacgtggggagcttcgatgggttagtccctcatggaccgggaaagtatatgtggacagatggagctctttatgatggtgagtgggacaagagtaaaatgaccgggagaggactaattcagtggccttctggtgcatcctatgaaggtgacttccgtggaggtttcattgatggagcaggcactttcaagggagttgatggctcagtttacaaaggttcttggaggatgaacaagaagcatggtatggggacaatggtttactctaactccgacacttatgaaggtttctggaatgaaggtttacctgatgaatttggtaaatacacatgggctgatggcaacgtatacattggaagatggaaatcaggcaaaatgaatggcagcggggtaatgcagtggataaatggtgatactcttgactgtaattggctcaatggcctggctcatggcaaaggttactgcaaatatgcatctggggcttgctacattggtacatgggatagaggactaaaggatggccatggtttatgaacgggaatacgtacaaggagtgcttatcatggaatattatctaatgcttaacttgcaacttggcatcagaggtatactgtaggtaaaattacccctgtgcctttgcgtgaagttcgttcaaatgattttggacctcgagcacgaataaaaatgtacttcccttgtgagggatcccagtatacccctccgcactactctgtcgatttcttttggaaagactattgtccgatggtcttccgaggaatcttcgagaaatgtttcatatcgatgctgcagattacatgatgtctatatgtggtggtgatagtctaaaggagctttcttcacctgggaaaagtggcagcattttctatctttctcaagatgaacgttttgttataaaaacattgaggaaaactgagctgaagctgcagatactattgaagatgcttccaaagtattacaatcatgtcaaagcttatgataatacgctcattacaaaattctttggcgtgcacaggattactctgaaacctggaagaaaggtccgttttgttgtcatgggaaatatgttttgtactgaactgcgaattcatcgtaagtatgacttaaagggctctacacaaggccgatcaacaaagaagcaaaatataaatgagaacacaacactaaaggaccttgacctatcatatgtttttcacgtggataaaccatggagggaggcacttttcagttcaggcagatagctcttgattgtatgttcctggaatcccaatctataattgactatagcatgctattgggaatccatttccgagctcccaatcacctgaagcgtatcacatcataagggatttctactagttgctgctgatgagccaggtccagcagtacgtggttcgcacataagaggaagcatggttagggcagcagaaggtggttatgaagaagttgatcttgttttgccaggcactggaagaggttccgtgttcagctaggggtgaatatgccagctcgagctcggaaagtgcaagaggacgtgaacgtagaagtagaaaacagggacaccattgaagagtatgatgttgtcctataccttggtatcatcgacatactacaagagtataatgtgtccaaaagagttgagcatgctgtcaaatcactaaaattcgaccctctttcgatatcagctgttgatccaaatttgtattcgagacgatttataagtttcttggagaaggttttccccgagcaagattgaacagtaaatagatattgcaagtttcttggagaaggctttccctga

SEQ ID NO: 573 - DNA, 1822 bp, Oryza sativa
atggcgccggctccggctccggcgggctcggccgaccagttccgcgggcaggcgaggctgccgcggttcgcggcgccgcggcggtacgagctccgcctccggcccgacctcgacgcatgcgtcttcaccggcgacgcgtccgtggtcgtcgacgtctccgcgcccacccgcttcctcgtcctcaacgccgccgacctcgccgtcgaccgcgcctccatccgcttccaggtgtcgctgttcgaggacgacgagatcctggtgctggagttcgacggggagctgccgctcggcgagggcgtgctcgccatggacttcaacggcacgctcaacgatcagatgaggggattttaccgaagtatgagtataaaggggagacaaaaaacatggcggtgacacagtttgaggctgtggatgctcgacggtgcttcccctgctgggatgagcctgcattcaaggcaaagttcaagttaacacttgaagttccatctgagctagtagcattgtccaacatgccagtagcttgtgagacaattgctggtcctatcaagaccatccactacgaagaatcgccgcttatgtcaacttatttggtggccatagttgttggtttgtttgattatgtagaaggtgtaacatcggaagtactttgatactccatatccactccctaagttggacatggttgctattcctgatttcgctgctggggccatggagaactatggattggtcacttaccgggaagtttctttgctttttgatgagcagtcttcatcagcatctttcaaacagaatgattcttttttccctcaatggaatatctggacacagtttcttgatagtacaacctctgctctcaaattggattcacaagctgagtcccatcctattgaggttgaaatacaccatgccagtgaggtagatgagattttcgatgccattagctatgacaagggtgcttctgttattcgtatgctacaaagttacctaggtgcagagcgttttcaggtttcatttcagaaagcattaacttcatatataaaaaagtatgcctactcaaatgctaaaaccgaggacttgtgggctgttcttgaagaggtatctggtgaacctgtcaaggatttgatgactacgtggacgaagcaacaaggttatcctgttatcagcgtgaagcttaaagggcacgacttggaacttgaacagggtgctggcatctggattgtccctataactttaggatgctgttcatggattaagttgaacattgatgaaacaggattttatagggttaaatatgatgatgagcttacagctgcacttcgaaatgcattgcaggccaagaagctctctctaatggacgaaattgggcattgtggacgatgcacatgccctttctattgcctgcaagcaaacattgtcatcgttgctccacttgctgtatgcgttccgtgacgaggctgattacagtgttctttcacacataaattctaaattaggttgggaccctaaagatggtgaaagccacctgaatgcaatgctcagaccaatgcttttggttgcccttgttcagcttgggcatgataagactataaatgagggattcaggcgtttccaaatcttctttgatgatcgcaacacttcccttcttactccagatactagaaaggttcgcaatcaagatgcatatcgtgtgcttggaggtgtcataatagaggcacgtgaaactgcatggtcctggttgaaggttcttcgcgacccgcactaagcccgggtacgagaggacactgaagcagagcctcgagagggtgctgatcaacgccag

SEQ ID NO: 574 - DNA, 1770 bp, Oryza sativa
atggggaactgctgccgctcgccggccgccgcggcgcgggaggacgtcaagtcgtctcacttccccgcatcggccgggaagaagaagccccaccaggcgcggaacggcggcgtggggggaggcggcggcgggggcggcggcggcggaggaggaggaggagcggggcagaagcggctccccgtgctcggggaggaagggtgcgagctgatcggagggatcgacgacaagtacgcgctggaccgggagctcgggcggggggagttcggggtgacgtacctgtgcatggatcgggacaccaaggagctgctcgcctgcaagtccatctccaagcggaagctgaggacggcggtcgacgtggaggacgtgcgccgggaggtcgccatcatgcgccacctccccaagagcgccagcatcgtgtcgctgcgggaggcgtgcgaggacgagggcgccgtgcacctcgtcatggagctctgcgaaggcggggagctcttcgaccgcatcgtcgcgcggggccactacacggagcgcgccgccgccaatgtcacccgcaccatcgtggaggtcgtccagctctgccaccgccacggcgttatccaccgggacctcaagcccgagaacttcctcttcgccaacaagaaggagaactcgccgctcaaggccatcgatttcggcctctccatcttcttcaagcccggtgagaagttttctgaaattgtgggaagcccatattacatggctccagaggtattgaagagaaactatggtccggaaatagatatttggagtgcaggagttatcttgtatattttgttatgtggagttcctccattttgggctgagactgagcaaggggtggcacaagccattcttcgtggaaatatcgatttcaaacgcgaaccctggccaaatgtttcagaaaatgctaaagatttggttcgacgcatgttggagcctgatccaaaactcaggttaactgcaaagcaagttcttgaacatccatggcttcaaaatgctaagaaagctccaaatgttcctcttggagatattgtgaagtcaaggctcaaacaattttctagaatgaatagattcaaaagaagagcactaagggtcattgccgatcatttatctgctgaggaagttgaggacataaaggagatgttcaaggctatggacactgataacgatggcattgtatcttatgaagaattaaagagcgggatagcaaaatttggttctcatctggcagaatcggaagtgcagatgcttatcgaagcttgttgcttaggtgtaggagctgaacctgcacttgtagattgtaggactaggaaactagctgcaataggagtggttttacttttcaccatatgtgtatcaagaaacttatgtgtagtggatacaaatggtaaggatgctctagattatggtgaatttttggctgtctctcttcatttgcaaaggatggcaaatgatgagcacctccggcgagccttcctattttttgacaaggatggcaatggctacatagagcctgaagagcttcgagaggctctagtggacgatggagcaggtgacagcatggaagtggtgaacgacatattgcaagaagttgacactgataaggatggcaagattagctatgacgaatttgtagcaatgatgaagacgggcacagattggagaaaggcgtcccggcattactctagaggaagattcaacagccttagcatgaagcttataaaggatgggtccgtaaaactggtcaatgagtga

SEQ ID NO: 575 - DNA, 1769 bp, Oryza sativa
atggctgtgaaggcgagttctgcagataacaggaccagaagcaccgtgtcactatgcatagtgattggcatgtgctgcttcttctacatccttggggcatggcagaagagcggatttggaaagggggacagcattgcgctggagatcacgaagcgaacggactgcacaatcttgcctaaccttagcttcgacacgcacctcgctaagcaggcaaggcctcgcgatctcgtttcgccggcgaagaagtttaagccgtgcccggatcgctacacggattataccccttgccaagatcagaacagagcgatgaagttccctcgggagaatatgaattacagggagcggcattgcccaccgcagaaagagaagctgcactgcctgataccgccacctaagggatatgttgctccattcccatggccgaaaagtcgggactatgttcctttcgcgaattgtccctataagagcttgacagtcgagaaagcgatccagaattgggttcagttcgaaggcaacgtcttcagattccctggtggaggaacacaattccctcaaggagctgataagtacatcgatcaacttgcatcagttgttccaatcgccaatggaactgtcaggactgcattggacactggctgtggggtggctagttggggagcttacttattaaagagaaatgtcttggcgatgtcatttgcgccaagagattcacacgaggcacaagtgcagtttgctctggagaggggtgtcccagctgttatcggtgttcttgggacgataaaactcccttacccatcaagagcctttgacatggcccattgttccaggtgtttgattccatggggagcaaatgggaatatacatgatggaagttgatagggttctaagacctggtggatactgggtgctttcagggcctccgattaattggaaagtgaactacaagggttggcagcgtacaaagaaagatcttgaggcggagcagaataaaatagaggaaattgctgaccttctttgttgggaaaaagtcaaagagattggtgagatggcaatatggaggaaaagattaaacactgagtcttgtccctctaggcaagatgaatcaagtgtgcagatgtgtgactcaacaaatgcagatgatgtctgtacaagaagatgaagccttgtgtgacacctattcctgatgtaaatgatccaagtgaagttgctggaggtgcaatcaagcccttcccaagcaggctcaatgcagttcctccaaggattgctaatggcctgattccaggtgtttcatctcaggcctaccagaaagacatcaaaatgtggaagaagcatgtcaaggcttatagcagtgtgaacaagtacctcctcactggaagatacagaaacattatggacatgaatgcaggttttggaggatttgctgctgccattgagtccccaaaatcttgggtgatgaatgccgtgcctacgatttcaaagatgtcaactctaggggctatttacgagcgaggattgattggcatataccacgactgtgcaacatggaagacatcctactggagatggaccgcgtcctgaggccagaaggcgccgtcataatgagggacgatgtcgatatcctgacgaaggtgaacaggctcgccctcggcatgaaatggaacacgaggctggtcgatcacgaggacggccccatggtgcgtgagaaggtgctgtatgctgtgaagcagtactgggtaggcggaaaccagactgcagcagctgcagcatga

SEQ ID NO: 576 - DNA, 1749 bp, Oryza sativa
  misc_feature (150)..(150): n = any nucleotide
  misc_feature (643)..(643): n = any nucleotide
atggggtccatggagcagcagcagccggagtcggcggcgccggcgacggaggcgtcgccggagatcatcttccggtcgaagctgcaagacatcgccatcaccaacaccctcccgctccaccgctactgcttcgagcggctcccggaggtngcggcgcgcccatgcctcatcgacggagccaccggcggcgtgctcacctacgccgacgtcgaccgcctgtcccgccgcctcgccgccgcgctccgccgcgcgccgctggggctccggcggggcggcgtcgtgatgagcctgctgcggaactcgccggagttcgtgctgtccttcttcgccgcgtcgcgcgtcggcgccgcggtgaccacggcgaacccaatgtccaccccgcacgagatcgagagccagctcgccgccgccggcgccaccgtcgtcatcaccgagtccatggccgccgacaagctcccctcccactcccacggcgccctcaccgtcgtcctcatcgacgagcgccgcgacggctgcctccacttctgggacgacctcatgtcggaggacgaagcgtcgccgctcgccggcgacgaggacgacgagaaggtgttcgacccggacgacgtggtggcgctgccgtacttcgtcggggacgacgggntctccccaagggggtgatgctaacgcaccggagcctgagcacgagcgtggcgcagcaggtcgacggcgagaacccaaacatcgggctccacgccggcgacgtgatcctgtgcgcgctgcccatgttccacatctactcgctcaacaccatcatgatgtgcggcctccgcgtcggcgccgccatcgtcgtcatgcgccgcttcgacctcgccgccatgatggacctcgtcgagcgccaccgcgtcaccatcgcgccgctcgtgccgcccatcgtcgtggccgtggccaagagcgaggcggcggcggcgcgagacctctcgtcggtgcggatggtgctctccggcgcggcgcccatgggcaaggacatcgaggacgcgttcatggccaagctccccggcgccgtgctcggacagcaggggtatggaatgactgaggcagggccagtgctgtcaatgtgcctagcattcgccaaggagcccttcaaggtgaagtccggtgcgtgcgggacggtggtgcgcaacgccgagctgaagatcatcgaccccgacaccgggaagtcgcttggccggaacctgcccggcgagatctgcatcagggggcaacagatcatgaaaagaggttacctgaacaacccagaggccacgaagaacaccattgatgcagaagggtggctgcacaccggcgacatcggctacgtcgacgacgacgacgagatcttcatcgtggataggctcaaggagatcatcaaatacaggggcttccaggtagcccctgcagagctggaggcccttctcatcacccatccaagcattgctgatgctgctgttgttgggcctgaaatcggagaaataccagtcgccttcgtggcgaaaaccgaagggagtgagctgagtgaagatgatgtcaaacaattcgtagcaaaggagaggtgatctactacaagaagatccgggaggtcttcttcgttgacaaaatccccaaggcgccgtcagggaagatcctgagaaaggaactgaggaagcagctgcaacatcttcaacaagaagcttaatttacaaccggcctcagacatgaaaagaatttagcatgaacaagcaagttccatga

SEQ ID NO: 577 - DNA, 1749 bp, Oryza sativa
  misc_feature (1082)..(1083): n = any nucleotide
  misc_feature (1085)..(1085): n = any nucleotide
  misc_feature (1087)..(1088): n = any nucleotide
  misc_feature (1096)..(1096): n = any nucleotide
  misc_feature (1129)..(1129): n = any nucleotide
  misc_feature (1160)..(1160): n = any nucleotide
  misc_feature (1184)..(1184): n = any nucleotide
  misc_feature (1214)..(1214): n = any nucleotide
  misc_feature (1354)..(1355): n = any nucleotide
caagctttgagtgcccgtggttgtgcaaaccttgaagtaattctaaatgcagatgcaaagaatgtggaagagcatcatgagggggactgtcagaaattggattgctgtcatcaaccaaagccattggggccggtgcaagttctggtgataagcaggatgagttggaggaagggttttctgatctggaggttccaccagaagctcataaaaaggatttagatttgacatccgatgagagttctgatgaggacaccattgatgcaattggcttgtctgaagtggaggctgatgcaaaacctgaggagccgataaagaagtcacaatccactcttcttaaggctttgctggaatctccaagggttgatgtcgctggagcattgaaaaaatggcttaatgatggcaatacattggatagaagtgagctcttttatgtccttcttattcttcggaggcggaagctctacatcaaagccttgcagctgcagcttctggagtatgttgaagaatccaaactaattgatcttggagaacgtgattatgcttcacgcgtggatttggtagctaaaacccacagtatttacaaagctgaaaagtacattgagaatgttcctgcatctcataggggtgagattgtatacaggactcttttggctaactgtgtggctatagccaatgtgaaaaaagcagaacaagtcttcaataagatgaaggaccttggatttccagttagcgtattttcttgcaatcagcttctgctactctacaagagagtggacaagaagaagcttggtgatgttctcacaatgatggaaaaggagaatgtgaagccttccctcttcacttataagctccttgtagataccaagggtgctgctagagatattgaagatatggaaaaggtcattcaggcaatgcaagcggatggaattgaaccagatcttctgtttcaagccacaattgcaaggcactacatatttggtggttatcgtgagaaatctgaggcaattttggagcaaatggtgggggatgatatcaatgaaaaccgttctgcttgcaaatttgttttacccctgtatgctttnntngnnaaaaaagntgatgtggaaaggatctggaaggtttgtgaggncaatgctcgtctagatgagtgcatgtctgcnatagaggcttttggtaagcttggngatgttgaaaaggccgaggagatatttganaatatgttcaagacatggaagacactctcgttcgaatactacaatgctatgctgaaggtgtatgccaacaaaaagctttttgacaaggggaaagagctagcaaagcggatgggtgatgatggttgcagactagggccctnnacattggattcacttgtgaagctctattcggatgcaggagaggtggagaaagctgattccatattgcataagctatcatataagaacaagattaagcctatgtacaccacatacttgatgctgcttgatagttattccaagaaaggagacgtccataatgcagagaaattgttcagcaaggtgcggcagatgggttatactgggaggattagacagtatcagctgcttcttgaggcatatctgaatgcaaagaccccaccttatggattcaaggagaggatgaaggctgatgacattttccccaatagggctgtggcatctttgcttgctgctaccgatccgttcaacaggaagaacgcaatgtctgaattgctcgattaggttcttctgttag

SEQ ID NO: 578 - DNA, 1746 bp, Oryza sativa
atgccgctggggcaacgcgcgggggacaagagcgagtcccgctactgcggggtggaggtgctcgacttcgttgatcccgactaccggccgacgcccgggtccgtcctccccgtggcggcgtcggacctcgtcctcggcccggcccagtggagcagccacatcgtcgggaagatcagtgagtggattgatttggatgcggaggacgagcaactccggttggactccgagatcactctgaagcaggagattgcgtgggcgtctcatctctcgttgcagagagttgtgaatcatattttgcaaggcctgaccaatttgcagttgttctgtctctttcttaagttgtggcttaggatacctctggagaagtctgaacctatggatgaagaccatgatggagcaaaagataatagcgacatggactcttgggaatggtggaattcatttagactattatgtgagcatagcagtcaactgtgtgtggcgcttgatgttttagcacactgccatctatgaattcactagggcggtggtttggggagcctgtaagagctgcaattcttcaaacaaatgcttttctgacaaatgccagaggttatccttgcctgtcaaagcgccaccagaagctgcttactggattttttaaccattcggttcagtaccttgactacattgcttacatatatcagaggatggacccacttcctgaacaggaacgctttgagtatagggattttctgcaatctcctctccagttgcagcctctaatggacaatttggaagctcagacatacgagacttttgagaaagataccgtgaaatatacccagtatgaacagtatcaaagagcaattgctaaggcattggttgatagagtttccgatgatgatgtctcaacacaaaaacagtgctgatggttgttggagcaggccgggggccactagtgagagcgtcgttacagtcaatgcaggctgctgaggaaactggccgcaagctaaaagtatacgccgtcgagaaaaatcctaatgctgttatcacccttcacttgatcaaattggaaggatgggaaagcttggttactataatttcaagtgacatgcggtgctgggaagcccctgagaaagcagatattttggtcagtgagttgcttggttcctttggtgataatgaactttctcccgagtgtctagatggtgctcagagattcttgaagccagatgggatttctattccttcatcgtactacactagctttattgaacctataacagcatcaaaactacacaacgataaagcacataaagatattgcacattttgaaactgcatatgttgtcaaactacaccgaatagcaagacttgcaccaacacaatcggtttttacttttgatcatccaaatccctcaccaaatgctagtaaccaaaggtataccaagttgaaatttgagataccacaagagacgggatcatgcctcgtgcacgggatttgctggatattttgatgccgtattgtataaagatgttcatcttggaattgaaccaaacacggctacaccaaacatgtttagctggttcccgatcttcttcccattgagaaagcccatctacgtaccgtcgaagacgcctatagaagtgcacttttggcgatgctgcggtgcaacaaagggtgtggtacgagtgggctgtgacggcaccttctccatcaccaatccataacagcaatggtcgatcatattgggtcggcctataa

SEQ ID NO: 579 - DNA, 1742 bp, Oryza sativa
atgtatcgggtgaagagcgagagcgactgcgatatgatccatcaggagcagatggactcgccggtggccgacgacggcagcagcggggggtcgccgcaccgcggcggcgggcccccgctgaagaaggggccatggacgtcggcggaggacgccatcctggtggactacgtgaagaagcacggcgaggggaactggaacgcggtgcagaagaacaccgggctgttccggtgcggcaagagctgccgcctccggtgggcgaaccacctgaggcccaacctcaagaagggggccttcaccgccgaggaggagaggctcatcatccagctccactccaagatggggaacaagtgggctcggatggccgctcatctcagttgccagggcgcactgataatgaaataaagaattactggaatactcgaataaagagatgccagcgagctggcctacccatctatcctaccagcgtatgcaatcaatcctcaaatgaagatcagcagtgctccagtgattttgactgtggcgagaatttgtcaaacgatcttctgaatgcaaatggtctttacctaccagattttacctgtgacaatttcattgctaattcagaggctttaccttatgcaccacatctttcagccgtttctataagcaatctccttggccagagctttgcatcaaaaagctgtagcttcatggatcagtaaaccagacagggatgctaaaacagtctgatggtgtgcttcctggattgagcgataccatcaacggtgtgatttcctcggtggatcaattctcaaatgactctgagaagctcaagcaggctgtgggttttgactatctccatgaagccaactctaccagcaagattattgcacctttcgggggtgcacttaatggcagccatgcctttttaaatggcaatttctctgcttctaggcccacaagtggtcctttgaagatggagctcccttcactccaagatactgaatctgatccaaacagctggctcaagtacactgtagctcctgcgttgcagcctactgagttagttgatccctacctgcagtctccagcagcaaccccttcagtgaaatcagagtgcgcgtcgccaaggaatagtggccttttggaagagttgattcatgaagctcagaccctaagatccgggaagaaccaacagacatctgtgataagttctagttcttctgtcggtacgccatgtaatactacggttcttagcccagagtttgatatgtgtcaggaatactgggaagaacaacatcctggtccattcctcaatgactgtgctcctttcagtggcaattcattcactgaatccacccctcctgttagcgctgcatcgcctgacatctttcagctctccaaagtttccccagcagcacaaagcacttcaatgggatctggagagcaagtaatggggcctaaatatgaacctggggacacttcacctcatcctgaaaacttcaggccagatgcattgttttctgggaatacagctgatccatcagttttcaacaatgccatagcaatgcttctgggcaatgacttgagtatcgattgcagacctgttcttggcgacggtatcatgttcaattcttcctcgtggagcaacatgccacacgcctgtgaaatgtcagaattcaaatgaattctgtatttggtatttgccagacgctacagcagattcttggtatcgttcttgctcattgtttggatcataa

SEQ ID NO: 580 - DNA, 1723 bp, Oryza sativa
  misc_feature (95)..(95): n = any nucleotide
atgtccaccgacgacgcccggttctcctcggaggccggggacgaggacacccccgagaccgacggcggcggcggcggcggcgcgggcgccgacgncacgccggtgttcgtctggggcaccaacatcagcgtgcaggacgtcaacgccgccatcctccggttcctccgccacttccggacccgcgcgacgccggccgcgtcgacccggtcatggacgagggcaagatatcgagaagatggtgtccatcaagggtatgataattcggtgcagctcggtgattccagagctcaaggaggctgtgttccgctgcttggtttgcgggttctactctgagcctgtaatggttgatcgagaactctatgactcttgtgcataaccgatgcagaggtttgcagataagcagatcataaagttgcaggaaacaccagatgagataccagaaggtggcactccacatactgttagtgtcttgatgcacgataagcttgtagatgctggaaagcctggagacagggttgagactgggatatacagagccatgagtattagagttggcccaactcagaggacagtgaagtcgattttcaagacgtacattgattgccttcacataaagaaggagttgtcaaagttgccagatatatatgacagattaactaggtcattggctccaaacatatgggagctggacgacgttaaaaggggcctcctttgccagcagctttttggtggaaatgctttgaggcttccttctggagctagtttccgaggcgacatcaatattttgcttgttggtgatcctggaacaagtaaatcccagcttctccaatacatgcacaaactgtctcctcgtggcatttatacaagtggcagaggaagttcagctgttggccttactgcatacgttaccaaggatcctgaaactggtgaaactgttcttgagagtggagcgcttgttttgagtgacaaaggtgtttgttgtattgatgaatttgataagatgtctgataatgctcgaagcatgttacatgaggtgatggaacaacagactgtctccattgccaaggctggaataattgcatctttaaatgccagaacatcagttctagcatgtgcaaatcctactgaatcacgttataatccaaggctctctgtgattgacaatatccatcttcctccaacactgctttctagaggtttgacctcatttatctgatattggacaaggcagatgagcaaactgatagacgcctggctaagcatattgtttcgttgcattttgagaatccaaactacataagttatgcaaggaagcatatacaaccacagttatctgatgaagctgcagaagaattgactcgcggctatgttgagatgaggaaaagaggaaacagccctggtagcagaaagaagataactgcgacagctcgacaaattgagagcttgattcggctcagtgaagcactggcccgaatgcgattctctgaaatggttgaagtacaagatgttgtagaggccttcaggcttctcgaagttgccatgcagcaatcggcaactgatcatgccactgggtacaatcgatatggatcttatcatgactggaatatctgcgagcgaaaggcagaggcgggaccagttgctggaagaaattaggaagcagagctctatggaagttcatctgcatgatgtaagttggagatctagtctgcattgcttgcattga

SEQ ID NO: 581 - DNA, 1711 bp, Oryza sativa
atgctagcatgtgtacaggcggcaggagacgagagctacacgttcatgaaggacgcggtgcagtccccgcaggtgtcgtactacgactacatcatcgtgggcggcggcacggccgggtgcccgctcgcggcgacgctgtcgcagcgcttccgcgtgctcctgcttgagcgcggcggctcgccgtacgacgacgagcggatcgggaacatgacacgcttcgcggacacgctgtccgacacgtccccctcgtcgcccgcgcagcggttcgtgtccgaggacggcgtgatcaactcgcgcccgcgggtgctgggcggcggcagctgcatcaacgccgggttctacacgcgcgccagcgacgagtacgtgcgtggactcgggtgggacctcgaggcgaccacggcggcgtaccggtgggtggaggacgtggtggcgttccagccggagctgggtccctggcagtcggcgctggagagagggttgctggaggccgggatcgcgccgcagaacggcttcacgttcgaccacctcggcgggacgaaggtcggcggctcgatcttcgacgccgaggggcggcgccacacggccgccgacctgctccggtacgcccgcaccgacggcatcgacgtgctgctccgagccagagtggccaagatcctgttcaacgtcagagccagtggcgcacggggtggtgttccacgattccgaggggcagatgcacagggcttacctcagcaacggccgtggcaacgagatcatcctctcggcgggcgccatgggcagcccgcagttgctgatgctcagcggcgtcggccccgccgaccacctccgctcgttcggcatcacgctcgtcctcaaccagccggccgtcggccagggcatgtccgacaaccccatgaacgccatctacgtgccgtcgccttccccggtcgaggtgtcgctcatccaggtggtcggcatcactgaggtcgggagctacatcgagggcgccagcggcgcaaactggggcgtccggcgctccggctccggcggcgacagaccgcaccgcaacttcggcatgttctctccacagttccgcggcggcttcatcctggagaagatcctcggcccgctgtccacgggccacctcgagctgcgcaaccgcaaccccgacgacaacccgtcggtgacgttcaactacttcgcgcacccggaggacctccggcgctgcgtggccggcgtgtcggtgatcgagcgcgtcatcaggtccgaggccttcgccaacttcacgtacccgtacttctccgtcgagacgctgctcaatatgacggcggggttccccgtcaacctccggccacggcacgacaacgactccacgtcgctggagcaattctgcaaggacaccgtcatgaccatctggcactaccacggcggctgccaggtgaacagggtcgtcgacgccgagtaccgcgtgatcggcgtcgacgcgctgcgcgtcatcgacggctccacgttcaacgcctcgccgggaaccaatccgcaggccactgtcatgatgctcggcaggtatgcttcctcccttttgcttctttggcatctttacacgcacagtatcaatgtatcgtcagtatatttaattagtcgtcctaaccgtatttattctttctccaagattgcagagatctttaggtcgaatcctatctgtcctattaaaacgattgatcatgtctgttaa

SEQ ID NO: 582 - DNA, 1708 bp, Oryza sativa
atgtatgagcgccgcctcctcgccgccgcctccctcctcctctccgccgatgcgcagggccaaccaccccacgccgccgcccaactcggagtcggagtcacggccgagctcaagccgcaccaggtcgatggcgtcgcgtggctcatccgccgctaccaactcggcgtcaacgtcctgctcgcagatgggacttggcaagaccctccaagcaatctctttgttgagctacctcaagatccactccatctcacctggaccatttgtcttatgtcctctaagtgtcaccgatggctggctctcggaattcaataaattttgtccttctttgagggttatccagtatgttggtgttaccgtttgatgtcatgatgacaacctatgacatagccttaatggaccaagaatttctttcacaaattccttggcactatgttgtcattgatgaggcccaacgtcttaaaaacccatccagcgtatgtactgtataatgtccttgagcaacgctttatcatgccaagacgtctgctactaacgggcacccctatccagaataacctttctgaactatgggcattgatgcacttttgcatgccctcgatttttggtaccctggatcaatttctttctactttcaagcaatcagctgagagcatttatgctgagacgaactaaagctttactaattcaaagcggaattttggcattgccttcattaactgagttaacagtgatggtacctctgacacccttacagaagaaactatacttgtcagtattgagaaaagagctgcaaacactacttacatttactggaggattgtcccgccaccagtctctgcaaaacatcgtagttatacaactgcgaaaagcttctagtcatccatatctattcagtggcattgaacttgagccttatgtggaaggggagcatttggtttagcaggctagtggaaagcttgtcatgctagatctcattcttaagaagctccatgaagtaggccatcgagttctgctatttgctcagatgactcaaacactggacattcttcaggacttcttagaattgcgtcagtacacctatgaacgtctggatggttcagtgcgtgctgaggaacggtttgcagcaataaaaagtttcagctctcaacctaccaagggtgttgtcagagatgataatcagagtggagcttttgttttcatgatatcaactagagcagggggtgttggccttaatctcattggtgctgatactgttattttttatgagcaagattggaatcctcaagctgacaaacaggccttgcagcgtgcacaccgcattggacagttaaataatgtattatcaataaatttggtatcacaacgcacaattgaagaggtcatcatgcgaagagcagaaagaaaacttaagcttagccacagcgttattggacgctcgattatatttggcttacacctatttgatgaaaaagtagtgttgatgcgtagtcatgaaccttcagaaaaggatgaacgggcattcgaaatcaatccaaatatgacagacaacagtggggctgttgttacgaggagttgtgttgataattcaggaacctggggacatggaggaatgttcgatgctttggccaatctctcaacatgcattccagatgcttataatcgtgcttctgaatttgatgatctccacctggcagatcttcacttgatt

SEQ ID NO: 583 - DNA, 1696 bp, Oryza sativa
atggagaagatacaatctgattgcccttatcctggatgtttcttctgtgttatgaaagaggcaaaccctagtaaacgaagagcaagtgtactgaagttctttagggaacttccttctcaagatgatgatggtcaagttctccctattagtggtctttggaatactgcgatggcacatccaaatgaccctgaattcatcaacttggggatatttgaatgcatgtcagctcttatatggaagggactgaaaaacaggcgttggctttctcatgatcagaatatttacatcccatattatgcagcacatataattggatcctacacaatgaatatggaggagtttgcggaacgtgctgttcgtgctggtgtaatacctccattggttgaactcttacgaggcaggctaacttgggtagagcaaagggttgctgttagagctttggggcatttggctacatatcccagtacatttcctgcagttgctgaccatggagaagtacttgaacttgctattcaacttgcttcaagttctctagagattgtgtattctcatttttaccagtttgtggaccgaaggattggctaccactgtgaccttctcacacgaggcatgggtggtgtggaaatggaatctcgcaaagctgaggaatgggcaagccaacttcagtgctggtctttgcaactcattaactgcttcgcatttaagtctgaatttctccatgatatttgcaaggctgattttctagtcaagttacctggaatgtggggtggactcgtaaatgagaactcacctgctggtgttggtttgctaagaactatctgccagagcaagcttggccgaggccatgttgctaatattcctagtgttgttgaagctctctgcaacattgcccgttcttcagatgactggcaatacatggctgttgattgtttactttggttggtgcaggattcaaatacatgtcataagacactgatagatttagcaaatatctcaatgctcggtgattataaaaaacttggtgacaccattgtcacagtgctccaagaataaattggagaagaatatgccaaaggaggatcttcatataaaacaagcagcagcattggttgttaagttggaaggcaattcacttttctcttcagggaacatagcaggagctgcagcaaagtactctgaagcacttgcgctgtgtccaatgaagtctaagaaagaaagagtggtgctttatagtaatcgagctcagtgttatctactcctgcagcagccattggctgccataagtgatgctacccgtgcattgtgccttcatagtcctttgaatcgccacgcaaaaagcttgtggagaagggctcaagcatacgatatgcttggtttagcgaaagagagcctgttggatgcaattctctttataaatgaatgctctcagtcgaatgatcctgacctgtcattaaagcaaaataaagttcctgattatgctgagcgtttggtgaagaagcagatgcgcacagcttggttattcagggaagcagctttgaaacatgggggaatccattgcgagggagaagctagtgatgcttttggtcaagaggcagatgactctgagtgggaaacagccagtgaaagtgatgctgagaatgatgcaacaggagaggcagatgatgaaactgaatggaagaacgataaccaagtatga

SEQ ID NO: 584 - DNA, 1676 bp, Oryza sativa
  misc_feature (11)..(11): n = any nucleotide
atggccgccancgccgccgccgccgccgcggcgcctcccgccgacccgccggactcctccccggccgcttcctcccctccgaggcccagcccggaggagctggtcgcccgtgcagtggcccccgtcaagcccgccttcctccgcccgccccctgtcgcggagaagaagtccaagcgccagctcaagcgcgagcgcaagcaggtgagctcttgcaaatatggtgattcttgccgtttcagccatgacatagatgcctatttggctcagttctgtgcacagaaaccagctgaccttgagggcacgtgcccatttaccaatctggaccagttgtgtccatatggactaacttgtcgatttttgggtacacataaggacatccatgcagcttctggaaatctttcagagaaacatgagataaatgctttaaacaaagacattcaaaagctcttatggaagaacaaatataagttccccaaggccagtgcacagatcaagcttcttggtcttaagcatttacgtgaaaagaagataatagattttcgggagaagttgtaccttgctcccttgactactgtcgggaatctgccttttcggagactctgcaaaaccttgggagctgatattacttgtggagaaatggccatgtgcacaaatcttttacagggacaagcttcagagtgggctttgctgcgacggcattcatcagaggatttgtttggggtgcaaatttgtggagcctatccagatacagtagcacgaaccgttgaacttgtggataacgaatgttcagttgatttcatagacataaatatggggtgcccaattgatattgttgtcaacaaaggtgctggatcatcattgctaacaaaacctatgaggatcaaaagtattgtacaagcagcatccactgttactgaaaaacctttaactgttaaggtaagaactgctttctttgagggaaggaaccgtgctgattctatagtttccgacatctatgactggggtgcgtcagccataacagtacatggtcgatcccggcaacagcgctacagcaaacttgctgattgggattatatttaccagtgtgcccagaaagcccctgaccagttgcatgtcgttggaaatggtgatgtattctcttttactgactggaacaaacatgtttcaggctgctctaaaatatcgacaagcatgattgctcgaggtgcactcataaagccttggatatttactgaggttaaagaacaaaggcactgggatattacatctggcgagagattcaatattcttaaagattttgtgagttttggtctggaacactggggttccgattccaaagggtgttgaaacaacacgctattttttactagaatggctaagctacacctgccgctacataccggttggcctgttggatgtgatcccgcaacgtttgaactggaggcccccaagctactgtggccgtgatgatcttgaaaccctaatgatctctgattcagcagctgactggaggatctcagagatgttgcttggcaaagttccagaagggtttacgtttacacccaagcacaaatccaatgcttatgatcgagctgaaaacggctaacaccattcatctctcttcaaagcttgtgcccagccttggagctccatgctgcctgataatgtttacttga

SEQ ID NO: 585 - DNA, 1665 bp, Oryza sativa
gttgagaatagtggaccggaggctgtttctcaatttctactggcgtttcccaatgtccaagcaaagaacttagcagctataagagcatttggtactgaggaaaaggtgaaaggtccaagtatggtccttccgattgaagttgttcagccttctggagtgcccccagaacttacattcttttcggcatctttatccaaacctttggagaaggggaagactcttcacttagatgtcctgaccgtatttacgcactctgtccagccattccccgaagaaatcacacaagctgaatcgcagcttgttgtctatcaggacagtgctcagtatctgtcaccttaccctgttaaggtacagacacttagtatcagattgcctggtggaagagttgagtcctacacaaagtacccaaacacaaaacttgcagagtcagaactaaaatatggaccatatgaagatcttccaccgttttcctactcccctatggttgtgcactatgagaacaataacccttttgcagttgcaaaggaagttataagggagatagagatatctcactgggggaatgtacagattacagaacattacaacattgctcatggtggtgccaaactcaagggtgaattttccaggattaccaatctagaccgtacataagaggggtctcatcttttaggcatcttattgctagactgcctccaagggcacattctatatactacagagatgagattggtaacatttcaacatcacatttatggagtgattccaagaaggagccaaggtttcctttgtttggtggttggcaaacgacctttaccattggttatggtttacctcttcaagactttgttttcaattctgatggaaagagattcctcaatatcacatttggttctccagtggaggagattctcatagaaaagcttattgtgaagacaggttgttctgcctgaaggttcaaaggatattgatatttcagttccatttccaacaaagcaagagcaagagaagtattcacaccttgatatttctggaaggccagtggttgtcttggagaagcttgatgttattccagagcataatctatatttccagcaggtttactacaggttcaacaacatctctctactcagagaaccgatgatgttgataactggcttctttctcctcttcatggcctgtattgtttacatgcgcactgacatgtcaatctctaagaattctccttcttatctggcaaaggtgcagtgggatgagtgtctagcagctcatgataaactggagacctcattacacgagttatctaggtcaggagatgttaaatcatgcaaagtggctcgtaagacagctgatgcacagtttaaggaattagcaaaagagttgaagccattgttgacatccctgcagtcatcctctcagtcttaccagatatggccaaaggtagaggaattggttgccaaggagagagagttgcaggataagctcatgacaaggcattccactgtggttgacagctttgaaaagaagttgcgagggcaagatgtggagaacaggattgctgcccagcagcagaaagttgctgccctgaggcaagaggtcgaatctcttttagagtacatcagtgagatctgagcgaatccggcgctgcatggtatgtcaatttag

SEQ ID NO: 586 - DNA, 1649 bp, Oryza sativa
atgcagagggaagtggggccgcaggtggcccctccgatgttcctacaccagtggaaccccaggatgtgggactgggatagccgctgttaggccgagcaagagggttcggtctggatcgcctggatcaggcggtggtggcggaagctacccgatgtgccaggtggatgactgcagggcggatctgaccaacgccaaggattatcaccggagacacaaagtctgcgagatccacggcaagaccacgaaggcgctggttggcaaccagatgcagcgcttctgtcagcagtgcagtagagatttcacccgctctctgagtttgatgagggtaagaggagctgcagacgtaggctcgccggtcacaacaggcggcgaagaaaaacccagccaacagatgttgcttcgcagctgctgctacctggaaaccaggctgtgccatcaaccatggacttgctagcagttttatcaactgccctcgaccgtactggtagaatcatatttaaactatttggcaaggagccaagcacaatccctgggaaccttcgtggagagattgtaaattggctcaaacacagccccaacgaaatggagggatacattcggccaggttgccttgtactatcaatcagcttgaagaaaatcttctccagcgagtaaacacattagtccaaggttccgatttggacttctggagaaaaggaaggtttttagttcgaactgatgcccagttggtgtcatacaaagatggtatagcgcttatcaaaatcatggagaacatggaataccccagagttgacctttgtctcaccaattgctgttgttggtgggagaaagacctccctcattcttaagggccgtaatctgacaattcctggcacccacttggacgttacttcattgagggtcgagaataggttcagagggaacagctttcctgttatcattgccaattcaagtgtttgtcaggagttgagaagccttgaagctgagcttgagggttcacagtttgttgacggctcttcagatgatcaggctcatgatgctaggcggctaaagcccaaggatgaagttttgcactttctaaacgaacttggatggctcttccagaaggcagctgccagtacatctgctgaaaaatctgattcttctggtttggatttgatttctcaactgcacgcttcagataccttctgctgttttcaagtgagcgggactggtgctctcttactaaaactcttctggaaatccttgccaagaggagtttggccagtgatgaactatcacaggaaactctggaaatgctctcagagatccatctcctgaacagggcagtgaaaaggaaaagtagccacatggcgcgcttgcttgtacagtttgttgtcgtgtgccctgatgattccaaattgtaccccttccttccaaatgtagctggcccaggtggtttgactccattgcacctggctgcatccattgaggatgcagtggatattgttgatgctttgacagatgatcctcaacagattggtttgagctgttggcactcagcgctagatgatgatggtcagtcccctgaaacttatgccaagttgaggaacaacaatgcgtacaatgagcttgtagcacagaaattggtggacaggaagaacaaccaa

SEQ ID NO: 587 - DNA, 1622 bp, Oryza sativa
  misc_feature (248)..(248): n = any nucleotide
atgcggcgggggaggggaagaagagggcggaccaggcggtggcgttccacgagctgttcacgttcgccgacaagtgggacctggtgctcatggcggcggggagccttggcgcgctcgcccacggcgccgccatgccgctcttcttcctcctgttcggtgacctcatcaacggcttcggcaagaaccagaccgacctccgcaccatgaccgacgaggtctccaaggcgtgctggatgtacaccggggancggcaggtgatcgcgctgaggaaggcgtacctggacgccgtgctgcgccaggacgtggggttcttcgacacggacgcgcgcacgggggacatcgtgttcggggtctccaccgacacgctgctcgtgcaggacgccatcggcgagaagagtcttggccaggcattctcaaatcttggagccttcagcaaagggaagattgctggttacaaactgttggaggtcattcgccagaaaccctctatagttcatgatcataaggatgggaagttgctggcagaggtccatggaaacatagaattcaaagatgttacttttagttatccgtcaaggcctgatgtcatgatctttcgggatttctcccttttcttccctgctgcgaaaactgttgcggttgttggaggaagtgggtcgggcaagagtactgttgtggctttgatagaaaggttttatgatcctaatgaagggccaggttttgcttgacaatgttgatattaagacacttcagttgaggtggctgagagatcagattggtcttgtaaaccaagaacctgctctttttgcaacaactatacatgagaacatattgtatggaaagcctgatgctacaatggctgaagtcgaggctgcagcaactgcatccaatgctcatagttttatatctactcttccgaatggctacaacacgatggtaggggaacgaggaatacagctgtctggtggtcagaaacagcgtattgcaatagctcgtgctatgctgaagaaccctaagatactgctccttgatgaagctacaagtgctctagatgcaggctcagaaaacattgtccaagaagctctagaccggctgatgactggaagaacaacggtagttgttgcccaccgtctctccactataagaaatgttaacatgatcgcagtcatccagcagggccaagttgttgagactggcacacatgatgaacttctaaaagggagctctggagcgtatgcctccctgattcgttttcaagaaatggcacaaaacagagaccttggtggtgcatctacccgcaggcaacggaggaggaggtgatccaggcggcaaaaacagcaaatgtgcacggcttcgtcagtcagctacccaacggctacaagacggcggtcggcgagcgaggcgtgcagttgtccggtggccagaagcagcggatcgccattgccagggcggtgctcaaggacccggccatcctgctgctggacgaggcgacgagcgcgctggacgccgagtcggagtgcgtgctgcaggaggcgctggagcggctgatgaaggggcggaccaccgtgctggtggcgcaccgcctgtcgacgatccgaggcgtggaccgcatcgccgtcgtg

SEQ ID NO: 588 - DNA, 1612 bp, Oryza sativa
tatgactacatcattgttggaggtggcacagctggatgcccattggcagcaacgttgtcccagaagtacaaggtgctcttgctggaaagaggagggtctccttacggcaaccggaacatctcacatcttgagaacttccacatttgcttggcagatgactcgccaaattcaccatctcagggatttatctccactgatggtgtcatcaatgcccgggcaaaggttctaggtggtggaactagtgtcaatgctggtttctacagccgagctgacccaagtttgttcaagacgcaggctgggatgcagagttggtaaaccaatcatacccttggatcgaagagaggattgtttattggcccaatattacaccgtggcaagctgcactgcgggacgggctgcttgaagcaggggtctcaccttacaatggatacagctatgatcatctctttggaacaaagaggctggggtacaggcacactgctgctgacctccttgctgctggaaatcataacaacctcagggttctccttcatgctagtgtgaccagaataattttcaacacagaacaagccaaggaccattggtgttgaattcaaggatgagaatggggggcagcagcatgccttccttacccgaaacagagacagcgagattatcatctctgctggtgcaattggcagtccccagctattgttgcttagtggaattggacccagaaaggaacttaaaaagcataacatttctgtagtccttcgcaacgaacatgtgggtaaagggatgtcagataatccaatgaattccatctttatacctaccaaggatgcccctaagcaatcactgattcagactgttggaataaccgacggcggggcgttcatagaagccagcagtggtttcagccagtcaccagatagtatccagtgccaccatggaatcatgtccgctgagtcaacgattcccccaaagcaaagaaatctagatgcagtcaagaagtatgtacataaaaaatataacctacccaaagaagtattcagtgggggttttatactttcgaagattgatggtccattgtctactggtaatctagttcttgtggatactgacatcaatagcaaccccacggttaccttcaactacttccagcacccaaaggatctcagtcggtgtgtctatgggatcaagaccatagagagaatactgaagacaaaccatttcactaattttaccctcaatggtggtggatatccaatggaagtggtgctcaacatgagtgtaacagcaaacataaacttgatacccaagcacacaaatgacagcacatccatggagcagttttgcagagacacagtggtcaccatctggcattaccatggcggatgccatgtgggcaaggtggttgaccaacaataccgtgtgattggtgtctcaggccttcgtgtgatcgatgggtcgaccttatttaggtcaccaggaaccaacccgcaagccacagtcatgatgatgggcagtggtcagatacatgggagtgaagattctaagaagaagattaggacgagctgctggagtataactgattcttggaccttattgattatgtaagaatgtgacttag

SEQ ID NO: 589 - DNA, 1575 bp, Oryza sativa
  misc_feature (250)..(250): n = any nucleotide
atgtatcaaataaaaattaaaaaaaaaaaacgagatgaggtgttggttgcgacaaggtttggggaaaaagttagagattttgcaggccttgcggatgacggacgagtctccggcgacgacgatgccggcgagcggcgcctttccggcgatgtcggcgtgcggtgcggcaatgtgggcccaaatcaaaagttgggctggattggttgggcctcccatggatcatcacctcgctgacgcatccgcctcctgnctcgcctccactcccatcggacgcgccgccgccgccgccgccgtcgccaccgccgggttggtctcctcaccggcgcatccggggaagctacgggttagcaagcgctcatggacgggagccgccggaagcggcagcggcgaagaccacggccgccgtcgccgcaggccgagccctcgccaacggagctcaccgctctcggccaaagaggtctcatggacagcatgcttcaccaaatcattgctttgcttagctcattccaggacttgcttgcttttagtggcacttgccgctcttggcgagctgcattatcttccttcccatccatatatactttcaccttcccacctcttcacctgaaaccagatatacctaattcccatccccattgcagcagttttaggtacactcttttatataaatgcagatggcagcttggtgatccatcccaagagaactttatcccttcgctgttcagctccacaaaatactccaaatcgcatgcgctatttgggttgttcatagggtatctcatcttctcatattatgagaattgcctccttgttgatatgtacactggcgctaaggtgaagcctcccaaactacaatccgcaggcaacaaggaaacatactatggcatccttactgctccacttaatttgccaatatcgcatctcctactttgttcgagatcgtccatattctattggcaggttggaacgaattcttggtcagagcacccttttggcggtgagcgcattcttcagattgtgctcttcaaaggtgagttttttgcgatggactttcatcacaggctccataccatgcgctttgcacctcagctcagcatgcaggaagtaggggttgtgtggggagaagaaatgtttgtgggtgtacattttaagccgtggctggtgatcagcggtgacatgcttctcatgcttgacctctcagtaggcattcaccattcgtatggtttccctggcacctttcaagtctttcgtcttgacttttctgctcaaacagccaagtggatgaagatggaaaagttggaaaatagtgctctatttgtcagccttgataggaggaatcctacgttctcttgcacgaaccctgaaagatggggcggaaagagtaactgcatttatgttgcgaaaccatctgaagattctgatgaaccttggactgcagtcgagcttggtcagccaattcctggtgcaacacattgtgttccatacagtcatccactcctgcgaactgaaggccattgcagtcaactagagtacctctgggtgctccccagttttattaatggtgttgaccagtga

SEQ ID NO: 590 - DNA, 1569 bp, Oryza sativa
atgacagagttcaaggttgggagccttgatgcccgagcaacaaagatcagaaatgtccccattgctgtaacaccagaaggattctggtgctgcccgtcgcaggccgtgctccaaaagacaatgaagaaccaaaatcagcaggcaaagcctaaagggggtgcatctcctcttgcatcaaaggcctcttcggttcagagggcgcctaccatttcatcagagagaagagcgcattcaactccgacaaggtctagaatcaattcggatgaacagaagtgcgcgccagcggaaaattcaacacccaatccaccgaaggtagcgaatgatagaccacagaagcagcataagatatctgttggatttggtcaacttgagatgagtgatctcaaggttgtgttgtatggcaaggatggtgttgctgtaaagatgagtgttcacaggaacatccttgcagaaaatagtacctggtttgctgataagctctcaagacaatccccaatgtcaagcatggaggtgcctgattgtgaggatgtggagatctatgttgagacagttggattgatgtactgcaatgatgccaagcagaggcttatcaagcaaagtgttccacgcgttcttcggatcttgaaggttgcagaattattaggtttccaagcatgtgttttgtcttgcttagagtacttggaagccgtcccttgggtcggggaagaagaggagaatgtggtatcatctgttcagcatctgcaaagtgggaattatggtgttagcccaatactgaagagggtatgctctgacctaacaagcccaccaaatgacacatttgtgcatatcatagaattagtcttgaagagcggcgaggatagagggcgccgcgaaatgaaatccctggtgctgaagcttctgaaggagaatagcagctgtaccagtacatctgtggatatctatgctgagactctctacagctcttgccagaattgcctggaatccttgttgaccttgtttcgacaagcgactgccgacgattttgctgagcaatccttagaccttaaagagccagtttttcgacaaattgctctagaagcagataatctcctttggttaactgagattttggccgacaggaatgctgctggtgagtttgcagtcatgtggtctaaccagggtgagttggctgagcttcactccaagttaccaaccaagtcgcgccatcttgtcagctgcgtcacagcaaggctctttgtggcaattgggaaaggagacatgctcccttcaaaggacacaaggaagcttctcttggatgtctggctgcagcctctcatggatgactacaactggttacagcatggctgcaggtcatttgaccgcaaagttgtcgaggaagggatcgggcgtactatcttgacactcccgctcgaggatcagcagacgatattgctttcatggctcgggagcttcttgaaggttggggatagctgccccaatctgcagaaggcctttgaggtgtggtggaagaggactttcgtgcggccttatgttgaacaagggaatcaatctcagccgggtcggagttga

SEQ ID NO: 591 - DNA, 1560 bp, Oryza sativa
atgctttcccggattctgcatggctatggaggacacggcgggagaggcttcgagcagacgtaccggtgctactcggcggcggccttcaacaagccgcagctcgaaggcggagacaaggtgatcatgccggcgtcggcgctccaccgcctcgcctccctccacatcgactacccgatgctgttcgagctctcccaccacggcgacgccgccgcccaccgggtcacccactgcggcgtgctggagttcgtcgccgacgagggcacggtgatcatgccgcggtggatgatgcgcggcatgcgcctcgacgacggcggcctcgtcgtcgtcaggagcgccagcctccccaagggcagctacgccaagctgcagcctcacaccggcgacttcctcgacacggcgaaccccaaggccgtcctggagaagacgctgcgcagcttcacctgcctcaccaccggcgacaccatcatggtggcctacaacaacaaggagttcctcatcgacatcgtcgagacgaagcccgcctcggccgtctgcatcatcgagacggattgcgaggtcgatttcgcacctccactcgattacaaagaacctgaaaaggttcagcagaaaccatctgttccttcaagcaaggcggcttccgaagatcaagatcaaatcaaagatgagccagaattcagagcattcactggttcagggaatcgtttggatggtaaggcctcaaaaccgctagcagcagggatctcttctaatcctgctgctgcaagttctgcaatttcagactcgaacaagaaggtgaatcaggagacagcagcatcaggagttagcaactctacacgtcagaaaaaggggaagcttgtttttggttcaaacaaaagcagcagcagcagcaaagaaccagagaaggctcctcctgttaaagttgatgaacttgcaaagaaggaagagcccaagttccaagcattttctgggacgagctactcgttgaaacgcaatcgcgataaagtgtcacaccttttggagattaccaagtgccaaaggagaaggctgcaacttgaagaaatgcttgttcctgcgataaatggtactctgaatgtgctgaaatcttgcaagaagaatccatttctgaaaagggttgttcttacatcctcatcatccacggtaagaatcagggatgagagtaaacatccagaaatctcactggatgaaacaatatggagctctgtggcactctgtgaaaagctacagctatggtatgccctggcaaagatatctgcagagaaagcggcatgggagtttgccaaggagaacaacattgaccttgtaactgttcttccatcatttgtgattgggcccagtttatcacatggaactgtctgtcactgcttcagacatccttggcttacttcaagcttgaggaacccatatgagaaacagtcatatgagctaaacacatccaagatccagcagctgggtttcaagttcaaaggggtgcaagagatgtttggtgattgtgtcgagtcgctgaaagatcagggacacttgctggagtgcccgttgtaa

SEQ ID NO: 592 - DNA, 1555 bp, Oryza sativa
  misc_feature (1390)..(1390): n = any nucleotide
  misc_feature (1435)..(1435): n = any nucleotide
  misc_feature (1447)..(1447): n = any nucleotide
  misc_feature (1451)..(1451): n = any nucleotide
atgctggcggcgtcgttgagagtcgaggcggtggcggtggttgctgcggctgtgctggtgctgctgctctcgccggctgcggtggtggtggtggccgggcagcatgattacggcgacgcgctccataagagcatactgttctttgagggacagcgctccggcaggcttcctcccgaccagcgtctccgctggcgccgcgactccggcctccacgacggcgccgccgccagcgacttgaccggagggtactacgacgccggcgacaacgtgaagttcgggttcccgatggcgttcacggcgacgctgatgtcgtgggggctgatcgacttcgggcggagcttcgggccgcacaaggaggaggcgaggaaggcggtgcggtgggcgacggactacctgatgaaggcgacggcgaagcccaacaccgtgtacgtgcaggtcggcgacgccttccgcgaccactcgtgctgggagcgccccgaggacatggacacgccccgcaccgtctacaaggtcgacccctcccaccccggctccgacgtcgccgccgagaccgccgccgccctcgccgccggctccatcgtcttccgcgacgccgaccccgcctactccaagcgcctcctcgaccgcgccatcgccgtgttcgagttcgcggacaagtaccggggcccctacagcagcagcctccacgacgcggtgtgcccctgctactgcgacttctccgggtacaaggacgagctgctctggggcgcggcgtggctgcacaaggcgtcgcgccgccgcgagtaccgcgagtacatcaagaagaacgaggtggtgctcggcgccagcgagtccatcaacgagttcggctgggacaacaagcacgccggcatcaacgtcctcatctccaaggttctgatggggaaggacgagtacttccagtcgttccgtgtcaacgccgacaacttcatgtgcagcctcctcccgggcatctctaatcacccccagatccagtactccccaggggctgctgttcaaggttgggggcagcaacatgcagcacgtgacatcgctgtcgttcctgctgctcgcctactccaactacctgagccacgccggcgcgcgggtgtcgtgcggcgcgggcggctcggcgtcgccgacgcagctccgccgcgtggccaagcgccaggtggactacatcctcggcgacaacccgctgcggatgtcgtacatggtgggctacggcgccaggttcccgcggcggatccaccaccgcgggagctccctcccgtccgtcgccgggaaaccggggcggatcggtccaaaccccaacctgctggtgggcgccgtcgtgggcgggcccagcgacgccacggacgcgttccccgacgcgcgcgccgtgttccagcantcggagcccaccacgtacatcaacgcgccgctcatgggcctcttngcctacttctcngccnacccaaacccagccgagtgggccgacgactagaacaacccgccaaagtatatcagctatacgggcctgggctattgtttgttttgtcagggccgaatcgggtga

SEQ ID NO: 593 - DNA, 1485 bp, Oryza sativa
  misc_feature (1435)..(1435): n = any nucleotide
  misc_feature (1442)..(1442): n = any nucleotide
  misc_feature (1449)..(1449): n = any nucleotide
  misc_feature (1471)..(1471): n = any nucleotide
  misc_feature (1473)..(1473): n = any nucleotide
  misc_feature (1480)..(1480): n = any nucleotide
atgcagtcgccagagaatgcggcaccgcgcgtgtacttcatcccgttcccgacgccggggcacgcgctgccgatgtgcgacctcgcgcgcctcttcgcgtcccgcggcgccgacgcgacgctcgtcctcacgcgcgccaacgccgccaggctcggcggcgccgtcgcccgcgccgccgccgcgggatcacggatccgcgtccacgcgctcgccctgcccgccgaggccgcggggctcacgggcggccacgagagcgccgacgacctccccagccgcgagctcgcggggcccttcgccgtcgccgtcgacctcctcgcgccgctcttcgccgacctcctgcggcgcagacccgccgacgccgtggtgttcgacggcgtcctcccgtgggctgccaccgcggcggccgagctccgcgtcccgcggtacgcgttcacggggacggggtgcttcgcgctctcggtgcagcgagcactgctgctccaggccccgcaggacggcgtcgcgtcggacgacgagccgttcctcgtgccgggcctccccgacgcggtgcggctcaccaagtcgaggctcgccgaggcgaccctccccggcgcgcactcgcgggagttcttgaaccgaatgttcgacggcgagcgcgccacgacggggtgggtggtcaactccttcgccgacctagagcagaggtacatcgagcactacgagaaggagacggggaagcccgtgttcgccgtcgggccggtctgcctcgtcaacggcgacggcgacgacgtcatggagcgcgggcgcggcggggaacccgtgcgccgccacgacgccgcgcgcgcgctggcgtggctcgacgcgaagcccgcgcggtcggtggtgtacgtctgcttcggcagcctcacccggttcccggacgagcaggtcgcggagctcggcgcggggctcgcgggctccggcgtgaacttcgtgtgggtcgtcgggggcaagaacgcgtcggcggcgccgctgctcccggacgtcgtgcacgccgccgtgtcgtccggccgcggccacgtgatcgcggggtgggcgccgcaggtggcggtgctgaggcacgcggcggtgggcgcgttcgtgacgcactgcgggtggggcgcggtgacggaggcggcggcggccggggtgccggtgctggcgtggccggtgttcgcggagcagttctacaacgaggcgctggtggtcgggctcgccggcacgggcgccggcgtcggcgcggagagggggtacgtgtggggaggcgaggagtccggcggggtggtggtgtgcagggagaaggtggcggagagggtgcgcgccgccatggctgacgaggcgatgcggcggcgggcggaggaggtcggcgagcgcgcgcgccgcgccgtcgaggtgggcgggtcgtcgtacgacgccgtcggcgcgctgctggaggatntgcggcnccggganatggcggcggatccacggaacntnaaggaantatga

SEQ ID NO: 594 - DNA, 1479 bp, Oryza sativa
atgggttcttcttggtggtggcatggaagggcggcggcggcggtggcgtgttgggtgtggctggcggcggcggcggcggtgggggtggaggcgataggggcgaactgggggacgcaggcgagccacccgctggcgccggacacggtggtgcagatgctcaaggacaacgggttcgacaaggtgaagctgttcgacgccggggaggacaccatgagcgccctgaggaagagcgggctggaggtgatggtcggcatccccaacgacatgctcgccgccatggccagcagcatggcggccgccaacaagtgggtcgaccagaacgtctccaactacctcaacgacggcgtcaagatcaggaatatcaggtatgttgctgttggtaacgagcctttcctggagacatacaatggaagctttctgcaaactacttttcctgccatcagaaacatacaaagtgcgcttgtgaaggctggcttgggtagtcaagttagagtgacatgccctctcaatgctgatgtttatcaatcatcgactagcaagccttctgatggggacttccgcacagatattcatgatctgatgctcaccatcgtaaaattcctgagcgatactggtggagctttcactgtcaacatctaccctttcataagcctctattctgattcaaacttccctgtcgactacgccttctttgatggtgccgcatcacccattgttgatggctctgcgacatacacaaacatgtttgatgcaaactatgacacacttatatgggctttgaagaagaatggctttggaaatctcccagtcattgttggggagattggatggccaactgacggggacatgaatgcaaatattcagatggcgcagcacttcaaccaaggcttcctaacacatattgccacagggcgaggaacgccgatgaggcctggaccagttgatgcttacttgttcagtctaatcgatgaggatgagaagagcatacagccaggtaattttgagcgtcactgggggatattcacctatgatggcttgccaaagtatcaactgaatcttgggcaatcacatggccttctcaaagcgaagaacgtgaagtaccttgagaggaagtggtgcgtgctgaagccttctataggccttactgatccaaggctttcagatagcatcagctatgcctgctccctggcagattgcaccagccttggttacaagacatcttgtgggggactggacaccagaagcaacatctcgtacgcgttcaacagctactaccagaagaacgatcaagacgatgtcgcctgtgggttctcgaacctcgcaacgatcactggccaagaccccagcaccggaacatgcagattcggtatcatgatcgaggttgactcggccttctcgtggaagctgcagcatgttagaagcagcaacctcttgatgcttctgctagtgcttctccagctttgcctgtcattctcatag

SEQ ID NO: 595 - DNA, 1456 bp, Oryza sativa
  misc_feature (492)..(495): n = any nucleotide
atggcggcgggagggaaggggtgggtggagagggcgcggcgcggggtgaagacggcgtggttcatggtggccatggtggcgtcgctgctgatggcgtcggcgccggcgctggtggccgccggcgacgtggccgtcgcgctgtggctcgaggtgcggctcgggtgcctccgctgccacggcctgcgcggccacctcgagcgttacggcttccggagctcgctcgtggacataccgcttgtctccatcgctcgatccgtcgtcattacctgtatacctcatgtctgatgcttctgggctctcccatggcccgtaccttggaacagcaacttgctgttccctggcttctctgctcatcttgttgattaaggccagcgtttacagtccggcgcaggagattgggcctgagctctcgccgtcattggcggatcacaagctcagtctcaagaagctatcgggaatgccggtgcttttcctgtcctccttggtctttgnnnntggccatgttgttgtcgcttacaggacaagctgcagggctcggcggaagctgcttatccatggcattgaccctgaatctgtaggatcactgtgcattacaaactttgggaaatttgctgttgttttggtgcatgggtttggaggtggggtgttctcatggagacacgttacaaatttgctttctcgtcaagtgggttgcactgtgctggccttcgatcgccctggatgggggttaacatctcgacctcgcagaaaggattgggaagacaaaaatctaccaaatccatatgagcttggatctcagcaggttgatcttcttatttcattttgctcggacatgggcttacgctctgtggttttagttggtcatgatgatgggggcctgcttgccctaaaagctgcagaaaagttgcgagcatctggagattcaagaaaggtgaagggagttgtgcttataggtgtaagcttatcaagagaagtcattcctgcatttgctcgtatactcctgcatacccctctaaggaaaaagcacatggtacggccactgttacgtactgaaatcactcaggtgatcaatagacgtgcatggtttgatgctaccaagttaacaacagatgttctgaacctctacaaggctccactatttgttgaaggctgggatgaagctctccatgaagtaggacgtctttctttctcgactgtcctatcatcaaaaagagcagcagatttactaagatcagtggaagacctccctgttctggttgtagcaggctctgaggatgctcttgtttcttcgaagtcaacgcaagtaatggcttcaaggcttgtaaattctaggctggtaacgatatcaaattgtgggcatttgccacatgaggagtgtcccaaggcattgctttcggctctttctccattcatatcaggactggtgtcatcagatgattcattgcaaagattgtag

SEQ ID NO: 596 - DNA, 1439 bp, Oryza sativa
  misc_feature (278)..(278): n = any nucleotide
atggatcgcgacccctccgtctccgacgaggacgacgacctcgagaccctcgtcccgcagaacgaccccgcggcgtcccggatgcgcgacgccgagctccgcgcgctctacctcctccgctcgcagcgctcgggcctcctcgccctcttcaaccgtacggcagcacccaccaacggcagcagctcgggctcgaacgctgtctcgtacgccgatctccacgacgcgctcctcggccagatcaagatcaaccgcgagatccaggcggcgctcctctccgngcaccgcactggcgctgcgggcaatgcgacggaggatgggttggatcttgatctgccggctgacgggtgcaggaggagggaattgccgtccaaccggcggaccatagagtggaaccccaagaaagatcgattcctgttcgccatctgcgtctccgggcaaatgtccaaccacttgatttgcttggagaagcacatgttcttcgcggcgctgcttggccggatcttggtggtgcctagccagaagctggattatcagtacgaccgggtgcttgatatcaaccacattaatgattgcattggaaggaaggttgtaattacctatgaggaattcacagagaagaggaagaaagtgagcattgatcagttcatatgttacgcggcatcacccccttgtttcattgatgaggatcatgttaagaagttgaagggattggggatttcactgggaaagatccaggcagcttggccagaggatgcgaagctgaaggagccaaagaagagatttgtggaggatatcatgccaaagtttaccacggatgctgaggtgctcgcgatcggtgacatgttctatgctgatgttgaggaagagtgggtgatgcagcctggtggcccattggctcacaagtgcaatactttgatccagccaagtaggcttattatgctcactgcgcaacgctttgttcagaccttcttggggggcaactacattgctttgcattttcggcgacatggcttcctgaagttctgagctgcttcttccctatccctcaggcagcagaatgcattcttcgaatcgttgagaaagctaacgccccagtcatatatctgtctactgatgctgccgagagtgagacaagtctcctgcaatccttggttgtgttcaatgacaggcaagtccctcttgtgaaaaggccagagcaccacaactctgagaaatgggatgccttgttatacagaaatcacatgggtggagacaatcagcaggttgaggccatgctcgacaagacgatctgtgcgctgtcgaacgttttcataggtgcatcaggctcaaccttcacagaggacatcctgcgtctacggagaggctggggttctgcgtcccactgcgacgaatacctctgccagggtgagctacccaacttcatagcggagctagactga

SEQ ID NO: 597 - DNA, 1437 bp, Oryza sativa
gatttttattcagttttatcaggaggaagtgcaagcgagtctgatccagatactgcaagtcaagtggcagatgttgaaactgatgaagatgaagtgatgtactttgatacaagagacttcttgtctgcagagtctcttcgaagtgcttcatgtcgaaggagagaacttttgacaaatggttgcaatggattagaacatacagaccctgctgcaaatgtcgtcaaaactactcagtatccctctgttaaacgtcgagataagttacctgagccaaaagaaaaagaaaacccagtagggttgtggtcaataattaaagaaaatattggaaaagatctctcgggtgtttgtctgcctgtttatttcaatgagccactgtcttctttgcaaaaatgttttgaagatctcgagtactcttacttggttgaccatgcactacagtggggaaaacagcagggcgatagcttgatgaggacacttcatgttgcggcatttgcagtatcaggctatgcttcaactgaaggtcggcaatgcaaaccgttcaatcctttactgggtgaaacatatgaagctgattatccagataaaggacttcgatttttctctgaaaaggttgtcagtcatcacccaatggttgttgcatgtcactgtgaaggaagaggttggaagttttggggggattcaaatctgaaagggaagttctggggtcgatcaattcaacttgatcctattggtgttctaactctccagtttgatgatggggaaacgtttcaatggagtaaagtaactacttccatatacaatatcataataggcaaaatttattgtgaccactatggtacaatgcgcatcaaaggaagtggcgactactcttgcaagcttaaattcaaagagcagtcaataattgatcgaaacccacaccagcaggtgcatggatttgtgcaagataatagaacagggcagaaagttgctatgttaatcggaaaatgggatgaagctatgtattatgttcttggggatccaagtgcaaaacccaaggggtatgacccaatgtcagaagcagttcttttgtgggagagagacaagtctctgaaccaaacacgatacaacctttccccttttgcaatttcactaaatgaattgacagctaacctggcgaagaagttgcctcctactgattctcgtctgaggcctgatcaaaggcatcttgaaaatggtgaatatgagatggctaatgcagagaaacttaggcttgaacaactgcagcgacagcaggcccgaaggttacaagagaaaggatggcaacccaggtggtttagcaaggatgacgacgacagctaccgctacattggcggttactgggaagcaagggagaaggggaactgggatgggattccagacatcttcggtcagcgcagcgcttcacctgggtggtcatag

SEQ ID NO: 598 - DNA, 1426 bp, Oryza sativa
  misc_feature (125)..(125): n = any nucleotide
  misc_feature (168)..(168): n = any nucleotide
  misc_feature (1253)..(1253): n = any nucleotide
atggagagccccgcgaaggaggaggcgggaggggagctggcgatggagatcgagtccaccgtcacggcggaggactggcgccgggcgctggcactcgtggtgccctccgtcgtcgtcctccgcancaccgcgccgcgggccttcgacaccgaggtcgccggcgccagntacgccaccggcttcgtcgtcgacaagtccaggggcatcatcctcaccaaccgacacgtcgtcaagccaggggcctgtcgtcgcggaggcgatgttcgtgaacagggaggagatccccgtgtatcccctgtacagagatcctgtacatgattttggtttttttcgctatgatccaggtgctatcaagttccttaagtatgatgagatcccgctagcacctgaagcagcatctgttggtctggaaatccgggttgtcggcaatgacagcggcgaaaaggttacgtgtcaattttggcgggaacacttgctcgacttgatagagaagcaccttactacaagaagatgggtacaacgatttcaacacattctacatgcaggctgcatctggtaccaaaggtggctctagtggttcccctgttgttgattgtcaaggaagagctgtcgccctgaatgctggaagtaaatcttccagtgcttctgcgtttttccttccattagaacgtacctttcaacacaaaggatttgaagaaactcggcgtcttggactcaggaatgaaacagaacaggtacgccttgtttctccatcaggcgagactggaatgctggttgttgattccgtggttccagaaggacctgcacataaacatttggaacctggtgatgtgcttgttcgcatgaatgatgaggttgtaacacagtttctcgcaatggagaccttgcttgatgacagtgttggcaaggagatagatttgcagatcgaaagaggtggtacacctttaacagtaaagttggaggttgaggatttgcactctataactccaaatcatttcttggaagttagtggtgctgtgatccatccactttcgtaccagcaggcaaggaattttaggttcaaatgcggtctcgtatatgttgctgaggcaggtacatgctctctcgggcatctgttccacgccatgctattattaaaaagctcgcaggagaggatattgaaaatttaggggaccttattgcatgtatttcaaaactatctagaggagcaagagttcctcttgaatatgtaaagtacaccgaccgttataggnataagtctgtactggtgaccattgatcggcatgaatggtatgcgcctcctcagttatatactcgaaatgatgcaactggcttgtggactgcaaaatcagctataccgccggaatcttcaagtaatgcatcattggcagaacaagtaattgaaccagcccttgtaatgtttgag

SEQ ID NO: 599 - DNA, 1424 bp, Oryza sativa
atggccgcgcccccggcggaggcggcggtcggggtgaactggggcaccctgtcgtcccaccgcgtcccgccgccggtggtggtggacctgctccgcgccaaccggatcgggaaggtcaagctcttcgacgccgacccggccgtgctgcgcgcgctcgccggcagcggcctccaggtcatggtcggcgtcaccaacgccgagctcgccgccgtcgcgggatcccccgccgccgccgacgcctgggtcgcgcagaacgtctcgcgctacgtcggccgcggcggcgtcgacatccgagatacattgccgtgggaaatgagccgttcttgacgagctaccagggtcaattccagtcatatgttattccagcaatgacaaacattcagcaatcgctggtgaaggctaatcttgctagctatgtgaagcttgttgtcccatgcaatgctgatgcttatcagagtgcttctctcccatcacaaggagtttttaggactgaactgactcagataatgacccagctcgccgcttttctcagttctagtggagcgccatttgtggtcaatatatacccttttctcagtctttatcagagctctgactttccacaagattatgccttcttcgagggatctactcacccggttgtagatggtcctaacacatactacaatgcttttgatggcaactttgacacattagttgctgcgctgggtaaaattggatatggacagctaccgattgcaattggtgaagttggctggccaactgaaggagcaccgagtgcaaacttaactgcagcaagggcattcaaccaaggtcttatgaatcgtgttatgaacaacaaaggaactccgcttcgtcctggtgtacctccagctgatgtctatcttttcagcctttttgatgaagagcaaaagagcatactacctggaaactttgagagacactgggggatcttctcatttgatggacaagccaagtacccattgaatcttggtttagggaatccggtacttaagaatgctagagaggtgccatatcttccatcacggtggtgcatcgcaaaccctgcccagaatcttgataatgttgcaaatcacttaaagcttgcttgctctatggctgattgtaccacactcgactatggaggttcctgctatggcattggagagaaggccaacgtttcttatgctttcaacagctactatcagcaacagaagcaggatgctaagagttgcgatttcgatgggaatgggatgataacttaccttgatccatccatgggcgagtgtcgctttcttgttggaattgatgatagtaaaagctctgcagtttcctcctgtggctgcggttgtggggtttgttgtggggtgtgggttctatttttctgggtgttcatgtaccttagaatgatgggttctgtctga

SEQ ID NO: 600 - DNA, 1423 bp, Oryza sativa
gcagagatggagatgatgaaggagaggttcgcgaagctgctgctcggcgaggacatgtccggcggcggcaagggcgtctgcaccgcgctcgccatctccaacgccatcaccaacctctgcgtgcgttgctgcagcgacgatatttgggcagctgtggaggctggagccgctgctgccggagaaaaagacgatgtggcggcgcgagatggactggctgctctgcgtcagcgaccacatcgtcgagctagtccccacatggcagacattccccgacgggagtaagcttgagctgcccgcactccgaaagctagaccacatgctcctcgaaattctggagagcttcagggacccggaattctggtacgtcgaccaggggatttgcccgccggaccgcgacggcagcgcccccttcatgctaacgttccaccgccgcgacgagaagtggtggctgcccgtgccccgcgtccctcccggcggcgtcggcgagaccacgaggaggcagctcgagcacaagcgcgactgcgccagccagatcctcaaggccgccatggccatcaacagcaacgccctcgccgaaatggacgtccccgactcttacctcgactcgttacccaagggcgacatcatatacaggtacatcacgtcggaccagttctcgccggactgcctgctcgactgcctcgacctgtcgtcggagtaccaggcgctggagatcgccaaccgcgtcgaggcctccatctacgtgtggcgccggaggggcacgtcgggcgccgcgagccgcgccggaaacaagtcgtcatggggcatcgtcaaggacatgatcatggacacggagaagagagacgacctcctcgccgaccgcgccgagggcctcctcatgtgcctcaagcagaggttccccggactgacgcagaccagcctggacacgagcaagattcagtacaacaagaaatctcgctatccgtgttgatggtgatcgggtttggatgaactgatcgtgagatgactctctcttcaggatgtggggaaatcgattctggagagctactcgagggttctggagagcctggcgtcgaacatcatcgcgcggatcgacgacctgctgtacgtcgacgagcggagcaggcaggcggagctgcttccaaccgcgggcgccgggagcggcaagatctcttgcatgccggccatgtcggcgtcgtcggtgccggcgtacccggtggtgtccacctcgggcaccccgccgccgtacgcgacggcgtacgccacgccgagcttctcgccggcgcagctgtcgagcccatccaacatcgggagggcactgctggtcgaccggcggtcgcacgacggccgagcgttcgacggcagcatggagttcatggggatggcggtcagcaacgccgtgttcgacctaccgggcctgtga

SEQ ID NO: 601 - DNA, 1415 bp, Oryza sativa
tttgttggtggtatggcaatcagtgatttggtcaagacaacgttggggccaaaaggaatggacaagatcctacaatcaactggcaggggacgcagtgtgactgttacaaatgatggtgctacaattctgaagtctcttcatatcgacaacccagctgctaagatctcaaaagtgcaagatgacgaagtaggtgatggaactacttctgttgttgttttggctggtgagcttttgagggaagctgaaaagttggtaaatatgaagatacatccaatgacaatcattgcagtttagatcagatctgatgaacattgctatgacaacgttgagttcaaaaatactttcccaggacaaggaatactttgctggtcttgcagttgatgctgttctaagacttaagttgcagggcagtaccaacttggaagcaattcaaattcttaagaaaactggagggtctctaaaggactcctttttggatgaaggttcattctagacaagaaaatcggtcttggccaaccgaagaggattgaaaacgccaagattttggttgcaaatactgctatggacaccgacaaagttaagatatatggagcacgtgtacgggttgattcaatggctaaggttgctgaaattgaagctgctgaaaagcaaaaaatgagagaaaaagtgcaaaagatcataggtcatggaatcaactgtttcgttaacaggcagttgatctacaacttccctgaggaactctttgcagatgctggcatactggcaatcgagcatgctgattttgagggcattgagcggcttgctcttgtcactggtggtgacatcgcctccacttttgataacccggagtctgtcaaacttggtcattgcaaggtcattgaagagattatgattggggaggacaggctgattcatttctctggggttgaaatggggcaagcctgtactattgtcctcagaggagcaagcttgatgaagcagagaggtccctgcacgatgccttatgtgtgctttcacaaacagtgaacgacacccgtgtgttatatggtggtggatggcctgagatggttatggccaaagaagtagatggactggcgagaaagacacctgggaagaagtcccatgctatcgaagccttctcgcgcgctcttcagtccattccaaccatcatcgctgacaatgctggtctggatagcgctgatctgatctctcagctcagagcagagcatcacaaagagcagagcactgctggaattgatgtcatttctggcggcgacatggaaaagctggggatatcagagtcgtttaaggcgaagcaagctgttcttatgtctgctaccgaggcagcggagatgattctcagggtcgatgagatcgtcacttgtgctccacggagaagggaggacaggatgtga

SEQ ID NO: 602 - DNA, 1380 bp, Oryza sativa
  misc_feature (784)..(784): n = any nucleotide
atgtcggtgggtgcagatccggaggcggaggtgatcgcgctgtcgccgaggacgctgatggcgacgaacaggttcgtgtgcgagatatgcgggaaggggttccagcgagaccagaacctgcagctgcaccggcgagggcacaacctgccgtggaagctgcggcagcggagcgggaaggagccgaggaagcgggtgtacgtgtgcccggagaagagctgcgtccaccacaacccgtcgcgcgcgctcggcgacctcaccgggatcaagaagcacttctgccgcaagcacggcgagaagaagtggaagtgcgacaagtgctccaagcgctatgccgtccagtccgactggaaggcccactccaagacctgcggcacccgcgagtatcgctgcgactgcggcaccctcttctccaggagggacagcttcatcacgcaccgcgcgttctgcgacgcgctggcggaggagacggcgaggctgaacgcggcgtccggggccgccgcggcggcggcggcggccacggccacgtcgctgtgcgggcagagctacctgttcgccgggtcgggtgggccggggatggcgggcatgcggccaaacatgatgatgccgccggcggcggcggcggctggagggcagctcagggcgggtcaaatgctcggtccggcggcggggggcttcggtggggacctgtgcgacggcggcttggcgcggcacggcgggctgtcgctgtggggttgccaagcgttgccgtccatgggccacattggcgtcctggccagcggttgcncggcgacagtgccgccgcagctgtacgtggatctcttcgcgccgagctccggggcgccgccgccgcagttcgacgcggcgcagctgagctggctgtacgggaacggcaagctctcgtcgtcgaatgccagcgagctgacgagcgccacggcggcggcgaaggaggcggagagcgtgccgtccgtgttcagcaaccagcagcacgcgaagcccgcggcgcccaccgacatgtccgcgacggctctgctgcagaaggccgcgcagatcggcgccgtgacatccaccgccgcgatgcccctagtgtccccgttcgagccgaccaagcccggcggcgccaccgcctcaccggccgacgagtgcggcaagttcgacggtgcagccctattcgccgccgcgagccatcacaatgccaacctcggcggcgcaatgagcgagctcacgggggccgccggcaacgtgccttacgacgtcttgtcggcggtgcgccaccatgccggcctgaaggacgccggcggcgtcgggagagaggaaactagggatttcttgggcgttggcgtgcaagcactgtgctcgtcgtcgatacatgggtggatttaa

SEQ ID NO: 603 - DNA, 1372 bp, Oryza sativa
atggcggacgccgtgcagtaccgcctcgagcggatgtccgacgagctcgacgacctcgagcgccggggcctcttcacccgcgccgagctcgccgaggtcgtccgccgccgccgcgacttcgagttccgcctccgacgccgctccccgctccgctccgacttcctcgactacatcgcctacgagctccgcctcgacgccctccgcgacctccgcaagaagtccgtctccgacatcgccggagtcctccgcgtcctcgacatctacaggatggccaccgtcaggtacaagggggacctcgacctctggttccgttacctcgagttctgtcgcgacaagcgccatggtcggatgaagcaggctctggcacaagctattcgttaccaccccaaggttcctgggctctggatctatgcagcagcatgggaatttgatcagaacttaaatgttgctgcagcacgtgctcttatgcagactggtcttagatcttgtccagaatcagaggatatgtggattgagtatcttcgcatggagcttacctatcttaacaagcttaaggctcgaaaggttgctcttggagaggatgtgaagacactgcaaaagaagaataatgatgcaagcacttggaaagaggaaaataaagaactgttcatgtcactgaatgaacaagatgaaggtcccaaggagtctggctcacagggagttgctttggaggggaaggaagacctattctggcagcaagggctgctaatcattcaaaccatataccatggtgctacaaaagctcttccttcaagcttaaccttgcggaagaaattcttagagatattgagtagtgttgacctagcacattctgacgaactgaaggtagaggtcatggatgacctgaagaaagagttctctgacagtgaggactactgggattggcttgctaggcttcagcttagtgactcaactagttccagtaatttgaatagaatggaagctttatcaaataaactgaataaatcaatacaggtctatcaaaatgccgaatcaagcggttgtcttactgaagatcttgcttgccaatatgtgtctctttatttgagacttggagagatttctggctttaccacgtccaagcttcaagttcttccagtactgcatagagttggaaacaaaccttgcatcaatcggaaaccaagacagccttgtgaatgctcgtaagctgtatgatgcagcgctcgatctctatccccaggaaagagaactttggaggaactactacaacatggagctgaagttgggaacatcagaaacagcaaatgctatatactggcgcgctcgtaaggtgctcggtgattccagtgccctggacattccccacagctag

SEQ ID NO: 604 - DNA, 1360 bp, Oryza sativa
  misc_feature (687)..(687): n = any nucleotide
  misc_feature (724)..(724): n = any nucleotide
cgcaacacgtacaacctcgtcccccgctccatcggcgggtgccgcgggagcgtcaggtcgctcaagttcttcggcaacgacgtggaggtgctcccgccggaggctggcgagctggaccagctcgagagcctgcaggtgaaggtgtccgcgcccagggtctccggggcgccgctccgccggatgcgggcgctcaaggagctcgagctctccattgtcccgcccaggccgtccgcgtgctccatactggtcgaggtcgccgcgctcaagtgcctcaccaagctaacaatctgccatttctccattagaggtacctccctcctgaaattggctccctaaggaagctgcaagaacttgatctttcgttcaacaagttgaagaacttgcctaactgtataactgagttgggtgccctaaagttcctcaaagtgactaataataagttggtggatctaccatcaggaatctcttctttgagatgtcttgaaagccttgatttatcaaacaacagattgacttcccttggatcagttaaactcatttctatgcttacactacagtatttaaatcttcagtacttgtgcgatcgagcagaccctccaattccttgtgagcttgtgcgggggcatcttgactacacacctcatgcttggaatgttgttcctgttagaaaagggaatacatgggtanggatgatagtggatgcatgctacccaaccaatataanggaagagacagatccagagtacttttgcagtttgaatacaagcttctcgcggaagtaagaatgctgggtgccctaaggaagcaccaatccatagtggaaatatatggtcatcagctttattctaaatgggttcaagctgatgatgataaggaatacaagatattacagtccacaattatgatggagcatgtgaaaggagggtctctgaagggcaagaagcatgcacctattgacctggcattctacattgtacgagaagttgcttgtgcattgttggagctgcacaaaaagctagttattcatcgggacataaaaagtgagaatgttttggttgatctggatttagagagaagtgatggcacaccagtagtcaaactctctgatttcgacaacgcaattcctttgcattctctctcccacacatgctgtatagctcaccttgggacatatccacccaatgtttgtgttggtacaccatgctggatggctccagaggttcttcgtgccatgcgagacaaaaaccaatatggactggaagttgatatctggtcatttggctgttttttattggagatgcttacacttcggataccctaccagggcctacctgattcagaaatatatgatctcataatg

SEQ ID NO: 605 - DNA, 1354 bp, Oryza sativa
atgggttcacggtttccatcccaccaactaagcaatggcctttatgtctcgggccgaccagagcaacctaaggagaaggctccagtcatttgctccacagcaatgccatacactgggggtgacataaagaaatctggagaactagggaaaatgtttgacctccatgttgaaaagtcgcggaagtctggtcctttgggtaatcaaccttcaagaaatacttcatttggtggtgctggttccaactctggaccagtttctaatgctcttgaaatcaaattctggacctctcaataagcatggagaaccaggaaagaagtcatctggtccccagtcaggcggagtgaccccaatggcacgtcagaattctggtcctttacctcctgttcttcctacaactgggctgatcacatcagggcctatctcctctggacctctgaattcatctggtgctccacgaaaagtatcaggccctcttgatcctagtcacaacccagctgttacaaacctgaatgccgatgatggttactctattaagggcagcattcctaagacaatactctggatggttattctgctctttttgatggggttcatagcaggtggtttcattcttggagctgttcataaccctattctgctggtagttgtggtggtcatattttgctttgttgctgctcttgtgatttggaacatttgctggggaacaagaggtgtgactgggttcgtcagtcgctatcctgatgctgatctcagaacagcaaaagatggacagtatgtgaaagttactggggttgttacatgtggaaattttcctctcgagtcctcatttcaaagggtcccaagatgtgtgtacacttcaacttgcttgtatgagtacaggggctgggattcgaaagctgctaacactgagcaccgccaatttacttggggtcttaggtcaatggagagacatgctgttgatttctacatctctgatttccaatctggactacgagcattggtcaaaacaggatatggagcacgggtaaccccttatgttgatgaatctgttgttattgacataaacccagataacaaggacatgtctcccgagttcttgagatggctgcgtgaaaggaatctatcaagtgatgatcggataatgcgcctgaaagaagggtactacattaaggagggcagcacggtgagtgttatgggggttgttcaaaggaacgacaacgtgttgatgattgttcctccatcggaacccatctccactggctgccagtgggccaagtgcatcctccctactagccttgatgggctagtcttaagatgcgaagatacatcgaacatcgatgtaataccagtctga

SEQ ID NO: 606 - DNA, 1344 bp, Oryza sativa
attctggcatacaagaatgcatatcctggatgctacaagactcctcgatctcccacaccatacagtggaaaattttattctaggagtgacagtgagacgaagagaaaatctgttgctcacgacgatagggatattccaatcagtttccttgcagacggtgatagcatgttcattgcttgccaggggatcactgtgcattacaaactttccgatccatcgagttgcatatcttcagctacagacacttttccagaaatccatcatgatgttatttcagcaagcatttctcctagaagacagagacatgatagcccaccatcagcctccactaatacccgtcgtcttttgaataggagcttcagccatcaataccatcagacatcgctatatgcaccattgttggtagagccagtgacctctccaactttgtcggatgacacccctgttcttagtgttgatgatggcagtgctgatgtatgtttgaaacctatgggatttgatcttgaggctggagaacaggggaaatttgctgttgttttggtgcatgggtttggaggtggggtgttctcatggagacacgttacaaatttgctttctcgtcaagtgggttgcactgtgctggccttcgatcgccctggatgggggttaacatctcgacctcgcagaaaggattgggaagacaaaaatctaccaaatccatatgagcttggatctcaggttgatcttcttatttcattttgctcggacatgggcttacgctctgtggttttagttggtcatgatgatgggggcctgcttgccctaaaagctgcagaaaagttgcgagcatctggagattcaagaaaggttgaagtgaagggagttgtgcttataggtgtaagcttatcaagagaagtcattcctgcatttgctcgtatactcctgcatacccctctaaggaaaaagcacatggtgatcaatagacgtgcatggtttgatgctaccaagttaacaacagatgttctgaacctctacaaggctccactatttgttgaaggctgggatgaagctctccatgaagtaggacgtctttctttctcgactgtcctatcatcaaaaagagcagcagatttactaagatcagtggaagacctccctgttctggttgtagcaggctctgaggatgctcttgtttcttcgaagtcaacgcaagtaatggcttcaaggcttgtaaattctaggctggtaacgatatcaaattgtgggcatttgccacatgaggagtgtcccaaggcattgctttcggctctttctccattcatatcaggactggtgtcatcagatgattcattgcaaagattgtag

SEQ ID NO: 607 - DNA, 1342 bp, Oryza sativa
gaggacgagatcgagcgcatccgccgcgagttcgaggacgccaagcggaactacctcagcatccccgtcgccatcaaggacatggccaagatgaacccgcaaggtatttatgtgaacaagaacgtcaaactggatgacctgcaagtctatggttttgactatgactacacgctgtcccactactccgagcacctgcagtgcttgatctacgatctcgccaagaagcacttggtcaatgaggagtatgaccacggctttcccatcagggggctctattatgacagattaaaaggttgccttttgaagcttgattttttcgggtctatcgaaccagatggttgcttctttgggcggcataagctgagtttgagtgagataaaagaactctatggcacacggcatattggcagagatcaagctcgccagcttgttgggctaatggatgtcttctgttttagtgagtcacaggcatgccttcttgctgatatagttcagcactttgtagatgccaggctggagtttgatgcatcctatgtatatgaagacgtaaaccaatcgattcagcatgtccacagaagtggtctgattcacagcgtttcttaaagatgctaagagagaaggggaaaaacctatttcttctcaccaactcacctttctactttgtggatggaggaatgagctacttgcttgaggggaattcctggagggagctctttgacgttgtcattgcgcaggcaaataaaccgactttctataattcagaccacccattcaggatacactagcttttactgcagttgacaagtttctgccaaatgaagtttattatcacggttgcttaaaatcatttctgcagattacaaagtggagaggcccagaggttatatactttggtgatcatcttctcagtgacttgagagggcctgcaaaagctggctggcgaacagctgctgtaattcgtgaacttgagcaggcaaaattaagtataatacatgatctacttgggaaagttcatgcaactgtggttagcactgagaaaggacaagtttaccgagcattgcttgatgagttgaatgcagaaaggcgtcaatgtcgatctgcgatgcgagatcttttcaatagctcttttggtgcaaccttccttacagatactggaagggaatcatcgtttgcttatcacatccatcaatatgcagatatttacaccagcaagcttgagaattttttgtcatatgcccctgaatcatggctccatccacctcatgacataaagataatgccacataatgcgaaggtagcttatatttcctcccatatgtggtatttatatccacctgattag

SEQ ID NO: 608 - DNA, 1340 bp, Oryza sativa
ggtttttctgctgatgatgacgagcttgacctagacagcccaactgagggtttctcatccattcctgaagctattgaggatattcgccaaggaaaagtgattgttgtggacgatgaagatagagagaatgaaggagatcttataatggcagcatcaaaggtgacacctgaggctatggctttcatagtgaggcatgggacaggcattgtatgtgtcagcatgaaagaagatgacctggaaagactagaacttcctcttatggtgacaacaaaggaaaatgaagagaagctgcggactgccttcactgtttcagtggatgctaaagaaggcacaacaacaggggtttcagctaaggatcgggcaaatacagtcttagcacttgcatctcctaattctaagcctgaagacttcaacaggccaggacatatttttcctcttaaatatagagaaggaggtgtgctgaaaagggctgggcatactgaagcatcagttgaccttgccatgttggctgggttacctcctgctgctgttctttgtgaaattgttgatgatgacgatggatccatggctttattgccaaaactccaagattttgcaagaagggagaacctgaagataatttcaattgcggacttgattagttatgcaggtataggaggaagagagacagattggtagaacgtgtttgtgttacacctttacaattacaatggggatcatttcaatcttattgctaccgatctcttattgatgggatggagcacattgctatggtcaagggtgatggccaggatatcttagtgcgagtgcattcggagtgcctaactggagatatatttggatcagccaggtgtgattgtgggaatcaacttgccctggcaatgaccatgattgagaagactggcaggggtgtagtagtttaccttcgtggacatgaaggtaggggcattggtttgggtcacaagcttcgtgcatacaatttgcaggacgatgggcgggatactgttgaggctaatgaggatctaggtctgccggttgattcacgagagtacggtattggtgcacagcagatactacgagatcttggtgtccgaaccatgaggcttatgactaacaatcctgcgaaatatactggactgaagggctatggtttgagtgtcttgggcagagtgccactgttgacaccaataaccaatgagaatcggcgttacatggaaacaaagagattaaagatggggcatgtttatggaacccggcctagtggtaatacaagcaccttggctgatggcggcataaaaaaggagcaagatcagattgacagtgctagcgagcaagagtaa

SEQ ID NO: 609 - DNA, 1312 bp, Oryza sativa
atggcgggcgcggtgtcggcgctgttccttctggacatcaagggccgcgtcctcgtctggcgcgactaccgcggcgacgtctccgccctccaggctgagcgcttcttcaccaagctcctcgacaaggagggcgactcggaggcgcactcgccggtggtctacgacgatgccggggtcacctacatgttcatccagcacaacaacgtgttcctactaaccgcctcccgccagaactgcaacgccgccagcatcctcctcttcctccaccgcgtcgttgatgtgcaggtgttcaagcactatttcgaagagttggaggaagagtcgctgagggataactttgtcgttgtggtatgagttgcttgatgaaatgatggattttgggtacccacaatacacggaggcgaaaatcttaagtgaattcattaagacggatgcgtacaggatggaggtatcacagaggccacctatggcagtgacaaatgccgtgtcatggcggagtgagggtattcggtacaagaagaatgaaggtgttcttggatgttgtggagagtgttaacattcttgttaacagcaatgggcagattgtgagatcagatgttgttggggcactgaagatgcggacatatttgagagtggaatgcctgagtgcaaacttggattgaacgatagggttcttttggaggctcaaggccgagctactaaaggaaaagcaatagatcttgatgatattaaatttcaccagtgcgtgaggttggctagatttgagaatgatagaactatatccttcatacctcctgacggatctttcgatctaatgacatacagacttagcacccaggttgtaaaaccacttatctgggtggaagcacaaattgagaaacattcaagaagccgaatagaacttatggtgaaagcaagaagtcagtttaaggaaaggagcagcacagcaacaaatgttgaaattgaagtgcctgttccttcagatgctacgaaccctaatataagaacttcaatgggctctgctgcatatgcacctgagagagatgcaatggtctggaaagtaaaatcatttcctggtggcaagtaggattacatgtgcagagctgaatttagtcttccaagtataactgcagaagaagcagctcctgaaaagaaggcaccaatacgagtgaaatttgagataccatatttcactgtgtcgggtattcagcaggttcgctatctgaagatcattgaaaagagtgggtaccaggcgcttccttgggttagatacattacaatggctggtgaatacgaactgagacttatatga

SEQ ID NO: 610 - DNA, 1300 bp, Oryza sativa
  misc_feature (151)..(151): n = any nucleotide
  misc_feature (233)..(233): n = any nucleotide
  misc_feature (300)..(300): n = any nucleotide
atggccgcgttgcatgggcatggcttcgcggtcaccgtgctactggtggtgttgttggtgcaatgtgacgcggcggaggcgacgacgtgcgccggtgcggtgccggcgaggccacggccggagacggtgtccatcgccgagttcggcggcntgggcgacggccggacggtgaacacgtgggcgttccacaaggcagtgtaccgcatccagcaccagcgccgccgcggcggcancacgctgctcgtgccggccggaacgtggctcaccggcagcttcaacctcaccagccacatgaccctnttcctcgccaggggcgccgtctggccgctggcggagccgctgccgtcgtacggaagggggagggagctgccgggggcgaggtacaccagcttcatccacggcgacggcctccgcgacatcgtgattacagggaatcatcgatggacaaggtgatgtatggtggaacatgtggaggcaaaggacacttcagcataccaggcccaaccttctggaattcatgcattccagtggcattcacatctccaacattgttctcaagaattcacccttctggaacatccatcctgtttattgcgaagcaatgtggtcataaccaacatgatgatcatcgcaccacatgactcgcccaacaccgatggagttgatccaggattctagcaccaacgtatgcatcgaggactcctacatctcaaccggcgacgatctcgtggccatcaagagcggctgggacgagtacggcatcgcctacgggcggccgagctcgggcatcaccatcaggcgcgtcaggggctcgtcccccttcagcggcatcgccatcggcagcgaggcatcgggaggcgtcagcaacgtgctggtggaggactgcagcatcttcaacagcggctacggcatccacatcaagaccaacattgggaggggcggcttcatcaggaacatcaccgttgacaacgtccgcatgaacagcgtccgcaacgggctgcgcatcgccggcgatgtcggtgaccacccagatgagcacttcagccagctcgcgctgcccaccgtggatgctgtcagcatcaagaacgtgtggggtgtcaatgtgcagcagcccgggtcgatcgaggggatcaggaactcgccgttcacgaggatatgcctcgccaacgtgaagctgtttgggtggaggaataatgcagcttggaagtgcagggacgtccatggcgcggcgctgggtgtgcagccggggccgtgtgcagagctcacgaccagcctttcttcagggttctgcagctattag

SEQ ID NO: 611 - DNA, 1224 bp, Oryza sativa
atggagtacttcgatgctaggcggaagcctcataatgttgggaaagttattgcagctctggtcctcacaacactatgtatatttattttgaagcaatctcctggttttggtggcagtagtgtgttttctcgccatgaacctggtgttactcatgtcttagtaacaggaggagctggctatattgggtcacatgcttcattacgcctgttaaaggacaattatcgagttaccattgtggacaatctttctagaggaaacatgggagcagtaaaggttctccaagagttgttcccccagccaggaagacttcagtttatctatgctgatcttggagatcaaaaaactgtatcctcattttgtacttctaaattacctcctcgtcaacaagatctttgccgaaaatgcgtttgatgctgttatgcactttgctgctgttgcctatgtgggtgagagtacattggaaccccttagtactatcacaatattacatcgaacaccttattgattttggaggctatggcgtctcatggagtcaagacccttatttactctagtacatgtgccacctatggagaaccagagaagatgcctattgtagaaaccacacgtcagcagttaccaattaatccctatggaaaagctaagaaaatggcggaggacatcatactagatttcacgaaggggagaaaggacatggctgtgatgattttaagagatatttcaatgttattggatcagacccagagggaagactaggtgaagctcctagacctgaactacgagagcatggaaggatatccggggcatgctttgatgctgcgttaggaatcattccagggctgaagttgcaggttaaaggaacagattatcctacaactgatggaacctgcataagagactacattgatgtcacagatcttgttgatgctcatgtgaaagcactcaacaaggcagagccaagtaaagttggcatttacaatgttggcactggaagagggtcgttcagtcaaggagtttgtggatgcctgcaaaaaggcaactggagtcaacattaaaattgagtacctcagcaggaggccaggggactatgctgaagtatacagtgacccaacaaagatcaacacggagctcaactggactgctcaatataccgacctcaaggagagcctgtcagtcgcttggagatggcaaaagtcacatccacgcggatatgggtcaaactaa

SEQ ID NO: 612 - DNA, 1211 bp, Oryza sativa
atgtcgtcgtcgtcgtcgccgcccgccgcctccgccgccgcgaggctggatctggacggcaaccccatcgcgcccctcaccatctgcatgatcggcgccggcggcttcatcggctcccacctctgcgagaagctcatggccgagaccgcccacgtcgtctacgccgtcgacgtctactgcgacaagatccgccacctcgtcgaccccgcccctccccacctccatggccgcatctccttccaccgcctcaacatcaagaacgactccaggctcgagggcctcatcaagatggccgatctgacgatcaacctggcggcgatctgcacgccggccgactacaacacgcgccccctcgacaccatctacagcaacttcatcgacgcgctccctgtggtcaagtactgctctgagaacaacaagcgtctcatccacttctccacgtgcgaggtctacggcaagaccatcggcagcttcctccccaccgaccaccctctccgcaagttgaaacaggaacctgaattttatgtactgaaagaagatgaatccccctgcatttttggtccaattgtgaaacagcgatggtcttatgcatgtgcgaagcagcttattgagaggcttatttttggctgaaggagcagaaaatggccttgagttcacaattgtgagacctttcaattggattggaccaagaatggactttattcctggtgttgatggtcctagtgagggtgttcctcgggttttggcatgtttcagtaacaatctcctgcgtcgggagcccctgaaacttgttgatggtggccagtcccagagaacttttgtttacattaaggatgccattgaagctgttcacttgatgattgaaaatcctgctcgtgccaatggtcaaatcttcaatgtcgggaatcctaacaatgaagtcactgttaggcaattggctgaaatgatgacagaggtctatgcaaatgtctcaggagagccaccactggatgaacctatgattgacgtgagttcgaagcagttctatggtgaaggatatgatgatagtgataagaggattcctgacatgaccataatcaacaagcagcttgctaggttggaatccgaagacccctctcaaggatttgctggagacaacattgacctaccagcacaagacttacaaagaagctatcaaaaggcaaatgtcacaggcttcagcgtcgagttag

SEQ ID NO: 613 - DNA, 1199 bp, Oryza sativa
cagaaacctgcatcaatggctgatgcacaagacttctttaagccgctgaatgatgttattgcgaaagcaattgcgatgactgaaggaaggaggcctgactatttcaaccatatcaagagtgttgccgacagtctcactgctttggcgtgggttggcttcctaggaaaggattgtgggcatgagtttccctacagcacatgttgaagaaagttggcagatggctgagttctacaataacaagaggttcttgtggagtacaggaacaaagatgctgaccatgttgagtgggctaaagctttgaaggagctatacatgcctggtttacgggattttgttaagaaacattaccctcttggtccttcctggcctaaagcaccaggggctaaggctccccctccacctgctctaccttcggcacccctttttaccacagagaaatctcctaaatctgcacagcctaaagaaggaatgtcagctgtctttcaggaggcaggattgcgaaaggttactgatgacatgaagactaaaaaccggtctgatagaagtggtgttgttagctgggtggtcgaaaatcaagttggtaaaaagaaccttgcaatcgatgattgtgatgctagacaatctgtatatgtgtatggatgcaaggattctgtccttcaaggtaaagtgaacaatatcactgttgacaaatgcaccaaagttggaatcgttttcaagatgttgtagcagcttttgaagttgtcaattgcaatggtgttgaggtgcaatgccagcagggtacagcaccaacaatatcaatcgacaacacatctggatgtcaattgtacttaagcaatgattcacttggagcctccatcacttcagctaaatctagtgaaatcaatgtgatggttccaagtggtgctactgatggtgattgggaacatgctttgccccaacagtacatccacagcttcaaagacgggcaattcatcacctcaccggtgtctcattccggagcatagctacaatcataccggcctttctgggtttgtctgtgcattggttgtgtgttgagagttgtaacagtatttgatgtttgttggagatgctgtttggagtgttggatggtgcctacgattgctgtttcttctgccctactcactgtgttggttggtgtatttgcatgccaacaaactactgttgtatgtttgagctga

SEQ ID NO: 614 - DNA, 1196 bp, Oryza sativa
  misc_feature (515)..(515): n = any nucleotide
  misc_feature (548)..(548): n = any nucleotide
agcaagcgagttagtggatttgatatggcgcctccagctcaagctgtggttccacaatttcctgctattccaaccccaagcaggtcagtttccgggcactgctattcctggaatgtttccaaacatgctcccgatgggtgttggacagcaggctactcgacacgcgagacgtgtttatgttggtggacttcctccaactgctaatgaacagcagtcagttgcaatatactttaatcaagtcatggctgctattggaggaaatactgctggtccaggtgacgctgttcttaatgtctacataaaccatgacaagaaatttgcttttgtggaaatgaggtctgtggaggaagcaagcaatgcaatggcactggatggcattttgtttgaaggggctccagtgaaggttaggagaccaacagactataacccttctctggcagctgccttgggccccagccagccaagccccaatctgaatcttgctgcagttggcttaacacctggttcagctgganggctagaaggcccagatcgtattttcgtgggtngccttccatattacttcactgaggctcaagtccgggagttgcttgaatcctttgggcctcttcgaggatttgaccttgtgaaggatagggaaactggtaactcaaagggctatgcattctgtgtctaccaagatctcaatgtcactgacatagcctgtgctgctctgaatggcatcaagatgggagacaaaaccctaactgttagaagggcaaaccagggagcggctcagcctagaccagaacaggaaagtatcctgttgcaggcacagcaacaagtgcaattacagctccctacaaaggttgtgtgcctgacccaggtggtttcggctgatgaattaaaagatgacgaggagtatgaagacattatggaggacatgagattggaagcaggcaaatatggttgtcatccctcgccctgatcctagtggattaccagttgctggagttggaaaggttttcttggagtatgcagatgtggacggcgccaccaaagcaaagacggcaatgcatggaaggaagttcggtggaaatccagttgttgcagtgttctaccctgagaacaagttttctagtgcggaatatgacgcgtagattatcccgctatgtaaaacactagtcttttgtttttcttttgcgccagtttgctaa

SEQ ID NO: 615 - DNA, 1191 bp, Oryza sativa
  misc_feature (18)..(18): n = any nucleotide
atgcagccgccgccggcntcgagggtctccacggttgtcgacgtcgacctcggcgaccggagctacccgatctacatcggcgcaggccttctcgacgagcctgacctgctgcagagctgcgcaggcatgttcatgggaagagggttttggtggtgaccaacaccaccgtcgcgccgctctacctggagaaggtgacctgggcactcacgcacaacaacccgaatgtttctgtggagagcgtgatcctgcccgacggcgagaagtacaaggacatgacactgatgaaggttttcgacaaggcagtcgagtcccggctggaccggcggtgcacgtttgttgcgttgggaggtggcgttattggggacatgtgcggttttgcagctgctgcgttcctgcgtggtgtcaatttcatacagattcctactactctgatggcccaggtcctaagcttgatttagattttttactacaattggttacatgtagcttgatgctaacggtggattcatctgttggagggaagaccggcattaaccatccattggggaagaacttaattggggcgttctaccagccacagtgtgtactgatagacaccgagacactgaatacattgcctgacagggaactggcttcaggcatagctgaggtggtgaagtatggtctcataagagatgcaccgttctttgaatggcaagagaaaaacatgccagcattattagcaagagagaaccaagtgctctggcctatgctattaagagatcgtgtgaaaacaaagctgaagtggttgctcaggacgagaaggaaagtggtctccgagcaacacttaatctcggccatacatttggccatgctatagaaacaggaactggttatggagcatggctccatggggaggctgttgcagctggaacagttatggcagctgacatgtctcaccgcctgggttggatagacgagtcaatcaagaaacgggcaattgacatactagagaaagcgaagcttccaattacacctccagaggccatgacagtggagaagttcaaaagtattatggccgttgataagaaggttgctgatggattgctgaggctcatcctcctgaaaggacctctgggaagctgtgttttcactggcgattacgacaggaatgccctcgacgaaaccctccgtgcattctgcgactgctga

SEQ ID NO: 616 - DNA, 1189 bp, Oryza sativa
atggctgaccttggattcggcgatgccaggagtggcaatggcagcaggagccaatgctccagggggaaggcgatgctgctcgccctcggcaagggcctccctgagcaagttcttccccaggagaaggtcgtcgagacctacctccaggacaccatctgcgacgatcctgcaacaagggcaaagctggaaagactttgtgagttttgttcatacaggcaagaccaccacagtgaggacaaggtacactgtcatgtcaaaggagctcctagacgagcacccagagctcaggactgagggaactccaacactgacgccacggcttgacatctgcaatgctgcagtgcttgagcttggtgctactgcagcccgtgccgcccttggtgaatgggggcgtccagcagctgacatcacccaccttgtctacatctcgtccagtgagcttcgcctcccagggggtgaccttttcctggcaactcgccttggcctccatccaaacaccgtccgcacttcccttctcttccttggctgctccggtggcgctgccgcgctccgcaccgccaaggacattgctgagaacaacccagggagccgcgtccttgtagtagccgcggagacgacggtgctgggattccggccaccaagtcctgaccgtccttacgatcttgttggtgctgccctgtttggtgacggcgcatcagctgcgatcattggagcaggccccattgctgctgaggagagtcccttcctagagcttcagttctcaacacaggagttcctaccagggacggacaaggtaattgatggcaagatcactgaggaagggattaatttcaaactggggcgtgatttgcccgaaaagattgaaaaccgtatagaagggttctgcaggacactcatggatcgggttgggataaaggagttcaatgatgtattctgggctgtgcatcctggtggtccagcaatactgaacaggctagaggtttgccttgaactccagccagagaagctcaagatcagtagaaaggccctgatgaactatggtaatgtgagcagcaacaccgtcttctatgtgttggagtatttgagggatgagttgaagaaagggatgataagggaagaatggggactgatcttggcttttggcccaggcatcacatttgaaggaatgctagttcgaggcattaactga

SEQ ID NO: 617 - DNA, 1171 bp, Oryza sativa
gttaaatggaggtgggaagaccacacattcggcagagtatccagaacggccggggcaaccagtttgtgagagtactatatgaagaatggaacttgtaagtttggctctaattgcaagtatgatcacccaagggaaggctctgtgcaagcagtcatgttaaattccagtggataccctctacgctcagtgagggtgagaaagattgtacctactatgtcaaaactggccattgcaaatttggatctacatgtaaattccatcacccagaaattggtggagtttcagagacacctaacatgtatccaccagttcagcctcagcctatctcttcctctcatccatatcaacatcttgctggctggcaaatggggaggcctcctgttttgccaggatcatttttatcaggctcatatccaccaatgatgcttccgtccacagtcgtaccaatgcagggatggaacccttacatttcacctgtgaaccaagttgcgtcagctggggggcatcaaactgttcaagcagggccgttttatggcttatcgcaccaagggccttctgctgcagtcacttatggcagtcagtatgcaccgttatcttcttcaaccatgccttcaagtagcagtaaacaagaacctgcctttcctgcgcgacctgggcaacctgaatgccagtattatctgaagacagggagttgtaaatttggatctgcatgcaaatatcatcatcctcagtatttgaatacacctaagtctaactgtatgctgagtcctcttggtcttcctcttcggccggggtagccaaccatgtgcttactatacacagcatggattttgcaaatttggtccgacttgcaagtttgatcacccaatgggtactctaagctatagcccttcagcgtcatcgattactgatttgcctattgctccctatcccctcaattacgctgttgctcctgtggctccaccttcatcttcttctgatttgcggccagaataccttctaaccaaagagttttcagccaaccagtcagcgtcacctggtactacatgcggacctgctggagcaatgttaaaagcttcgacttaccctctcagcatcagttcacttggacccccactcattgtgaataaggcttcaactgactttgacaaaggcatggccaaggtggtaa

SEQ ID NO: 618 - DNA, 1168 bp, Oryza sativa
  misc_feature (8)..(8): n = any nucleotide
  misc_feature (46)..(46): n = any nucleotide
  misc_feature (49)..(49): n = any nucleotide
  misc_feature (102)..(102): n = any nucleotide
  misc_feature (190)..(190): n = any nucleotide
cggcggcngcggcggcggcaacaacccaaagcccgtttttagcctnganagttacggggggaacggcgacggcaagcgcgacgacacggcggcgcttgccanggccttgaacgccgcctgggcctcggcggcgccggccgtcgtgctcgtcccggagagcaggagctacctgctccggcaagtcaccctntccggcccctgcgaatccaccatcaagctcatggtgaaggggacgctggtggcgtcgccggacatgtcgaactggaacgagagcaacaggaggtactggatcgtcgtccgcggcgtcgacgggctcgccgtcggcggcggcggcaccatcgacggcaacggcgaggggtggtgggagaactcctgcaagatcaacagggcactcccatgcaagggagctccaacggcgctgagtttccacacgtgcgacaacctgagcgtgaatggtctgaagatggtgaacagccagcagatccacatgtcagtggaggattgcaccggggtggagctggcccacctgtcaatctctgcgcccggcacgagccccaacacagatggcatccacatcacccacagcaagaacgtccaagtcagcgactgcaccattaagacaggggatgactgtgtgtcgatcgaggatgggacccacggtttacacgtcacgagactggtgtgtgggcccgggcatgggattagcattgggagcttaggagatgacaactccagagctgaggtgtctgacatcttcatcgacaccgtgcacctctatggcaccaccaatggagctcggatcaagacatggcagggagggagtggatacgccaaggatatcgtattccagaacatggtcatgaacagtgtcaagaacccaataatcattgaccaaaactactgcgactcagctaagaaatgcgagacacaggagggatcagcagtggagattagcaatgtggtcttcaagaacatcgcagggacaacaatttccaagagtgccatcactctgaactgcagcaagaactacccatgctatgacatttccttacaggacatcaacctggaaatggtggatgacaatggtgccacaggaagtacttgccagaatgcaaaatggaggaaatctggaacagttgttccacaaccatgcaccagcacaaattag

SEQ ID NO: 619 - DNA, 1140 bp, Oryza sativa
atgttatgcgatgaatataattttatttcattatgtgtgcaggggatattcactaaatacaagcaaccctttgcaattacttacctgggggcctcccttatgatcatctatatacctctttcatttttaaaggattttatatgtaatttgttgagaaggtcttcttcaagtagtagagtttcaaaagttaccaacaaatcttctttcggtggttgtgctcctctgaagaatggtgaattccagaagatgttggaaatggaatctcaaaaaactatagtcataaactatactgatgtggatattcctgtaatagaagagacaaaacctcttatatgtggaatcactgaattcgatgacgttttgaaggagcaagaactttccactaaggagattgcaatgtatgggttgtatctttgtcccatatggtttgtgacggagtacttgtcaaatgcggcacttgcaagaactagtgttgctagtactactgtactatcttcaacgtcaggactcttcactcttttcattggtgtgctacttggccaagattctataaatgctgcaaaagttattgctgtttttattagcatggctggtgtggtaatgacaaccatggggcagacttgggcatcagatgaatcagaaatcagcaattctggagaactcttctaggtgacatgtttggtcttctgtcagctatgtcatatggtttattcactggtgcttctaaaaaagtttgctggagaggaaggagaaaaggttgatgtccaaaaactgtttggctacctcggacttttcagtcttgttcttctctggtggcttggtctggccattgaccgcattaggcattgaaccaaagtttacaataccccactcagccaaagtggatgaagtggtgttggcaaatggccttattggaagtgtattgtcagactacttctggctctttctgttgtttggactactcctttggtggccaccttgggcatgtcactcacaattccactagcaatggtggctgatatgatcattcatggtcgtcgttattcagcggtctatatctttggttctgtccagcaggtattttctgggtttgtcattgcaaatcttgcggatcgcttttcacgttttctagggctctag

SEQ ID NO: 620 - DNA, 1131 bp, Oryza sativa
ggtatctggtcagagtctgcaagctttagcgatgatgggcttggtcctgtgcctaaaggcacatgtcaagctgggcaagaattcaaatctaacctgtgcaacaggaagataattggagctcgatggtatgacgggcatctgaagccaaaggatcttgagggtgagtacaggtcggccagggatactaacggtcatgggacacacgtagcgtccaccgcggctggtgccctggtgccgaatgttagctttcacggtctcgctaccggttatgccaggggcgttgcgcctcacgcgcgacttgctatttacaaggcttgctgggggccaggaaggagttgcaacgaggcagccgtgttgcaagcgattgatctttctcttggagggcccagctttgaatattatactagcctccacgctgtgaaccatgggataataacagttgtcttctcggcgggaaatgatggctctgctcctaggactgttacaaatgcatccccctaggtcatgtcagtagcgtcggccacaatagaccgtactttccccacttgccaatagcaccagtaaccttgtgcctgatgttgcggcacctagatctaatatcttggcagctgtcaaagatccatacacgttcaagtcaggaacttcaatggcatgcccacatgtgtcaggtgtagctgcattactcaaagcattgcatccagattggtctcctgctatcatcaaatcagcaatagtgactacaggtgatactatttggcttaccaatattggctgatgggttacctcaaaagccagtagatccatttgactatggtggcggcttcattgatctaaacagagctgttgatcctggcctagcatatgatgttgatccaaaagactatatcccattccatgattgttttttagctggcaactcaagctgtgaatcagaatccagaaatctgaacattccatcaattgcgatcctaaatctaaaggaaccaacaactgtgctaagaacagtgacaaatgtaggccaagctgatgcaatttacaaggctgttgtgcaatctcctccgggcatgcagatattagtagagccatccattctaaaattcagcgcttggcatgaataagcagagcttcaag

SEQ ID NO: 621 - DNA, 1124 bp, Oryza sativa
caggtgtcatttttgcttggtctattccctgttctcattgcatggatctattcagaagtcctggagtacagaaaatcttcgtctatgaaagtcactccgattccaatttggagaatggaactgtcaaagaagatgataaaacggtattgctggaaggaggcctgtcaaagtcaccatctacaaagtttcggatcaattctacaaaagcaaacctcataagtctttccttctggaaaatcgtgctgtactgagagcaatgaatttggcatcgttctggtttatttctacatttgtgatcggacaaacatatttccagaaagcaagaagtacaaccgtgatctgtttctgtttttatacattcttctcatcatagcatcagcattaacatcacttaagaagcaccatgacaaatcagcattctcagggaaatctatactctatcttaatcgccatcaaacagaggaatggaaaggttggatgcagcaggtcctgtttttaatgtaccactattttgccgccactgaaatatacaatgcaattcgtgttttcattgctgcctatgtctggatgactggatttgggaacttctcatactattatattaagaaagactttagtcttgccagatttgctcaggtgccattctgatctttaaccccaatctgttctatatgatactttaatgatgtggagacttaatttttttgtggctttctgctgcattgtccttgacaatgattacatgctctattacatatgcccaatgcacactttgtttactcttatggtatatgggtcccttggtctctttaataagtataatgagataccttcagtgatggcaatgaagattgtcagctgcttcttagcagtgatcttgatatgggaaattcctggtgtatttgaactgctgtggagtccatttacatttctgctagttgaatcgttatatatggattattggaatgatctatgcctacttccatccaaatgttgaaagatggatggaaaagcttgaagaatctgaaactaagggctatttgtggtacgagtatatttacaaactagacaaaattacatacaacaagtaccatccgtacacatcatggattcctatcacgtga

SEQ ID NO: 622 - DNA, 1121 bp, Oryza sativa
  misc_feature (102)..(102): n = any nucleotide
  misc_feature (105)..(105): n = any nucleotide
  misc_feature (933)..(933): n = any nucleotide
gacgaggacttcgtgtgcgcgacgatggactggtggccgccggacaagtgcgactacggcacctgcagctggggcctcgcctccctcctcaacctggccttntcnccgttgaagctgcggctgggcgggtcgctgcaggacaagctggtgtacggcaccggcgacggcggagggccgtgcgcgccgttcgtcaagaacacgtcggaaattttcggcttcacgcagggatgcctgcctttccaccggtgggacgagctcaacgcctttttccaaaaatccggttcgggctgaacgctctcaacggccgggttccgttgccggatgggtcgatgggagggccatgggattacaccaatgctgcatcgctgattcgttacaccgcgagcaagggttacaaaattcatggatgggagcttgggaaatgaactcagtggcagtggagttggaacaaaagttggggctgaccaatatgctgcagatgtgattgcactgaaatcactagttgacactatctaccaaggcaatccatcaaagccacttgttcttgctcctggaggtttctttgatgcaggctggtttactgaagttatagtcaaaaccaggccaaacctactgaatgtggtcacccatcacatctacaacttagggccagggagtggacacacatctgattgagaagatcctgaatccatcttatcttgatggaatggtgagcacattcagcaatcttcaggggatactgaaatctgccgggacttcggctgtcgcatgggtcggagagtccggaggcgcgtacaacagcggccgccatcttgttaccgattcatttgtgttcagtttctgttggatcagcttgggatgtcagcaaagtatgacacgaagagttactgcagacaaagtttgattggtggcaactatggcctgctaaacaangaaacattccaaccaaatcctgactattacagagcgctctactatggcatcgcctcatgggaaccaaagttctatctgcaacattcaatggcaccaacatgattcgcacttatgcgcattgcgcaaaagattcttactccattgtgtttgctcacatacacaatttccctgcccctgcatgtagttag

SEQ ID NO: 623 - DNA, 1118 bp, Oryza sativa
  misc_feature (126)..(126): n = any nucleotide
atggagcccacctcgtcggcggcgatggcgaggcagacgtgggagctggagaacaacatcccggcggcggcctccgaacccggacgccctggacgcgatctaccgctacgacgaggcggccaggcncggtgcagcaggagaagccctgggcgaacgacccccaccccttccgccgcgccaagatctccgccctcgcgctcctcaagatggtcgtccaagcccgcgccggcggcactatcgaggtcatgggcctcatgcagggcaagtgcgagggcgacgccatcgtcgtcatggacgccttcgcgctccccgtcgagggcaccgagaccagggtcaacgcccaggccgacgcctacgagtatatggtcgagtactccaccatcaacaagcagaggctggaaggttggagaatgtggttggctggtatcactcacaccctggttatggatgctggttatcaggcattgatgtgtctactcagatgcttaatcagcaatttcaagagccattcttggctgttgtgatagaccctacaaggactgtttctgctggtaaagtggaaattggagcttttaggacatatccaaaagattacaagccaccagatgaacctgtgtcagagtatcagacgataccactcaacaagatagaagattttggtgtccactgcaaacagcagtactatgctctggatataacttatttcaaatcatccctggattctcatctccttgatctactttggaataagtactgggtcaatacgttatcttcatcacctctcctgggcaacagggattatgttgctggccagatatttgatttagagctgataaactagagcaagctgagggtcaactggcacacagtcgatatggcatgcttatgccatcgcaacgaaagaaagagagcaagaggagtctccactggctaaggtaactcgggatagctcaaaaattactgctgaacaggtccatggtctcatgtcacagaggtcattaaggatatcctcttcaactctgtgcacccgtcaaacaaggcaagcacaagcgcaccagattcatccgggcctgagcctatggttgaagcatgagtgttctacagaattccttcattag

SEQ ID NO: 624 - DNA, 1104 bp, Oryza sativa
atgggagccagcggctccaagctcgagaaggccctcggcgaccagttcccggaaggcgagcgctacttcggcctcgagaacttcggcaacacctgctactgcaacagtgtcctccaggtgttccaggcactatatttctgcatcccgttcagggagaaattgctggaatattatgcaaataacaaaactcctggagatgcggaggagaaccttttgacttgtttggcggatcttttcatgcagaagaaaaagactggcgttattgctccaaaacgctttgtccaaagagtaaagaaacagaatgaactatttcgcagctacatgcacccaggatgcacatgagttcttaaattttctgttgaatgagcttgttgatattctggaaaaggagtctaatgctgcgaaggactcccctcaatcatcatctcctgaaaaggttccaaacgggccagttcaacctttagccaatggtgttagaaaagaaccaccggttaccttggtgcataagaattttcagggcatactgaccaatgagaccagatgcttaagatgcgagacagtaacagcaagggatgaaacattttttgatctgagtgttgatattgagcagaatagttctatcacaagctgcttgaaaaacttctgctccacggagactttaaatgctgaggacaaattcttctgtgacaaatgctgcagtgttacagcttgcaagaagcacagaagagaatgaagatcaagaaggctccacacatattagttatccacctaaagcgcttcaagtacatagagcagcttggtcggtataagaagctttcataccgggttgtattcccaatggagctgaagctcagtacatctgatgatgtagataccgagtactccctctttgctgtcgttgtccatgttggaagtggccccaaccatggacattatgtaagccttgtcaaaagccacaaccactggttgttcttcgatgatgaaaatgtcgagatggttgaggagtcgaccctgcaaacattcttcggttcttcacatgaatactcaggcaacacggaccatggatacatcttgttttatgagggtcttggtgggaagagttag

SEQ ID NO: 625 - DNA, 1092 bp, Oryza sativa
atgtacgggtgggagatgctctcgttcaacatccacgacggcttcctggaggccatcgtgcgggggaaccggtcgggcctcctcaccgccgccgactacaacaacctctgccagtgcgagaacctcgacgacgtcaagatgcacctcaccgccaccgagtacggcccctacctccagaacggaaccttcacccctgcacacaactacaattgtggagaagtgcactcttaaactggttgatgagtacaaacacatgatgtgccaggcgactgaaccactatccacattcttacagtatataacaggtatggccacatgatcgacaatgttgtacttattgttaccggaacattgcatgagagagatgttaatgaactattggagaaatgccatccattgggaatgtttgacaggtattctgagcattgcatctcttgcagttgctcaaaatatgcgcgagctttacagattggttttggttgacacaccgttagccccatacttctcagaatgcattacatctgaggatttggatgacatgaatatcgagattatgaggaacactctttacaaagcataccttgaggacttttacaaattctgtgaattttgtgttatacagaaacttggtggtgcaactgctgagattatgtgcgatcttctgtcatttgaagcagacagaagagctgtgaacattacaataaacagagtattggtacagagttgactagagatgaccgtcggaagctgtactccaactttggtttattgtagtatccatatggtcatgaagaactggctgtttgtgaagatgttgatcaggtccgtggtgtaatggagaagtaccctccataccaggctatttttgccaaaatttcgtatggggaaagccaaatgttggataaggccttctatgaggaggaagtgcggaggctgtgcttgtcatttgaacagcagcagttccactatgctgttttctttgcttacataaggctacgggagcaggagattaggaacttgatgtggatatcagagtgtgttgcgcagaatcagaagaacagggtccacgacagcgttgtgttcatcttttga

SEQ ID NO: 626 - DNA, 1048 bp, Oryza sativa
  misc_feature (42)..(42): n = any nucleotide
  misc_feature (48)..(48): n = any nucleotide
  misc_feature (54)..(54): n = any nucleotide
  misc_feature (59)..(59): n = any nucleotide
tgcgacctgttcgacggggaatgggtgtggaacgacagctanccgctntaccantccanggactgccccttcctggacagatttgatgccagaaatatgctggagaagttgagaaacaaaagagtagtatttgttggtgattcaattgggcggaaccagtgggaatctcttctttgtatgctctctgttgctgttcctgataagagctccatcttcgaagttaatgggaatcccatcacaaaacacatgggtttcttaattttcaagtttagagactacaattgcaccgtggaatattacagatctccttttatagtccttcaagggcgtgccccacctggagctcctggggttgttaaatatacaattagggtagatgccatggattggttgtctgaccggggccagtggagggatgctgatgtattgatccttaacactgggcactggtggaactacgagaaaacaatcagaagggcacctattttcaagaaggggatgcagttaaaatggacatgactgtcggagatgcttacaaaagatccatacagacattgtttggttggcttcacaatgaggttaactcaagcaagacccatgtcatcttccgtacatatgctcctgtgcatttcagagaggtggtgactggaagactggaggaaattgtcatttggaaactcatccggatgtgacaccagttaaatcattggagcaatgggctgattttcttaaccccgtaaatgatgtactagggaacagcttcaggcccaagcttctcgggttggatatactgaacgtgactcagatgacggctcaacggaaagatgggcacgtctcagtacacctgagtccttcaggccctgtccctctctacaggcaagattgcagccactggtgcttgcctggagtccctgatacctggaatgagcttgtctacaacctcttgttgaaaagacaatctatgataggtcaaaatgtacctcttgttggcaccaaaacactgaaagctggctggcgaaagctaaataagtacaacttgacaatttga

SEQ ID NO: 627 - DNA, 1041 bp, Oryza sativa
atgtcaacactaattgatggtctccctaatgaagttgctcttcagtgccttgcacgggtgccatttttgtcccatcctgttcttcaaatggtctgccattcttggagagcatctgttcgaaatggtgagctttccaaagttaggaatcagattagtgcgactgaagacctgttatgtgtgttagcatttgaacctgaaaacatgtggcagctttatgaccctcttcgagataagtggataacccttcctgtcatgccatctcagattaggaatattgctcgttttggagtggcctcggttgcaggcaagctctatgtaattggtggtggcagtgatcgagttgacccacttactggagaccatgacaggatctttgcaagcaatgaggtttggtcttatgatcctctctgtcgtttatgggtccagagggctccaatgcttgtagctcgcgcaatgtttgcctgttgtgcactggatgggaacataattgttgctgggggcttcacaaattgccgcaaatcaatatcaaaggctgagatttataaccctgaagctgacacgtgggagcctctccctgacctacgtcaagcacacagctctgcatgctctggacttgtcataaagggtaagatgcatgtattgcacaaaggcctaccaacagtgcagattcttgaagatggcaatgcttgggctgttgaggactactcttggctgcaaggtccgatggcaatggttcgtggggagctttatgtgctgagcaatagttgcattatgaagcagcgtggtgtgaatttccctgataagatggtgtcgtgtgcatctgaattccaaagcaggataggttttgggatgattggtttgggagacaacatatatctggttggtggagtaattggacctgggccaagaaatcagtgcatcaagccactatctgatgttgatatcttgaatgttactagtgagagaccaacctggctaccaggatcaccaatgacacattgtcgagggagcatttctggttgtgctttgctgaggatttag

SEQ ID NO: 628 - DNA, 1039 bp, Oryza sativa
gaggtggtgaccgggttgctgtccagcacggcgtcggcggtggtgaagcagctctggtcgctcaaatcgaccgccacaaggacggaggtcgatggtgaagtacgagggcgggtacgcggtggagacggtgttcgacggcagcaagctggggatcgagccgcacgacgtcgaggtcaccccctccggcgagctcctcgtgctcgactccatgaacagcaacgtctacagggtccagctgcctctgtcgcgatccgaagcttgttgctggttcgccggaaggattatccggccatgtcgacgggaggctgcgggaggcgaagatgaaccatccgaagggatttacagtggacgataggggaaacatttatgttgcagatgctatgaatatggcaataagaaagatcagtgatacagggggttacaaccattgctggggggaaatcaatgagaggtgggcacctagatgggccaagtgatgatgcaaaattttctactgattttgaaattcgctacatcagcagtagctgctccctcttggttattgatagaggaaaccaagcaattcgcgagattgcactccacaatgatgactgtgaatatcagtatgaagctggttttccactagggcattgcattgctttttgctgctggtttctttgggtacatgcttgcattgcttcagcgacaggttttagggatggtatcaacagcagatcggcctccactgatcccaaccgaagatcaagctgggaaacatgaggctgaagaggggttcttcacctcaatcggcaagctcatcggaggagcaaaatcatctgcggtagagatattctcacgaaagaaacgcccaacccatcagtaccatcatcaccttcagcagcaaagagccaacccttggccggtgcaaaacgagatcgtctttggtgctgtccaggaggtggacaccaagcggcgaatggtggagatcaaggccgtgaactatggggacacattctatgagcagtacgggatgcggtatcgcaacaattacatcggctac

SEQ ID NO: 629 - DNA, 1021 bp, Oryza sativa
atggccgccccgccgccttcctccccgtcgccgccgccggcggcggcggctgcggcgacgcagcagacgcagccgcacccgcagacgccgttctacgagctcgtcaagggaaactccggcatcgaaaaggtccttctccgcggcacgcgcggtttctccgctgagtctatctttatggagctcaagtaacctcatggaagaatgaccatgcggaggagttgctttttgtcagcaaggctattttcaaacctccaaaagccattcgtggtgggatacccatttgcttcccccaacagtttggaacacatggaaatcttgaacaacatggatttgcaaggaaccgattatggactattgatgataatccaccacctttaccagtaaaccctgctattaaatcttttgttgatctgattctgaggccttctgacgaggatttaaagatctggcctcacagacagttttgagttccgcttgagagttgctcttggtcctaatggggatttgagtctcacttctcgaattaggaataccaacactgatggaagatctttctcttacacatttgcatatcacacatacttctcggtctctgacatcagatcagtgaagtgcgtgttgaagggctggaaacaatggactaccttgacaatttgaagggaaaggagcgttttacagagcaaggggatgctattgtatttgaatcagagttgataaggtataccttgctgcaccttcaaaaattgcaattattgatcatgaaaagaaaaggacatttgtcttgacaaaagaaggacttccagatgctggttgtttggaacccttgggacaagaaggcaaaagctatgcaagattttggagatggagaatacaaacacatgctttgtgtggagcctgcagctgttgagaagcctattactctgaagccaggtgaagagtggaaaggaagacttgcactctcagctgttccttccagttactgtagtgggcagttagatccatgaaggtccttcaaggttga

SEQ ID NO: 630 - DNA, 1014 bp, Oryza sativa
gagctgaagcggcggttggaaacttactatggggtggacgatgaggcagaactaccatctgtcacagaggctgttcttgagcggaagcttgcggatgtgcacagcgagacggacgatgaacttatcgaggagctgcgcagcaaaccactccctgaggttcgtgacagggattttgagtccgactttgaggagatgcacgatactgatgaggagctggacaacttgtacaacgccagacagtatgtggagaaaaagatcaagagtgacgagttctttaatatggatgacgacaagtggaataagatgatcaagaaggctgtggataatggccacctcggtaatatgaacgaatgtgagaatattttggaggacatgctccactgggacaaactattacctgccagatgaaattaaaaagaaggtggaggccaaatttaatgagttgggggacatgtgtgagaagggagagcttgaacctgagcaggcttatgaattattcaaagagtttgaggataagatggtttcagagtgcacagaactaatggaagctgagaacccaactgacgtggatgaattttctaaaatggaaaataagagtgttaagttggacgatccacctggtgagggacctgttctaaggtgggagtcacgtattgtctttgctcctggaggtgatgcatggcatcccaaaaacaggaaagttaaactcagtgtgactgtcaaagagctgggactttcacgacatgccttccgacgtttacgtgaggttgttgggaataggtacaattctggaaaagatgaactcacaataactagtgaaagaggtttgagcatcgggaagagaacaggaaagattgcttgaggacattgtatgctgtagtagaagatgcaaacaaggccaataagttggctgatgatgctagaaatgcatatgttaaaaacagacttaaggccaatgctcaattcatggaaaggttgaaggtgaagacacagaaattgagggtagctgcataa

SEQ ID NO: 631 - DNA, 1002 bp, Oryza sativa
  misc_feature (379)..(380): n = any nucleotide
  misc_feature (479)..(479): n = any nucleotide
  misc_feature (481)..(481): n = any nucleotide
  misc_feature (488)..(488): n = any nucleotide
atgacgtcgccggcgacgacgtacgcctcgccgttcgtgctgtcggtgctcctcctcgtctccatcccggtcatcttcctcctcgcgccgcgcctcctcccgcccaagacgcttccggccatcccggacgccgacgagtccgacgacctcgcgctcttccgccgcgccatactctcctcctcccccgcccccaaggtcgccttcctcttcctcaccaactccgacctcgtcttctccccgctctgggagaagttcttccgcggccaccaccacctcttcaacctctacgtccacgccgaccctttctccgccctcacgatgccgccgacgccctcgttccgcggccgattcgtcccggccaaggccacgcagcgcgctnncccaaccctaatctccgccgcccgccgcctcatcgcaaacgccctgctcgacgacccatccaaccagttcttcgctctcctctcgcaatcctgcatccngntccaccngttccccacgctgtacaacacgctcctctccgacagcttcatcgagataatggacgatgcctacatgattcatgataggtactatgcccgaggcgacgatgtgatgctcccggaggtgccgtacgaccagttccggttcgggtcgcagttctttgtgttgacgaggaagcatgccatcatggtcgtcagggacatgaagctatggaggaagtttaagcttccttgcctgatcaagcgcagagactcgtgctatccagaggagcactacttcccgacattgctggatatgcaagaccccgaaggctgcaccgggtatactctgacaagggtgaactggacggatcaagtcgagggccaccctcacacataccggcctggggaggtgtctgcaagcctgatcaaggagctgaggaaatcaaatgggacatactcgtacatgttcgcccgcaagtttgctcccgagtgccttgagccactgatggagattgcagactctgtcatcctacgtgactaa

SEQ ID NO: 632 - DNA, 1001 bp, Oryza sativa
ttgaggttttctgtagaaactgcacagcatgtttcaaaagttgtcacttggaagcgttctgtatcatctttgtcctcatcatctaagagtccacttacagcagcaatgattaccgatgatgtgggtgatagtaacagtgattttgttgagcaatttgccatggtatctggaagccactcgtctaccttggataggctacatgcatgggagagaaaactacatgatgaaatcaaggctagtgaacatgttagaaagacttatgatgagaaatgtaaccttctccggcaccaatttgcacgaggtctaaatgctcaactgattgataagaccagagctattgtgaaggatcttcattccagggtgtctgttgcgatccaggctgtcgatgcaatatcaaaaagaatagagaagttaataagaatgtggaaaacaatgttggaatgccaccacaaacaattcatcacaatatcactggcataccatgtcaagagtgcgaccacggtgcagcaaggtgagcaccaccacagggccgcaacgcatctctggaacgagttggactgcttttcgtccagcttcaagatctgggtcactgctcacaagtcctacgtcgagtccctcaacgcttggctccagaagtgtgtcctgcagccagcccaggaccgatggaggcgcaagcgcaaggtctctttccctccccgccacgcgctctcccctccgatcttcgttctctgcagagactggctcaccatgatggagtcacagtcactccccacagatgagctctgcaagtctatcaaagaggtggtgcagctcctgcgcgctggatcgcctgacaaagttctcagaggcttcactgaagcattacgaggagctcaagcagaattatgagatggctcgtgatgactacaagatgggtcgatcaaatgcacatcttgtttagtctgatgatgcccatcaaatgcccattttcaaccctgttactgtattctccatcatattag

SEQ ID NO: 633 - DNA, 997 bp, Oryza sativa
atggcggcggtggcggggggatcgcgcgcggctccaccggcggattccgctgccgtggcggcggtggcgaaggaggcggaataccagaagggcgtgcagaagctggtggacctgctgtccaagctgaacccggctgccaaggagttcgtcccctcgtcggcggcggtctcgtcgccgtccaggaaggcgctgtcggcggacgcgccggtgttcgactacaactcgatcggaggctggaacgggggcggcaaggaatccggcgccgacgcctaccagcagcgtcgggaggaggaatggatacctcagtcaaggaaggaggaggatgaacgagagagcaaggcatgcagacagggaagacagcattcggcgaactgtttatgtttctgatattgaccatactgtgacggaggagagacttgctgatatatttgctaactgtgggcaaggtcgttgactgcagaatctgtggtgatccacactcagttctaaggtttgcattcattgagtttgctgatgaagaagagggcgcaagaactgcacttaaccttggtggcacaatgcttggtttctaccctgttagagtcttaccttcaaagacagctatattgcctgtgaatccaaagttccttcctaggccatagacggaggatgagaaggaaatggtcataagaactgtttattgtacaaacatagataagaagaggttactcaattagatgtaaagaatttctttgaagaactttgtggtgagaatcccaaacctaacgtatcagatgttgaggaaccatgcacgcacttatatattttgcattattgttcttggattgatcaattatcgaatatacggtccacaactccttgacagaggcatagggtctgctcggctgcctttgctgttgttggcttgttgctgctgtggctgctgctactgccagcatctgtggccctcaacggcagcaggtgccaaggcatagctgttgtgcagccaatgtactga

SEQ ID NO: 634 - DNA, 990 bp, Oryza sativa
  misc_feature (554)..(554): n = any nucleotide
atgcagcggaacggggtggtggaatgcagcgtgtgccggtcgcggctggtggtgccgagcccgcggagcgtgtccagggcgtacgacaagcaccgcagcaagatatcgtccaagttccgcgcgctcaacgtcctgctcgtcgtcggggactgcatccttgtcggcctccagctgcagcccatcctagtgttcatgtcaaaggttgatgggaagtttcagttcagtcccatcagcgttaactttttgacggaggttacaaaagttgtctttgctatcgtgatgctaataatccagcagtctagaaagcaaaaggttggcgaaaaaccacttctggcacgttcaaccttcatccaggcagcccgtaataatgcactactagcggttccggcccttctgtatgccatcaacaattacctaaaatttatcatgcagtatgcagctgtacttcaatccgtcaactgtgaaaatgctaagcaacctaaagctctaggtgctggtcattgctgttcttctgaaatttataatgaaaaggagattctccgtaattcaggccntgaaaagccaatatgatactagtatatatcttcagttgcagaatttgtttttatatggatatggtgcaatattcaacttccttggcattcttgggactgccttattccaaggggccagagagtttcaatattcttcgaggacattcaagggctacgatgtttctcatatgtaataatgctgcgcaaggcattctttcttcattcttcttcaagtatgcaggcagacacaattttgaagaagtattcgtcaactgttgcaacaatttttactggtctagcttctgctgccttcttggggcataccctgaccattaattttctactgggcatatcagttgtgtttatttcaatgcaccaggttcttctctccactcgctaaagccaaagatgacaaaccagctgaattgttagagttggaagatacacagaatcatcg

SEQ ID NO: 635 - DNA, 984 bp, Oryza sativa
aggtatattctctggattggacccctgaaaagaattggatagtcagtgcctcacaagatggaaggctaattgtatggaatgcattaacaagtcaaaaaacacatgccataaagttacattgcccatgggtgatgacatgtgcatttgcacccaatggccaatctgttgcctgtggtggtcttgacagcgcatgctctatcttcaatcttaactcacaagcagacagagatgggaatataccagtatcaagaatacttaccggacacaaaggctatgtttcatcctgtcagtatgtcccagatcaggaaacccgcctaattactagctctggtgatcaaacatgtgtcctgtgggatgttactactggccaaaggatatcaatatttggcggtgaattcccatcagggcatacggcagatgttttgagagcttgtccataaactcatcaaattcgaatatgtttgtttcgggttcatgtgatgcaactgtaaggctgtgggatatcagaattgcaagccgggcagttagaacatatcatggtcatgagggtgacattaacagtgtcaagtttttccctgatggccagaggtttggtactggttcagatgatggaacgtgtagattatttgacgtgagaacagggcaccaacttcaagtatacagtcgggaacctgatagaaatgataatgaactcccaactgttacatctattgcattttcgatatcaggaaggcttctttttgctggatactccaatggtgactgttatgtgtgggacacacttctcgctgagttctgataggtggtacttaatttgggaaacctccaaaactctcatgaggggcgtataagctgccttggtctttcttctgatgggagtgcattgtgtacaggaagttgggacaagaatttgaagcagatttgggccttcagcggacaccggaaaatagtttgaaggacagttttcttcctgtgttgttgtaa

SEQ ID NO: 636 - DNA, 982 bp, Oryza sativa
  misc_feature (307)..(307): n = any nucleotide
atgcaggaagctcttctacctccggctcatccaggccgcttctactcggactttggcccgaagccgttcggcagcggagatcaacggctctcctcgcccaacctgctgaccaacggtggagatctcttctacggctgctactcccccttcagccctacccgcgtgctctcgccgccgccgccgcggcgcgccgcctcgttctcccactgctcgtcctcctccgactccgtcgtcgacgacggagatggtgcgggggcagcggcagcgacccagtaccaggagatggccaaccgcttcgagctctgcntctcccacctcgccgatgccgcggacgaggcggccgcgctccgtcaggagaacgccgagctccgcgtcgccaacaacgacctcgcatgccgcatcgccaagttcggcggaaggcagagctccgccatcgccctcgccggtgacctccgccgcctccgcctcccccgagaagcaggctgttcttccgaagagcatctccatccgttcgaccggataccagaagctgaaccagggcggcaagcatcgcgtgtcgaagccggtgaacgtcggctcggggctggagttcgaggtgtacaaccagggcatgttcaagacggagctgtgcaacaagtgggaggagaccggggcttgcccctacggcgaccagtgccagttcgcccacggcgtcgcggagctccgccccgtcatccgccaccctcgctacaagacccaggtctgccgcatggtgctcgccggcggcgtctgcccctacggccaccgctgccacttccgccactccatcacccccgccgaccgcttctccttcggccattgatcatacgtgtcagtccatcaccgatcgccactctctcactccctcctaatctcctctctctttgataatgacatgaaaagagggggaaaaaaagaagaggccgtaaataaggtatactatttagttgcacaaagcaaatga

SEQ ID NO: 637 - DNA, 969 bp, Oryza sativa
  misc_feature (6)..(6): n = any nucleotide
  misc_feature (12)..(12): n = any nucleotide
  misc_feature (16)..(16): n = any nucleotide
atgganatcgcngacntccccatcgcagatttgagcattgaggtacatgaggctgaagaaatctcaagttgccgtgggcgccaacaagtccaagggagcagatgggcctagcaccagcagtgttctcaaagaggtgtgcaaaatgcatgggatatgctatctgatgagcaatcacggaggcacatcaatactggatctgctgacctcaacaacatccttggtggagggattcactgtaaagaggttactgagattgggtggtgtcccaggagtcggtaaaactcaactgggggattcaactagcaatcaatgttcaaattccagtggagtatggtggacttggtgggaaagctgtttatatagagatacagagggaagtttcatggttgaacgtgtctaccaaattgctgaagggtgcatcagtgatatactggagtactttccacactgccatgacaaggctccagccggacaagaaaaactgaagcctgagagtttcctggctgacatctactactttcgaatatgcagctatactgaacaaattgcagtcataaactatctggaaaagtttcttggggagcataaagatggtaagaatagttattattgacagcgttactttccactttcggcaagattttgatgatatggcactaaggactagagtgcttagtggattatcattgaagttgatgaaactttcaaaggcatataacttggcgggttgtcttgttgaaccaagttactactaaattcacagaaggatcatttcagttaactcttgctctagaggtgacagttggtcccactcatgcaccaatcgactaattctgtattggaacggcaatgagcggtatggattcctggacaagtccccttcactaccagtagcatcagcaccatatgcagtgacagttaaaggggtgagagatgctgtgaattcaaacagcaagcgagtccgggtaa

SEQ ID NO: 638 - DNA, 961 bp, Oryza sativa
gacaaagtccgggctggtgttcttgtgggaactggcatgggtggcctcactgtgttttccgatggtgttcaaaaccttattgagaagggatacaagaaaatttcgcctttctttatcccatacgctataactaacatgggctcggcattgctagcaatggatgctggttttatgggtccaaactactcaatttcaacagcttgtgcgacctccaactactgcttctatgctgctgccaaccatatacgtcggggtgaggctgatgttatcgttgctggtggtactgaagctgcaattattccaattggccttggaggttttgtggcctgtagagcactatcgcagaggaacgatgacccagaaactgcatctaggccatgggacaaagagcgagatggttttgttatgggcgaaggtgctggtgtactggtcatggagagcctggagcatgcgatgaagcgggatgcaccaataattgctgaatatttgggaggtgcagtaaactgtgatgcttaccatatgactgatcctaggtcagatggactgggtgtatcgtcctgtattactcagagccttgaagatgcaggtgttgcgccagaggaggtaaattacatcaatgcacatgcaacttcaactcttgctggtgacttggctgaagtaagagccattaagcaagtcttcaagaatccatctgatattaaaatcaattcaacgaagtctatgataggccattgcctaggtgccgctggtgggttagaagctattgccgttgtcaaagccataactactggatgggtgcatcctactattaaccaatttaaccccgagcctgaagttgattttgatacagtagccaacgagaagcagcagcacgaagtgaatgttgcaatgcagctatctctaattcatttggatttggaggtcacaattcagtggtagtatttgcgccattcaagccatg

SEQ ID NO: 639 - DNA, 937 bp, Oryza sativa
tcaaagaaagacttggctctacaccaggctattgatcaaataacatctgcatttgggaagggcgcaataatgtggcttggtcgttctgaaggtcgtagagaagtacctgttgtgtcaactgggtctttctctttggatttggcattgggaactggtggacttccaaagggtcgtgttatagaggtgtatggtccagaagcttcaggcaagacaactcttgcacttcacgttattgcagaagcacaaaagcatggcgggttattgtgccttcgtagatgcagagcatgccttagatccagctctggctgaatcaattggggtcaacaccagtaatttacttctctctcagccagactgtggcgagcaggcactcagtcttgtggacacactgattcgaagcggctctgttgatgttgttgttgttgatagtgtagcagctcttgtccctaagagtgagcttgacggggagatgggtgatgcacatgttgctctccaggctagattgatgagccaagctcttcgcaagctgagccactctctctcactttcccagacaattttgttattcattaaccagaggtctaaagtgaccacatttggaggatttggaggtccaatggaggttacttctggtggaaatgcccttaaattctatgcttccgttagaatgaacatcaagcgtattggtttggtaaagaaaggcgaagagactataggtagtcaagtgcttgtgaagattgtgaaaaacaagcatgccccaccgttcaagacagcacagtttgagctggaatttggtaaagggatatgccgcagttcagagcttattgaacttggattaaagcacaagcttgtcaaaaagttgggtggtgcattttattctttcaacgaagagtcatatcgtggtaaagatgcccttaaatcttacctcaacgaaaat

SEQ ID NO: 640 - DNA, 934 bp, Oryza sativa
  misc_feature (618)..(618): n = any nucleotide
  misc_feature (622)..(622): n = any nucleotide
  misc_feature (816)..(816): n = any nucleotide
atggtgctgctgcaggtggggttcgcggggatgtacatcgtctccgtggcgtcgctgaagcgcggcatgaaccacttcgtcctcgtcgtctaccgcaacctcgtcgccaccgtcctcatggcccccttcgccctcctcctcgagagaggcccaagatgacactgagaatcttcctcaagatcatggggcttgccattcttgagatcagaacctatactacatgggcgcgaagctgacctccgccggcttcgcctcggcgctcgtcaacatcctccccgccgtcaccttcctcctcgccgtcctcctcaggatggagaaggtcaggctccggagcctgcacagccaggccaagatcgccggcacggtgttcacggtggccggcgccttcttcatcctccagaacaacacgctgcagagctacccggccgagctgtcgctgacggcgctcatctgcgtgctcggctcggcgatgagcggcgccgtcgcgctcgtggcggagcgccgcgacatgagcgtctgggtcatcggcttcgacacccgcctcttcaccgccgtctactcggggatagtgtgctccggcgtggcgtactacgtgcaggggctcgtgacgagggcgcntggnccggtgttcgtcacggcgttccagccgctctgcatgatcatcaccgccgtcttgggctccaccattctcaaagaagagatcactcttggaagcagtgtgatcggcgcggtgatcatagtggtggggctctacgcgctcatctggggcaagggcggcgaccacgccgacaacggcaagccgccggccgccgccgnggccgcgccggagaagggcttgccattgaccacgctgcaggccaacggcgacggcgacggcaagcttgctgtgctcgtcgccgacgtcgagatgccggcggtgaaggatgtctactag

SEQ ID NO: 641 - DNA, 926 bp, Oryza sativa
cctgttgtaaggtctggaggttgggctgatattgggtcaaggcacacaatggaggatgtctttatttgttctgataacctcatgaaagagtttggagttgaaagttttgaagatggtccgagcgcattttatggggtttttgatgggcatggtggaaagcacgctgctgactttgtgtgcagcaatttggcaaggtttatcgttgaggatgaggattttccaagggagatagagaaagctctgtcctcagcgttcttacagactgatgctgctttcgcagatgcttgttctgtgaactcctctcttgcttctggcacaactgctcttgctgctcttgtggttgggagatttttcataggtcacttctggtagcaaatgctggtgattgtagagcagtactttgttgtcgtggaaaagccattgaaatgtccagggatcacaagccttcttgcaacagagagaaggttcgcattgaagcctctggtggttatgtttatgatggctacctgaatgggcagcttaatgttgcgcgggcaataggagactggcacatggaaggaatgaaggcatgtgatggtcttggacctcttagtgctgagcctgaggtgatgatcaggaatctcactgaggaggatgaattcctcatcatcggttgtgatgggatctgggacgtattccgcagccaaaatgcggtagactttgcacgccgaaagctccaggagcacaatgatcctgttacctgttgtaaagaacttgttgatgaggccatcaagaggaagagcggcgacaacctttctgttgttgtcatctgcttcaactctcggccgcctcctgtcctaacaactccaaggcctcgtgtacagaggagtatatctgcagaaggcctgagggagttgcaaagctttcttgatagcttggctgattga

SEQ ID NO: 642 - DNA, 920 bp, Oryza sativa
cagcctaaacggcgcacagtgctcaaggatgtaaccaacatcggctgtgccaactcatccaaaaattgcaccaccacgagcaagctgcagttaggttttatagatattgacaatgataatggaaatcctcaaatgtgtgcttcctatgcttcagagatatacacaaatctgatggcctctgagtacatggaggctttgcaacgtgacatcacaaagggcatgcgaggcattctcattgattggcttgttgaggttgatttctcttgatgtttctgaagaatataagcttgtgccagacacactctacctaaccattaatcttattgaccgatttctttctcaacattatattgaaagacagaaactccaacttcttggaataacaagcatgctgattgcctcaaatatgaagagatatgtgctcctcgtgttgaagaattttgtttcataactgacaatacatacacaaaagctgaggtgctgaaaatggagggcctggtgcttaatgatatggggtttcatctatctgttccaacaacaaaaacatttctcagtttatcaggagattccttagagccgcacaggcttctcgtaatgttccttcaattaccttgggatatctggccaattatcttgcagagctgaccctgatcgattacagtttcctcaaatttcttccttcagtggtggcagcatctgcagtctttcttgcaagatggacacttgaccaatctgacattccatggaatcatactcttgagcactacacttcttacaaaagctctgatattcaaatatgtgtctgtgctctacgggaactgcagcataacaccagtaattgccctctcaatgctatacgtgaaaagtataggcaacaaaaggtacatgatcaccacttcaccagcttcttgaggtactag

SEQ ID NO: 643 - DNA, 919 bp, Oryza sativa
atggccgaccacgctgcggcggaggcggcgccgcagtcgtcgcaggaggaggaggaggactggaaggaggccgaggggggagacggggacgtcgaggtggcggacaggggcggcggaggcggcgccgccaatgggggaatcccggaggggaggccgatccgggtctacgcggacggaatctacgatctcttccacttcggccacgccaagtcgctcgagcaggccaagtttcctaacacatatctccttgtcggatgctgcaatgatgagttgacacataagtacaaagggagaactgttatgacagaggatgagcgatatgaatcacttcgtcactgcaatgggtggatgaagtcattcctgatgctccatgggtggtaacggaagaattcttgaataaacataacattgattttgttgcacatgattctctgcctatgctgatgctagtggagctggtaacgatgtctatgaatttgtggtcaaaaaacttggtaaatttaaggaaacccagcgcacagatgggatatcgacgtcagatattataatgcggattgttaaggattataatgagtatgttatgcggaacctggccagggggtacaccagaaaggatcttggtgtcagttacgttaagcaggaaaaaagactgagagttaacatgggattaaaaaacctgcgtgacaaagtgaagcagcaccaagaaaaagtaggggagaaggagtgggtggaaaatgcagatcgatgggttgctggttttctggagaagtttgaagaaggctgccactcaatgggaactgccatcaaagagcggatccaagagaggctcaaggcgcaatccagggatttcagccttctacagtatgatggcgaggatgttgacgaggatgaggacgacgacgaatatgtcagagaataa

SEQ ID NO: 644 - DNA, 853 bp, Oryza sativa
  misc_feature (635)..(635): n = any nucleotide
atgatgtccttcagccagcccgacgccttctcgccgtcgcagttcacctcctcccagaatgccgccgccgactctaccaccccttccaagtagagccggggcgcatcgagcaccatgccgctcaccgtgaagcagatctctgaagcgcagcaatctggcatcaccggggagaagggcgctcccttcgtcgtcgacggcgtcgagacagccaacgttaggcttgtgggattggtcagtggcaagacggagcggaacaccgatgtgtccttcacgatcgacgatggcaccggccgcctcgatttcatcagatgagggtcaatgatggtgctgattctgctgaaaccgctgctgttcagaatggaatgtatgtttctgtcattggtagcctcaaggggcttcaggagaggaagcgtgctactgctttcgctatcagaactgattataatgaggtcacactgcatttcattcagtgcgtgcgaatgcatttagagaacaccaaatcacagagattggtagccctgcaaaaacatattctgccatgggatcctcatcttccaatggcttcagtgaaatgaccactccgacctctgtgaaatccaacccgggcaccagtgctcagtgtaacaaatggatcnaaaactggatttgaacacagaagtgctgaatgttttccgcgaaccagcaaacgtcgagagcgagcatggtgtgcacattgatgaaatcgtgaagcgcttcaggctaccggaggccaagatcaaggtagctattgattacctcgctgacattgggcacatatactcaacaatcgacgagtctcactacaagtcagcgttcaatgaataaaggggattga

SEQ ID NO: 645 - DNA, 851 bp, Oryza sativa
atggcggagggtggcggcggaggaggagggtcggcggcgtcggcggcgctgaaggatcaggggaacgagcagttcaaggcggggaactacctcaaggccgccgcgctctacacccaggccatcaagctcgaccccgacaaccccaccctctatagagcaatcgggctgctgcatttctccatctagttaagcttaataaggcactcgctgatgctgatacgacaataaaactcaagccacaatgggaaaagggtcatttcaggaaagggtgtgttttagagtcgatggaacactatgaggaggctttgcaacacaatccacaaaatacagaagtttcaagaaaaattaagaggcttactcagttggcaagggaaaagaagcgggctcttgatgtggagaacatgcgttctaatgttgatgttgcaaagaacttggattcactgaaaaccgagctggctataaaggtctggcatgacaccggaaaagtagatgcaagagttaattttcttcttgatgaccagaagactgatactgaaaaacatgccccagtggttaacattgacaaggcctttgactcaccccacactcacagcagttgcttcacatttttgcggcaatattccgaggagtctttctcaaaggctgcttgtatggtagcacctaagagcgccatctcgtaccctcagtatatacaggtctggaaaggacagggatcaagaaaatggaagcttgaccagagtgatggtttctttgtgcaatttgagtcaccaattctgcggaagatatggtttgtccctagcacaactgaaaagggacgagtattatgcaggtacttatccctttcttcatga

SEQ ID NO: 646 - DNA, 840 bp, Oryza sativa
  misc_feature (270)..(270): n = any nucleotide
atggagaagaagaagcagaagagacagatcaaagatcaagatgttcagagcattgcagatcgtcctcaggggttggctgggaaggtggcggtgatcaccggcgcggcgagcggcatcggcaaggcgaccgcggcggagttcgtcaggaatggcgccaaggtcatcctcgccgacgtccaggacgacgtcggccgcgccgtcgcctcggagctcggcgcggacgcggcgtcgtacacccgctgcgacgtcaccgacgaggcgcaggggcanctcgacgtcatggtcaacaacgccggcatcgtgggctccctgtcgcgccccccgctcggcgccctcgacctcgccgacttcgacgccgtcatggcggtgaacacgcgcggcgtcctcgcgggcgtcaagcacgccgcgcgcgtcatggcgccgcgccgccgcggcagcatcatctgcgtggcgagcgtcgccggggtgctcggcagcgtgacgccgcacccgtacagcgtgtccaaggccgccgtgctcggcgcggtccgcgccgccgccggcgagatggcgcgctccggcgtgcgcgtgaacgccatctcccccaactacatccccacgccgctggtgatgcgcatcatggcggagtggtaccccggggcgagcgccgacgagcaccgccgcgtcgtggagcgggagatcaacgagatggagggcgcgacgctggagcccgaggacatcgcgagggcggcggtgtacctggcctccgacgaggccaagtacgtgaacggccacaacctcgtcgtcgacggcgggtacaccgtcggcaaggcgcccaacctgccggcgccgccgcaataa

SEQ ID NO: 647 - DNA, 826 bp, Oryza sativa
atggcttatgacagttttgcttattgtctgtgcagacgtaggaaagaagaggctggagagcctgaagcagatccagaacgagatcaaaggacagtatttgcctaccagctgaaggcggatgaaagagacgtgtacgaattcttttcaagggctgggaaggtccgggatgttcgcctcatcatggaccgaaactcgcgccgttctaaaggagttggtacatcgaattctatgatgttatgtctgtaccaatggcaatagctctttctggccagctgcttcttggtcaacaggtgatggttaagccatcagaggctgaaaagaatttagttcagtcaaatgcttcttcaagtggagcagcttcaggtggggcaagaaagttgtatgttggaaatcttcactcaaatattactgaagatcaattgagacagttcgaaccgtttggtcaggtggagcttgtccaattgccactagatccacttactgggttatgtaaaggttttggttttgttcaggctcagagtttaaatgggcaacttgatatagctggacgtgtgattaagcccagtgaatgcctattgcttaaaaatatgtttgatccatccgtggagacggaccctgattttgatttggatatcaaagatgatgtccaagaagaatgctccaagtttggccaagtaaaacacatttttgtggacaaggctttgtgtaccttcgatttgacagtataacagctgccatgagtgcacagaaagcacttcatgggaggtggtttgcgggaaagatgattacggcaacatttatggtatggaatacaacatttaattga

SEQ ID NO: 648 - DNA, 808 bp, Oryza sativa
  misc_feature (543)..(543): n = any nucleotide
atgctgctccggcgacccctccacacccttcccatcctccccctcctcggccgccacctctcctcctcctccgccgccgcggaggcggtcaccgcggaccaccaccaccaccacgacgcggacctcctgtcgccgccgttcgactacctcccgggccacccgcggccggacgcgaagcacgacgagctcatcctcgccgtgccgcgcgcctcctcggggcggcacgtggcggccaaggagcggaaggccgggcgggtgccggccatcgtgttcgagcaggagaacgggcaggagggcggcaacaagcggctggtgtccgtgcagtccaagcagatccgcaagctcgtcgaccacctcggccgctccttcttcctctcccgcctcttccgcctccaggtctggtccgagcacgccggccagggggagctcatcgagagcgtccgcgtccttccccgcaagcacttacatgcaggaactgatgagcctctgaatgtgacattcatgagagccccttcttcagccctactcaagatagatgttccnttgatgttcatcggagaggatgcatcgcctggtctcaggaaagggggcttacttcaacaccataaaacgaactgtcaagtatctgtgccctgctgacatagtgccaccatacattgaggtggatttaagtgagttggatgtcggacagaaactgttgatgcgtgatctcaaagttcacccagctctgaggttgcttcagtcaccggaacaacccatctgtagcattataggatcaagagcacctgatcagaagaagtcaaaataa

SEQ ID NO: 649 - DNA, 805 bp, Oryza sativa
aacctttcttcagaagtgtcagcaatatatcttgccatgcagcagtccaagttggagtgcattgatgaacatagtcaagattcaatctcaacagaaggttatgttgatcctgaggacactgaggaatatgatgattttgatccatatgcttttatcaaggatttgcctgatttatcactagtggtccccaagtttcgccctgtcctactccccaagcaaactcggagttgtcctacaactaccctggtacttgatctggatggaaacacttgtgcattcaactcttgaaccatgcgaggatgctgacttcgcatttccagtttattttaacttcagagaacacacaatatatgtccgatgccgtccctatctcaaagagttcttggagagggttgccaatttgtttgagacaatcattttcactgcaagtcaaagcatttatgcagaacagcttctcaatgttcttgatcctaaaagaaagttgttccgtcatcgtgtttaccgtgattcctgtgtttatgtggagggaaactacttaaaggatctaacagttcttggacgtgacttaactcgtataatgattgttgacaactctccacagcaggcttttggattccagttagacaatggcattcctattgaaagctggtttgatgatcccaatgatcaggagctgttgaaactgctcccattcttggaaagcctggttggcgttgaggatgttcgaccatatatagccaggaagttcaacctccgtgagaaggtagcaaccgcatcgtctctttcaatggacctgcaaatgtga

SEQ ID NO: 650 - DNA, 804 bp, Oryza sativa
gcgcacagcttcaccttcaaggatctgtcagtggcgaccggctacttcaacgaggcgaatttcatcggagaaggtggctttgggaaggtgtacaaaggcaagatcaatgggcaggtggcagtgaagcagctcacccgggacggcgtgcaggggaggaacgagttcttggtggaggtgctgatgctgaccgtgctcaaccatccgcatctcgtcagtttggtcggcttctgcgcgcagggtgacgagaggctgctggtggtgacgagtacatgccattcggcagcttggagagccatctcttcgggcaagcagccactggactggaatacacgcatgaggatagctgttggagtggccgaagggctttcgtatttgcacaatgtggctgatccgcctataatttaccgtgacatgaaagcagctaacattctgttggatgaggactacagaccaaagctctctgatttcggactagcaaaagttggaccagtcggtgacagaactcatgtctccaccagggttatgggaacttatggctactgtgctcctgactatgtggtgagtggtaagcttaccatgaaatctgacatatacagttttggtgttctcctgttggaactgatcaccggcagaaggatctacgatgcttcaaggcctaaaccagagcagagtttactaacatggctcgctgacccagctctgcacgggtgctatccaacatctgcactaaatcagttggttgtgatcagcatcatgtgcctccaagatcagccccacgtccgcccaatcatctctgatgtcgta

SEQ ID NO: 651 - DNA, 754 bp, Oryza sativa
gccttcgtcgccgccgactggtgtcctcgcctatacggttgcgcctatacggctggcctattatgccactgttggggggcatcttcgctttcaccatcgactgccttcgtcgccgccgactggtgtctttcgccgccgactggggtcttcacctatacggttggttggtcgcaacactattgttaggcgtctacatcttcaccacttcgtcgctgctcatggtgtctttactttcatggttggcctattttgtcgccgttcaaggacgtcttcattttcgtcatcattctacttcttccatcgccgacaggttatgccgccaccgactaatgtttttatcttcacaactacgcgtcttcgctaccggtttgcttctgttgccgccgactcgtgttcacttcatcacagctatgcaactttgtcatcatggtggagcgacttcatttttattatcttcagcaccggcaaactctattgccgctacttcacaagttttgctacttcaccaaccacgacgtctacaagagcttcgacatctcagcatgcgtcaccaaatatgatgccgtgttattttactacaacaagtggtgttccaatcttcaatatttctactcggatatcttcaacatgcatcttcactcaagcaatgactactcgacgacaagaagctatagcttttgactctatgttcagttgtttcccaactaaccaaagagtcgggggctacacaaatacacggctcaaaattcgatag

SEQ ID NO: 652 - DNA, 747 bp, Oryza sativa
atggggcgagggaaagtagagctgaaagcggatcgagaacaagataagccggcaggtgacgttcgcgaagaggaggaacgggctgctgaagaaggcgtacgagctgtccgtgctctgcgacgccgaggtcgccctcatcatcttctccacccgcggccgcctcttcgagttctccacctcctcctggtatgtacaagacactggagcgataccgcagttgcaactacaaccttaactcatgtgaagcatctgctgcactggaaactgaactaagcaattaccaagagtacttaaagttaaagacaagagttgagttcctacaaacaactcagagcagaaatcttcttggcgaggacttggttccacttagcttgaaggagctcgagcaacttgagaaccagatcgagatatccctcatgaatatcaggtcatcaaagagaatcaacagttgcttgatcaagtatttgagctcaaacgtaaggaacaacaacttcaagatgctaataaagacttaaaaaggaagttaaaaagggaattgcagttctttcagcttaactaaaaatcttttttattgcaacagatacaagaaactagtggagaaaatatgcttcatatatcttgccaagatgtagggcccagtggccatgctagtgaagctaaccaagagtttctccatcatgcaatttgtgacccttccctgcatataggggtatcaagcttacatggatcacctcaaccaatgaatga

SEQ ID NO: 653 - DNA, 696 bp, Oryza sativa
atgggccaagtataccctcagaaccattcaccaatcaagaggagtcagttcacatctcatgctggttttttcctgtgctgtagaacacaagacatgctaaagagcaagctcattcttgaggatgattttgggtggaatttactgaagtatataggaggtgttgacattagcttctcgaaagaagacccttccacggcgtgtgctgcactggtagttttagatgctggtaccttagaagttgtccacgaagagttcgatgttgttcggctgcaagtgccatatattccaggatttcttgctttcagagaggtactcatggttgatggaaatggattacttcatccacgagggttttggtttagcttgtcatcttggtgtccttgcagacctgccgaccattggagttggaaaaaatgtattaatattactgccattgcaactactcctatctgcaccatgtggatggccttaaccaatctgaattgagaagacaattagaagcaaaagaaaactgcaacaaggagttgtcgaagccgatctacatctcagttgggcatcgcatttcacttgactcagccattgggatagtgaagttctgtagtaattatcgcattcccgagcccattcgccaggtagaattttgctgatataagatcaaaggtgttccttcaaaagcaccaaaaacttgaagagtaa

SEQ ID NO: 654 - DNA, 690 bp, Oryza sativa
atgacgttctctggtacacaggacaagtgcaatgcttgtgacaagaccgtgcatttcattgatctccttaccgcggacagtattccctaccacaagtcttgcttcagatgcagccactgcaaaggcacactttcgagatgtgcagctattcgtccatggatggggttctttactgcaagacccattttgagcagctattcaaggaaacaggcaccttcaagaagaacttcccctcagttcaggtacaaaggcaaacagtgaacagaaacaggctaagattcccagcaagctgtcctctgtgttctgtggaacccaggacaagtgtactgcctgcaagaagactgtgtatccattggagaagagatgaccatggagggtgagtgttaccacaggacctgcttcaagtgcgcccatggcggctgccttctgacgaacgcctcctacgcctcgcacaacgggatcctctactgccagaaccacttctggcagctgttcaagaagtccggcagctacgacaacctgctgaagcccgcctccgccgccgccgagaacaccgtcgaatccgaggtcgccgtcgcggagcccgcgaaggaagacccggagacggaggaggcagccaaggaagaagaagaagaagcgtcaccggagcaggtcgcggaagctgttgtagaggaccaggagcactcatga

SEQ ID NO: 655 - DNA, 681 bp, Oryza sativa
atggacgcgacggcgccgctgctcagccccgcctccgacgaccgcttctgggaccgcctccgcacccgcgtcgacaccatcctcgaggaccgccgcctcgtcgctccccccgccgccacggaatccgagcgggggaagcggctcagggaggactcgctgatgctggtgcgtggcctcgactccgtcgccgcctcgctggcgcagctctccgacaccctcaccgccgcgcagaaggcggtctcgatggccggaagagcggctgctctggcgagggagctgaagaacatcaaatcggagctgcacttcatgcaggagagatgcggtttgcttgaggaggagaacaagaggctcagagaggggtatgacaatggagttccccctgaagaagatgacctggtgaggctgcaattggaggctctgctcgcggaaaaatctcgactggcgcaggagaacgccaacctgtccagggaaaaccagagcctgattcagctggtggagtatcatcagctgacctcccaggacctcgctgaatcttacgaggacgtaatggaggggatgcggctggacttctcgtcgccgctaggcaagatcgacagcgatgaagaaggcgagcgtgagaaccgaagagttgctgtcactccatctgataagttggaagccttggagtcatctgatgagtag

SEQ ID NO: 656 - DNA, 681 bp, Oryza sativa
agtctgctgcggctcaacgacctgagggacaatccgggggcgcggaagcagaagacccggaagggccgagggatcggctccgggaagggcaagacggctggccgcggccacaaggggcagaaggcgcggggcaccgccagattcggcttcgagggcggccagaccccgctccgtcgccgcctcccccgtcgcggcttcaagaaccgcttctctctgacgtttcagcagccatgtggtctggggaaaattgcaaagctcatcaacgctggaaaaattgattcctctgaattgatcacaatgaagacactgaaggatacaggtgctattggaaaacaaataaaggatggaattcgactaatgggccgtggagcagaggaaattaaatggccaatccaccttgaggtatcaaggacaactgctagggcaaaagctgcagttgaagcagctggtggaacggtaagactggtgtactataataaccttggattcagggcacttctcaagcccgagtggtttgcaaagaaaggccgacttttacctaaagcagcaaggcccccacccaagcaacgagacaaggttgatagcattggccgcctgcctgccccaacaaagccgcttcccttcacaccagaagaattggaatttgcagcaaaacgtgaagctgctcgagtgattgcgtag

SEQ ID NO: 657 - DNA, 677 bp, Oryza sativa
atggctcccgctgttgaagccgtggagaagaagacaggctcagcccccgtcaaggcccctgctctgaatgaaaggatactgtcatctatgtcccggagatctattgcagcacatccatggcatgatcttgagattgggacctggtgcaccaactatattcaactgcggtcattgagattcctaggggcagcaaggttaaatatgaacttgacaagaaaactggactgatagtgaaggtggaccgtgtgctctattcatcagttgtgtaccctcacaactatggattcattcctcgcacgctgtgtgaagacagtgatccgttggatgtgctggttataatgcagcaggagcccgttataccaggatgcttcctacgagcaaaggccattggtctcatgcctatgattgaccagcagggagaggcagatgacaagattattgccgtttgtgctgatgatcctgagtacaagcattacaatgatatcaaggagctcccacctcaccgcttggctgaaatcaggcgcttttttgaggactgtatccttttttatcaacaagaagaatgagaacaaggaggttgctgtcaatgacttcctgcctgcaagtgctgcttatgaggccataaagcactccatgatctctatgctacttacatcgtggagggcttgaggaggtag

SEQ ID NO: 658 - DNA, 669 bp, Oryza sativa
  misc_feature (523)..(523): n = any nucleotide
atggacagtaaggacaaggagaaggagcatgagcagaccgcgtcgggcaggaaccccgacgtgaacgacgtcgaggaggaggaggaggacgaggagggcaacaagcgcgccgtcgtgctcggcccccaggtccccctcaaggagcagctcgagctcgacaagggatgatgagagcctgaggaggtggaaggagcaactcctcgggcaggttgatactgaacagcttggagccggaggtgaaggtgctgaacctgaccatcctgtcgccggataggccggaccttgtactgccgatcccgttcgtccccgacgagaagggctacgccttcgcgctcaaggacgggagcacttacagcttccgcttcagcttcatcgtctccaacaacatcgtgtcaggcctcaagtacaccaacactgtctggaagactggagtaagaggggacattcagtccccagctagagccctacacatatgagggtgaagaggagaccaccccagctggcatgttcgcaagaggttccnattctgctaaactaaagtttgttgatgatgatggcaaatgctacttggagatgagttactactttgagattaggaaggagtggccaaccatccaatgatgtgtggaactaaaaaagggcttcagaaacatgttagctgctagctaa

SEQ ID NO: 659 - DNA, 669 bp, Oryza sativa
atggctaccaccaagcattttgtgttgctaataatccttgtcctccttagcataggaatgaccactagtgctagaactctcttgggttatggcattggaggagaaggtggcggtggtggaggaggaggtggtagcggcggaggaggtggttatggtggatcagggtacggctctggatcggggtatggcgagggaggtggtgctggcgctggtgggtatggccatggtggtggtggaggcggcggcggtggtgaaggtggtggttctggctccgggtatggttctggacaaggttctggatcaggatatggctctggtgcttttggagctggtggttatggaagcggtggaggtggcggaggtggtggtgcaggatctgggtatggctcaggtgagggttatggctctggatatggatcaggtgcaggtggtgctagtggtggtggaggtggacatggtggtggtggcggcggcggtcaaggtggtgggtatggtagcggctcaggctatggatctggcagcggatatggtcaaggtggcggtgcttatggtggaggatatggaagcggtggtggtggtggaggcggcggcggccaaggcggaggatctggctatggttctggctctggctacgggtatggatccggaggaggtggtgggcactactag

SEQ ID NO: 660 - DNA, 647 bp, Oryza sativa
atggaggcccagccgtcgtatcccggtgagattcacgtcatcgtgggccccatgttcgccgggaagaccactgcccttctccgacgcgtgcaggtcgaggccggcactggcaggcaggaacgtggcactcatcaagtctgacaaggacaataggtatggattggattctgtcgtaactcatgatggcacaaagatgccatgctgggctctacctgagctttcaagtttccaagataaattaggaacagaggcttacgataagaggttgatgtcataggtattgatgaagcacagttttttgacgatcttcatgatttctgctgcaaagctgctgaccgtgatggaaaaattgttgtagtcgcagggctagatggtgactacaaaagaggaacaaatttgggtcagttctggacattatacccttggctgactcggtcaccaagctcaccgcacgctgtgagttgtgcggtcgccgtgcattcttcacgctgaggaagacacgggaaactaagaccgagctcattggaggagctgatgtgtacatgcctgtatgtaggcaacactacctggatggtcagattgtcattgaggccacaaggattgtgctggatcttgaaaaatccaaggttatccatgctttcaagtga

SEQ ID NO: 661 - DNA, 643 bp, Oryza sativa
  misc_feature (15)..(15): n = any nucleotide
  misc_feature (57)..(57): n = any nucleotide
  misc_feature (109)..(109): n = any nucleotide
  misc_feature (111)..(111): n = any nucleotide
atgccactggcgaanggggaattcgcgctgccggacgaggtcctggcggtgatgccncgggacccgtacgagcagctggatcttgcgcggcgcatcacggcgctggccntngcagggcgggtgaccgggctggagcgggaggcggcgcggctgagggagtccgccgcggacaaggaccgcgagaacggggagctgcgggagcgcgtcaagctgagcaaggagcgggactcgttggcgcagacgtccaagaagctggcgcgggacctgcagaagactccagaagctacaccaaaaattatgtcaacttctgcttctccgagaagaatgtctacaacagcaacaccaaaattgatgtctggaactacttcaccatcaaaaactcgaattgaaggatacatgtccatgacaccatggtacccctcaagcaagcaatcgtcagcagaggagccgcctatcatacgaacaatttggagcattcttagccaacatcaaggaactcaatgctcataagcaatcaagagagactctcaagaaggctgaagagatctttggtccagacaacaaagatctttacctctctttccaaggcttgctgaaccgaagcttaccatagagcatatgcttcacattggtcccgcttctg

SEQ ID NO: 662 - DNA, 626 bp, Oryza sativa
tccatctggggcgtgccgctcgacgagcgcgccgacgtcgtgctgctcaagttcctccgcgcgcgggacttccgcgtccgcgacgcgcacgccatgctgctccgctgcgccgcttggcgggccgagttccgcgccgacgccgtgctggacgaggacctcgggttcaaggacctggagggggtcgtcgcctacatgcacggctgggaccgggagggccacccggtctgctacaacgcctacggcgtcttcaaggacagggacatgtacgaccgcgtcttcggcgacggcgagcgcctcgcccgcttcctccgctggcgcgtccagggcggcgtcaacgccatcatccaggtcaccgacctcaaggacatgcccaagcgcgagctccgcgccgcgtccaaccagatcctctccctcttccaggacaactaccctgagatggtcgcgcgcaagtcctcgcaggtgttcatcaacgtgccctggtacttctcggtgctgttctccatgatctcgccgttcctcacggagcgcaccaagagcaagttcgtcatcgcgcgcgagggcaacgtcgccgagacgctcttcaaatccggccggagctggtgccggtgcagtacggcgggctgagc

SEQ ID NO: 663 - DNA, 614 bp, Oryza sativa
aagctgtccgcgtaccgggacaggcggttcaccgggacgcaggaggagtacgaggcggcgctgcaggcgtcggtgacggtgtacgtcgggaacatgtccttctacaccacggaggagcaggcctatgagctcttctcccgcgccggcgagatcaggaagatcatcatgggactcgacaagaactccaagaccccctgcggcttctgcttcatactgtaccctctcctttccttcctcaatccgttttttttttaatacaagagattactccagggaggatgctgaagatgcggtcaaatatattagtggaacaatgcttgatgatcgcccaattcgtgttgattttgattggggctttgaagaaggcagacaatggggtcgtggacggagtggtggacaagtattaccatgatcttattctgcatgaataacaaatgtaagggatgagtaccgcacggactacgatcctagaggtggctatggtaagatggttcagaaagagctagaagcacaacgtgagttagttgactatggaggagaagaatcctaggtttcgtgagaaaggtgattctgatgaagaagacgatgattatgataagagacgccggcgctga

SEQ ID NO: 664 - DNA, 571 bp, Oryza sativa
gaggagaagaaggaggacgcgctagcgtatcagccaccgccggaggaggtggtgatgcgggtcttcatgcactgcgaagggtgcgctcgcaaggtcaagaagatactcaggggatttgatgggagtggaagatgttgtcgcggactcgaaagctcacaaggtgatcgtgaagggaaagaaggctgctgctgacccaatgaaggtggtgcaccgtgtgcagaagaagacaggccgcaaggttgagcttctatcaccgatgccacctccggtggaggagaagaaggaagaggagaaaaaggaagagcccgagccaccaaaacctgaagagaaggaggtggtcctgaaggtgcatatgcattgtgaggcctgtgcgcaagttatcaggaagaaaatcctcaagatgaaagggagtgcaatcagcagagccagacatgaaggcatcacaagtgacggtgaagggtgtgtttgaggagtcaaagctcaccgattacgtgcataaacgcattgtacccgtatgcgccgcagctcttcagtgacgagaatccaaacgcctgtgttgtgatgtgagaag

SEQ ID NO: 665 - DNA, 536 bp, Oryza sativa
atgtcgtcctcgtcctcgtcgtcggctgtcttcccactggaccacctcgcggcgccgtcccccaccgagcagctctgctacgtgcactgcaactgctgcgacaccatcctcgccgtgccgtgcagcagcctgttcaagacggtgacggtgcggtgcggccactgcgccaacctgctctccgtcaacctccgcggcctcctgctccctgcgccggcgccggcgccggccaaccagctccacttcggcccttccttgctctcccccacctccccccatggcctcttgccggagaagcgtcagagagtcccatctgcgtacaaccggttcatcaagagatccagcggatcaaggccggcaacccggacatcagccaccgggaggcgttcagtgcagccgcaaagaattgggcccatttccctcacatccattttggcctcatgccggatcaggggttcaagaagaccttcaagcctcaggtaaccagaatcccgagagaattaacgtatactactatgggagacacaagcataacctag

SEQ ID NO: 666 - DNA, 533 bp, Oryza sativa
gaaaagcttattgaggagaagtcaaagaaaattgctaccctgcagagtgagataacttcacttgagcaggcaggcaaggccaatgcccgggctattgagcttgagaagcagctccaaaagacaagtgatgagcaaaagcgtaggattcagaagactgaacatgctcttaaagttgcagagcatggagcttggttgccaccttgcactggaatgaacatgggaaacctgctgttcaggcaaagaaatgggccgagccacatgtagaagctgccaagacgcaggaagccaagaaagtatccaaaccttacattgatcaagttgctaaggccactaagccacatgtcgagaaaattagaatttatttgaagccttatacaaaaagagcagtccatatatatggaaattttcttgagaaggctacagcttatcatcaacagcaggctcaagcaactgtcttggactacctgcaccaacatgaattgacaaaagaatttgcgactgaagagttggcctggtacctggtagggcactaa

SEQ ID NO: 667 - DNA, 511 bp, Oryza sativa
gagatggagatgttcggcgaggacggccgggacggcgtgtggacggtgatggcgaacgtgacggaccccgagagcctgcaccgggcgttcgacggatgcgccggcgtgtttcacacctcggcgttcgtggatccggggggcatgtccggctacacgaaacatatggcaagcttggaggcgaaagcagcagagcaggtgatcgaggcgtgcgtgaggacagagtccgtcagaaaatgcgtcttcacgtcgtcgttgctagcatgtgtatggaggcaaaattaccctcatgaccgacggtttcctaccatcatcgacgagaactgctggagcgatgagagcttctgccgtgacaacaagctgtggtttgcactgggcaagacggcagcggagaagacggcgtggagggcagccaggggtagggacctgaagctggtcaccgtctgcccggcgctggtcaccggtccgggattccgccgccgcaactccaccgcctccatcgcctacctcaaag

SEQ ID NO: 668 - DNA, 505 bp, Oryza sativa
atggcctctctccgcaccattccggtgatcttcggcatcctcttctatgtccttgccagcactgccactgccaccgacgcaccggactacgtcgtccaaggccgtgtctactgtgacacgtgccgcgccgggttcgagaccaatgtcaccgagtatatcaaggattgcaggtgccaaggtcaggctggagtgcaagcactttggcaccgacaaggtcgagcgtgcgattgacggtgtgactgatgagaccgggacatacaagattgagctcaaggacagccatgaggaggacatctgcgaggttgtcctcgtccacagcccccttgcaaactgctctgaaatcgaggccgaaagggatcgtgcccgtgttttgctcaccaggaatgtcggcatctgtgacaacctgcgcttagccaacccactcggctacctcaaggacatcccactgcccatctgcggcgcgctgctcaagcagttcgacctggctgatgatgataacgagtaa

SEQ ID NO: 669 - DNA, 484 bp, Oryza sativa
ggtggtactttctcttctagctcagagattgggtatggttcatccaagagttccatatccgcgtcgatcgattctccgtcctggcctgaagcttggcaagagaacctattttgaagatgtctgtggagggcagaatgtcaagagttctccatctggtgtgagtgtggctaccccatctcctggtctggccaagaaggtgaaggtggctcagcagaacactcagaacccacactgtcaagttgaaggctgcaatgttgatctctcttctgctaaaccttaccatcgaaagcaccgagtctgtgaacctcacagcaagactcttaaagtcatcgttgcgggtcttgagcgacgcttttgccaacagtgtagtcgtgtaggtttcacggtttagctgagttcgaccagaaaaaacgaagctgtcgcaggcgcctccatgatcacaatgcccgcagacggaagccacaaccagaagcaatttccttaa

SEQ ID NO: 670 - DNA, 444 bp, Oryza sativa
atggcaagcaaagcaggtggtgacggcaaagaagccatcaatgagcaaataattgcaaacacttatgggaacatgcggtctgaaatgactcaactttacaccaagattacagaattagagatggaagtcagtgaacactctcttgtgattggcgcaatcgagccactggatcactcaaggcgctgctacagaatggttggtggcgtcctggttgaaaggaccatcagggaagtcttgcctgcggtgcatcgcaacaaggagggccttgaagaggtaatcgctcgcatgcatgaagcactggagaagaaaaagaaggagatcaccgagtttgagctgaagtacaagatcaggatccggaaggcggacagcaacgctgatgaggaagaaggcagcaagaaggaagggtctgctcagggtgttcttgttggtcctgctggccagtga

SEQ ID NO: 671 - DNA, 434 bp, Oryza sativa
atgctggtggggatggaggtggacgaggagtcggcgccggaggagcagtccttcttcgacgacgtcacccgcaactgcgccctcaccaccacccagcagaggctgtacggcttcgcgatatgcttggctgccggattgacgtgcaccttcttgttgcagtcaatgcttgttttcttcaatcctgtgaaattcggggtaacattcacccttggcaatttgatggcacttggaagggcagtacagcgtttcttataggtcccaaaaggcaatttgacatgatgcttgattctgtgcggatatatgcaactgctgtatacattgcaagcatcataattgctctgttctgtgctctcttttacagtctaagctatataccctttgcacgctcggttgtttcgaaggtgatgacgtcttgcttcgacactgaattctag

SEQ ID NO: 672 - DNA, 328 bp, Oryza sativa
atgattgcaaatgtggcttttgcagggcattgcctcggaggcaaggttggtatctgctacggctgcaagcccgcaacgccgatgacctgccggcgccggacaaggtggtgcagctcatccagcagcagtcgctcaagtacgcgcgcatctacgacaccaacatcgacgtcatcaaggccttcgccaacaccggcgtcgagctcatggtcggcgtccccaactccgacctcctccccttcgcgcttcaatgagaacaagaaaccggaaattgaatctgagaggaactgggggctgttcttccctgaccaaagctctatatacagtatag

SEQ ID NO: 673 - DNA, 304 bp, Oryza sativa
atggttgtcaaagcagcgttcgcagttgccatgtttttgctcacaaccaatatgctcgtttctgttgccacacggtctccggataacctcctaaactcttttcctgaagaaacgggtcacgtctactcagcgtcaactgtgcagaagatgaccgaatacaagcccacgactggctcacgaacctgctaaatcaaccacagcttttgctgcatgcgacgtcgctgagatgatcaaaatatctttctatatctgccattttctctgtattgtcgaactgctgatgaactatggtcggaacgcttaa

SEQ ID NO: 674 - DNA, 2217 bp, Oryza sativa
  misc_feature (246)..(246): n = any nucleotide
  misc_feature (1789)..(1789): n = any nucleotide
atgcagggctccaagaccaaatctggccatgccgaggcgaagagcaacggcaaggcggaggcgaagggcacgccgccgacgcccaagagcgccaagattgcgaggaagccggccgtgcccaaggcgccgccgcgcccctccgccgacaagtcccagtcccccggctcggccgaccgcaagaagagcgcctcccggatcaccacccctccagagaagcaagggaaggcgacgaagcccgctcaggantcggtggccccgaagccgtcgcctcaagagccggtggccgttaagccgtcgtcccaggagcaggagcagcaggcgctgctggctgcagttcagcaggagctcgtgaaggccaaggaggagttggtggagaaggagaaggagagggggaaagtcctggatgaactggagcgtgccaagagggcggctgatgaggccaatgcgaagctccaggaggcgctcgctgcgcagagcaaggcggcggaggagtcggcggcggagcagtccggcgatgccgaagcggagcaggcgagcgcgagcatggaggatgagctgcggacgaagctggcgagcatgcagagccagcaggaggctgacatggccgcactgcgttcgacggtggagcagcttgagcaggccaggtatgagctagcggatgcaatcgatgccaagaacgcggcgcttacccaggcagatgatgccatgagggcttcagatgagaatgccgagaagatcaagctcctcgatgcggaggtggcgcatctcaaagggctgcttgattccgaggtagggagctcgtcaaaaggtgctgtggagcacattaggaagcttgaagaagagaactctggattgaagcttgagcttgagaaagcaaatgtcgctgagcagagggcagttgaattggaaggtgtggttgaacagcttgaagttgaaatcgctgatgttaagaaggcgcgcgcgaggtcagaggagttacttggcaaatggaagacaaaagcactggaattggaggtcaggttggaggaagctgatcagtctaacattctcaagggcgagtccttagaatcagcaatgaaagaattggatgcaaaaatgactctgctccaagaaaaagaatctgaaatcgaagcacttcaggataaggtcaggttggagatagaagaccttaggttgaagctcgaagcggcggaagaagaccttaacaatgacaagattgccagttcagaaatggaaaccctgattgaacagaagaacatgctagccaaggaacttgaagctagcaaagctgaagttgagaagattaagaaggccatggagggtcaagcctctgctttgcacgaaatgtcagctcaactgagagtggcgcaggagaagtacctagataaacaagaggagattgatcgtgctcgtgcacaggtagaggagctcaatgtaagtctgcagaatacaaaggagagctatgaggtaatgcttgacgaagcaaactatgaaaaagtttgtctcaagaagtcagttgagagaatggaagcagaaaccaagagtgcgtctgaggaatggcagtccaaagagctaagttttgttaactcaattaaaaaatcagaagaagaaatcatcaacgccagagctcagatggacaagaccttggaggctgtaaaaggcaaagaaagtgaaaatgctgagttacaggagaagttgaagcatcttgaagctcagctaatggaagctaacaaaacatgcgaggaagccaaggccgagaccttccagtggaaggaaaagctactagacnaagaaaatgagttgcagaacattaaaccagagaacgatgatttgcaagcaaaggaacttgttgcttctgagaagataaaggagctctccgtgcttgcaaatgcaaaagatggagctacaaatggtagtcacaaggaagaaagtaatgtcaagggggacagcgaggatgatgaaccggtaatggtagttgcaaagatgtgggagaacagcaaggttactgatgatgcctcatctaaggagaagggaaacgatggtgaatcagaagttgatttagagtccaacacgggagattccattgttgatggcaatggtttgcactccacgacggcgagcaatggcaacgcatcaccgcccaagcagcagccgcaaaagaagaagcccttgctgaagaaatttggtggtctgctgaagaagaaaacccaaccttag

SEQ ID NO: 675 - DNA, 1827 bp, Oryza sativa
atggtgtacccgtcgagatggaatttcttgacttcaatccaaattctcgattacggcaagacaggagacttagtcgcatgctccgtaccttctcggttgacatcggagattaacctagacaaacccaatatagtgcctacaaagactgataagaggaatctagcaggccggcaagagggatctagcaccatctctgatgtcgacgagatcatattcgaggaggaagactaccccctcatcgactgcgagttggtgtttatgccgccaagtcgacgacgatccgttcctccggcgaaaagcgacggcgactttgttgacgctgcggcctcttcccgaccgcgcagcaaagatttgaggtcaccaatggatgattcaacggatgacgattcgtatcatccaagaaaacactatgcttatgatcgtcaggtttcttcaagcagatggcgtaccagccgcgagtatatcagaggtcccggccccgaaactcatactactgagagtgctcaagatggacaggatccacctgctggagtatattcctatggttatttttctggcagtggtaatgatcctcaagttcaaggacactttgttccggagattcaaaagtacaacccttacgtgattttcaaaggtgaacaactcccggttcctatatgggaactgccagaggagaaggtccaagattttcatgataggtactttattgcaaaagacaagagtcgagttgaagccaggaagactctgaataggttgttagaggggaacatcaatacaattgaaaggggacatggatataaattcaatattccaaaatatacagataacatggagtttaatgaggaagtcaaggtttctctagcaaaagcaggcaagaccataagccgttccttttgcaatgcgaatcagcgggaagttgcatctaggactggctataccattgatctaatagaacggacacttggggctggattgaacatctcgaagagaactgtcttatacacaaacaaggatctgtttggggatcaaagtaaatcagatcaagcgatcaatgacatctgcgctttgacaaatatcagaaggggctctttgggtataatagcagctgaaaaaggaattgtagttggaaacattttcctggaattgacaaatggcaaatcgattagttgttctattggagtgcagataccacacaggcttgaccagatcaaagatgtttgtgttgaaataggttcacgcaacatagagtatattcttgttgtggaaaagcatacaatgttgaattatctactagagatggactatcacaccaataacaactgtataattctgacaggatgtggcatgccaaccctccaaacaagggatttcctcagattcttgaaacaacgcactggactacctgtctttggactttgtgatccagatcctgaaggtataagtattcttgctacgtatgctagagggtcttgcaattcagcatatgacaatttcaatatttccgtgccatctatttgttgggttggattgtcatcctcagacatgataaagttgaatttgtctgagaccaactactcacgtttgtctcgcgaggacaaaactatgttgaagaacctttggcaggacgatttgtccgatgtatggaaacgcagaatcgaagaaatgataagttttgacaagaaggcctcttttgaagctattcatagtttggggtttgattattttgcaaccaatttgcttccggatatgattaacaaagtacgagaaggctatgttcaggttcaagagaaaaaagagcctcaagacactgaagccagtgaggactga

SEQ ID NO: 676 - DNA, 1305 bp, Oryza sativa
  misc_feature (219)..(219): n = any nucleotide
atgcgacgcctcgagcccgggctagggttccccgactccgcctccgccgccgccgcggccgaccgacgccaccatcccgcacgacggaagaagccgccgccgcagcggcgaaggcgaccggcggcggccgcagcaccggcggtggggcctcgcggcgcgaccgatccagatccagcgccctcgccgctgcgcgtgcacggcatcggcatcggcagccangcctcgcgtggcacggcaccgcgaggtgaggaggaagaggaggaggaggagtggagaggcgacggcgacgcgggctcggaggaggaggagggggaagcggtcagtgactccttctcccactcgctgagagagtgccagaagcagcggaagctcagagcggagggggctgcgttgctgctttcaccggccaagcatgagctcaccggcggaggtggtgggagcatagaactgctggtgctctcgccgaggtgcttggttggggagcacgtgcgcaatggtgacttcagcagtggaagaggtagaagtggggatgatggcagtagccgatcttactctgcagagaaggacccatatatcttgagatcagcaagtatacatgcgtggacagagacacttatggaagcatccgcctttgctaatatctcagaagaaactgcacaagatgataaattgcaaggcctgcgaggagaaactcctgccatttccagtccaataataaagaaagatgttgccacacaaatgagtcctgatgacagtatatcgtcttctccaaaagcaagacattcatgttccagtttaccatcaggacatcctattaaagaaccaaatagtaatgcacttaaacctgaagtccgagatgtccaggtagatgatcaagtaactgtgacccggtggtccaagcgacatgtaacacgagggtctgataggcggtcaacaaatattgtcgagtggaggaagaaaacaattgagactcgagctccatcttttgatgaaaaagaaagagaaagctgcgtatcaaagtgcaagagggaggaagcgaagatcactgcttgggaaaatctgcagaaagcaaaagcagaggcagcaattcgaaagttagagatgaagcttgaaaagaagaggtcatcatcgatggatagaatcttgggcaaactacgcactgctcaaaagaaagcgcaagacatgcgtagtgcagtttctgacgttgcagctcatgtcagccaacaaatcagaattaatcaggaagtcagatttttccttgctgtggcagctggagacatccaggatgccaatagttatttgtga

SEQ ID NO: 677 - DNA, 1197 bp, Oryza sativa
atgctctttgacaccttgcagtccatgcttcgtcttaggctgttgcgtcagggatttaaagttaaggatgaagtttggactctaccaaaaccagtcaggccacgccttccaaaacatgagcatgaggcctataccacaagcaagtgcattgctggtaaccaacataagggtggccaggttttggctgagaagtctactggttctgttgagagactagtttcttcggatggtttaggaaatgaacaaaatgatgggcagaacagcaacagtgaaaatcaatgtcaggaaggttgcaaaaacatggtaaaattatgtacccagaatcaggaatattctgagccatcgagtttcgtgaggtatgacgagcatagtaccgttgatgatgtctcgccaagtaccataagcacattgcatgaactttgcactccatcctcaaggggtgataatctaagagaagaagacaaccaaagcctgaatggttcatgggaagagagggcactatggataagtagtcttggttggcctgcaccagtggaagccatgagtccagacagctggaatcaggatgaaattggggatattgagaatcacactcagaatgaatttaatgatcgcccctggatagattcccctaactcatggagatcattgtgtgttgccacacaagcagacagcggatattatgatgagcgcttatactggagacagaatgatgaacaacagaatgctgatcagagggtatctgcacagtgttcattagcacctgtctcccatctccaccaacaagaaggctggcagcattcttcgtttgaacatcaacatcatgaaaaccaaaacttccttgaaatggaggtcagggttagaagtgaaatggcacaggtccatcatgaaatatatgaactacggaagttggtggaaagttgtattgcatcccaagtaaagatccagcactccattaaagaggagatgtgcagtgcacttcgcgaagcagggttgatgccaagccaacccgacacaccagcaaaaaggggaagctgctgcatctgccatcagacgcaagttgactctctactttacaggtgtggacatatgtgcacctgtttcaattgcgccgatcagctgaaatcgagcaacaggagttgcccaatctgccaatctcctattgaggatgttgttcgagcgcatatgaatttttga

SEQ ID NO: 678 - DNA, 999 bp, Oryza sativa
atgaaacaaaaagaaggtatagtggtcaccgttgtgccagtaggtactagaccttttcatgtcgtgattcagcaacgttgttggagactcgagtggagaaggcgttgttggagtgcagcctgtcgccataagattggaggaaacgcgcagtttgtcagtgtgcgaaagcgtcgacagacgttgccggctcacaacggaggtggaggtggaggcagagacggcggcccaatgggacggattcgtcgcaaagaagcgctaggtaaagatataggtatttggtatgcttgtgtaatgtatcgaactgttaatgggcctattggacctgctgggacttttgctgctaacgctaatagcctctctcatctcagtatattcatcagtaaaaagcaatggactgctgcttgtgcagcaccacgagcagcagcagcagcggatggtggagatgcggatggggatggcgatgggcgaggcgtacgtcgggggaggagaggtggtggcgcgggaggcggcggcgcaggcgctgggggcggtggtgcagctgcacttcgacaagacgctggagaagaagcgggcggcggacgcgcagaagcaggagctgtggcgcctcttcctcgccttcttcctcttcctcgccatcctcctctccgccgtcgcccagtccccgccgtcccgcctccagtgccgccacctctgggcccccgccggcctcctctccctcgcccacctcgccttctacgccgccgtcgcacaccacctccgatgcctcaacggattcagcggcgttgccacaagctgaccctggcgctggcggcggacaggctgcggatgctcaagtccggcggcgacgtggtggcggccgccgacgtggaggtgccgtaccaggagccgcccgagagctacctggccaagttcaagcgcagctgggccatccacttcgccttcctcatcaccaccttcgccttctccgtcgccgccgccgtcgccatcctctgcttctag

SEQ ID NO: 679 - DNA, 990 bp, Oryza sativa
  misc_feature (77)..(77): n = any nucleotide
atggcatactggctgacaacaataagtggtgcctactttgatgttaggatgatgtcctccggggatacttttttcgnacatcttctgaaattttctggtgatcatgtgagagtggtgaacgatgaagtggcggtccttgcaggcatgagatgtggcgatggtgttcgtctttataatgatgagctggttgaaacgttgttgcaattatgttcaaacaacacaggggaaggtgtgtcaaaatttggacacagatatttgcaacaaggatattaccgtgcacatgattatggagtacaatttccacaaacagatgaagcagaatttgtgaaaggtgatagtgctgtcgacaacgaaatgattccaggggcagaggctccagaaaacgaccccagtggtggtcggcctcctccccgttcctctcgggagattagtagtaggttcgcccagagggcagcgtccatgcagcttcgacaaatggccgtcgatgctgccacggccgctgtgccgaccgacagatcaacttcgtgttgcatgcgcgagcagcagcatgcagcggcactgcagggcggcgccagctcgatcttcacgttacatgatcagtcgatctcaaatatcgatcagtgcaaggataagatggatcgatgccttttgagttctctagagggccacctgcacacttacaggttctgtgacaatgtatggacattcatcttgactgaagcatcattcaagaacgaggagactacagaacaagttggcaagggtgtagaactagaagagccaccggtcgaaacgtgtctgagaaagttggaaatatcttgccaactctttgctagtacaactagtaccaaggccagcactgcagggaatcaatcagctcagcacagcactgcacagctgaggctgatcagcattcagcaatggcatgcacaagccaacatggaaaaagacaagcaagcagatggatctgccttcaagaaaggacgatga

SEQ ID NO: 680 - DNA, 924 bp, Oryza sativa
atggaaggggaggagattggcctcgtcctcgcccgcgcctccgacctccgctccaggatctccgcctgcgtcgccgcggccggagccagggagccgccggagggcgagggcgagggcggggaggcggtgaagcggctgtgcgatggggaggagggggaggaggaggaggaggtggagagcctggtcggtatcagcaacgcgctcgagtcgctcgagcggcagctcgcctctctgcaggaacagggtatgactggagtgactgtgcaagacctccaacaccaacaaagatatgaacgagagaccattttgagccagattgatcgcagccgaggatgtcttcttaacaagctcaaagaatacaaggggcaggactgtgaagtaatacatgaggctgcttcttttgctggtgaaaaaattgaacatgatgatggtctcatgctacctccgtactcaaatcatgtcaccaattcgtttgttcttgatgatctgtatcctccaagttacttggccaagttaaagtgtatgcacaacggattgggttctggtgggactaaccaagatgttacaaagacaaacaggctggagaacaggaatggtagcatgccaaacggcaattcacaaggaggaattagatcttttgttggatggcttgctaaaactgcagtaatggttgtaggtgctgtatctatcatgaaggctgctggttacgagccagtgataggaagacacagcataaaattggatatggcaggtttgttcagtaaggaggcaaccagtggaaaagatcaggctactgtccaatgccctcctggtaaagtaatggttctcgaagatggcagggctcactgtgttgtgaaggaaagagtcgagatacctttcgacaccaacctcgcctctccaaatgcaagttatgggttaggctga

SEQ ID NO: 681 - DNA, 741 bp, Oryza sativa
atggccgtgtttaattgtgtacaggaagacagttctggggttaaatttctcatacaagagctgtgcatagagccatacaccatagcaaatgcatgggaagctgctgaaggctggcaaatttgggttgatgctgctccaggttgcagggatggacttgtggcagaactcatgttgggagaggttagcgaagacgtctccaaggaccggtttgcccctgaagctggtccaggtgctgcagttgctggagcaaggtggccagggcaagctgacccttttcctcttgacgtcaggactgatgagctcaatattgttgaagtagatcttctggtgcttcacattggttattgtgattgtctggctcgaatgggctgtgggaactattgttgcgttgggaagcttgatgagcatcctgtcgttgggcatcaggaaggtggtgttgtgtgggatcttctcctgcaccatcctgatgagcatgacgaagtggaggcgatgtcgccattgcccaccaccgccgatggggaaggcgtagcagcgacgttggagcctgacactacgagggcaatgagcaggctagcagcaaggaaggaagccatgggggatggatgggggtgtgctgctgctgctgcttgtgcctgcatgcatgcttattacctgcgtgaactactctgttgcatttcaggctttgagcatggagcgttaactgttcttttcccgtatgcttatactggacctgggcgttaa

SEQ ID NO: 682 - DNA, 692 bp, Oryza sativa
  misc_feature (391)..(391): n = any nucleotide
cccaacttattactgccgcaagggccccaatctttgtgactggtattggtggtggaggtggtgggtatggcagcggaggaggagaaggcaatggtggatacggccatggttatggctatggttcaggatatggttttggcaatggaggtgttggcggaggtggctatggaggtggaggtgggtatggcagcggaggaggagaaggcaatggtgcatacggccagggttatggctatggttctggcaatggaggtggtggcggtggtggctacggaggtggtggtggcggcagctatggaagcggtggcatgggttcagggtatggtggtggctatggttcaggctatgattatgggggccaaggtggaggtggaggtcatggaggaggggntggtggtggatctggctatggcaacggtggctatggatctggctttggtgaaggttatggctcaggaggaggtgtaaatggaggtggtggcagcggcggtggtggtggaggaggtggtggagcctcaggatacaggtatggtgcaggctatggcaaaggatatggttacggtggtggtcctggtggtggaggtggtggtgcgggtggcggtgggggaggagggagttacaacggtggaacaggcggatatggagaaggtcatggctcaggttacgggggtggtggcggacatggccattaa

SEQ ID NO: 683 - DNA, 555 bp, Oryza sativa
atgagggtagagcggacaaaaggactgcgcgaggctgtgagttggaggcgaggcaagctgatgtcttcgttatgtggccttgggacgcccacctcaactgtgctgctccaaaagcctatacagtttcgcacgaaggtgctgcacctgccgtcgacgaacccctccgtccgacacacgtttgcgcaattatcttccaccatgcaaaacccctcgaatcggaggctcttcgtctcgcacggcctgactgatgattgcgctggcgccaacgcctctgccaacaactcacacataatattagtccttacggtcgcaaaaataatcggtttagacttttcggatcgaagtataaaacataaatcattttttggatcttaccaaaccgagcggcgccaggatgggctcctcgacgtcgacggcaaccgccggccagccggccaccgcgacctcctcagcgtcaacaccgtacaccagcaacgggaggactgctgcgagcctgcagatcagcaggcgtcaggcggcgtcgcgacaagcatcagccaccagcagataagctag

SEQ ID NO: 684 - DNA, 486 bp, Oryza sativa
  misc_feature (5)..(5): n = any nucleotide
  misc_feature (31)..(31): n = any nucleotide
  misc_feature (47)..(47): n = any nucleotide
  misc_feature (65)..(65): n = any nucleotide
  misc_feature (78)..(78): n = any nucleotide
  misc_feature (83)..(83): n = any nucleotide
  misc_feature (91)..(91): n = any nucleotide
  misc_feature (100)..(100): n = any nucleotide
  misc_feature (126)..(126): n = any nucleotide
  misc_feature (367)..(367): n = any nucleotide
atggngcagatggatcagaagtacaacccanggccttcgacgagatnccagagcacgaacgcgangtttcaacacccngaagnaaggccanggggcgcgngcgccgggatgagcagcagcagcatntgcgcgccgtttgggcaccgcgccgtgtcggcaatgtaccacggcctgaggcgccgcattgccggcgagatcatgtccgccgccgccgcggccggcaggccttgccgcggcggcgagtcgtcgtcggcggtgaccggcggcgagagggagcggagctgggagtcggcgttcatccagaagcactgggcggtgcagcagctgcggcgcggcgagcagcagtgctggcggccgcagcgcggcntcccggagaagtccgtcgccgtcctcaaggcctggatgttcgagaacttcctccgcccgtatccggaagacagcgagaaggagatgctcgcagcaaggagcggcctcagcaggaaccag

SEQ ID NO: 685 - DNA, 414 bp, Oryza sativa
atgaagaagcagaataaggtgttgataatggtgagtgagggtgttgtgctcaatgaatcagccaaccagccatgtttcctgaaccacgagactattgacgaacctgaaagcacgacgacgagcaccacctacacaacacgtcaacacgcagctccccgaaggagagagctcgccggtgaaggaagcagcgacggcgtgggggtagaggacgcttctcggcgaaggaaagggtgcgggcgtgcggcgctgttcaccggaatgcgtcgtgagaactgccgcgcgctggccgcgaatcaatccatgagaagggatgtggatacggatatgggcttttacttctggacgaaattgccccttgctaatggtgattactcggttaatcaacttttaatcctcaccattgacgtgctttaa

SEQ ID NO: 686 - DNA, 315 bp, Oryza sativa
atggcttcagctactgcctcattgctcacatgcttctttgctctcgcactcttcatgctgcacagcaacgcagccagcgaggatgctttgagggctaacctggagttcgcctgctcggagagcgactgcgccgccatccagggcaccggcggatgctccttccccgacgacgatggcagcctgccgacgcgggcgtcggtcaccatgaacgcttactaccaggccagggggaggaactcatggaattgcttcttcaacggcactggcctcatcaccatcactgatcccagttctggcaattgcaagtatgcctga

SEQ ID NO: 687 - DNA, 313 bp, Oryza sativa
tgttgtgcttgaggatcatataaacgactctgatcaatcctccaccatagctggttgttctgcttgctgtgaccatgccatgacatctgaaaacacagaggaccagcatgatgacagcattatttctatacatggggatattgtgtatccggataagaatagcattatttgtaggctggaggctatagaaaaatatttcagccttgaaacagtcaaggacattgtggaagccatggtgagtgatgcttcagttgttttatacttccaaatctctgggcatgatgaattgcaagctacaaatgctttgctgtag

SEQ ID NO: 688 - DNA, 7728 bp, Oryza sativa
atggggggtgagatgggatcttgcattgcttgttgccttgccttgccaccactagccactgcctgcccaccactggtcactgccacactgagagcgtcggccatggaatatcatgaatgggaggtaaactgcccacaattggagggtaaatttggtgtgcttttcaggctcctagcacttcgttttgcatggaagcatgatatattttgctgttgcttgaatgcatactttgaagaagtggaaacttcttttgttgttacatatgatttaccacgctgctgctcaattctgagcaccaaagacattgagacagacagacacatcgtgcctctgtggcagcttacttgctcatttgtgccaatggcttctttggtccggcatgattcaaatcccacccagtactcatggtggtgggttagccatatcagccccaaaaattccaaatggcttcaagagaacgttacagatatggacgtgatggtcaaagcaatgatcaaacttatcaatgaagatgctgactcttttgcaagaagagcggaaatgtactataagaaacggcctgaacttatgaatcttgtggaggagttttacagagcataccgtgccttagcagaaaggtacgatcaagctactggtgcactccggcaggcccaccggacaatctcagaagcatttccaaatcagatgccgtcaatgtctgaagactctccctcctctggccaggatgtggaaccacgtacaccggaagtgttaatgcccacccgtgcaccatttgatctggatgatctgcaggatgcagctggtgtatcaccacaccttttaactgtcaagaggaatggtacacagcctgatgacataggtttttcgtctagtcgcaaaggtcttaagcagttcagtgatttgtttgcaggcagtgacagtagccagcgtgtcaatttttctgatggaaaagtaaggaaaggtctcaactttgaaagcccagatgttaaaggaaagaaagatgatagtaatgatatcatgaatttgcaacatgaagtttccaaattattaacagagcgccaaagtctgaaagagcaaatctcatcagagtctcagagggcaaacaaggctgagagtgaaatccatagccttaaggacaccatttcatgtttgatttctgagaaagacacaacccttctgcaatacaatgaatctacaagaagattgtcagttttagaatgcgagatttctaaggcgcatatggaactcaagaaactctctgacgatatggctatggaagttgacaagctaaaatgtgctgaatcacaaaacagcgcaatgcagtctgagcttgagactctggatcagaaggtcagggtgcaggagcaagaacttgaacaaagtagaaaggagatagaaagcttccacttaagtctacaagatgaaatggccaagcgcaagcaagctgaagatgctctatgctctttagagaaacagtacgctcaatcgcagaaagaaataaataggttgactctagatatggagatggcaaatgatagattgaatgacttcaatctggtgaggctcaatctggagaacacagtctgtgagctgaagaaggaagtcacgagcctagaagtgaagatacaaatactggtgcaggaacttgaacagaagagagaagaggctgatgtcatgcatgctcagttgcaagatgaacactccaatcacatgcataaggaagcagctcttcatgcattggagaacttgcattcccagtctcaagaagacttcaatctggtgaagctcaatctggagaacacagttggcgagctgaagaaggaagtcacgagcctagaactgaagatacagatacaggcgcaagaacttgaacagaagagagaagaagctgataccgtgcatgctcagttgcaagatgaacgctccaatcacatgcaaaaggaagcagctcttcatgcattggagaacttacattcccagtctcaagaagacttcaatctggtgaagctcaatctggagaacacagtctgtgagctgaagaaggaagtcacgagcctagaacgcaagatacagatacaggtgcaagaacttgaacagaagagagaagaggctgatgccatgcatgctcagttgcaagatgaacgctccaatcacatgcaaaaggaagcagctcttcgtgcattggagaacttacattcccagtctcaagaagaggttaaacagatggctcgagatgttgagcactcgaacaagaagttgagtgacctggaaaataataacttgaaattgcatgacctgtcacaaggactcaagaagacggttgcagagctgaattctatgaaagattctgcacttcttcaacagcagaagtcctcggagaaggaacttgaacacaagaacaaagagatcagtgaactccaaaatagtttgcaagagcaagtccagaagtgcattcttgctgaaacatctctgctcagattggaggacctacatactaattcacaaaaagaagctaagacattagcacatgatcttgaaagattaagcgagcagcttactgaggttgaaaatgataggctggatctgcagaacatttcacgagaacttaagaatactatttcagagattaattctgagaaagacttaatgctacttcaacagcagcattccttggagagacagtcttacttagaggctcaacttttagatgcactgtcagaagtggaggaaaacaagaaggaagcccaattgttggaagaaaaccttgcacataagaatgatgagttgaatgacctccaaaataatttggaagaggaaggccataaacggatgcatgctgaagcagcccttagtatggtggaaaatctgcattccaaatcccaggaagaagtgggtaagctagttatggatcttgataaattagaaaatgagctaagtgaattgcaaggcagaaattcgagaatggaagaattatcatatgagcttcagaacaccatctcccttcttaattctgagaaagacgcagcacttctacaacagcagctgtcctctgaaagagcatgtgatctgatgtcacagctctcaaagatacagttggagctggagaaggctgaggagaagatgcagacaatggagcaaaaacttgcagataagaatgaaatggtggattttctgcagttgagtttgcaagatgagggcaagaaacgtgtggaagttgagacagctctcatttcatcgggtaacttgtactctcaatcacaggaagatgtgaataggttaaccctggagattgagaggttgaacgaaatgttgaatgatatggagaacaagtcttctgagtataagagcaccatcttgcttctgaattctgagaaagacatgagtgttattcagtacaagcagtcttcactaagaatatatgagctggagtctaaactctcaggggtgcaggaagaactagataatgctgaacaaaaagtgcaaatgctggataaagaactcaaggagaagagagaggtggttgaaactatgcaggctagtctgcaggatgaagcccaaaagcgtatgaagggtgaagcaactcttctcacgatgactaatctgcatacgcagtctcaggaagaagtgaataggttgaccccagagattgagaggctgaatagaaagttaaatgaagtggaaaatgtctcttgtgagcttaagaacaccatactgctgctgaattctgagagagatactactgttcttcagcacaagcaggccttggtgagagtgtctgatctggaatctgaactctctgatgtgcaggctgaactagtcaatgctgagaaaaatgtgcaaattctggataaagaactcaaacagaaaagagaagaggttgacagcttgcaggcgagcctgaatgaagaagcccagaagcgcattgagggtgaagtagctcttcttgcaatggaaaatctacattctcagtctcaggaagaagtaaggggattggttttgaagattgagacactacatggcaagttgaatgagatggagaacagtaatagggaccttaagaacatgatatgcaagcattcggaggagatacatgtgcttggtgagcaaaatctttctgccgagttaactattaaaggtctccatgatcaattggagaagtttacggaaatgaacataggtcttcagaatgaagtgggaatccacgttggtgagaaggaagcagtaaacataagggtggcaacacaacagcatttaattgaggaattgcagagtaagaacattgaattggaggaggtatgcaatgcatgtgatgttgaaaagacactcctcttggaaaagcttcatggcatggaggagctgtccacagagtattcaatcttgaagaaatcattttcaaatgcaattgttgaaatggaagacctgaaggaaattgtaaaagaactggaagcttcaaaaaactctctgaaatatgatgtctccttgcatgccactgagaaggatgctttggcattagaactagagacccttggtaaaagatgtgctgatgttttagaggaaaaatccattctggaaacttcattctctaatgtgaattatgagcttcaagaattgagagtaaagtataaagattcagaagaatcctctcggtcttatcttgctgacaacactgctcttcttgctgaaaagcacaaactactctcccagctggaaagcactgcagtgtctttgaaattcctggaggataaacatgctgatctgagagataatcatggatctttgttatcagagaaagttcttttatgcaaccaagtaaagaatatgcaagatcagttgggaataaaaaatgaacagcatgaagcgctgcttaagttgcaccaaatgcagatgcttgaacatgagcagcaaaaatgtgcagatgcttctatcagcacattgatattggaaaatagcttggttgatgcaagagacaaaaatcttgcactcttcaatgaatgccagaagttcatacaggccactgattctgcagaggtactaattgcgcagctcaaggaggaagccagaaaggaagaagaggacaaaaaagcattgctgaatcgcaatgagaaactaagggatgggatctcagagcaaattaaggtcctcaatatctgtaaagatttaggacctactgatgtggttcatgatgaaattatgctgcagactatgtctcgtgaaactttcaaccatgtaaaacataaagaggaaaccgaagagagaaatgtcttcatggatgctgagctatctgttcttggagcaattctggcacaaacagtaattggcttcagagctctgcaccagcagaactgtgaacttgtggaagaagtggagtcaggagcagcagaactgctttttctgcaaaaggaaaatcacaagcttattgaattgaatgaacagttggagcaaagattgcagttaggtggcaacagggaggagatgttgaagattgaaatactgggattatgcaaggagctatcaggcttgagacagtcctaccagacttctcaaagtgaaatttgcaacctaactaaaaaatacgattccttgctgcaggagtacaaagttttagttgagaagtacaatgctttggatgatgagaatgctgctgttattgcagaatgcataaagctcgacctcctgtcttcattctttcatgaccttactgttgagtctgcatctgttttggtttctcttgacaatgatatggctatgttgagttcggttaggcatgaacttgatcatgaggttaccatgctgaacagaagagctaagattcttgaaatggactttcagcacctcaagtgcactctagagaacttgttggaggctctggggagtcgcttggttctttcagagtttgattcaaacacaagcaaaatcatctgccaggaattaacaattgaatgtaacagtagcatgacacagttgatgcagaaagatgataaattacgcaaagtagatgagaaagttcaattcttgcaagagagaaaccaggaattgtgcagagttctcagggatcttgaggttgctgtagaagatgcagaaggagtaaaagtagaccttgagaagaaaatcacaacactaactgaacgaggtgctgtacaagacaatgagacccgtcttcttcgcgaagcaaacaacacgctgcaggtagaggttggcattcatgaacaaaaggaagagagtttgatgtctacatttgagacgatgagaaaagaggctgaacagcatgaaagggaaattactttgctggtatgtgatacgataactcgttcagtgaatacaatggtccttgaggaacaagtgcttgaaatgatgatggagcgtgaggtccttgagacaagattttttactgaaaaggacatgctaatgaaggaaatctcctcaagagatgcttatgttgatgacttgcagaaaagggtcgccagcatgaggggagaaaatgcaggactgatggcagagttggccgcatatctgccacttgtagcatctttgtctgatcagataagagcgctggaagagctagaagacggcacacttttactgtcagaacttaataaagaaggcaaattggaatttgtgcaaaaggacagacatgttccagaatcccaagatgattcatcaggagctttgaagttgcgaagcttaattgcaagagttgaagcactccatgttgtaatactggatgccaaaggccgccgagataaggagtttactgaatctgttgctcaactggaagcggcaaatatggaaattcaagagcttaaagcaagaaaaggctcgaatgctaaggaagaatgcaccgaggatgataggcaaaagtatgatgctgataactccaaagggaaacatgtacagatcatgaaagacatcgaacttgatcaagtatctacttgtgcactatatggtactggtgccaccatctaccctcttggtggcgatgcaaatgtggagcttgacgatgagatgcttcaactgtgggagactgctgagagggattgcaagaaccaaacagctaaatcttcatcgtctgagaatgacatacaagcagtggaggaggtgaagagtgagtacccttcgtttgaactagcaaggggaagagatccaggaattgacaggcttgagatatcagcagtgtccctggaacctcagcaattgtggagcaaaaatgtccttgataaactagcttctgatgctcagaggctgtctattgtccaagccagcattgaagaaataaagcagaaaatggtgggtgcttctaagggaaaatctaccgtaagctctgaatacagcagcatcagagctcagctgcaggagattgatggctctgtcttggagcagatagatttcaactgtaatgtgacaaagaaggctgagaattaccctgcatttgaggtgagtgctgaactagaaggctattccagcagaagaaaaatctcagagcaagtgcagaaaggatcagaaaaggtcgcaaagttggaattggaacttcagaagatacagtatgtcttgttgaagcttgaagaggagcatgagtacaaaagagttaaagcccctgagaaacgttcacgcgttcttttgagggattatatgactgcaaggaaggacaaaaatgatgccggacagaagacgaagaagaagaggatacccttctgtggttgtgtccgtattaaatcaagaactgagccttaa

SEQ ID NO: 689 - DNA, 4077 bp, Oryza sativa
atggagatggagatggaggtagggaggcggcggcggcggatcggagtcggagggagaagccagaaggcggcggcggcgggggagatcgatgttgggatcccatcggaaatcggatgggatcagacagactgggccgttcgttcgttcgttgttgccacgtgccacggcccggcccggcccatgaagataccacgacgtggcaggaaacccatggttgggcgggttatcctcttgctcttgcctgccattgcgcgcccagagcacaaggagatgctcgaggaaatgcgaacctattacatgctcacccacaaccatcaccaacacaccgctgccgctgatgacgatgacgatgaccaatccgtgctcaacggcaacgccaacaccactgctggtttttttggcattacagacaacggaaccttgcttcttaccagaagcttgggtctcagaacactcctgggattgtcaccagaccctgattcacacaacagaattgcttttgcaactcatttccagcgctccttcatgaaccttctgcgcaatgctcaatttgaagagctctctgcgcaagacctgctcttgacatacgccctaaacaccgattacctcttgactttgcccatttatgtcgattggaaaaaggcagctgagtccaatgctatcatattcaggcgtgggtatgcaacggagaggcagaagggcctactgttggttgaaaagcttgattacctacagtctaaactcttgcaaaatatcttctttggcttctccaagcccttgaggaagctggggaaatggctcaatgaggcattgaaaagatcaacagggaatgagggatttcagatctggattgaaaaacttaaagtctggcttaaagagcaaacctatgcggagaattcgctttcgttgattgagaactcttcatgggataaacttagatctgatcaattaccggatgctgatcttcctatttggattgctgctcaaagggcagtctctcgttacgaaggaatcctgtcaccagttggtcctcgtggcagacttctaagaagattgcttgcttggactggtttaatcccttctctgccagaagcaacaataaagtcagatatcgatacaaaagatcttgaaggctatgtgaggccaaattttctgccaagaataacacttgcaaatatatgggcgccagcaagcagagaatcttgtaacaacaatctctgggagataacaaaagcttcttttggtgttttatttgggaagtctactcttcaggaaccagcattccaagaactgatcctactttatactgatgaggctgatcaaagcaaagagagagaaaaatcagacatgatgccattgcaactgaaaatttttgaaaggatccccatccctgatctgccagtggtttttcctcacaagaagttgtccttccgcatcctagatacagtaaggttggatattgctaccgtaataggtttgttggcttatgtcgtgaactacaaatttgagagtttagcctcatctccatcggcttttcttcttgatatagttgcctttactgcactagcaatacttgtgttccgtgtggcgctgggttacaaacaaactagggatagataccagcttctggtcaataaaacgctctatgagaagacattagcaagtggatttggttcagtttattttctccttgacgcttctgagcaacaacagctttttcagaaagggttctcccttaatgagtgttttgttcagtataaagaagcgcttttggcatatggtatgttactgtgcaggaaaaagtatcaggtgtcatctcgtgtaagcatcagagatacatgtgagcagtttatgtacgagaaatttaaggcgaagatcgaaatgcctattgacaaagctatggagacactattgcgtctggggctggtgattgagctgccaactgacggcggctcccgtgtaatcgcacttccatgttcagacgcatacgagatcctgaaaagccgctgggacagcttgttggaacacaagacggaacaagatattgttatatctcgatattgttacgagggagctgatgaagaagactgtattattgagatggacggacgttgtctgtattcatctatagagctcttgatcgaaagtgctggctgcagcagcgtagctgcagtcggtgtaatggcaaaagagcagagtggatcccctaagcccaggcagccagtgttccaaaggatgcgagtaacgttaaccataggtgttattggcctctgtgttgcatcatacattcttggtgcttggcaaggcacttcaactactagtatacacccatccataatctacactaaaagccaatgtggtgaatccattttgcgcacctccagcaattcgtctggacggtcatcatcagacgctcgtcttgatttccaagcccaccatcaggtgagcttcaatgaatcttcacttgtcgccgaaaaattcccaccttgtcagctgaaatacagcgagtataccccttgccaagatccaaggagagccaggaaattcccaaagacaatgatgcagtacagggagagacactgccctcggaaagaagagcttttccggtgcttgattcctgcaccaccaaagtataagaatcccttcaagtggccacaatgtcgggattttgcttggtacgataacattcctcatcgggagcttagtatcgagaaagctgtccagaactggattcaagttgaggggaaacggtttagattccctggaggcggcacaatgttcccacatggtgctgatgcctatatcgatgacatcaacgctctcatatcattaacggacggcaacatcagaactgcgcttgatactggatgtggggtggcaagttggggcgcttatcttattaagaggaacatcatcactatgtcatttgcacctagagattcacatgaggcacaagtgcagtttgcattggagcggggagtgccggccatgattggagtgatatccacggaaagaatcccataccctgctagatcatttgacatggcacactgctctagatgtttgatcccatggaataagtttgatggtatctatctaattgaagtagacagagtaattagaccaggaggctactggatcctctctgggcctccaatccattggaagaagtacttcaagggctgggaaagaacagaagaagacctgaagcaagagcaagatgagattgaggatttggcaaagcgtctctgctggaagaaggtggtagagaaagatgatcttgctatatggcagaaacctatcaaccacatagagtgtgttaatagtcggaagatctatgaaacccctcagatttgcaagagcaatgatgttgactctgcttggtacaagaagatggagacatgcatatcacctcttccggatgtgaatagtgaagacgaggttgctggtggagctcttgagaaatggccaaaaagagcatttgctgtgcctccaagaataagtcgtggatcagtttcaggcctcaccacggagaaattccaagaagataataaggtgtgggcagagagagcggattactacaagaaattgattcctccactaaccaaggggcgatataggaacgtgatggatatgaatgcagggatggggggattcgcagctgcattgatgaagtatccactttgggtgatgaacgtggtaccttcaggctctgctcatgacacccttggtattatctatgagaggggattcattggaacctaccaagactggtgtgaggctttctcaacgtatccgaggacatatgacttcatccatgctgataaaatattcagcttttatcaggacaggtgtgacgtaacatacattctcctggagatggaccggattctaaggcctgaagggacagtgattttcagggacacggtggaggtgttagtgaagatacaatcaattacagaaggcatgcggtggaagagccaaataatggatcacgaatctggtccattcaaccctgagaagatacttgtggctgtcaagacttactggactggacaacccactcaaaagcagtag

SEQ ID NO: 690 - DNA, 3906 bp, Oryza sativa
atggtccgaatgcttcattccttagatcatccgaatgttctgaaattttactcatggtacgaaacctcagctcatttttggttaatactggagtactgcgttggtggagacctaaagggcttgcttgagcaggataagaagctgcctgaaaattctatacatgacttggcttatgatcttgtgaaagctcttcagttcttgcattcacaaggaattatatattgtgatctgaaaccatcaaatgttttacttgatgaatctgggtgcatgaagctgtgcgattttggattagcaaggcgtttgaaagacatagagaagaccaatcctggagatgtgccgcaacctttgaaggggactccatgttatatggctcctgagttgttccaagagggaggagtgcattcatatgcttcagatttctgggcacttggttgtgtattgtatgaatgctattcaggaaggcccccttttgtggctaatgaatttacccagctagtcaaatctataatttcagatcctacaccacctttgcctgataacccctcaagatcctttcaaaatctgatcaattgcttactcatgaaagatcctgctgaaagattacagtggtctgaactatgcgagcatcacttttggaggagcagaatgtcaattattcctttacctcctcagcctgcctttgacaacatggtcgacctttctgctacaccatatttagttgagagaaatggtgataaaccttctagacagtccacaccacccaagccccgtgatggcctacggaagaaggacgaaaattctgctaaggtgttcacccctgttaagaatatgctaagtggtaagaaaaacaatgcaaaaccttcctgtaaggctgatggattgaagggtgtaaatatcctcaggatgtctcgtgtagctaagaggaatttgcagagagaaaaagacaaggagaactacaggcgacaccctacagaagcttctgagaatgatacagaagttaagattgaaaacaatgatatggaacttgattttggtgaaaatccagaaggtgatgcacctgatgacaatgatggatcagacaatcctggatccgcagaagatgaaaaactttccactcaaggcactgatggtaatgaagagaactgcatgagtaatcagatggatatgctcacagatgaaggcccagttaaggctgaaaccatgataaaaactgaacataattgttcagaaaatcttgatgtggtggccactccaccaagtatttgtatgaggaaagcacaacgagcaaagacaacttcaggtgccgcagctggttccgagccatctgacatctctgcagcattctggcatccaacagatcttgctgttaaaccagttatgcctggtaggaaaggagataaagctgtagagacagtccctatgcttccgtttgaagctcttcctgctgttgattatattaagttgccacgggaacaaatgaatgcattcaatagtcagatacttcagagtttaagtggtacttttcaggtttcagagaaacagaatatcatcaaatacctggagatgttaagcatcaattctgatgctgcaaatataatcacaaatggtccaattatgctgttgcttataaaaatgctccgtctgtcaaaaacttcagtattgcgtgtccaaattgcttcacttatgggattgttgatacgctactccactatccttgatatagagctggcaagttcagggatttttaatgcactatcagatggtctaagggacaagcatgataaactcaggcgattctgtatggcaacactaggagaattactgttctacatttctactcaatctgatcaagataccaaagaaatcaatgcccaagaatcccctttgaaggataacagggccacagcttcttggcaggttccaagttctgtaattgcgctggtgtcatcaatcttgcgtaaaggtgaagatgatctagcccagctttatgctttacgaaccattgataacatctgtagccaagggacagattggacttcacgtttcgcttcccaagatgtaatcagtcacctgtgctacatctatagagcaactggtaagcaggagaatacaagacttattgcaggatcttgtttggcacgcttagctcgcttcagctcatcttgtattcatttaatactggagaggctggccttcaaggatatcgcatgcacactcattaaaggcaattcacgtgagcagcagatcagtttgaatcttctgaattcagcactagttaacagccaaatcataccaaccatgaaccgctacattcagtcgttaacagaagagaagcagttggttcctggactcatctctcttattgaacagggaactgatgttctgcgtggcaaaacccttctatttgttgctcttctttgcaagaacagtcgaagatggcttcctcatttcttttgcaatgcaaaactactatcagcagttgatagattgggaaaggagaaggaaggcttcattcatcaatgcacagaagcatttgtgcagttggttgcttcattggtcccaggcatccttgacactgtctctagtgatatacaacaggttatgggaggcaagcgtcatggagctgctactgctttaactggacgagctcatccaaagagcataattcatttgtttcctgttatccttcatcttcttgggagtgtttcattcaatcacagagttgtgacgagccatgtattgcttcagttggcaaatcttatgaaaattttggaagcaccatttcaggctcgggatgattttcaaatgacactattgagggttcttgaggcagccacggaggagccttctgttatacttaatgaacacaaaatattcacaagtcgaatccttccaagcttatccgtcttgtacaagggcaataaagatggtgatgccagattcctatgtttaaagatactgtccgatgtgatgattgtgatcttcagtgactcttcattgacgtctaatgagcaaacagtatctgacctggaaaagatctctcagaagtattttctccccatgtatccatcatttgcagaggatgaagatccaatacctatatatgcccagaaacttctggtaatgctgatggagcatgattatgttaaggtttctgatattctcaatgaagcaacagtatcccggtgctttgaatttttgctaggagatttgtctaatgcaaatgtaagtaatgtcaagctttgctttgcattggcatctgctcccgatatggacaccgacattctttctcagcttcaagttgtcagaagaatagggaacctgctggagtttgtgactgcaaaagatatggatgattttctagaaccaaccttggaactttgcagagcattcattatccggggcatcagcagtgacaaaattgtggccctttccaaagagcccgcactccttgttgatagtgccttcagcatgagcattgctgtcgatcaacaatcatgcgtcatggatatatgcgactttggtggcaacatgggcattttcctcgacctagttggaagttcagatccacatataagcgatttggcatcagactgcttggtgctgttactcaaagcagcacctcgggaggctacggtgggcttgctgaccaatcttcctaaactgagcgttgttctggacctgctgaagcatggcacctgcctaaggctgactcgcctgctgtattgcctggccttctcctgcaggcaatatctagcgcaaggaatgatcgtgtcgatatctttgtcagccttgatgcgagtagaagcactcgtgtcggcattcaagggttcacatgatggctgccttgctgacgccgcctcatatttgggcgctgaactgcagcgtttacctcgctgtggttga

SEQ ID NO: 691 - DNA, 3855 bp, Oryza sativa
  misc_feature (2331)..(2331): n = any nucleotide
atgggctgtgtcagttcgaagcaattccatggcgaggagcagcgtggcggcgaggggaagccccggcggcgcccatctagcaactctctgaggcgtcttgttagttacaattccagcaagaggcatgagcactttgaggaggaggatgaagaaggtgtggttgtgtcagccacctcctccagtgctggacatcgtgtagggaatgatgtgagcacggctaggctcatccggaagccccccgcgccggtggttgaggctgtggctgtgcctgtggctgcattgccagatgaggcggcttctgtggcggttagcgtggttgatgtggagaggccagttgccgcgcctgcgaattggaggcgtgctccgaatggcgcggcggagcaagagcctaggagtggtggtacaaggagtgaggcgaaaccgaggattacagatgttgtgcccaatggagtgcagggggggcatgcggcagctggctggccaaggtggctcacagaggtcgcagcagaggcagtccgtgggtggcaacctcggaaggcagagtctttcgagaagttggacaagatagggcaaggtacatacagtagtgtttacaaagcacgtgatcttgagagtggaaaaattgtggcacttaagaaagttcggtttgccaacatggaccctgagagcgtgcggttcatggcaagggaaattcacatcttaagaagacttgatcacccaaatgttattaagcttgaaggtttggtgacgtcgcgcatgtctagtagcttgtatcttgtatttgaatacatggagcatgatctagcgggacttgcagctacacctggcataaagttcacagagcctcaggtcaagtgttacatgcaacaactactctctggacttgaacactgtcataatcgtggtgttttgcatcgggatataaagggcgcaaatctcctcattgacaacaatggtgttctcaaaatagcagactttggtctagccacattctttaatcctaaccaaaagcaacatttgacaagtcgtgtggtaacattatggtaccgacctcctgaactattgctgggtgctactaactatggtgctgctgttgatctctggagtgctggttgcattcttgcggaattgctgtctgggaagcctatcatgccagggcgaacagaggtggaacaattgcacaaaatatttaagctttgtggttcaccatcagaggatttctgggctaatttgaagttgtcacgtgctacaatattcaagccacaacatccttatcgtcgatgtgtgaatgatgtatacaaggatttccctcctccggctttagcgctattggattgtttacttgctgtagaacctcagaataggggtactgctgcttcggcccttggaagcgaattcttcacgacaaagccttatgcttgtgatccatcaagtctacctaaatatcctccaagcaaggaatatgatgctaagcttcgagacgaggaggctagaaggcaaagagcagctgcagttaaaggacatgaatctgaagctgggcgtagaaagcaacttccagcaccaaatggcaacaacgaattgcagcaacgacgggttcagcttaatccaaaaagcagcagtaataagtttattccaaaggaggatgctgtcactggcttcccaattgatcctccaggaagagctggagacaatgtttaccctcagcgtgcgcctctgatgcatgctggtcgttcatcctctactctgggccgatcaagtggcactgatcagaatgctcagaggttttacacatctcaaattgctgctgctgagatgtctactgcaactggtgggcagcgaggcaatgccactaagctgtcctccaaccttggggagagtgccaggagacaatatttgagagagcatcgatctagttcaagatatagtcaacttgctgctgctgaaccctctgacagacctgaatggacacaccaattccaagaaagaccatcatcttcccaccgcaaagatgatggggcagcaaataaggaacctactgtggtgaatggcgctaagaagagcaggatccactactcaggaccattaatgcctcctggagtaaacatggaagaaatccttcgagagcacgagcggcagatccaacaagctgtacggagggcgcgcctcgacatgggaaagggcaagaatcacgtcgagagagaccagtcggaatcgcttctgtacactacccagaatggcagacccaaaggctcgcctcctttctacctagccctcgccgacctcccggccgcgcgggccgccgtcgagcaggcggcgggaaaggcgcgggcnttcccctggaacctgcttatatggggctacgcgggccgtgggctgtgggaggacgtgatcttgtcgtacgagaagatggtgggttggggcgtcgccgccgacaggttcacgtacccgtcggttctgcgtgcctgcggcgagctccgggaggtcaccattggccggaacattgagcagcgcattcggaggtgtagatatggtctggacatgtatgtctggaatgctttggtggggatgtatgccaagtgtggggagctggaggatgcccggagggtgtttgatggaatggctgtgagagatgttgtcagctggaatacgatggtgtccgcgtatgcgtcgacggggaagtcgaataaggcatttgagcttttacagcaggttcctggtgcaaacgttgtcacgtggaatgcggttgcagcagggaatttgaaggcggggaactacgatgaagtgattaggttggtgtctcaggtgagaggatatcatgggacaggggtggattctgtgaccatcgtgattgggctcaaggcgtgtggtaggaccgggtatttgagtgttggtagggagttgcacggggtggctgttcgtctatgctttgatagccttgagtgcgtggtgaattcgttgataactatgtactcaagatgtgggatgatgagctctgcctgccttctgtttagagcatgctcagttcggagcatcacaacctggaactcactgcttgcaggatttgcattcatggaacagatcgaggaagcttctttgattttcagagagatgatcggttttggtgtctgtccaaatggtgttactgtcttaactatgctttcccttggtgcacgggttggacacctctgtcatggaagggagctgcactgctacatccttaagcatgagctggatagctctaaactaatggaaaattcacttgtcgacatgtactccaaatgtagacaaatggtagttgcacagagagtgtttgaactgatgcaatttcgagacaagcatgcctacacatcactggttttgggttatggattgcaaagagagggacatgtatcactgaagctctttgatgagatgattgtgaacagtatagagccggaccatgtaactttcgttgcagttctatcagcatgtagccactctgggctagtaactcaggggcagctactatttgccaagatggtttctatatttggtattgcaccaagagtggagcatttttcttgcatggttgatttgtactgccgtgaaggtttgctcaagatggctgaggtgataattgacaagatgccatttcaaccaactgctgcaatgttagcaactcttattgaggcttgccgaatccatggtaatacggaaatcggggatcgggctgcaaagaagttgctggctatgaggacaaacaaccctggtcattacagattgattgcaaacatgtatatagcagcaaaatgctggccagaactagctaaaagtgagatcactaatgagcaccctggagctaaatatgattcctag

SEQ ID NO: 692 - DNA, 2898 bp, Oryza sativa
atgggggcggcggaggaggaggcggcggcggcatgggacaaggcggaggccaaggaggagaggataatggtgtcggtgcggctgcggccgctcaacggcagggaggccggcgacagctgcgactgggagtgcatcagccccaccaccgtcatgttccgcagcaccgtccccgagcgcgccatgttccccaccgcctacacctacgatagggtgtttggtcctgattcctctacaaggcaggtctacgaggaaggagcgaaagaagttgctctatcagttgtcagtggaatcaactcaagcatattcgcgtatgggcaaacaagcagtggcaagacttacacgatgaccgggataaccgagtatagtgttctcgacatctatgactacatcgaaaagcatcctgaaagagaattcattttgagattttcggcaatagagatatacaatgaagctgtgagggacctcctgagccacgacaccacacccctcagacttcttgatgatccggagaaaggaactaccgtagagaaactcactgaggaaaccttgagggacaaggatcatcttaggaaccttcttgctgtgtgtgaagctcaaaggcagattggagaaactgctttgaatgaaacgagttcaaggtcccatcaaatactcagattgaactttgttgacctagcaggaagcgagcgtgcatctcagactgcttcagctggagtgaggttaaaagaaggtagccatatcaatcgaagtcttcttacactgggaaaagttgttcggcaactcagtaagggaagaaatggccatatcccctacagagattcaaagctgactcgtatattacagtcttccttgggaggcaatgcaagaactgctattatctgcacaatgagccctgcacggagtcatattgagcaatccaggaatacactattgtttgctacttgtgcaaaggaggtagttacaaatgcacaggtcaatgtagtgatgtctgataaggcactcgtgaagcatctacaaagagaacttgaaagattacaaagtgagattaaatttccggcgccagcctcctgcactactcatgctgaagcattgagggagaaggatgcacaaattaaaaagctggagaaacagctaaaagaattgatggaagaaagagatactgtgaagtctcaacttgactgcttgcttaaaagcgattgtgatgaccatagtgacggccgcgttgcgaagcgatgggatgagcatagtcgatcctcagagtcttttgcacggaatgcgtctgaagaagcattttcagtttcagatacttctggtgttccttaccaggatcaagataatgctgtgtttaatggatcctatgtcttcagtgatgaccgtgatgatattgtattccctgttcaaacagtggatcttcctgaagaaacaaagcatgaaaaatttatgtcaccttggcaccctcccagccaccatagttcttctgattgcatagagtcatatcatatgacagaagcggcttccagaactgcatcagaagtctctgaagagcattgtagagaagtccaatgcatagatatacatgagcatagaagaagcacaagtcacaaattcgaccttttgctgccccaggacaccgagttccaaacacctgaattagagatctccaaagaagcagtccctcaacctgatgaagaccaagaacttgagagcataacaaacagaatggaagatcctaccaggatgtgccctgtcgaggaggagcaacaagatgagatcgtagatacatgtgaatctaatggtaccacagacaatgatgtcaagctatatacatgtgattctaacatttcttttgacattcagaaaccttaccctaatggatgtctgactgtaaaaaggtgtatactgagctccaaggatagggcgttgtctagaagtaaaagctgcagggctagctttatgattattccaaatagttggtttgatgattccgagtacaccagccagacaccacctaatgaaatcttgaagcataccccaagaaggtttgacaaggttaggagaagcttgtatccagaaaatgataacccttcttcagtagaccgttctgagttttctggtgaagtttcttctgatgaagtagtgaaggacatgagcaccattgatgaagtagccaaagacatgtgccccagcgacgcagaacaagaaactctcaccagtgacatcagttgtctcaccaagttgaagaagactgatagtgaccatgaggatgaacttgatgagtatcaggatcagcagtctattagagatggatctacaaccttgagaactgtcaaagatgttggcatagattcatcactgagtgcctctccttctcgttggcctattgattttgagaagatgcggcaagagattattcagttgtggcacgaatgcaacgctcccatcgtacacagaacttacttcttcctcctcttcaagggagatccagcagataacatctacatggaggtggagcacaggagactgtccttcattaggaggtccttcagtgccagccctgcaggaggcgagcttaattctgccgtcgtatcaagcctgaaaaatcttcgacgcgaaagggacatgctctacaagcagatgcttaagaagctcaccaatggggagaaagagcgcgtttacgctagatggggaatcgatctgagctcgaaacagcgaagattgcagctatctcgtctcgtctggacgcagaccgatatggaacacatcagggagagtgcatcccttgttgcgaagctgattgagctgctggagccagcacaggcactgaaggagatgtttggactgaacttcacactagctccccgatctgaacggcgatccttcggccttctaggtacctga

SEQ ID NO: 693 - DNA, 2826 bp, Oryza sativa
atggctttggagaaaaaaatcctcagaaaggacaatttcaacgaagaacaaagccaatatatcagagagggaacaggaggtacatcacttatctctttaacattattaagaagccttatgaattatgatatgttcctatctggattttcaacttttccttccctgcagaaagagaagattgcacggttagagagatccttgcaatgcttaaatgaacagatttcatttgctcaagctgaatgcgtggagaaggatgctattttagctaagcaagcaaaagtggcagaagaagcaatattaggttgggagaaagctgaaggtgaagcaatagctattaagacacaacttgatgatactctagatcagaaagccgcaattgagcaaaggatttgccatcttgatgaggctctaaatgttgccatggtagagagggagttattgataaaggacactgctaaactgatttctcatgagcaagttaaagttgagaggctggaaggagatgtagtagagaaaataaacataattgctagcttggatgccgagaataggaaactttctgaaatgctctcaatgaaagagaaaatgatctcagagttaactgaagcaaagggtgtgatagagtcaaatttcaagaaccttgaggtaaaactagagtcagcggacaaattgaattcttctcttagatatgaggtttgcatgctgcagaagcaacttgatattcgaagtgaggaaaggaaatttaacctgaaatctgctgatgctgcacataaacaacatcttgagaatgtaaaaaagattacaaaacttgaagcagaatgccagagattgcgttcaatggtacgtaaaaggctaccaggccctgctgccattgctaaaatgagaaatgaagttgaaacactgggtaacaatgcagtaataacaaggacgagaaggttcaattctacaacatcattcaactcaggcaatctagtgcagaactcctatgatgcatcacatgaaagttcttcattgcttgcaaggctgcatgcgatggaagacgaaaataagactatgaaggaatctctttctagtaaggatggtgagctccagtattcgcggaccatgcttgctcgcacaacctctaaactttcccaagttgaagctcagcttgaggagttatcaagaggtcgggttgcaacagatttagtaaaatgcagtcctacagtggtcgagaaccctctatcatcaatctccgaggacggttgcaatgaagataatgtcagctgttcaagctcatgggcgtctgccttgatttctgaactggaacacttcaagaaggggaagctgactacaccctcttgtaagagtaccggagtatcagacttgagtttcatggacgactttgaagagatagaaaagttagcattggcatgtgatgcgaaacctacagaatcgtatgattcaaggagggagtctagagaatcatcagggaaagagctagtaacagttgatggtcctattgaaacatctgaccaactccgtcagcacaagattgagaaggcagtcctgaagttgatagaacttattgagggtgttgtccagagatcatcaaaagattatagtagcactgttgtgctctctggtggcagtgagggcgaccgctctaacacattgactggctacgttgcacgtgcattcctgtggaaaacgtctgaacttacttctgtactacaaaatttcgtccttgggtgtaacgagcttttgtatgggagtacagatgttgaaagatttgtgcttgaaatcaatatcacactagactggataatcagccactgcttttcactccaagatgtatcagacatgagggagactatcataaagaacttggagataaatagcagttccggactagaagttgttccagtaattaagcacaccggaatccaaacaacagatggcatgtgtgaacccaggacgcctaacaagatgcagatggcgatagtatctgtatcaagcttaatggatattggatataaagctgatgatgactcagaaattttcaggaataaaataccagtctctaaatgtgaggaatcagaaggaaaagcttcaagcctgcgagcagagcttaatgcattgaaagaaacaggaaaaatgatggcacatggtgtcgatggtgaatccacaatcaatgaacttgggaaaccatccaactctgacataaacaagggcaatcaacacggagtgtcttctcttgaatccaagcttcagctagaacgtttccctgctaaagaaggtccaaaatgtgtttctaggaatgaagatcagcatgtacagatgcggctggagatctcaacagcatcagagaagcttatcgagtgtcaggagacaatcctaaacctgggaaagcaactgaaagcacttgcatctccaaaggatgcgatccttttcgacaaagtggttcatacaaaaattcagtctgagcgaaaaccccggtctcagtcgctaaacgagatgctagccatggatgatggaggattcgattacctcagctcccccaaaaccaaggagatcatatgcgcggaactaagatcgcggcatgaaagaagttgctctgtcgacaacggaggcgatgattcagtaacatgcagttcccacccaatgccggtggcaccaccaatgaggccctacgatgtgaatggaacttgcaaggatgaggctgctctcaaggtagtagcacttatgccgagcaagcagaaggggaacaccaacttgctgaaaaggattctggcaggaaggagaaaggaagccatgaccaggccaaatgtcgttgcgactgcttag

SEQ ID NO: 694 - DNA, 2727 bp, Oryza sativa
atgaagaaagtattcgatcaaacagtccgggacctaaaaagagaggtgaacaagaaggtcctcaaggtgcctggtatagaacaaaagattcttgatgccacaagcaacgagccatggggcccacatggatcactcttggcagaaatcgcccaagcaacacaaaattaccatgagtaccagatggtcatgaatgttgtgtggaagaggatcaatgacactggtaaaaattggcggcatgtttataagacactagctgatttccagtatatcgattcgagtgggagagatcaaggtagcaatgtacggcggaaatcccagagccttgttagtttagttaatgacaaagagaggatacaggaagttaggcagaaagcacttgctaccagggacaaataccggagtgcattcgccaccagtggaacacacaggagcccaggtggctatgacaatgaccgctatgaaggaagctatggcagtaggtatgataacagaaatggctacgggggagaaagagagtatggatatagggatgatgacagatatggtgttgctggaactactcccaatcgggaaggagatcgttattctagggattctaatgagcagcgctacagcagagatagagaagatgagtacaaaggaagtcatagcaaccatgaatatgcagaaggatcaggtcgcaggagctatggacgagatagggattcatatggggatgatgaagcttattcatcccgtggccggcaaagcaatgctgacggacctactcaggatgagaggcccatggagcggaagccttctaaccagcagattgcttcaccaccgccaaactatgaagatgtcacaagagatacacaggataataatcatgatggacgaaatggagggactgtgcctgtgccagttgctgcagcaaaggtgtcttcacctccaagaacaagtgtacccccaggtcaggtgaatggtgtacatgataatactgtggaagacgtacctgcaccaccacctactcatcctgaagttaatgggtttgacgagtttgatcctcgtggatcagtaccagatacctcacctccagtgaacccctcacaagccgtgaatagcttggaaatggatttattcggaccagatcctattaattcgttggctttggtatctgtgcctcagccaactgccagcccaaatgttgagccatcagcaaatccaggatttgagagtaacagttttatgggcatgccaccggcttctactggattcaatgaggcctttgatgcaactaatccttttggggatcctacgcctttcaaggctgttcatgaagaaactcctgcagtttctcagacaaatgctgcacctgctggttctttccatgctactgaacctgctgcagatgcaaatcctttccagcctgcttcagcagcaagctttggttttggagacactcttggcgacctctcttttggatcgaatgctgcacccgggcagcaagatatttttgtgcccacctcatcacattcagaggtaccacctgcaaacccatctgtgcaccctgaacaggcagtcccatcttatgtctcctcccaggcacctcagcctgcagctgctggtccacaaactcatgctgctcccgcttcatttgcttctcaagcacctcccacttcatttgcttctcaagcacctcaagcaggggcaccctatcctcaggctgcctccacatttcctcattcacaagcatctcatcctgcagccactaatccatctacaatccctcagaatgttgccacaccatttgctcctttacaaatgcctcaacctgtaccatcaggccaatcaaactattttatgcaaccagttccagggactggcattaatggcatgtctggggctccttcacagaatggagcaccatcctacatcccttcacaggcttctcaatttgcagctccaacaaatctacagccctctcagccaaccttccccccacaaactgccatggcagcttcacaggcaacatcaatttctcgaggggcatctcagcctcttgcagtgccgaattcaatgccttctggtgtgaactttccattacaatcaagttcatcagctccccctgaaacaatcctttcagccttgcaagttagtcagtctgagccagtgaagaaatttgagtccaaatctacagtttgggctgatacattgagccgaggtttagtcaatctggacatctctggaccaaaggctaatccgcacgctgatattggagttgacttcgattcaatcaatcgcaaggagaaaaggcaagaaaagaaagtctctcaagctcctgtggtatctacgatcactatgggcaaagccatgggaactggctccggcatcggtcgggcaggtgcgagtgccatggcacctccagccaacccaatgggtgcaagcaggggcattggcatgggtatgggcgctgctggttccggttacggtggtggaatgggaatgaaccggccaatgggcatgggaatgggaatgaaccaacaaatgggccatgggaatggggatgaccaacaggccatgggaatggggatgaaccaacaaccaatgggaatgaacatgggcatggggatgaaccagggtatgggaatgaacatgcggcctcctatgggaatgggtccaggtagtggatataatccaatgggtaccggatacggagggcagcaaccatatggtgggtacaggtga

SEQ ID NO: 695 - DNA, 2562 bp, Oryza sativa
atggcggggtcgaagtttgggtcgttcaagtcggagaaggggagctcggcgggggcggcggcgggggccggagcggcggcgcagaggagggacccatacgaggtgcttggggtggggcgtaatgccaccgagcaggagatcaagagcgccttccgccgcatggccctcaagtaccatccagacaagaatgcagacgaccctgttgcctcggacaagtttcaagaagccacattctcttacaacatactgtcagatcccgataagaggcggcagtatgattcctcgggattcgaggccattgaagcagatagtcaggaactggagttggacctgtcaagtctgaacactgtaaatacagtgtttgctgccctgtttagcaagctaggtgtaccaatcaagaccacagtttctgcaacagttttagaggaagcattgaatgggtcggtgggaatttcccaactcgagcttggccagtccgtctttaggaaggtggaaaagcaatcagctcacttttattctgtggacataacagataaagaagccaaaatggggttagtgtgtagagttcaatcaactgctaaaagtaaattcaagttgctatatttcgagcctgaagaaaatggtgggttaagccttgctttacaggagaaactacgatgcgtggaggcaaagatacttgcaaaacgatctgagctgtctaaatttgagtctgagtatagagagatcgacgagcttctcaaggaaaggaatgcaattcatgcatcctacaccaacaacacaactctgcaacggagttccagtagcaacaaagggaaaacatcctctaaagagtccaaaagtgatgatgaccaaactgtgaaaaaggaaaagaaatcgaagagcaagtccatggagggatccagaagtgatgatgatggtcctagaaaggaaaagaaacctaaggaacgacttcgaaggaagaaatggttcaacatccatttgaaagtattccctgcaagttactactcccaggaaatggaacccaagggagttgctccgagaagaaatatctttttctttgtcgtccactccatgggatcaaataggcaggaatctcagtttgacattcggaaagacaccctcgcaaattattttttctcctgtgacaacagcaaacccaactcctcccccctcctctcctcgcatttcttcgacctgccattccacacccgcgcgcgcctcaaactctatgtgagggaagggaaacaatcgacttcccagctgagaaaccaagaagcagcagcagcagccatgcgtccgtccttcctcctcctcctcgtcgtgtttgccggcgtcttggccggcggggcgcgcgcggggccgccgttggcgggcgagaatctgccggggcagctgttgccgggcgagaagccgccggggcagccgttgccggggcagccgttgccggggcaaccgttgccagggcaatcgttgccggggcagccgttgccggggcagccgttgccagggcaatcgttgccggggcagcctttggtgggcgagaagccgccggggcaaccgttgccggggcagccgttgccagggcaatcgttgccggggcagccgttgccggggcagccgttggtgggcgagaagccgccggggcagccgttggtgccggggcagccgttggtgggcgagaagccgccggggcagccgttggggggcgacaagctgtcgccggattactacgcccagacgtgcccgcgcgcggagcggatcgtcgcggaggtggtccagtcgaagcagatggcgaacccgacgacggcggccggggtgctccgcctcttcttccacgactgcttcgtcagcgggtgcgacgcgtcggtgctggtggcggccacggcgttcgagaagtcggagcagagcgcggagatcaaccactcgctgccgggcgacgcgttcgacgccgtggtgcgcgccaagctcgccctggagctcgagtgccccgaggtggtgtcgtgcgccgacatcctggcgctggcggcgcgcgtgctcatcaccatgaccggcggcccacgctacccgatctccttcggccgcaaggactcgctgacgtcgtcgccgacggcgcccgacaaaggagatgccgcagtccaacttcaccatggaccaggtgatcaagagttcgcgcagaggatctacgactaccaggggaagcccgggaacgtggacccgacgatgaacccggtgctgagcaagggcttgcagacggcgtgcaaggagtacctcaaggacccgacgatcgcggcgttcaacgacgtgatgacgcccgggaagttcgacaacatgtacttcgtgaacctggagcgagggctcggcctcctcgccacggacgaggagatgtggtcggacaagcgcacccagccgttcgtgaagctctacgcgtccaaccccaccgccttcttcgacgacttctcccgcgccatcgacaagctcagcctcttcggcgtcaagaccggcgccgccggcgagatcaggcggcgctgcgacacctacaaccacgggcccatgcccaagtga

SEQ ID NO: 696 - DNA, 2079 bp, Oryza sativa
atgtcgaacaccccggcggtctccacgtattgtggctaccgagaactaaacgcctacaatcgcatcttcctagggactgatgtagagaaaactcctattggccgaagccggtgttcaccacttcaccaccaaaccaaacaggagtggtctggcaggctagtaaacagtgcaaagacagttgaaagctctgctcgcgagttcttaggaaaggacaagtcaactacacttgtggctagtgcaaactttgttgatctggctggaagtgagcgtgcatctcaggcattgtcagctggcacaagactgaaagaaggttgtcacattaataggagtttgcttgcccttggcactgtcattagaaaactgagcatgggaagtaatgcacacataccgtatagagattcaaagcttacacgcatactacagccatctttgggaggtaatgcaagaactgcaattatttgtacactgagccctgccactagccacattgagcaatcaagaaatactctgctatttgggagttgtgcaaaggaagtagttacaaatgctcaggaacttgctagattggagagcgagttgcggcatccagttcagagttccagtctcgaaacattattgaaggaaaaggacaaccaaatcagaaagatggagaaagaaataaaagaactgaagtcacaacgtgatttggctcaatccaggttgcaggatttgctgcaatctgtcggtgatcatgacctgaaccgtcaagttcaaggaaagcattcagtcagaagccctccatctgttggaatgcccccaagcgtcagcagagatgatagttctcaggtctctcatgatgattcagatctttacaaggaagtgcgatgtattgaaagcaatcggacaggaggaaatgaccagttggacttatcagctggtgaaagtagtagcccacaagattcaaatatgaattctggtttgcatggaaatgattcaaatgcatcagtgaattctaggcattcaaggccctctggcgaagctcctattactttggaggaacacttggagaatattagaaggccttttgtcagtctagccaaagatctaggatcttcaacacgtaactcatcaaacttaagagtaattggtagaagcaggagctgtagatcactgacaggttctactatgtttgacgatatggagatggatgattgcactccactaaatagaagtttggtggagttcccaggaagacctgtggaatctcatagaagaggatctgcactgcactatgatgcagagaccgacacactttcaagggcaggatccatgagttctgagatcagcacttttaaggatgcaaagacaaatgggtctgttgcatgcgatacagaattcactggtattggtgaatttgttgctgaactcaaagagatggcccaggttcattatcagaagcagttaggtgaccagaatgcaaatggaaagagcatcggattggacccgatcgagggtgtttctcagtcaccttctcgatggcctttggaattcgagaagaagcagcaagagatcatcgagctttggcaagcttgcagcatttccttggtccacaggacttactttttcttgctattcaagggagaagcagctgactcgatctacatggaagtggagcttcgaaggctatcattcctgagagatacatactcaagggggagcacccctagcaatgcgatagtaggcagcctgagtacttcccctgttgcgagcgcaaagaagctgcagcgggagagggagatgcttgccaggcagatgcagaagcggctgtccacggaggagagggagcacacgtacacaaaatggggtgtctcgctggactccaagaggaggaaactgcaggtcgctcgccgcctctggaccgagacgaaagacctggagcatgtcagggagagcgcgtccctggtcgccaagctgatcgggctccaggagccaggccaagttctcaaggagatgttcgggctcagcttcgcgccgcagcagcagccgacccggcggcgatcctccaacggctggagatacgggatcccttcgttcgcctga

SEQ ID NO: 697 - DNA, 1935 bp, Oryza sativa
atggcacctgatcctgtcatgcaatttcagactattatcaccggatcttcacgtgaacaaacctctggtcaacgtgtcaactcagaagctgctgcgctaaacactccaaatgaaaagatagtgcgtgttccatctgataaacagcttgtgcctggtcaccgtctaacaaacggtacaggtccggtttccagctcaaagcagccctcccacacaggctcatctcctgatcctttggaccctaatggacatcccaaaaagaaaaagaagcctaaaccatggtccagagaggaggacatggaactaggagcaggtgtacagaagcatggtgaaggaaattggatggaaattctgcataaatataaatttgatagttcaaggacgcatcttcaacttcaacagagatgggcgcttatttgcaagcgtcaggggtcaaccaagcctgctacccctaaaatacccaatgttatgtcggaggaactaaaggcagcacaaaaagcattttcattggccattgggacgaccagatcgtctacattaagaccaggaggtgtgccacatcacaatccaatggttactactacgaatcctgaggtgaaatctgttacagcaccttcaccattgccggtaccggtgcatgttgttccggtgcctgttccagtgcaaccagtacaagtgcagttaccaccacctcagttgcatcaagcacctgcgcaatctgcacctccacctccaaaagtatcaaatgcttcaaataagtcacgaaataattctaagaaacaagttgcccaatcaattcctgtgaatggccctttgtcgatacaagaggcagctcttgctgctggtgggcgaattgccgaaccaagtgttgccaccaattttttaaaagctgcacagtccacaaaagctgtgcacataagatctcgaggaacaggatcttcaaaatcttctacgggatctaaaacacctactgtggctggtgaacctgggacacagcttggcagtgatcaacacctagaattacaaagtactggtggtccatctcaagttttgactgcacatgcaactgaacaagttcataatgtttcagaagtcgctggggttaatcctctgggacaatccgctggagtgcatttatcagaaactaagaaagcactgaacaccacaccagtgtctggatcttctgacaaaatggaaatagatgacaactctaattattttgcagtcacaatggaggacttgttccctgaggatgtgaagcaggaagatgttcaagatcccaagattgaggaggccatagaccccaaggatgcagacatgttagaatttgatcgctttgtggcccaaggatgcttaaataaggataatgtggataagagcaaggctgccaagattgctccagaagctcaaagcgttattggcagccagaaaaaacagctgaagacgctgcccacagttggcaaaagcaaccctgtatttgctggacctccagcaactgcgaaaaagaccaaagctccagttccacagggtgggatgtctagcggcatagttggcgtgctgaatagatcattaggagggaaggcacctgctcctgctaccacaggcacccaaagtactgtccagaagcagcaaagcatgagctcaaagggcaacttgttagtgcccaagaatgtggcgcctggcaccgtaacaccagccaacaaccgggccaacacagcggtgaacggggctagcaaggggatgaattctggaatggccttgtttttggctcaagattttttccatgctgcacgcattgcgacgaagatttggagtgtgatagcatttcatacactctactgcatgtcgcttgctttgatcattctttgccattgcggtgacatcgtggcaactggcaatggacggacgctggcaatgctgctggttgttcgaagctga

SEQ ID NO: 698 - DNA, 1857 bp, Oryza sativa
atggagggaagtggacaaagtgataagggtggacatgttacatggacatcttcaatgtctacctacatgcttgaatacctcgagggtattgttgctagtgggaacaaaacttcctcggggtttaagcaagtccacttgaaggcttgtgctaaagctttgaatgatcacttcaatattaatttgacttcagatcagattactaatcacataaggacttggaaaaggaaatattctaagatagctgatttgaggaagttgagtgctgctctttgggatgatgaaaattttatcatatcacttgatcataaacattatgcagaccacatcaaggatcacaaggctgatgctgaatatctgaacaaacctattcacaactatggcaagatgcttgtgatatttggcaatagcttggctacaggaaaatatgcaaaaggatctggtgatcctctagccactgaatctattcccattgatgatgatgaagaagaagaaattggtattggaagtgctgcagcaactggatcagctagtagagttcatgcccttaatgaggaaaatggtgcatcatcttcagcacccaaacccaagaaagctaagactgatgctgcaattgaagaggaagggctgataggcgcatttaaatctgttggtgacaagcttgctggagcaatagttgaagctggaaaagaggctgcaaaatctaacaaagagctgcccgataacctatatgagagtgtgcatagcattccagggtttgaagatacacatcttgctcattaccatgcacatctagttgacaatcctccaactgcaagagtgtttgttacccttgaatttgctcacaaggtagacaacaaatacgtgatgcagttgattatttgtacatgcaactatccaattttcccaagtataccaggtaggagtgtgggactgggagcggcggcggcgtcggaggcaatggacgcttcgtcggtggcgctctacggccagctcaaggctgctcaaccattcttcttgttagctgggcctaatgtgattgaatcagaggagcatgtcctgaagatggcaaaacacatcaaaggcatcacaaccaagcttggtctgccacttgtgttcaagtccagctttgataaagcaaatcgtacatcatcaaaatccttccgtggtcctggtctggaggaaggcctgaagatacttgaaaaagtgaaagcaacatatgacattccagtggtcactgatgtgcatgaaagccaccaggcatgtcccagtcgtttttgccagtttgaatatcatcagaaaaacaagactgatcttctagtggctgctgccaagactggaaaaattatcaacatcaagaaaggacaattctgtgctccttctgttatggccaactctgcagagaaaatcagacttgctggaaatcaaaatgttatggtctatgatctaattgttgatccaaggaattttgagtggctgagagaagctaattgtccagttacctttgaattagctatcaactatggtatagtacgtggaccattgatggatattacatttcaggtagctgatgtaacgcatgctctacaacagcctgctggaaaaaagcttgatggtggaggtgttgcaagtgggggcttacgagaactaataccatgcatcgcaaggacttctgttgctgtcggagttgatggtattttcatggaggtacatgatgatcccttgaacgcaccttgtgatggcccaactcaatggccactgcgcaatttggaggagctattagaggagctgattgcaattgctcgagtcaccaagggaaagaagccactcaagatcgatctcacccccttcaaagaataa

SEQ ID NO: 699 - DNA, 1833 bp, Oryza sativa
atgggcgaggaagaagctgagagcatcctagaggcgctcaagaagaacattgatatcttcgccaggagccccgatgaggtgggaggtgttccgacagatctcatcatgcatcacctggcggtcaaaccggataccaagccaaaaaaacagaagctgcgcaagatgtccgccgatcgccaagaagcgacaaaagccgaagtccaaaaactgctcagagctggggtcattcaagagattgaccatccggagtggctggcgaatctagtgctggtgcggaagtcaaacgacaaatggcgcatgatgcctttcggcctgaggaatgcaggagcaaccatcgccatgctggtgtataaggtcctttgcaggcagttggggcgaaacgtggaagcttatgtcgacgacatcgtcgtaaaaagccgcaaggctttcgaccatgcgtccgacctacaggagaccttcgacaacttgcgtgcagcgggcataaaactgaatcctgagaagtgcgttttcggcgttcgtgcaggcaagctgttaggcttccttgtttctgaaagaggcattgaggcgaatcccgagaaaatcgatgccattcagcaaatgaagcctccgtcgagcatacatgaagtacaaaagcgccaagcagcgttcgacgagctaaagcaatacctgcaaagcccgccagctctgctaagcccagcaccaggaagcgaactgctactatacttagcagcttcgccggtggcagttagtgctgccctcgtccaagaaacagagttcggccaaaaaccggtctatttcgtctccgaagcattgcaaggagcgaagacaagatacattgaaatggaaaagctcgcttacgccctggtgatggcttcgcgcaagcttaagcactactttcaggcccacaaagtcatagtgccatcacaataccccttgggcgaaatactccgaggcaaggaagtcaccggccgactcagcaagtgggcggcagagctatccacgttcgacttgcattttgttgcacgcactgctatcaagtctcaagtgctagctgacttcgtagctgaatggacaccggtattcgcccccgagcccgagcccgtcgaacaattctgggtgatgtgctccgacggttcatggtcgcacaagggggcaggcattacgacagtacacatttcaccgaatggtgtgccgattcggtacgctgcaaggctgcagttcgacacaaccaacaacgcagcagaatacgaagccattctcctgggcctaagaaaggcgaaagcactaggggtccggcgcttgctaatccgaaccgactccaagttggtggcaggccatgttgacaaatccttcgaggcaaaagaagaagggatgaagaggtatttggaggccgttctgtccatggaaaagtgcttcaccggcataacggtcgaacacttacctagaggccagaacgtggaagcagacgccttggcgaaatctgctgcttgtggtggcccacattcgcctggcatcttttttgaagtcctgcatgcaccaagtgtgcccatggacagcttggagatcatggcaatcgaccaggtgaaactaggcgaagacccatacgactggcgaaccccgtttgtgaaacaccttgaaattggctggcttccggaagacgaagtagaagcaaagtgcttgcaactcagagccacaaagtataagatggttccgggccagctctatcgctccggggtacttcaacccttacttcgttgcatctctttcgccgaaggcaaggaaatgacaaaggagatacaccaggggctatgtggcgcgcaccaggccgcatga

SEQ ID NO: 700 - DNA, 1764 bp, Oryza sativa
  misc_feature (1686)..(1686): n = any nucleotide
atggccggcgctagatctgctccaagtgtcgctgccgcccccttacccatgccgctcccgaggcccagcagcagcggatccactctccagaagctcgttggccctgccgccccttcccttgcgccgttgacgctgagagccgcgtttgtctccttccccgcgctgcttccgaggcccggcactagcggatccgccctcccaaggcctgcccgcgccggattccctcctcggtgccccctctcccatgcctctactgccgcccccttccccacgcagccaccctttccctcatcattgccattgcccagctcgacccgctttggccagccagatccactagcagggaggttgggtcgccagatccggaagccctctcttatgcgaggcggtactgggcggcggtggagagagaagggacgccggagggaggagggagaagggtgggagagaggtgtagagagaagggaggcggaaggacccgagggaagagggagagagccgaagggagtttgtggcgtcctttacctaccgttagcgaaaacccgatttttgctgagctttgggaatcttggaggaggaggaggagcaggggggagcggcaaggcggcggcgtcgtcgttcctgcagctgccgctgtccacggcggcggcggccaccgcgtactacggcacgccgctcgccttgcaccaggcggcggccgcggctggcccgtcgcagtaccacggtcacggtcacccccaccacggcggcggccaccaccacagcaagcacggcggcgccggtggtggggagatctcggcggcggaggccgagtccatcaaggccaagatcatggcgcacccccagtactccgccctcctcgcagcctacctcgactgccagaaagtcggagcgccgccggaggtgctggagaggctgaccgccacggcggcaaagctggacgcccgccctcccggccgccacgacgcgcgcgacccggagctcgaccagttcatggaggcgtactgcaacatgctggccaagtacagggaggagctgacgcggccgatcgacgaggccatggagttcctcaagagggtggagtcgcagctcgacaccatcgccggcggcgcccatggcggcggcgccggctcggcgcgcctcctcctcgccgatggtaaatctgaatgtgttggttcttctgaggatgacatggacccaagtggccgcgaaaacgagccgcctgagatcgacccgcgcgctgaggataaggagctcaagtttcagcttctgaagaagtacagtggctacttgagcagcctaaggcaagaattttccaagaaaaagaagaaaggaaagctgcctaaggaggccaggcagaagctgcttcactggtgggagctgcactacaagtggccttacccctcagagacggagaagattgcgcttgcggaatcgacaggactagatcagaagcagatcaacaactggttcatcaaccagaggaaacggcactggaagccatcggaggacatgccgttcgtcatgatggaaggttttcacccacagaatgctgctgcattgtacatggatggcccgttcatggcagatggaatgtaccgcctcgacggatggttcgaattaaaatcgaaattacttgtgaaattgctggacctggatgttctacttcctagagctgtgaatttnatagtttctggatttggtaatcaggcatgcttggtgaagcatttagaaattatgtatacatttccagatgataattaa

SEQ ID NO: 701 - DNA, 1620 bp, Oryza sativa
atgggaagaggagaccacctgctgatgaagaacagcaatgctgctgcagctgcagctgctgtcaatggaggtggcaccagtttggatgctgcattgaggcctctagttggttcagatggctgggattactgcatctactggaggctctctcctgatcagaggatgcatgcgcaggcattgctgtcgaaccagccgatctggcagagcagcagtgaggaggaggaggctgatggcggcggtggcgccaagacgcggctgctggtccccgtcgccggcggcctcgtcgagctcttcgcgtcgagatatatggcggaggagcagcagatggcggagcttgtcatggcgcagtgcggcggcggcggcgccggggacgacggtggggggcaggcgtggccgccgccggagacgcccagcttccagtgggacggaggcgccgacgcgcagaggctgatgtacggcggctcgtcgctgaacctgttcgacgccgccgccgccgacgacgacccgttcttgggtggtggtggtggtgacgccgtgggcgacgaggcggcggcggcgggcgcgtggccgtacgcggggatggcggtgagcgagccgtcggtggcggtggcgcaggagcagatgcagcacgcggcgggcggcggcgtggcggagtccgggtcggaggggaggaagctgcatggcggtgacccggaggacgacggcgacggcaaggggcgctccggcggcgccaagaggcagcagtgcaagaacctcgaggcggataggaaccggaggaagaagctcaatggccacctctacaagctccgctcgctcgtcccaaacatcaccaagatggatcgcgcgtcgattcttggagacgcgatcgactacatcgtggggttgcagaagcaggtgaaggagctgcaggacgagctggaagacaaccatgtccaccataagccgcccgacgtgctcatcgaccacccgccgccggcgagcctcgtcgggctcgacaacgacgacgcctcgccgcccaacagccaccaacagcagccgccgctcgccgtttccggcagcagcagcaggaggagtaacaaggacccagcaatgaccgacgacaaggtcggcggcggcggcggcggtgggcaccggatggagccgcagctggaggtgcgtcaggtgcaggggaacgagctgttcgtccaggtgctctgggagcacaagcccggcgggttcgtccgcctcatggacgccatgaacgcgctcggcctcgaggtcatcaacgtcaacgtcaccacctacaagaccctcgtcctcaacgtcttccgcgtcatggtatacgccccgctcgccgccgccatggccatgaacgcgagctcgcgagctgactactccgagctggtgagggacagcgaggtggcggtgcaggcggacagggtgagggactcgctgctggaggtgacgcgggagacgtaccccggcgtgtggccgtcgccgcaggaggaggacgacgccaagttcgacggcggcgacggcgggcaggctgcggcggcggcggcggcggccggtggagagcactaccacgacgaagtcggcggcggataccatcagcacctgcattacctcgcgtttgattga

SEQ ID NO: 702 - DNA, 1524 bp, Oryza sativa
atgctcagcttctcgtcctccgcctcgtcgtgctcctccggcggcggtggcgccgccgtggccgctgcggcggcggctggcggggcgatgccgctgtactatggcacgcctgcttcttgctcaggattgagctcagtgagcttgagcagcagcatgcagggtgcaatggccagggtgaggggtcccttcacgccgtctcagtggatcgagctggagcaccaggcgctgatatacaagtacttggctgcgaatagccctgtaccacacagcctcctcatccccatcaggaggagcctcacatcgccctactcacctgcctactttggctcaagcacattgggatggggatctttccagctgggctactccggcagcgcggatccggagcccggccggtgccgccggacggacggcaagaaatggcggtgctcgagggatgcggtcgccgaccagaagtactgtgagcgacacatgaaccggggacgccaccgttcaagaaagcatgtggaaggccagcctggccatgccgcgaaagcgatgcccgcggcggtggcagcagccgctgcctctgctacccagcctagtgctccggccgcccacagtggcggagctgttgctggcctcgctatcaaccatcagcaccagcaaatgaagaactacgctgccaacactgccaatccttgctctctgcaatatagcagggatctggcaaacaagcataatgagagtgaacaagtgcaagactcagacagtctctcgatgctgacttccattagcacgagaaatacgggcagcctgtttccgttctcaaaacaacataatccttttgaagtgtccaactcaaggccagattttggcctagtatcacctgattcactgatgagttctcctcatagctccttggagaacgtcaatttgctcacttcgcagagtctgaatgaacaacagagttcagtttcccttcaacactttgtggactggccaaggacacctgcacaaggagctctcgcatggcctgatgctgaagacatgcaagctcagagaagccagctctcaatatctgctccaatggcgtcttctgacctgtcatcagcctcaacatctcccatccatgagaagctgatgttgtcaccacttaaactgagccgtgaatatagtcctattggtctcggttttgcagcaaatagagatgaggttaaccagggagaagcaaactggatgcctatgttccgtgattctttgatgggcggaccattgggagaggttttaaccaagaataacaacatggaagcaaggaattgcctatcggagtctctgaatcttttaaatgatggctgggattcaagctcagggtttgattcatccccagttggtgttctgcagaagaccacctttggatcagtatccagtagcaccggaagcagtcctagactggagaatcatagtgtttatgatggcaacagtaacctgcgggatgatctcggttcagttgttgtaaatcatccgagcatccgcctggtgtga

SEQ ID NO: 703 - DNA, 1467 bp, Oryza sativa
  misc_feature (354)..(354): n = any nucleotide
atggcggcgtcgctggcaatcgttgccgtggtcgtcgcgctgtgcgtggcggctgccgcgtcggccgagacggcgacgtacatcgtgcacatggacaagtcggcaatgccgagcggcggcggcggcgggaacgggtcgaccagcctggagagctggtacgcggctacgctccgggcggcggcgccgggcgccagaatgatctacgtgtaccgcaacgccatgagcgggttcgccgcgaggctgtccgccgagcagcacgcgaggctgagccggtccccgggtttcctctcgtcctacctcgacgcccccgtgacgcggcgcgacaccacgcacacgccggagttcctcggggtnagcggcgcggggggcctgtgggagacggccagctacggcgacggcgtcatcgtcggcgtggtggacaccggggtttggcccgagagcgggagctaccgcgacgacgggctcccgccggtgcccgcgcggtggaagggctactgcgagtccggcacgcggttcgacggcgccaaggcgtgcaaccggaagctcatcggggcgcgcaagttcagcgcgggcctcgccgccgcgctggggaggcggaacatcacgatcgccgtgaactcgccgcgcgacacggacggccacggcacgcacacctcgtcgacggccgccggctcgcccgtcccgggggcgtcctacttcggctacgctcccggggtggcacggggcatggcgccacgcgccagggtggccgtgtacaaggtcctgttcgacgagggcgggtacacgacggacatcgtcgccgccatagaccaagccatcgcagacggcgtcgacgtgctctccatctcgctgggcctcaacaaccgcccgctccacaccgaccctgtggccatcggctcgttcgccgcaatgcagcacggcatcttcgtgtccacctcagccggcaacgacggcccgggcctctccgtcctccacaacggcgcgccgtgggcactgaccgtcgccgctggcaccgtggacagggagttctccggcatcgtcgagctcggcgatggcaccaccgtcatcggcgaatcgctgtacgccggctcgccgccgatcacccagagcactccactcgtgtacctcgactcctgcgacaacttcaccgccatcagacgaaaccgcgacaagatcgtgctgtgtgatgcacaagcttcctcctttgctctgcaggttgcagtgcagttcgtgcaagatgccaacgcggccggcgggctcttcttgaccaacgacccgttcaggctgctgttcgagcagttcacgttcccgggcgccctgctgagcccgcacgacgggccggcgatactgcggtacatccagaggagcggcgctccgacggccaagatcgcgtttccgggcgacgctgctgaacacgaagccggcgccggaaggcggcggcgtactcgtcgcgcgggccggcggtga

SEQ ID NO: 704 - DNA, 1242 bp, Oryza sativa
atggctaggattctttatctaatcaatttggtggttcttttccttggctttaatctgcacagagctctctcatggaggaaccaaagttacatgaatgatatcgctgatcgatgtgccccttcaccccatcctttaagtatgtgccagtcacgagcagcagcttttggctatccatgtgaagaatacaaggtcacaacagaagatggctacattcttagtttaaagaggattccccatggtcctcatgactctaacacctcgactgagatgaggccaccggtactgcttttccatggacttatggtggatggtgctacttgggtaatgagtactccaaaacaatcacttggatttattttggcagacaatggatttgatgtttggattgccaatagtcgtggaacaaattccagccggaaccatacctcactctccacaaaagatccggcttactgggaatggtcgtgggacgaacttgcttcctacgatcttcctgcagtgctgcagtttgcctatgatcacacaggcgagaaaatccactatatcggtcactccctgggaaccttgatgattcttgcagccttctctgagcacaagttactagatgtagtgcgatcagctgttttgctctgcccaatagcttatctgagcaggacgaaatccaaactccttaagcttgctgctcacatcttccttgcagaaacagttcactggctaggcttttacgagttcaatcctgttgggccagttgcacatgaagttctaagccaaatatgcggcgatcctgaaattaattgctatgatctattttcggctgtagcaggaccagattgctgcctcaatacttcaaccttttgtgcctttctagagcatgctccacagtctacctccgtcagaaacctcgttcacttgtcgcagctggtaagaaatggaggtgtcagcaggttcgactacggcaacgccaaggataacatgaagcattacaaccagccacgcccaccgccgtacaacctctcctccattccgaatcatgtccccatcttcctcacccatggtggcgaggactacctcggcgatgtccccgacacaaggcacctcctgaggacgctggtcaagaagcacaacagcgacagcatcgaggtgatctacgtgccagactacgcgcatgccgactttatcatggcctacaatgctccagaactcatatacggaccgatggtcgacttctttaagcgtcactga

SEQ ID NO: 705 - DNA, 1215 bp, Oryza sativa
atggtcagggatgcttatggtacagcttcatcaagaagagccttcatggcatatgtgtctgaagggttgggcagcctacaagattgggatcagtacaaactctcatttggaaatgttaataatcatttcggaactattgagcagatggaatggctcaatttgtggaacaatccagctttgaatgactcaattcatggatatctaaatgatactaaggctttgctggagttgtacagaagttcacaaattcgttgcttggaagatgatttgattctacaagatattggttcttgccatgcaaaagagaaggcaattatttctcataatgccattatcatactttcgcaggtggagtatgccttgaaattcccagtctatgccaccttggaaaggctagagcagaagaggaacatagaacaattcaagaccaaggaacaactaaaaattgagggcttcaagctgctgaaatcaggataccggtgggacgggcacggtgagattggcttctcctccgagtgtgtagagattctattctatgctatttacaacacgagcaagcagattgcggaaaaggccgtgccgctgcagaaacgcaatgtcgtggatcatatcgccgaatcgtggtggttcacagtgaggggcatgttgaccgaggcagaatggaggatggacaagtatgtgccaacaacagtggaggagtacatgtcagctgccgtggactcctttgctctaggccccaccatcacctcagcggcattgttcgtcggaccagagctctcggaagaggttttcaggagcaaggagtacatccacctaatgaaccttgcgaacactatcggccgccttctcaatgacatgcagacatacgagaaggaaatcaaaatggggaaggtcaatagcgtcatgttgcatgctctttcccacagcggcggcggccgcggctcaccggaggcatcgatggaggaggccaagagagagatgaggagggttctccagggtagtaggtgtgacctcctaaggctggtgactagagatgggggggttgttcctccaccgtgcaggaagctcttctggttcatgagcaaggttttgcacttcgtctacatggaaaaggacgggtatttcacggccgatgggatgatggcatcagcaaatgcggtgattcttgatcccctgcaagtgacacttcttccatctggtttgggaacgctgtga

SEQ ID NO: 706 - DNA, 1173 bp, Oryza sativa
atgggttcccgcgacggatggcggctactcctcctcctgctcggcttcctgctcgtggcgccgacttgccgcgctcgggaggcgcagccgctgccggtactggaggaagaggaggtggtggcggacgcggcaggagggcgtggtggcgcgggcgctgctgccggcggaggaaacaggcgcgcgccggtgcggcacgagctgtcgctggacttctacgccaagacgtgcccggccgtcgaccagatcgtcggcaacgtcaccgcgccgcggttccgcgacaaccccgccgccggccccgccgtgctccgcctcttctaccacgactgcttcgtcgaagggtgcgacgcgtccatactgatcgcgccgacggccaacaacggcggcggggcgccgagggtggagagggacatggaggagaaccggaacctgccgcaggaggcgttcgacacggtggagatggccaaggccgccgtggagaaggcgtgccccggcgtcgtcacctgcgccgacgtcctcgcgctcgccgcccgggacttcgtccacctggcaggtgggccctactacgcggtgaagaagggtcggaaggacagcagggtgtccctggcgggcaaggtgcggggcagcctcccgcgcgccaactccaccgtggacgagctcctccgcgtgttcgccgccaagggcctcggcgccggcgacctcgtggcgctctcgggcgcgcacaccgtcgggttcgcgcactgcgcccacttcctgggccgcctctacgacttcggcgggacgcggcagccggacccggtgatggacgcgcggctggtgaaggcgctgcgcatgtcgtgcccctacaccggcggcagcgcccgcgtggtggtgcccttcgacgtgagcaccccgttccagttcgaccacgcctactacgccaacctgcaggcgaggctgggactcctcggctccgaccaggcgctgttcctcgacgcgcgcaccaggccgctcgtcgaggggctcgccgccgacagggagcggttcttccaggcgttcgcggccagcatggacaggatgggctccgtccgggtcaagaagggcaggaagggggaggttgatgtgatggaaaaagttgaaagtttagggaagtttggatctaaacacagccttattgatatggccaggttgatgtga

SEQ ID NO: 707 - DNA, 1125 bp, Oryza sativa
  misc_feature (556)..(556): n = any nucleotide
atgttcgccgccatctgccgccgccggctcgccgccctattcccccaaatccgcggtggcggcggcggcgcatatcatgtccagtccaacccccaggccgccctcctcttccacagctactcctcaaccgccgtcaccggcggctccgaccccgagccatgccccgacaccgtctcttacctggtctcctgcggcctccccccggccgttgcccgtcacacggccgccaacacccgcggcctccggatccgatccaccgagaaggcggacgccgtccgcaccctcctccgcagctacggcttctccgacgcggacgtcgcccggattgcccgcagcgccccgctgctcctcaccgtcgatcccgaccgcatcatccgccccaagctcgagttcttcgccacgatggggttccagcccagcaagctgtccaccgcgccgctcctcctcgcgcgcagcctcgagaagcacctcgtccccaccatccagttcctccgcagcatcatcggcagcgacgacgggatccgccgcgggttcttcccgcatccctcgcgcactncctggtcagcctggacaactgcatgcgccccggcggtggaagccctccacaggcacggcctcaccggccgcgaggacgtgtccaaagtcctcgtcctccagatgggcgtgctcatgctgtcgccggtccgcatcggcgaaatcttcgaggatctcaaggctatgggtatgtccatcacggacggccgctttgccaactcgttccgcgcgatgtgcagcatgaggagggcgacctggctgcggaaggtggcgctgtaccggagctttggcttgtccgagagtgaggtgttcgaggccttcaagaagcagcccacggcactgcttggcgctgacgagaccataaaaaagaatgcgtcgttcttccgcgacgcgctaaagcttgaaatgcgcgaggtaatggtgcatcctgttgttatggcatatagctttgagaagaccatcctgccaagtgccaagacattctcagggaggtatgtagataggtttgctgctgatgtgccagacgttgttgaagcatatgagggtaagatcaaattcaaaggattcaagggtcagggtcagggtgtttaa

SEQ ID NO: 708 - DNA, 1092 bp, Oryza sativa
atggcggcggcgctgtccaagctcctccgccgtcggctgcgcggcggcgggcaccgcctgctcccgtcccgtccctccacctccgccgcctcccagccacctccgccgcctccttccgccgccacaccgccaccaccaggggcagggaaggaggcgggcgcgtggtccaagctcttcctctttgcccccggcgccatcaccttcggcctcggctcatggcagctcttccggaggcaggagaagattgagatgctggactacaggacgcggaggctggagatggagcccattgcgtggaaccagatggccccgtctgatctcagtgccggggtcgatccggccacaccggagttccggaggatcgtgtgcgagggtgatttcgacgaggagaggtcggtgttcgtcgggcctcgctccaggagcatctctggtgtgacggagaatgggtattatgtggtcactccattgataccccggcctagtgagcatggcagttcgtggccacctatacttgtgaatagagggtgggttcctcgtgattggcgtgataagaacgtacaggatcaccagggcgtcagagaagttccagaatataaagaggctgataaaaagacagatggaaaaggttcatggtggaagttttggtctaactctaaggagcctgaacaatcttgtgagattgaaaaacctgtaaaacctcctgtaagagttttgggagttatccgaggaagtgagaagcccagcatatttgttccagctaatgaacccagtgttggccagtggttttatgtggatgttcccatgattgctcgtgcatgtggcctccctgaaaatactatttatatagaagatataaatgaggatgtctctccaacaaatccttatcctgttccaaaagatgtcagtactttgattcatcactcagtgatgccacatgaccatctaaaatacaccgttacatggtacactctttctgctgctgtgactttcatggctgcaaagcggataaaggcaaagaagctcaagttcccgctgcttcagaaagagatgttcgataacctgagtactgcatcttcatctctcaggcaatga

SEQ ID NO: 709 - DNA, 1071 bp, Oryza sativa
atgtaccaagagtttctcctccggtccaagctgagggaagcccaagtccagggtgcgcctgctggacaactgttgggccagttcgccatgccaagccaagctcaaggggcctcgccccaaggccaactgccacagtttgacccgagcaccacggtccatgcacccatgactttcgcacaagccgtgccctccgggtacggagcgatcccaccgccgaatcaagcctggaatccagccatgttcgatccagctgtggcgatgcaagctgcttccacagaccagcagaaccaggcgatggtgttcggcacggggcatcaatcaacacctgcagctcaacctcatgtgcaagttgtaggttcgccattcgcgctcccatacccacagttgaactggccctctcagaccgatcgagctggcaaggcggtgatggtagtcgaagaagtgcaagccctccacaaggagttcgacgcccaatgggcttgccaacactggcattatcccaagcgccaacttcgctcaaggagttcggaggagaagcagtgcaagctttgggtcaggccctcctcaaagtcgccttcggcacacaagaaaacaagagaagaagagatacccttcgatgttgttgacatcccatataattacaacgccatcttcggtcgaggcactttgaacaagttcgaagcaatctctcatcacaactacctcaagctgaagatgcctggcccaaccggtgtaatagttgttaagggtttccagccttcagctaccgcggtgacctccttcgatagggaagttcataccttacaagtcgaagggcaagaaagagccataccaacgacgaaacctgccccacacggcaagattttccagttgcagatagatgatactgaccccacaaaagtcgtatcactcggcggagacctaggcgaacaagaagtgaatagcatcttggccgtgctcagtaagaacattgatatcttcgcttgggggctagacgaagtgggaggtgtttcgccagatctcattgtgcaccatctagcagtcaagcctgacgcaaagccgaagaaataa

SEQ ID NO: 710 - DNA, 1026 bp, Oryza sativa
atggaggtgacggccgagttcggcggcgcctactacggcggcgcggcgggccgcgagaagaaggcgctgcagcaggggtgcggggaccacttcgccgtggacgacctcctcgtgttgccctacggcgaggaggatgaaacaacaagggagggtgaggccaccggcggtaaggaggaggctgccggctttgggaacgcgtcggcggactcgtcgaccataacggccctggatagctgcagcaattccttcggcctagccgacggcgacttccccggcgagctgtgcgagccgtacgatcaactcgcggagctggaatggctatccaactatatgaacgagggagacgacgcattcgccaccgaggacctccagaagctgcagctcatctccggcatcccctccggtgggttctcgacggcgagcgtcccgtcggctcaagctcaagctgcgtcggcggctgcctccatggcagtgcagcccggcggcttcctgccggaggcccctgtccccgccaaggcacgaagcaagcgctcccgcgctgcgcctggcaactggtcgtcccgcctgctcgtgctgccgccgcctccggcctccccgccgtccccggcatccatggccatctcgccggcggagtctggcgtgtcggcgcatgcgttccctattaagaagccgtcgaagccggctaagaagaaagacgcgccggcgccaccggcgcaggcgcagctctcgagcgtgccggtgcactcgggcggctcggcgccagcggccgcggccggggaagggaggcggtgcctgcactgcgagactgacaagacgccacagtggaggacggggccgatggggcccaagacactgtgcaacgcgtgcggggtgcggtacaagtccgggcgactggtgccggagtaccggccggcggcgagccccaccttcatggtatcgaagcactccaactcccaccgcaaggtgctggagctgcgccggcagaaggagatgcaccagcagacgccgcatcatcaccagccgcag

SEQ ID NO: 711 - DNA, 975 bp, Oryza sativa
  misc_feature (9)..(9): n = any nucleotide
atgggggantgcggcggcggcgagtacaggtgctgggaggagcttctgccggacgcgctggggctcgtcttccggaacctgccgctccgggaggtgctgacggtggtgccacgggtgtgcaagtcgtggagccgggtggtggccgggccgtactgctggcaggagatcgacatcgaggagtggcggcagcagcagggcaagcccgagcagctcgtccgcatggtggagatgctcgtcgcacgcagctgcggctcctgccgccgcatcagcgtctccggcctccccggcgacccgctcttctccttcatcggagaccatgcacgggcactgaggacgctggagattccacggagcgagatcagcgacgcggcggtggagagcgtggcgccgaggctgcccaacgtgacgttcctggacatcagcagctgcaccaagatcggggcgcgcgcgctggaggcgttcggcaagaactgcaagtcgctggtggggctccggcgggtgatgcacccgacggacgtcgccggcaaggcgtgccagcgcgacgaggcgcgcgccatcgcctgcaccatgccgaggctccggcacctggagatgggctacatggtgatcgcgacggatgcggtgctcgacatcctcgcgcggtgccgcgacctccggttcctcgacctccgcggctgctgggccgtcgacgacaagttcctgcaggagaggcacccggggctgagggtgctcggccccggcgtcgacgactgcttcgagaacagctacctggaggagtgctccgactactccgacgactcctccatctactcgtgggagctcatggaggacgacgacgacgactactacgccgtcgggagcgacgacgaggccatttgggacgacggccagggcctcgagaacctggaggtcaggttctacggcggcggcttcagcgagagctatgctggcttcgattggccaccatcaccatga

SEQ ID NO: 712 - DNA, 912 bp, Oryza sativa
atgtttgaaagaggagttaaattgtgtttgtcatacatagaagcagttccatggaatgagaacgaggaggagaagctcaagaatctctttgcaagatgtacttttgatgaagcaatatcccaagatgttctggctagattgcggcctcacagctggagcagctcagaagacctcacagtgcatcttatccaatcagtcacgagcagcaccaacagtggtgcaagaaaagatatgcaatctttggtaaatggccttctaagcaaaagttctgtctaccaaaaagacatggcagggctaaacagagagagcctgtataatatctgttatgcctgtttaaattcactagtggatctttatgacgaagcaacagaggctacaaaccacactgctcaagcattagttatcaagggcagtaaaccatttattgagagaatctctcagcagacagagaacctcaactggctcttggacattcttgtgaatattgacatggctgaagagtttgtggagctgtgggcaaagcaagacaggctcatcaggatacatgagcaggcatcacccatgatgaggtatgaactaagccgaatatctgctagtgttttcatcgcactcggcaaaggaaaagttcagtgccgtggagagctgaggagcctcctcttctacggatggttcagcccgatgttgcttgatttcggctggcttcagcgatgctccaaaggtctggatgtaagatctttggaggaaaatctaggacaggccctactaaccctcccactcaagcagcagcagtgtctatttgaggagtggtttcagtgttttgcatccaaaggatcagagtgcccgaaccttactagagctttccaggtatggtggagaaggtccttcgttagatcatcggtagaaggtcagtga

SEQ ID NO: 713 - DNA, 867 bp, Oryza sativa
atggtgtctctccgcgcggccatcgtcctcgtcgtcgccgcctcgtcggtcgccgtcgccttctctcatgcggaagggaacgaggggccggacttcacctacatcgaaggcgccatggacgggccgtcgaactgggggaagctgagcccggagtacaggatgtgcggcgaggggaggtcgcagtcgccgatcgacatcaacaccaagaccgtcgtcccgcgctcggacctcgacacgctggaccgcaactacaacgccgtgaacgccaccatcgtcaacaacggcaaggacatcaccatgaagttccacggcgaggtcggccaggtgatcatcgccgggaagccgtacaggttccaggcgatccactggcacgcgccgtcggagcacaccatcaacggcaggcgcttcccgctcgagctccacctcgtccacaagtccgacgccgacggcggcctcgccgtcatctccgtcctctacaagctcggcgccccggactccttctacctccagttcaaggaccacctcgccgagctcggcgccgacgagtgcgacttcagcaaggaggaggcccacgtcgccgccgggctggtgcagatgaggtcgctgcagaagcgcacggggagctacttccggtacggcggctcgctgacgacgccgccgtgcggcgagaacgtggtgtggagcgtgctcgggaaaggttttcccccgttgttctactcttccgtgtcaaagagtgcatgtcagattaagcagaaccaccagctaatccccttcgatgcgcagccaccgcgccgcaccaccggccggggcttgagatgggaattgaagcacgacggagatcgagactcttctactttcaagatatga

SEQ ID NO: 714 - DNA, 834 bp, Oryza sativa
  misc_feature (791)..(791): n = any nucleotide
atggagatttattctaacaccacaaggtttgcgcttgcatgcaacacttcatctaagatcattgaacccattcaaagccgttgtgctattgtacggttctcaaggctttcagatcaggagattcttggccgactcatgattgtggtagcagctgagaaggttccttacgtgccagagggacttgaagctatcatctttactgctgatggtgacatgaggcaagctttgaacaacttgcaagctacagttagtgggttccgttttgttaatcaagaaaatgtgttcaaggtgtgtgatcaaccacatccgttgcatgtcaagaatatggtgaaaaatgtgcttgatggaaagtttgatgaggcttgctctgctctgaagcaattatatgatttgggctactctcccactgacataatcactactctcttccgggttatcaagaactacgacatggctgaatatctgaagctggaattgttgaaggaaaccggatttgctcacatgagaatctgcgatggtgttggctcatttcttcaattatcaggccttctggcaaagtttgcgttgttgtacatctgtgccaccacacaactgagcttaggtggcccctcgaccaatgataggctacgaagcattgcaccatcaaaggaagatgcgtgcaacacgataccggcgttgatagctcgagactatcaaacacagacctatgatcagaacctcacataccagcacgacaattcggagcttctacaaaatgtatcacatctccctgtaacaaaagctagaaaccngaaacaccaacaccctgagccagccaacaaaaaacacagatga

SEQ ID NO: 715 - DNA, 765 bp, Oryza sativa
  misc_feature (489)..(489): n = any nucleotide
  misc_feature (593)..(593): n = any nucleotide
atgttatggctgcgtggatttttcaccctgcgtgaaggaattaacagccagacagtactctacacaaatgttttcaagtcacaaggtataggttcacatgactcagtgaggttttataaagagccttgggattcagaaaggaaagacttagggttgcaagcgggtcaacccgtgaacccgcttataggcaaaattagtttgcgagttggcccgcttgcatccctagatgccgtcttagctcttaacaagcatgggattggggtgctgcacgccgcggcatgccagggccatctgaatgtttgcaagttcttggtggaggaattggggggtgacgtgaatattgctggaaaagaagatataacaccgtttatggccgctgctgagtctggtgatgttcctacggtggagtattttcttgatcatagtggtgatgtaacaaaagcagatgttagaggatgcacagttctccaccatgctgctggcacaggnatacctgttgacatagactgtggccttggaacaccactctttcatgctgctaacaatggcaaggataagacactgaagattttgttggatcacaaggcagatgnattggctatttgtgacagacatttgaagagtattgacatattatcttcaacaacgggagacgacgacaggattctcgagaacccggccgacgtcctcgtaatcgtttgccggaaccaagcaacccatcgtcatcgtcatcatcctctagatgttgatctagagcttaaataa

SEQ ID NO: 716 - DNA, 750 bp, Oryza sativa
atggaggtagaacaagttctatctatcacctccaaccccaaggtagacagtatcaccaatggcgacaatgtgatcatcatccctagtgtgagcacggaggagaaggagcacatcaatggagctgcagagacaaatcatgttgtgatgatcaccgctgcttccatggacagaaccgacggcgacgacaggacgatgaaggaggaggagacggacggcatcgccatcgccaggagcgcctcctccaacggaagccggcagcaagacaagaagcggggcgcgttcggcctcttccgggcgatgttcatgtccttcaacggcagcgccagcatcaagaagagggccgccgccgccgccgccaccatgggctatcagaagaaggccgaggcggccggcggcggcgcggcggctgacgtggagaggtcgtccagcgacgtcgcgtcgtggaagaacctcgtcgacggcatgcgcccgctccgcctccacggccacctggagtactacccgccgccgtcgccggacaggagcgatggcacgagcatgaccagcagctactcgtccgcccaggacctgcaggagcttgtcaatggccatggaaaagaagacgaggaagaagaaaagaattctctggagacggaggacggtggatgcagcccgaatccgatcgacatgcaggccgaggagttcatcgcgaaattctacgagcaatttaggctgcaaaagtcggactcattcaacaaccgagcctattga

SEQ ID NO: 717 - DNA, 726 bp, Oryza sativa
atgacccgacatctcatctcactggaccgtacctgggctctagacccagcacatagggccgacacagcatggctgttcggtcagccgtgcctaatcggacagtgccccaaagaagaagatcatcgtcaaaacatgtcgctcatttcgaagctgcggttgatcactgtggatgtcaccggtactctgcttgcctacaaagggcagcttggtgattactactgtatggcagctaaggctgctgggaagccatgtcctgactaccagcgaatgcatgagggcttcaagcttgcatacaccgagatggcaaggcaatacccatgctttggatttgcagcgaagatgccgaatatcgactggtggaggatgtgcgtcaaggattcttttgttaaggtgatgccactgttttggctccgagtgggacttggggtgttctctggaatagttggtgtggagaagccagatccaagtatctacaggattgcactggaaatggcgggcaaggtcgcgccagaagaggcgcttcacataggcgacagcatgcgcaaggactacacccctgcacggagcatcggaatgcacgcgctgcttctggaccgattcaagaccgccgatgctgagagctggaggaagtctggagcaactgtgctccctgacctggtagctgctcaggagtggctcagcaagaatctcaaggatgagccagtagcagctgaacaaaatgtctga

SEQ ID NO: 718 - DNA, 687 bp, Oryza sativa
atgggcgccgcaggggtgggggtggtggttgggggcggaggaggaggaggcgcccgctgttgccggatcaaccgcaccgccaacgtgggcgcgtggggcccgggggatggccggcggagcgtggtgggcggcaaccggagcaggcgaagtcacagcgatggccggagggacgcggggcaccaccggcgagaggagaggagccgcccgcggcccgtcgctgctccgccctcagctccgcccactgctgagatggttgtcctcaccggcggccactccatcggcaaggccaagtgcttcttcatcgaggacggctacatgggagccgtcccacttgatcccatcacccccaacctcgtcaatcccaacttcttcgacctcgtcatggccaagaagatgccgctcaccgtcgaccacctcatggggatggaccgaggacgcggcgccatggaggaaagaatggcggccggtgaggcgaagacggttgctacggacactgagaggaagccaaccaggacggcgccgactgtgaggaggacaacgtcggctgaggagaagacccctcctagcgtctacagggacgaaaatgagactgagcgacaaatagagggacctaaatccgagcgcatgtcggcaacaaggatagtggacggcaccaatctcgtggcctcctccatctcatgcttttga

SEQ ID NO: 719 - DNA, 354 bp, Oryza sativa
atggcctcgttgtcctctttccggcttgccgtggcggtggcagcactgttggttgttggctcatgtgccactgagctcaccttcaaggtcgctgagggctctagcgccagtagtctagagcttgtcaccaacatcgccatctctgaggtggagatcaaggagaagggtggcaaggactgggtggcgctcaaggagtcatcatctaacacctggacgatcaaaagtgaggcgccgctcaagggccccttctctgtccgcttccttgtcaagaatggcggctaccgcgtcgtcgatgatgtcatccccgaaagcttcactgctggctctgaatataagagtggcatccaactctaa

SEQ ID NO: 720 - DNA, 330 bp, Oryza sativa
atgcgcgtcgcagtggcgacactgtttgtcgttggctcatacgccaccgagcttaccttcaaggttaatgagggctctagcgcaactagcctggaactcatcaccaacgtcgccatctctgaggtggagatcaaggagaagggtgccagcgactggacggcgctgaaggaatcatcgtctaacacctggacgatcaaaagcggctcgccactcaagggccccttctccgtccgcttcctcgtcaagaatggcgggtaccgcgtcgtcgacgatgtcatccccgaaagctttacggccggctctgtctacaagagtggtatccagctctaa

SEQ ID NO: 721 - DNA, 1755 bp, Oryza sativa
  misc_feature (917)..(917): n = any nucleotide
  misc_feature (1750)..(1750): n = any nucleotide
atgacgacgacggccgccggcggagccaccctgtgcgcggcgagggaggagcaggagctcctggccacccgcctgaatgtgaacggcatccggccgccgcattgcgccgcggaatctatcctcatctacctcaccgcgccggggctctccatgatgcccatgcgggtgatggcctccgactccatcgcctccgtcaagctccgcgtccagacctccaagggcttcgtcgtccgcaagcagaagctcgtcttcgatggccgggagctcgcccggaacgacagccgcatcatggactacggcgtctcccacggcaacgtcctccacctcgtcatccgcatctccgacctccgcctcatcaccgtccagaccgtccacggcaacaagttcaggttccgcgtcgagcccggccgcaccgtcggctacgtcaagcagcagatcgccaagaactccacccacgacgacgaccaccacagcctcgtcctccagggcgaggtgctcgacgacgcccacctcatccacgacgtctgcaggaccgacggcgccgtcatccacctgctcgtccaccgctccgccaagctcgccgccaggcccgtcgaccgggacttcgaggtctccatcgtcgcgcgcaaccgcaacgccgccgccgacgctgctcaaccgacgttgcacctgcagagggacttcgccatcgagccggtcatcgtcaaccccaaggccgcgcttccgccagtgatcgagaacctggtgggcgccgtgctggccgggatggagaaggggaacgccccgatcatgtcgtcggagggcaccgggggggcgtatttcatgcaggacgcgtcggggcaggagcacgtcgccgtgttcaagccggtggacgaggagcccatggcggccaacaacccacgcggcctcccaacctngcccaccggcgaggggctcaagaaggggacacgcgtcggcgagggcgccatcagagaggtcgccgcctacatcctcgaccaccctcccggtggccgccgttcgttcgcaggacatcatggctccgccaccgtgggcttcgccggtgtcgcgccaaccgcgctggtccgttgcatgcacaggagcttcaagcaacctgcagcttccgaacaaggtcctccattgttcaaggtggggtcattgcaagcgttcgtgaagaacagcggcagctgcgaggacatgggacctcgtgcgttcccggtgcacgaagttcacaagatctgcgtgctggacatcaggctggccaacgccgacaggcacgccggcaacatcctcacctgcagagacgaacaaggccatggcctcaccctggttccgatcgaccatggatactgtcttcctgagagttttgaggattgcacattcgagtggctctactggccgcagtgtcgggagccattcagcgaggagacggtggagtacataaggtcactggacgcggaggaggacatcgccattctgaggttccatgggtgggagatgccagccaagtgcgagcgcgtcctgcgcgtcaccaccatgctgctcaagaagggcgtcgactcgggcctcgccgcgttcgacatggggagcatcttgtgcagggagacgctcaccaaggagtctgtcatcgaggagatcatccgtgaggttgaagacgatgttggtgatgaagctgccttcctgcagtctgtctctcaatccatggatcgccgtctgggtgaattatccaagaaaaaaaaaagtaatattttcncgtaa

SEQ ID NO: 722 - DNA, 1383 bp, Oryza sativa
atgttggtagatggagatgggcgcgtgacggggaaagacgcgctcaagttcttcgccatgtcgaatctctcccgccccgagctgaagcagtgggcaatcgctgattccaagcgtcagggttatcttggattctcggagtttatgaccgcaatgcagcagctggtttctcttgcacaagctgggaatgagattcctttaagatcagttacttcgatcatcgatgggttaaagaaatcttacattgagaagttgaggccactagaaaaaacatatcagttcgatgactttgtttcacctttgctgttgtagactagcagtgatttcgatgcgaagccaatggtcatgttgctgggtcagtattccacaggaaaaaccacattcataaagcatttactgaagacaaattatccagggtgctcatattggtccagagcctacaactgacagatttgttgttattacttctggacctgatgaaagatgcatccctggaaacacaattgccgtgcaagcagacatgccatatagtggcttgtcatcttttgggacagcatttctatcaaagtttgaatgttctcagatgcctcatccactactggatcatataacctttgtggacactcctggagttttatcaggggaaaagcagcgaacacagcgtagctatgacttcactggagttacatcatggtttgcagccaagtgtgacctaattcttctcctatttgatccacataagcttgacatcagtgatgagttcaagcgtgtaattgggtcactcaaagggcatgatgataaaatacgtatagttctgaacaaagcagaccaagttgatgcacaacaacagctcatgagagtctatggagcactgctatggtcgcttgggaaagttctgaacacaccagaagtcatgcgtgtgtacataggtcatttaacgacaagcccattagggagacagtagctgggccactgggtaaagaactgtttgagaaagaacaagaagacctgctctccgacctgaatgacattccaaagaaagcctgtgaccgtcgaatcaacgaattcgtgaagcgttcgaggtcagccaaggtccatgctcacataatcagccacctgaagaaggagatgccggcgctgatgggcaaggccaaggcgcagcagcggctgctcgacaccctcgacgagcagttcgccaaggttcagaaggagctgcacttgccggccggcgacttccccagcgtggatgagtacagggagacactgagcgcctacaacttcgacaagttcgagaggctgaagcccaagctggtgcagggcgtcgacgacatgctcgcctacgacatccccgatctcctcaagagcttcaggaacccctacgaatga

SEQ ID NO: 723 - DNA, 1051 bp, Oryza sativa
  misc_feature (177)..(177): n = any nucleotide
  misc_feature (183)..(183): n = any nucleotide
gccaccgactccttcagcccgaacaacctgctcggggaaggcggctttgggagggtgtacagaggccacctcgaagagatcaacgagcagatcgtcgccgtcaagcagctggacaaggacgggttccaggggaaccgcgagttcctggtggaggtgctgatgctcagtctcctgcancacccnaacctcgtcaagctgctcggctactgcaccgacatggaccagagaatcctcgtctacgagtgcatgcggaacggctcgctggaggatcatctcctagctcccgtggcaaacgcggatgaagatcgcggtgggcgcggcgaagggcatcgagtacctgcacgaggtggccaacccgccggtgatctaccgcgacctcaagacgtccaacatcctcctggacgaggacttcaactccaagctgtccgacttcggcctcgccaagctcggccccgtcggcgacaagagccacgtcagcacgcgggtcatgggcacgtacggctactgcgcccccgagtacgccatgaccggcaagctcaccaagacgtcggacatctacagcttcggcgtcgtgctgctggagatcatcaccggcaggcgggcgatcgatacctccaggccgacgcacgagcaggttctcgtccaatgggtgagcaactcactgccctcgtcctacaaaaattaaccgatttcgagctgcattaattaactggcttctctgtgtgtgcaaacacaggcggcacctctcgtcaaggacaagaagagattcgtgagactggctgacccgttgctggaagagaaattccccctcaaggggctttaccaagctctcgcgatcgcctccatgtgcttgcaggaggatgccagcaacaggccgatgatcagcgacgtcgtcgcggcgctctcgtttcttgccgagcagaagtatcatccccaagatggcccggatcaggccgcccggaagagcagagacagggactgtagcaatcctcccaggaagacagacatggtttctgagatcaaggcagatgatgaaatcaagcacaggtga

SEQ ID NO: 724 - DNA, 762 bp, Oryza sativa
atggcgaggagctctccttgccttgccgtcgctgtgctcctccttggagtggtggtggcggcgattggagcctttgctgatgaaggggcggcgagcggttggggactagggcatggcgcccgtttcctcagcaggcgaggccgtgctgcgtatgagaagtcgtcggagccagaggcaaagcctgcgtcgcagcaggagccgaagtcggattcttactcgcaggcaaagcctgggccaaaagatgagcccaagccggagccagaggcaatgtctgcgtcgcagccggagtcgaagccggcaacttactcggagtctaagcccgaatcaaaggcagagcctgaatcaaaaccagagccaaaggcagagtccacgccacaaccagaagcaaagtcagagcctaagtctgagccaaagccaaagtccgagccatacgcagaaccaaaatcagagcccaagtccgagccacagtcagaaccaaatcccgagactaaggcggagccaaagtctgaacccaagtatgaacctaaatcagagcctaccccacagactgaaccaagggcagaatcgcaaccagaaccaaagacagagccaaagtctgagtcgaaggctgaaccgaagccagagcgaaagtcatactcaaagtcaaaaccagaaccagaatccaagccagaagcaaaagcagaacgacagccagagtctaagcccgagccaaaacccgagtcagccccaaagaaggaaacgccttcgtcggcctacccatga

SEQ ID NO: 725 - DNA, 583 bp, Oryza sativa
atgggcgaggaggccaagtacctcgagacggcgcgggccgagcgctccgtgtggctgatgaagtgccccccggtcgtctcgcacgcctggcagggcgccgtgtcctcctccttcaagatggagatggctcaaactaacactggcaatacaccaaagagttactccttgaatatgtccaaggattttgtaccaatgtgtgttttctctgagtctaaccaaggaaggaaaagtcgagcataaatttgacatgaagcctcacagtgataatttggtgaactatggaaagttatgccgtgaaaggacacaaaagtccatgatcaaaactagaaaagtgcagccgttgcctggcatgaaaagaatacgtagggatcgcagggaactggaaaatattatattcaagctttttgaaagacagcccaattgggcactaaaggcgctggtgcaagaaactgaccagccagagcaattcctgaaggagattctgaatgatctgtgtttttacaacaaacgaggaccaaaccagggaacgcatgagctcaagcctgagtacaagaaatctacaggggacactgatgcttcttga

SEQ ID NO: 726 - DNA, 413 bp, Oryza sativa
atgtcgtggcagacgtacgtcgacgagcacctgatgtgcgagatcgagggccacacctcacctccgccgccatcgtcggccacgacggcaccgtctgggcacagagcgccgccttccctcagtcgtctgtgcctgtgcagttcaaaccggaggagatgaccaacatcatgaaggacttcgacgagccggggttcctcgccccgaccggactgtttcttggaccaaccaagtacatggtcatccaaggtgaacctggcgctgtcattcgtggcaagaagggatcaggaggcatcacagtgaagaagaccgggcaggcgctggtggtcggcatctacgacgagcccatgaccccggggcagtgcaacatggtggttgagaggctcggtgactacctcgtagagcagggcctgtag

SEQ ID NO: 727 - DNA, 579 bp, Oryza sativa
atgatgagatttagttcaacggataagaaggatagaagaaatatgctatttgctgctattccatctatttgtgcattcagtgctgccgttcccccggccccaaaggacaagattgagtcgccgctatcactttttttggggggccaatcccgcgaagagttatggaaagattttatagctcaattgaatgaagaaagtgaattcatggacaacattttttttggtgtttacaacgcgagaaacggctatgaaagcgccacagttcttcagggaatacggatagatttagcgataaacggctatgaaagtgcatttttgtcggaatttgcacctatttgtatctatttagtgatcagtccgctagtttctttgattccactcggtgttccttttccatttgcttccaatagttcgacctatccagaaaaattgtcggcctacgaatgtggtttcgatccctccggtgatgccagaagtcgtttcgatatacgattttatccggttcctattttatttattatccctgatctggaagtcaccttttttttcccttgggcagtacctcctaacaaggattga

SEQ ID NO: 728 - DNA, 979 bp, Oryza sativa
  misc_feature (780)..(780): n = any nucleotide
ggatccgagcccagtacgtgtgaaacgtgcttgctgtgagctgtgcgatgcggcccggacgaacatgcatgcagagctgcagctcaagctggaaggccacgaagatgagagagattctaacaattggtatcagagccaatttatgcccaagatcctgcgcttcaacaagatggccatcgtcgagcactccgcatcgcgatcgatgagggagggcatcgtgtcgctcccatatccagtgctcacctccaccaactactccacctgggcgatcaagatggaggctaacatggaggcgcaaggcatctgggatgccatcgagcccgcggccgatgaggccgtggacattaagaaggacaagcaggcacgtgcgtgtctcttcggggccgtccccgaagacgtgttgcagcagatcgcgaagaagaagactgccaaggaggtctgggaaagcctcaagacgaggttccttggcgttgagcgtgtgaagaaggcgcgagtgcaaaccttgaagagcgatttcaaggcattgcacatgaaggacaccgagtcaatcgacgagtttgccggcaaaatcagtggcctggcaaacaagttgagcgatcttggtgtaaccatggacgatgatgagcaagtcaagaaactactcgattctgtgccagataagtttctgcatgtcatcgctgcaattgagcagttctctgacttggacagcatgccatttgatgaggcaattggtcgcctcaaggcatacgaggaaaggatacgcaagcgtgatgacatgantggcgagcatctacttttcacgtccggcgacacaagcggtggccgcagccgcgtcaagaagccggacaggtccaagacaatgtgctactactgtcaagaacttggacactttgcgtatgagtgccctgagaaaaagaagaagaaggagatagcgctccttgccgcagcgtcaagtgatgaggagccaactcttctctga

SEQ ID NO: 729 - DNA, 4173 bp, Oryza sativa
  misc_feature (2859)..(2859): n = any nucleotide
atgacggacgatgagctcgtcaagaagctacttgactcagtgcctgaaaagtttttgcacataattgcagcgatagagcaattctgcgatttggacaccatgccatttgaggaggctattggccgcctcaaagctttcgaggagaggatacggaagcacagtgacaatgatggggagcagcttcttctcaccacacgcaacactgatgatggtgctggtcgagcccgcggcaagaggtttgataaatccaagtttggctccagctcattggcgagatgccgacgtgccgtgcgatgcggtggtgcgagaatggagcaaacaacgttcatgaagaccaagctcaactgcatgtggagtgctgcgagaagtagccgaattgcaagcaagacaagaagatgtacctcggcattatggtacaacgacatcccccggcgcacggtggtgtgggtcgccgaccggggaactccggtcacaaacagcagttcgtctgcgccgacgctgtcgctgaccaactcctccaacctcgtcttgtccgacgcagatggcggcgttcgctggacgaccaacatcaccgacgatgcagcgggcggcggctccacggcggtgctcctgaacaccggcaacctcgtcgtccggtcaccgaacggcaccaccctgtggcagagcttcgagcacccgagtgactcgttcctgcccggcatgaagatgcgggtcatgtacaggacgcgcgccggcgagcgcctggtgtcgtggaagggccccgacgacccgtcgccggggagcttctcgttcggcggcgacccgggcacgttcctccaggtgttcctctggaacgggacgcgcccggtttcgagggacgggccatggacgggcgacatggtgtcgagccagtaccaggcgaacaccagcgacatcatctactccgccatcgtcgacaacgacgacgagagatacatgacgttcaccgtctccgacggctcgccgcacaccaggtacgtgctgacctacgccggcaagtaccagctccagagctgggacaacagctcgtcggcgtgggcggtgctcggcgagtggccgacctgggactgcaaccgctacggctactgcggcccgttcggctactgcgacaacacggcgagggcgcccgccgtcccgacgtgcaagtgcctcgccggcttcgagccggcgagcgcggcggagtggagcagcggcaggttctcgcgtggttgccggcgcacggaggcggtggagtgcggcgaccgtttcttggccgtgccggggatgaagtcgccggacaagttcgtgctcgtcccgaacaggacgctcgacgcgtgcgccgccgagtgcagcagcaactgctcgtgcgtggcgtacgcgtacgccaacctgagcagcagcgggtccaagggcgacatgacgaggtgcttggtgtggtcaggggagctggttgatacagagaaggaaggtgaagggctaagcagcgacacgatctacctcaggcttgctggtcttgaccttgacgcgggtggaaggaaaaagagtaatgcaatcaagatagtactgccagtgttaggctgtattctgattgtcctatgcattttctttgcatggttaaaaatcaaaggcaggaaaacaaaccaggaaaagcacagaaagctaatttttgatggcgaaggaagcactgtccaagattttgaactcccatttgtaagatttgaggacattgctctagcaaccaacaatttctcagaaacaaataagattgggcaaggaggtttcggaaaagtttacatggcaatgctaggtggtcaagaagttgctattaagcggttaagtaaggattctcgacaagggacaaaggaattcaggaatgaagttattcttatcgcgaaattgcaacacagaaatttggttcgccttcttggctgttgtgttgagggagatgaaaaactgctaatatatgagtacttgcctaacaaaggcttagatgctaccctttttgatggttcaagaaaaatgaaactagactggacaacacggtttaatataatcaaaggggtggcaaggggacttctttatctgcaccaagactctagattgaccataattcacagagatctcaaagctggcaatgttttgctagatgctgaaatgaaacccaagatagcagattttggcatggcaaggatctttggtgataatcaacaggatgcaaatacccagcgtgttgttggaacatatggctacatggctcctgagtatgcaatggaaggtatcttctctactaaatcagatgtctacagctttggtgtgttattgttggaaattgtgactggtataaggagaagctccactagcaatatcatgaactttccaaacctcatagtttattcatggaacatgtggaaggaagggaaaagcaaggatttggtagactcatcaattatggatagttgcttactacatgaagttttgctctgcatccatgtagcattgttatgtgttcaagaaagcccagatgacaggccacttatgtcatctattgtgttcaccctggagaatgggagtagtgttgcactgctcccagccccaagttgccctgggcactttacacaaaggagttctgagatagagccaatgaaagataatactcagaactcaatgaatacttttacgctaacaaacatagagggaagaattctgctgaagaaagttttgatggatcggtcagctgcggctttagcctgcatcaccagtgttcttctcctcctcctgccgccgccatgtgcatccgacgatcggcttgtcaccggcaagccgctctcccctggcgccaccatcgtctccgatggcggcgcnttcgccttgggcttcttctccccctccaactcaactccggagaagatgtacctcggcatatggtacaatgacatccccgggcgcacggtggtgtgggtcgccgaccgaggaactccggtcacaaacagtagttcgtctttgccgacgctgtcgctgaccaactcctccaaccttctcttgtccgacgccgacggccgcgttcgctggacgagcaacatcaccgacgatgcagcgggctccggctccaccgcagtgctcaagaacgacggcaacctcgtcgtccggtcaccgaacggcaccaccctgtggcagagcttcgagcacccgaccgactcgttcctccctgggatgaagcttggggtgacgttcaagacgcgcacatgcgagcgcttggtgtcgtggaagggccccgacgacccgtcgccggggagcttctcgttcggcggcgacccggacacgttcctgcaggtgttcatctggaacgggacgcgcccggtttcgagggacgggccatggacgggctacatggtgtcgagccagtatcaggcgaactccagcgacatcttctacttctccatcgtcaacaacgaggaaaagagatacataacgttcagcgtctccgagggctcgccgtacaccaggtatgtgattacctacgccggcaagtaccagttccagcgctggaacatcagctcgtcggcgtgggatgtcgcggagtggcctagatgggactgcaactattacaactactgcggcccgaacggctactgcgacaacacagcgagggcgcctgctgtcccgacgtgcaagtgcctcttcggcttcgagccagcgaacgcggcggagtggaacagcggccggttttcgcagggttgccggcgaaaggaggcggtgcagtgcggcgaccgtttcttggccgtgccggggatgatttcgccggacaagttcgtgctcttcccgaacaggacgctcgacgcgtgcgccgccgagtgcagcagcaactgctcctgcgtggcgtacgcctacgccaacctgagtagcagcatatctaagggcgacaagacgaggtgcttggtgtggtcaggggagctgattgacgcggagatggtaggcgaaaggcttggcagcgacacgatctacctcaggctcgccggtcttgacgcgggtaagcaccaatttaaattgagcaattttactgttcgtaaggagaagtacggattacaatttgaggtattttactgtttgaggtttatacttttagtccttgagttgagaaagtactaccagatacagcgaggtgctaatgaaatataa

SEQ ID NO: 730 - DNA, 2221 bp, Oryza sativa
atgaggccctcgccgcctcccggcggcccggcggcggaaccggtgcccccgtggctgagatcgctgcccgtcgcgcccgagttccgccccaccgccgccgagttcgccgatcccgtctcctacatcctcaagatcgagcccgccgcggcgccgtacggcatctgcaaggtcgtgccgccgttgcccccgccgccgaagaaggccaccttctccaacctctcccgctccttcgccgcgctccacccggacgaccgctcgccgtccttccccacccgccaccagcaggtcggcctctgcccgcgccgcacgcgcccggggctcaagcccgtgtggcggtcctcccaccgctacacgctcccgcagttcgagtccaaggccggcgccacccgcaagtcgctcctcgccggcctcaacttccctgcctccaggcaactcaccccgctcgaccacgaggtgctcttctggcgcgcatcggccgaccgccccatcgtggtcgagtatggcagcgacatgtcgggctcgggattctccccttgcgccgcgcagccgcagccgccgccgcagcagcaaccgacggcgcgggcggcggcgcaccttggggagacggcgtggaacatgcgcggcgtggctaggagccccggatcgctgctgcggttcatgccggaggatgtccccggggtcaccacgccgatgctctacgtcgggatgatgttcagttggttcgcgtggcacgtcgaggaccacgacctgcacagcctcaactacatgcacctcggggccgccaagacgtggtacggcgtgccgcgcgacgccgcgctcgcgttcgaggacgtggtgcgcgaacatggctacggcggggaggtgaaccccctagaccttcgctacattggggcagaaaacaacagtgatgtcccctgaagtgcttgtggagtcgggtatcccctgctgcaggtgttatttccttctgtttgttcaagattggtgcagaatgcaggggaatttgtggtcacttttccaggatcttatcactgcggtttcagtcatgggattcaactgtggggaagcatccaatatagctactcccgaatggttgagaattgccaaagaggccgcaatccgaagagcttcaatcaatcgtcctcccatggtttcgcactatcaattactttacgatctcgcactgtctatgcgttttagcggagctctcgaataaaggagaagaagaaatgcgaaggggaacaactggtcaagaagatgttcatccaaaatttgttagatcagggtctattatcatgtgtcacttgtggaattttaagtttttcatgtgtggctgtactcaaaccaagagattctacagcacgatacttgatgtctgctgatgacaaggattcatcaagaatgcatgtattttgtcttgagcatgctattgaggttgagaagcaactgcatgctataggtggttctaatattatgcttatatgtcgtccaggaatatcccaaaatagaagcggaagcaagattgttgggtgaagaaatgggactggtatatgactggaagggcattcatttcaaggaggccaacatggaggacaggcagaagatacaggaagttctgcgggatgaggaagcaatacctacaagcagtgattgggctgtaaaattgggtattaacctttattatagtgcaaatctggccaaatctcctttatataacaaacaaatgccatacaacagagtcatttatagggcatttggctgtgattctcctaatgactcgccagtaatgttcaatacttgcgaaaggaaacaaagccaccagaagaaaatagtggttgctggccggtggtgtgggaaagtatggatgtcaaaacaggagggttgttctatgagttttcgtacaaagcgggacttgtctctgcacaagagtgatatctgcccagtgaaaggctgcgggaagaagttcttctcgcacaagtatctgctgcagcatcgcaaggttcacacagatgaccgtccgctaacatgcccatggaagggctgcaacatggcattcaagtggccatgggcaaggactgaacatctcagggttcatacaggcgacaggccctatgtttgccatgagccaggttgcgcacagacattcaggtttgtctcagatttcagccgtcacaagcgcaagacaggtcattctgtcaagaagaagaagaaagcaaagagttga

SEQ ID NO: 731 - DNA, 1714 bp, Oryza sativa
atggcggcagtggtggtggtgcgcgcgtcgcacgtcgtctacccggagctccagtcgctggaggcgaagcacgtcgacgggaagctccggaccgggtaccacttccaaccacccaagcactggatcaacgggtccgatgtactataagggcttgtaccatctgttctaccagtacaaccccaagggcgccgtgtgggggaacatcgagtgggcgcactcggtttcgacggacctgatcgactggacggcgctggagccggggatctacccgtccaagacgttcgacgagaagggctgctggtcgggctccgccaccgtgctccccagcggcgtgccggtgatcatgtacaccggcatcgaccccgacgagcggcaggtccagaacgtcgcctacccggtgaacctctccgacccgtacctccgcgagtggtacaagcccgactacaaccccatcatcaacccggacggcggcatcaacgccagcgcgttccgcgacccgaccaccgcctggtacgggcccgacggccactggcggctcctcgtcggcagcaaggtgaacatgaaggggctcgccgtgctgtaccggagccgggacttcaagaagtgggtcaaggcgcaccacccgctgcactcggcgcacaccgggatgtgggagtgcccggacttcttccccgtcgctgtggcgggcgggagccgccactaccgccgcggcgtcgacaccgccgagctgcacgacgccgccgtggcggaggaggtcaagtacgtgctcaaggtgagcctcgacctgacgcggtacgagtactacaccgtcggctggtacgaccacgccaccgaccggtacgtccccgacgccgccttccccgacaacgactacggcctccgctacgactacggcgacttctacgcatccaagtcgttctacgacccggccaagcgccgccgcatcgtctggggctgggccaacgagtccgacaccgtacccgacgaccgccgaaagggctgggccggcatccagcaggcgataccgaggaagctctggctgtcggcggacgggaagcagctggtgcagtggccggtggaggagctcaaggcgctgcgagccaagcacgtcaatgtcactgacaaggtcatcaagaagggcaactacttcgaggtcaccggcttcaagtccgtgcaggtgcagtcggatgtggatatggcgttcgcgatcaaggacctgagcaaggcggaggagttcgacccggcgtggcggacggacgcggaggcgctgtgcaagaagctcggctcggacgtcgacggcggcgtggggccgttcgggctgtgggcgctggcctccggcgacctcaaggagaggacggccgtcttcttcaggggtgttcaaggccaacgactcctcgcacgtcgtcctcatgtgcaacgaccctaccagaggtcatcgtacgagtcgaagatctacaggccgaccttcgccggcttcgtcgacgtcgacatcgccaagaacaaacaaatcgccctccggacattgatcgatcactccgtggtggagagcttcggggcgcgcggcaagacgtgcatcctgacgagggtgtacccgaggaaagccgtcggcgacgacgcgcacctcttcgtcttcaacaacggcgagtcggacgtcaaggtcaccaacctggacgcctgggagatgaagaccccgaagatgaacgcggaggagtag

SEQ ID NO: 732 - DNA, 990 bp, Oryza sativa
atgccgtcagagttcgtcgccgccaggaagaagccgccgccggagttgttgttcgccgccggtcggaagaagcagcagccgccgccgcctggcatggcgttcgtgccgtcggagttcgccgccgccggcgttggcaggaagaggcagcctgcgccgccggtggagatacgccgggtgtgggcgcacaacgtggaggaggaattccggatcatccgcaacgcgatcgatcacttcccgtacgtgtccatggacacggagtttcccggcgtgatccaccgcccgaccaagcaccccgccctgctcaccgccggcgaccggtacgacctcctccgccgcaacgtggacgcgctccacctcatccaggtgggcatcaccctcgccgcgtcccccaccgcggcgcccgcgctcgccttcgagatcaacctctccgacttcgaccagcgcgtccaccgccacgccgccgagtccgtccagctgctggcggagcacggcgtggacctcgccgcgcaccgcaggcacggcgtcagggcgagcgcgctggcgccgctgctcatgtcgtcgggcctcgtctgctcccacggcgccgtcaagtgggtcaccttccactccgcctacgacttcgcctacctggtcaagctcctcatggggcggaagctgccgaggtccatggccgagttcctgaacctggtgcgcgtcttcttcggcgacgaggtgtacgacgtgaagcacatgatgcggcactgcggcggcgagctgtacggcgggctggagcgcgtggcggcggcgctgcaggtgaagcgcgcggcggggcggtgccaccaggccgcctccgacagcttgctcacctgggacgtcttccggcggatgcgggagctctacttcctcaagcatggcgtcgaggcctaccaaggcgtgctcttcggcctggagctcgacatggacatgcccagcaacaaaacaccctcgctgccgctggtggcagcgagatga

SEQ ID NO: 733 - DNA, 647 bp, Oryza sativa
atggttgggaataggatatggtttgggggccttttcaccagctcaggtagaaggcgccaaatcaatgctgagaagacctttgagctgagccctgttcagcaggagcaacgtttgcaaaagctgaaggaaagactaaatataccttatgatcaaactcggagagatcatcaggaagctctcagggctctgtggagtgcttcatttccggatgcagagctgtcaagcttaatttcagagcagtggaaggacatgggatggcagggcccaaacccatcgactgatttcagttcaggggctgtggatttgtgggacttgagaatcttctcttctttgcaacaacatatccggtacgctgcttctgaagaaacaagggatgagagccacatgggagtacccctttgcagttgctggtgttaacgtctcatacatgttgatccagctgctggagctcaacgcaggaagaggcatttgacgtcctgtactgtatagctttcgagatgatggatgcccagtggctggcaatgcgagcatcctacatgcagttcaaagtgctggaagcaacaaagcagcagctggagagagagctatctctggaggacgtcaatggaatccgtgacataccagcttacaaccttttgtacaagtag

SEQ ID NO: 734 - DNA, 621 bp, Oryza sativa
atggccgcgcgatccctccaccacctcctcctcctcctcttcctcgccggcttccactccctctccctctcccccgccgccgcactgcggttcgacctgcagtcgggccacaccaagtgcatctccgacgacatcaaggtgggcgccatggcggtggctcccggagtcccaccgcgtctcattgcgggtcacgtcaccctacggcaacagcctgcactactcggagaacgtgcagtcgggcaacttcgccttcacggcgtccgaggccggggactacctcgcctgcttctgggcgcccgaccaccgccccaccgccaccgtcggcttcgagttcgactggcgcagcggcgtctccgccagggactggaccaacgtcgccaagaagggccaggtcgatatgatggaggttgagctcaagaagctggaggatactatcaactctatccatgaagaaatgttttatcttcgcgcaagagggaggaggagatgcaggaactgaacaggagaacaaactcaaggatggcttggcttggtttcttctcactagctatctgcctgtcagtggcggggttgcagttgtggcatctgaagaacttctttgagagaaagaagcttctataa

SEQ ID NO: 735 - DNA, 604 bp, Oryza sativa
atgtcgttcaccggcacgcaggacaagtgcaaggcgtgcgacaagaccgtccatttcatcgacctcctcaccgccgacggcgtctcctaccacaagacatgcttcaagtgcagccactgcaaggggaccctctcgctgcagatgtgtaactactcttcgatggatggtgtcctgtactgcaagacgcactttgagcagctcttcaaagagacggggagcttctcaaagaaattctcgcaagaaaaactttttccagggaagagctcctagcaagctatcttcagcattctctggaactcaagataaatgtgcagcctgccaaaaaactgtgtacccattggagaaggagggtgagtcttaccacaagagttgcttcaagtgctcgcatgggggctgcatcctgacgacgtcttcctacgcggcgctcaacgggatcctctactgcaagatccatttctcgcagctgttcaaggagaagggcagctacaaccacttgatccagaccgcacaatcgaagcagaaagagtccgaggaggctgcaccggtggcggccacagaggccagcgagaaagaacaggaagtgcccccacaagacgcgacatag

SEQ ID NO: 736 - DNA, 528 bp, Oryza sativa
  misc_feature (231)..(231): n = any nucleotide
  misc_feature (251)..(251): n = any nucleotide
  misc_feature (254)..(254): n = any nucleotide
  misc_feature (295)..(295): n = any nucleotide
  misc_feature (301)..(301): n = any nucleotide
  misc_feature (346)..(346): n = any nucleotide
atggccgacgtgctcctcggctcggagcgccgcgtcctcatcagcgcctccgccctccctccgccggagaccctcctcggccgcctcgaccagctcgacctccgggttgcggcagctggaggagcagcggcgggcgaatgccggcgacggcgacggcgggccggcggcgcaccaccagcacagcaagtcgctgccggcggcggcgctgctagcatgtgcggcgttgcagcntttgcaagccaagggcagcntgntggaccgcttaaacttgttcgattcacgcttcaggcagttnagtgcnagttggaacttcgcggcggcggccggcggttcgagcttgcccgcnttggcgcggccggccgaggaccgcgcgtggtcggagccgccgtgccggagccgtgcaaacaccaggcgccggtttgcgccgccgccgcggccggcggcgggagctggagcggcgcgcatttcctgtacaagggcgcgcggcagcttcatcgcaccaaaccgaacacatccacggtgacatga

SEQ ID NO: 737 - DNA, 474 bp, Oryza sativa
  misc_feature (71)..(71): n = any nucleotide
  misc_feature (91)..(91): n = any nucleotide
atggccaaggtaatcacactaatccttgtcgttattacagtgtcaaccatgctagcctcacctgtggaatncaccaagattcctggtgccnttcctattggaatgtctccatacaactttacgacaatgatagatatcttcaaagtggccatgttagtgccaacggaggattgcacctccaatgttgagatgtgcataagtgagacatgctcctacatcagaaaagccctcgatggtgttgttgatgctgccccaccagcaaaacaggcggaaactaaggaggccacggccaagatggctgggattgctgctactatgctcgacacagccatggcttcaggagaaaagagacaagttgccgcagtttccattgccttcatgcttgctgctgatgcgattgacgcatccgcacctgctgacaagtttagagtaatggatgaaacattcaaagcagccgcttctcctatcgcttga

SEQ ID NO: 738 - DNA, 351 bp, Oryza sativa
  misc_feature (159)..(159): n = any nucleotide
  misc_feature (162)..(162): n = any nucleotide
ctcctggccgcgggcgctaccgacgacatgggcgtggtggcgtcggggcggtggcagatggcggcggcggtggagacgtgcgacggcgccgtcagggagtgcgacgtggacgacgaggaggaggtggaggagatggcgttgatgggggcggccgccgcngcngccgccggggagacgctgatgcggcggccgacgaactggtaggtgagctacgcggtgctggacgccaacaaggtgtcgtgcaataagcgcggtcagtcctactaccagaactgcgcctcacagaaggccggcaacccctaccgccgcggctgctccgccatcacccgatgcgctcgcaacaccaactga

SEQ ID NO: 739 - DNA, 3075 bp, Oryza sativa
atggcttctagatggatactatacgtgactcgatgcctcgggagagtatttacggtgatggaccgggagtcggcttggggatacgatgatgtccgtggtggtcagagatcatgtgggatacttaggcgagagttgatgcacgtggttgatggagattctatatggcatacaatggaggtgtttaggactcctagtatgagtttggttcatggctttaggctgcctacatcagtcgaaatttttgtaaggagtgctgttggtgcactttgtaaagtcgtcatctactttaagagttcttcgatttgtgtttcaccgggtttcggcagtctaaccggtgatataccggcggctcggcaggcgacttcggcggtcagaccggttgatctatactggtcagacgggcggcatccgagcggtcagaccgacagatcgatcttggtcagaccgaactccgtcgattttgaggcttctctatttaaccagcaaagtgaaagaaagaaaagaaaaaggggaatgagggatcaggtggctgccagccaacgctactgctccgttgccgtcgctagcagtgcagggagagggcgcggacgtggaaggggcaggcctggaggtcggttcaatggtcgccatgatcatggccaaggaggtagatggcatggtaatgctggtggttgtcatgggtggaataatgggttcggtttgaatgctggaccgagcggtggcaacttcaatccatcgctagggtttcagccgcagtttggttctctcggtcagtctgttgcgggacaagggttctttggtgcggcgccaagtggtcctctagcttccgcccctgtggcctttcctgttctgccgggtgcaggagctgtgttacctgctgctagtgtggcggcggggattcctcccttcccggtggctggaggagacgttgcacctgggggtccggcggtaaccataccagccgcaggtcttcaagcaggagggcatgttgctggtggtttagtggatggaaagggtgctgttgttggtccaaccggtggaactaaggctgcagctaagttgggctctggtgttgattctgctggtactgccggttttaccactgctgctgtattgggtggttctgatactattggttctaattcacaacagggaatttgtccttttgatgcaaacagaggtaaaacaaaggtcgacaacaaaggccatacaatgcaggagtgttcttctaagtattattgtgaggtctgtgaaagtgaggatcatattgcttctcgttgtccaatatttagatctacttttaaacctactgcccagttatgtggttatgctgtggatggtttgggtttctttcatattcctctttcagctggacagagaattaaacctgagccaaaggcggctttagttaaggtgaataaaggtcagatgacagtgaattctgttatatctgagttggagagattgatccctggtaaatggaattgggtggttcatgacaatggtgatggtaccttccgagccatttttccttcagctgctgaattgaggcgtatggtagaatggggcaaagtgcatacaaaagttggtgatgctgaaatggagattgtggagagaggtgtgggtaatgaggtgaaatatgttatttcaaaggtgtgggtacagtgcaaagggctgccttctgagctaagagagtacttgatcatctgtgctgttggttctttattgggtattactaaagccgttgatatgctttttactagaagatatgacatagctcgcctacaagtgttggtccttgatccatcttcgattcctgatgtggttgatgtgggagagaatggggcaagtaagaagcaggatatggggaaagaatctggttctggagctactggtaatacctctaagatgggttctggggtctctggtaatacctctaagataggttctggtgatcagtttagtgagaagggtggtacttctctagttaattcacagttaagcctgttatctaagaacgatggcctgaatttgtctgatgaagagtttgatggattggaggatgatgctatattggttgagaagtcccagactcaggaaagcctagtggctaaattatctgctattcttgaggcagtaatctctccatccaggaagagcaagagaagggcaagtgatagtgatcagatggttcttgagagggctgagaaactgaaggctgagaggaacctggagaatcttcagtctaaaagtaatgacccaaaaaagcataagttcgtgtttgatttagttaaggaacatcaacttgattttattgcgttgtcagagaccgttaagaaagagtttactccggctacacttaaaaatctttgtactggtaaggagtttttatggcattgtaaaccctctagaggcagggagttacaaatgtctggtaggaagtttacttgggcaaataacttaactcatccaacttttgagaaacttgatagggttttaatgttgacggagtgggaacataaattcgcactatcctcagtgattgctcttaatagagatatctcggatcatactcctttacccttacgtacgaattcgccatcttcgaataatgctcaacctacttttaagtttgaacttggttggcttttacgtgatggttttgttgatatggttaaggaggtttggtctagtgttgacgaaggcaactcttcgatggagcattggcatgcaaaaattcgtcgcttaagacagcatccgaggggttgggctaaacatacaagcggtatttataagaaggagaaaaaagatttattagacaagttggactttcttgataaaaaggcagagactgttcttttgactcaggaggaaattaactttcgatggttttataggaatagattatcttcacttcttagagaggaggaaattaagtggtatcagaggtctaaaactaaagatattctggagggtttatttggtcctactgataattctgttattcaatttgatgagaatagaaccgttgatattcctcatgtttctcatttggagaatgaggctttaacataa

SEQ ID NO: 740 - DNA, 1368 bp, Oryza sativa
atgtctccaaggatcccgacgagggcgaacctcgccctcgccgccctcctcatcctcctcaccatcgccgccaccaccctcgcatcggcgaagtgcatcgcgaagaacaaacccgaaggcgaggagggggaacccagtggtgcgggcgcggctgcggcccacgcttcaccggagaagaaacccggctccaacggcgggttaaccaccatgtccgtcggtgagagcgtaccggagatcaagaaggactcctccgatgatggcgccgccgtgaatgagagcaagaaacctaaatccagtggcggcttgactaccctctccgtcgatgatagtcaagcagaacccgcggacagtatagcagaacccgtggaagatggcaccgacgacggcgaggatgagtcggagaaaaagaagaagaagaagaagaagaaatccaaaagcaagagctccgatgatgatgatgatgatgccgagaagaaatccaagaagaaatcgaagaactcggacgacgatgaagatgacaagaagaaatccaagaagaaacccaagaacccggacgacgatgaagatgacaagaagaaatcgaaaaagaagagctccgatgaagacaacgacggtgccaagaagaagaagaagaagaaatccaagggcaagagctccgatgaggaagatgatgaaaagcccaagaagaaatccaaaagcaagagcaaatcctcctcctccgacgaagaagatgagaagaaatcaaaatccgagggccaagccgcggccaaaccaaaggaagaagacgaggaaggcggctcggcatcggcatcggcatcgacatcggcgccgaagaatgagcaccactcgggcaccatgtcgctcccggacccggacatgatcgcgcagccggtgatgcaggcgctgaacccagtggtgaaggcgctgtgcggcaagacggaccacgccgacctgtgcgagtcctccatcgggcagctgccgcagcagccgccggcgcagctggacgacatcggcgtcctcaggctctccatgaacgcgctgcgcgccaaggtgcaggaggcgatcagcgtggcgacgaacaggatgggggcggcctccggggacgaggtgtccaaggacgccatgggcgactgcctccagatgtacgacgacatgaaatccaacctggactcggcggacgcggcgctcaagaagggggacaaggacacggcgcacaccatgctcgactccgcgcgcaccgacgtcgacacctgcgaggacggcttcagcgagcgggaggggctcaagccgatcatgggcgacctcgacaagatcctcgccgagctctccagcaacaccatcgccattgcctccgccataattgagtga

SEQ ID NO: 741 - DNA, 1161 bp, Oryza sativa
atgaatatgcacgacatgcaattcgagaactccaacatccaacctggaagggcgccgattaactgcatcgacgacgcacccatggatgatgcacctggagcaacaaagatcggttgcacatcgtgcaacctgccggcctcccccatcggccctccttctctaaccaccggctctccttgcccttcggcccctccttctccggaggggaacgctgcctccactgctttcgttggatcccctcctcctttcgtcaatccgccaccgccagctgactacattcctccggccatatctaggacagagagagggaggcagggaggggagcggcgccgaccactgggaggggagccgcctactgtggctgccgttagctcttatcctagtcgtcgcgcgcctccacactaccgatggccgccggctctccttctagtcattgtgcgcctccatgctgccggtggctgccgcctccaccctccacgccgccggctctcctcctggtcgccagtggccgtcgtctccaacctgtgcaccatcggctctcctcgtggtcacagcgcacctccccccttcttcccctcccggcaagatctgggagggagggagggagaggagcagctgccgccaccaggagcagcctccgccaccgccctcccccttccccccttcagccggatctgcgagggaggggaggcgagccgtgccggggtgcgtcgccatctccctctggccggatctgcaccggggataaggaaggagaggtgggcgggagagaatgtcgattcctcacaatcgatcactctttgtgatgctgccaaaccatggcaattaggatctcaagacgctgcaacacctatgatgcaaggaatcattgacttacatcacgatatctttttcttcctcattctgattttggttttcgtatcatggatgttggttcgcgctttatggtatttcaacgagcaaactaatccaatcccgcaaaggattgttcatggaactactatcgaaattattcggaccatatttcctagtgtcattcttttgttcattgctataccatcgtttgctctgttatactcaatggacggggtattagtagatccagccagtactatcaaagctacggctagagaagtcaatagcatcgaatgcttctggtga

SEQ ID NO: 742 - DNA, 1041 bp, Oryza sativa
atgccttcctcctcctctcgccgccgccgccgccgcggccgccgccgcaagaagaaggaggaggaggcgagggactgggccgatggcctgccgctggacgcgatcctggccatcttccacaagctcggccacgccgacatcctcatggccgccgaccaggtgtgtgccacctggcgccgcgccgcgcgggacgagcccgcgctgtggcggcgcatcaccgtgcgcgggaccgaggcgctctccgccaggatcaaccgcggcggcttggcctgcgccgccgtccgccgcagcgcgggccagtgcgaggccttctgcggcgagtacgccggcgacgatggcttcctcgtgtacctcaccgagcaggcctcctgtttgaagagccttcggctcatctcatgcttgggtgtctcaaatgaaggaattgaggaggcaacaaaggaattccctcttcttgaggagcttgagctctcattctgctacaatgttactcatgaggcgtatgcggctatcggcgcggcatgcccacagctcaagcgcttcaggcttagcaaacgatccttctatgattcaggaggtatccgctggaaaaacaacgatgatgctggtggaatttcaaagatgcacgggctacgctccctgcagctcttcgccaataacctcacaaatgaaggtctctcaaccatcttggataactgccccaacctggagtctcttgacattcgccattgcttcaacatcgacatgggcgccgactccctgcgagcaaaatgtagcaggatcaagatgctgaggccacctgatgactcaactgatgactatgacttcgatgtgtacactcccaggaggctccccatctcccccggttttgtgcggtattattcggtgtattctgatccggaatattccatgtactcggatgaatggacgtctgaggaatttgatgatgatgatgatgattattccggtccttcccgctacgaggaagatcttgacaagtatgataacgcgcttcccaggtgcatgaggacgtttctgaaatga

SEQ ID NO: 743 - DNA, 537 bp, Oryza sativa
atggatgtacttgatggcagtcgtcggcagtttcagttcctcgcggcaccacgactaggggtgaaatcgggtcgggttcgagatgaggatcggctggcagcaaaggcatgtagcggcggtggccgcggctcaacggatgcagcagaagctgatctccaaagaactctaaagttaagcgtgcttagcctggagcaatttgggatggatgaccgatcggaaaattattcccggttgcgcagacatgacgttactgaatggtaccagagccaactctcgcggtttcacgggcacgtgagtcacagttgcacaggcatgctgcgtatggctggtgtggatccggagtggtcacacagcatggcacatacgctggcattggacacacggacgtggccaagagggacgttcctggctaggaattacacagtacaacgcagacactcacaacgcacgcgcactcacccctatgaacgcatgcacgcaaaccctacccctatgagcatctttgaagactgggccggcaaatcctggagagattga

SEQ ID NO: 744 - DNA, 1661 bp, Oryza sativa
atggatcgttccgtttttcgtgccagagccaaacgttcccaacctgctctttcgaacagagccttagatgtcttctgcatgtatttggggagttcggcaatctgccatcatgcaaagccccagcaagatctctgatgcctctggctcaatgccccctgccacgttccaagaagaactgcttcactccattgttcctctgttgggctccttcgtcgacattctcgcctttgctggcacctgccattcttggcgtgctgccttctcatcatacccatcaaaatctgcctttcgcaccttactcccaccactcctcgtccgacccaatgtccgcgtcaaatccccttgtatcccttctaccagcaatggtcctcacaagctactacgctcatgtcaggtcattgatctagccaaccgaaacaccccgctccgctgccagattcctcgagaaactctgcagaagatgctttttgcaggctcttctcatggtcaactcatatgctgccgcagtggttactgtctcgttgttgatgtgttcaccggtgctgaggtttcaccaccacgtcttccattcagcaaggaccatgaggagatctacttttgtggcactctgacggctcctatcacgtcacccaactcacatctccttatcagcaaccggtcatctctgttcgattggccggttggaagtgactcctggtctgagctcaagcttcctgttaatcgggtcgatcagattgtggaattcaatggtcagctcatcgccgtgattgaatacaagctgtacactttgcagttggcccccaagcttcgcctgaagaagatgaaaaccctgtggtgggatgacatgagtgaatgtccatatttgagaccatggctagtggtttgcgatggcatgcttctcattgttgaccactacataactttgtcatttggagcaccagtcaactacagaccgtaccgcctggacatgtcagccaagcctgcaaaatgggtggaggtaaagaagctggagaactgggcactctttatcgggggtgatgcgagaagcccgccgtttgctttcaagaacccggagcgctggggagggaggagcaactgcttgtactatgctcactactcccagccatggagccttcatgggttgggtgatgatgcagatgctgtgtgggatcctaccactgatgataaccttgtgttcaaaagaaactggtacagtcagctgcaggccttctgggctcgctggacagttgtcgtcatcaatggcggaagaagatatcaacaagatgatgagctccgacggggagatatcatcaatggcggagagggcggcgagcctgttgcggcaactgatcgaggacggctgcgccgccgccaaacccctcgctgagatggtcgagtactgcgccaagcacgccgccggcgaagctcaaggtaaggaagaggaagtattagacggcgagtccagcgacgaggaggagacggacatactcaggctggaggccagcttgatgggcgtggagaacatgctcagcgcacggcggagctcatcaaggactaggacaagccgccggagccgtcgccggagaacgtccccttccacggctttcacagtatacattcatttattgagcactgctacacagactaaattttcttattaa

SEQ ID NO: 745 - DNA, 1493 bp, Oryza sativa
atggatactgtggtgggttcatcatccaagccatgcgggccgctgacggattaccgcattccggattacatcctgaggccggatgcgcagcgggtgcttcttgatcatgcgcccccgtgccccgtgctggtgttcatcaattctggatctggtgcaggttttcgatgtctccgaagaggctccggataaagtgttgcaccgtttgaatgtcaaccttgagaagctcaagatggatggagacattcttgctgttcaaatttggagaactctcagaataattgttgcaggtggcgatggtacggcaagctggctgcttggggtagtcagtgatctcaagctttcacaccctcctccaattgctactgtgcctctgggaaccggaaacaaccttccattttcatttggatggggaaagaagaatccttgtactgaccaagagtcagtaaaatcattccttgggctagtgaggcatgcaaaagagatgaaaattgatagtggcatatcatgttgaggatgcgagctacaaaggaaggtccatgtgatccaatcgcccccttagagttgcctcattcattacatgcatttcaccgtgtgtcaagtagtgattccctcaatatggaaggttaccacacattccgtggaggattttggaattactttagtatggggtatggatgcagaaatttcttacggatttcattctgaaaggaagaaaaatccagagaaattcaaaaaccagctgacaaatcagcagggtacatatgctaaggttggacttaaacaaggatggttttgtgcttctttaagtcatccatcttcaagtccaggaatattgctcaacttgcaagtgtgaaaatcatgaaaagagccggtagccactggcaagaacttaacattcaccacagagcattcgatcaatcgtctgtctcaacctgcctagtttctctggaggtctgaatccttggggcacacctggcacaaggaaagtagaagagagggagctgacggcaccttttgtcgatgatagacttattgaggttgttggattccgtgatgcctggcacggacttgtcttgctggccccaaatggacatggtacccgccttgcgcagcaggcccaaaggatccgtttcgagttccacaaaggcgcagcagagcacaccttcatgaggatcgatggggagccatggaagcagcccctcccaaaagatgacgacaccgttgttgtggagatctcccaccttggtcaggtcaccatgcttgccaacgagccctgcaagtcgaagagcgtccatgacgaccaatcctcccacgcacaacacagcggccatggcaacaacgacgacgacaaggacagcatggaggacgaagatgagtgggaggatggcaggaggaagtttggtgccgcagatacattcaagatccctgacgaggttgacattgctcacctcagctgaactcagaattggtatcttttctggttgcattcttga

SEQ ID NO: 746 - DNA, 1473 bp, Oryza sativa
cagacctgccaccacatcaggaaattgggatgccatcactctctcctacaatgactgagaggggaacattgcaaggtggctgaagaaggaaggagataaggtctcacctggtgaagttctctgtgaggtggagacggataaagccactgtagagatggagtgcatggaagagggctatctcgctaagatcattcatggagatggtgccaaagagatcaaagttggtgagtcattgctgtaactgtggaagaagagggtgaccttgagaagtttaaggattataaaccttcaacttcagctgcacctgcagccccttctgaaccgaaggctcagcctgagcctgcagagccaaaggtgaaggagacagagccttccaggactcctgagccgaaagccccaaagactgaagaagcttctcaaccagggggtcgaatattctccagccctcttgcaagaaaattggcagaagataacaatgttccactgtcaagcgtaatgggaactggtcctgatgggcgaattttgaaggcggacattgaagattacttgggcttctgtagcaaagggtggcaaaagggaagctcttgcggctccagggttaagttacactgatgttcctaatactcagataagaaagaggttactgcaaaccgcctgctaagctctaaacaaactattcctcattattacttgacagttgacgcccgtgttgataatcttatcaattgcgaggggaactgaatccgttgcaagagtcatctggcggtaagaagatatctattaacgatcttgttataaagaggctgcagctctggctcttcgaaaggtccctcagtgtaatagctcgtggatgagtgattttatccgccaataccacaacgtgaacatcaatgttgctgtacagactgagcatgggttgtttgttccagtaattaggtgtacctgtgtttcaggatgcagacaagaaggggacttggtacaattgctgaggaggtgaagcaggtggctcaaagagcaagggataacagctttaaaacctggaagattatgagagggaggcacattcaccatatcaaacctaggaggtcctttcggaatcaaacaattctgtgccatcataaatcctcctcagtcagcaatcttggccattggtactggctgagaagaggggtgatacctggcagcgtagacggccagtatgagtttggttccttcatgtcggcaacaatgagctgtgatcacaggaggtgctatcggcgcagaatttctgaaagcattcaagggctatatcgagaatccaaactcaatgttactgtgaagttaaagatcagcaaaactattcttctcatgtgctcgaataacgcagagtggtgctatctcattttgtataataccggcacggtgttctgtcaaggaggacccgaaaaccaagagcacataaccatagacagaatgacctggtttttggattaa

SEQ ID NO: 747 - DNA, 1412 bp, Oryza sativa
gaaatagcctttcttattcaaggcttgacagttgaccaagataattatatcgaagattacatgattggtcataataatgatgaatttgatgatcaatcaatttcaaacacagaaacaaccaaattgtatggccatgaagaaggtgtgacttggtttgcacgtccattcaagggaaaaaatgttgttgaaagtgaccatagtcctatacctaatttgcttgatcctattgtcacactttttgatagtatccatggtaatatattgaatacacctgaattcactagttctggaaacatgtcaaatgatatagaacaacctaaaacagatttggagagccaagaagatcttgatactgattatgaagatgacctcggccatccacttctatttcaccaaggatcttatatggaaggaatagatgatgcatgtgttaatggaggatggcacatagcttggaaatttgttcaaagagagaatgaatttgggcaaacacaagatgacttccaacaaatttttctacaaggtgatattcttcaagctggccgtgtttcccatgcaaccgctttggttagcacaccttcttttcaccattctattggacctgcaatggtgcatccatccaaattcaacttgtctaccgaaggacaaagttggtctgatcttttacaacccggggtaaagcagggattgattgtgggtgtcacaatacaaattcttcaacagcttgctggaattagtggcattctttattacactcctcaaatacttgagcaagctggagctggaattttgttaaaatggtttaatgttagttcttcctcatcatctattttgacgagtgctctaaccacctttacgatgcttccttctattggtattgcaatgaaatgcatggatcgttatggaagaagagatcactccttctttacacaataccaatgttgatagtatcacttattatattgatcgtggtcaatgttatgaacttagaagcaatttttggagctattttatccacatttggtgttatcatctatgtttgttgcttcgttatgggatttggaccaattcccaatgttctttgctcagagctttttcctcctagttgtcgtaaccgttgtatgtctatttgtacattgacattttggattgtttccattattgtcacttatgcatttcctgttatgctaagctccataggtctaattggtgtttgtgggatatatgctgttgtctgcatagtctcctttatattcgtgttaattaaggtgcctgaaacgaaaggcatgcctcttgcggttatcgcaaattccttagctgttggagcaaggctatcagttaaacggaatgagaacatctaaatgagagtgatttttctttgttaacattttttaatagtaagacattattga

SEQ ID NO: 748 - DNA, 1405 bp, Oryza sativa
atggacggccgcaaggatgtcgggatcctcgccatggatatctacttcccgcccacctgcgtcctccagcaggaatcgctcgaggctcatgacggcgccagcaaagggaagtacaccattggtctcggccaagattgcatggccttctgcagtgaggtggaggatgtcatctcgatgagagcatgacagttgtcacatccctgctgaaaaaatacaaggtcgatccaaagctgattggtcgattggaggttggcagtgagacagtcatagacaagagcaaatccatcaagacttggctgatgcagattttcgagtgcggtaatactgacattgaaggagttgattccagtaacgcgtgttatggtgggacagcagcgctgttgaattgtgtgaactgggttgagagtaactcctgggatggacgctatggccttgttgtttgcacggacagcgcggtttatgcggaaggcccagctcgtccgacaggtggtgctgctgctattgcaatgctcattggtcctaatgctcctattgcattcgagagcaaatacaaagcttctcacatggctcacgtctatgatttctataagcctgatcttgcaagtgaatatccggtcgttgatggaaaactatcccaaacatgctacttgatggcgctagactcatgctacagacagttttgtaagaagggaaacaattctcaatttctgatgcagattactttgttttccattctccatacaacaaggcttgtgcagaagagttttgctcggctttactataatgatttcacgcgcgactgcagtctgttgacaatgatgctaaagagaagctccagcctttctcaaatttgactggcgaggagagctaccaaagtcgtgacttggaaaagtcacaacaagtagcaaagcccttgtatgacatcaaagttcaaccatcaactttgcttccaaaacaaattggtaacatgtacacagcatctctttatgctgcgttggcgtctgtactctataacaagcatgctagtctgcaacgaattgttatgttctcgtacggcagtggcttgacatccactatgttttcgttgaaacttaacaatggccaggaccccttcagtttatcaaacattgcttcagtgcttaatgccacggagaagcttgagtcaagacatatgttgcccgagaaatttgtggagacgctgaagctgatggagcaccgatacggcgcaaaagatttcgagacgtgcaaagacacgagcttgttgcctcctgggacgttctacctcaccagggttgactccatgtaccgaagattctatgagaggaaggccgacgaggagatcgctgcagccaaagccaagtacagtaatggacatgccaccaatggctatgccaatggccactag

SEQ ID NO: 749 - DNA, 1386 bp, Oryza sativa
atggagaagaaggcgtccatcctcatgaaccggtatgagctcggccgcatgctcgggcaaggcaccttcgccaaggtgtaccatgcacggaaccttgcatccaaccagagcgtcgccatcaaggtcattgacaaggaaaaggtattgcgtgtcggcatgattgaccagatcaagcgagagatctccatcatgcgcctcgttcgccaccccaacatcgtccagctgcacgaggtcatggccagcaagagcaagatatactttgcaatggagtatgtccggggtggtgagctcttcagcagggtagccagggggcgactcaaggaggatgctgcgaggaagtacttccagcagttgataggggctgtggacttctgtcacagccgcggtgtctaccaccgagacctcaagccagagaacctcctcgtcgacgagaatggcaacctcaaagtgtcggactttgggctgagcgccttcaaggagtgtcagaagcaggacgggctgctccacacgacgtgtggcacacctgcatatgttgcaccagagataatcaataagaggggctatgatggagcaaaagcagacatatggtcttgcggtgtcatactctttgttctgcttgctggctacctcccattccatgactcaaatctaatggagatgtaccggaagataagcaaaggtgatgtcaagttcccacagtggttcactactgatgtccgaaggcttctgtccaggctgcttgatccaaatccaaacattaggatcaccgttgagaagctagttgagcatccatggttcaagaaggggtacaaaccagcagtgatgctatcacagccaaatgaatcaaacaacctcaaggatgtccatactgctttcagtgctgatcacaaggacaatgaaggcaaggcaaaagaaccagcaagctctttgaagccagtgagcttgaatgcatttgacatcatctccctctccaaaggatttgatctgtcaggcctgtttgagaacgacaaagagcagaaggcagactcacggttcatgacacaaaaaccagcatcagcaatagtgtcaaagctagagcagattgctgagacagagagcttcaaggtgaagaagcaggatggactggtgaagctccagggatccaaagaagggaggaaagggcagctcgcgatcgatgcagagatctttgaagtgacaccatccttctttgttgttgaggtgaagaagtctgcaggggacacgttggagtacgaaaaattctgcaacaagggcctaagaccttctctcagggacatctgctgggatggtcagtcagagcatccatcactggcacagtcatcaactctgactcagtcctctaagtcaatctcgagacatgccatttaa

SEQ ID NO: 750 - DNA, 1378 bp, Oryza sativa
atggacgtggagtacgacgtgatcgtgctcgggacggggctcaaggagtgcatcctcagcggcctcctctccgtcgatcgcctcaaggtgaggtgctgcatatggacaggaatgattactacggtggagactccacatcgctcaacctgaatcagcagctatggaaaaggttcaaaggtgaaggtactcccccggcgcaaattggggctagcagagactacaatgtagacatgattccaaagagtttatgatggcaaatggtacattggtccgtgtacttatccacactggtgttaccaagtacttatcattcaaagctgttgatggaagctatgtcttcaataagggaaagatccacaaggttccctctactgatatggaagctctcaagtctccattgatgggattgttcgagaagcgcagagcagggaagttcttcctttttgtccaagattacaaggaaaatgatccaagtacccacaagggatatgaccttaacaaaatgaccaccaaggagcttatctcaaatatggtttggatgataatacaatagactttattggccatgcagtggctcttcataaagaggataactacctgacagaacctgcaattgacactgtaaagcggatgaagctttatgcagaatcagtgggtcgttttcaaggaggatcaccatatatttatcccttgtatggcttaggagagctgccacagttgatccagggttttgcaaggcttagtgctgtctatggtgggacatacatgttaaataagccagagtgcaaggtataatttgtgttgttattgaatttaatgatgaaggaaaagtttgtggtgttacgtcagaaggggagactgcaaaatgtaagaaggttgtctgtgatccatcatacatacctgataaggttagaaaagttggaaaagtttttcgggcaatcgctatcatgagccatccaatcccaaatactgcagattctcactctgtacagatcataataccacaaaagcaacttggacgcaaatcagacatgtatgttttctgttgttcctactctcacaatgttgcatcaaaagggaagttcatcgcgttcgtgtcagcacaagcagagagtgaaaatccagcggcggaattgaaaccagggatagaccttcttgggccagtggatgaactatttattgatacatacgacagatttgaacctactaatgacccatcttcagacaattgtttcatctcaacaagttatgatgccacaacacactttgagtctactgtgatggatgttctttccatctatacaaagatcaccggaaagagacggttgatctcagtgtggatttaagtgctgcgagtgctgctgaagatgatctctaa

SEQ ID NO: 751 - DNA, 1203 bp, Oryza sativa
  misc_feature (556)..(556): n = any nucleotide
  misc_feature (643)..(643): n = any nucleotide
  misc_feature (655)..(655): n = any nucleotide
atggtcaccctcctcctcgccttccgcctctccactctcttcctcctcctcgccgccggcgccatcgccgtcgatcccgatggcgccgccgcgcccgataccgccgccgcgcccgataccgaggcggcggcgctcctccggctcaaggcgtcgctgatcgacccgacgaacgcgctagaggcgtggtcgccgtcgtcgccgtcgccgccgtgcgatgaaacacaccggtggccaagggtgcagtgctacaatggcgtcctcatcggcctccgcctcgcccgcctcaacctctccggcgacttcgacttcgcggcgctgtcgcggctaccggggttgcactccatcaacctcatccgcaacaacttctccggcccgctgccggcgagcctcgccgccgtgcgcagcctccgcgcgctgtacctgtcccggaacgcgttctccggcccggtccccggcgacgtgttcgccgccatgagctggctcaagaagctctacctcgacaggaacgacttctccggcgagctcccggccggcgccatcgccggcgcgccgcgcntccaggagctccacctggaccacaaccggatcgaggggcgcgtccgtccaagctcccggccaagctccggctgttcaaggtgttgcnaaaacgccttancggggttcctccgggaggccgtcgccgcgcggttcaacgagtcggcgttcgccgggaaccccggcctgtgcggcgcgcctgggagcggcgccggcgcgtgcgccgcggcggcgccggccccgcgcacaccgcgatgccgatcggcggcgtcggcggcgcacggaaacaggtggcggagttcgtcctgatgagcaacgccgccggcgagttcgggctgccggagctgatgaaggcgagcgccgaggtgctcgggaacggcacgctggggtcggcgtacaaggccgccatgcgcaacggcgtgacggtggcggtgaagcggatgcgcgacatgaaccgcgtcggccgcgccgagttcgaggagcacatccggatgctcggcgagctccgccaccccaacgtcctctcccccgtcggctaccattaccgcaaggaagaaaagctcatcgtctccgagttcatgccacgtggcagcctcctctacgtcctccacggtaataatagaatggttacaagtcgttttgactttgatcaaaatcaaactactctaa

SEQ ID NO: 752 - DNA, 1197 bp, Oryza sativa
  misc_feature (114)..(114): n = any nucleotide
tgccggccatacttgagtatagactccacagcccttaatgggagttggaatggtcagctaggttctgctacatccatagatggacacaactggatgtttccggttgcatttggnttttttcaaagtgagaccactggcaattggacttggtttatgcaacaacttcataaggccattggaaaacagccacacttagcaatcagctcggatgcttgtaagggactggagaatgttgtgaaaagtgtatttagtacagcagagcatagagaatgcttttggcacttgatgcagaatttcatcaagaaatttcatggttcagtgtttgggaacatgtaccctgcagctaggtcttacatgacagatagatatgagtattacatgaataaaattcatgaggcaaaatcagatgtgaagccatatctagaaacttatcacggcctactttggatgaggagtaagttcttagaaaagataaaatgtgacttcatcaccaacaatctagcagagtcatggaacaaatagatcaaggatatgaaggatcatcctattgcagatctcgcagatggcatcagagcaaagacaatggatctatttgcgagacggaggaagataggtgagaaactagatggtgttatgctccctattgtagttcgtcaactgaatgcaatgactagagatttgggtcacttgaaggtagtgcaaggtaataaggacctagcagaagtgactgagattactcctgaacatgatattagtaggcatgctgtcaatcttacagaacatacatgcacttgtagagagtggcaagtttctggcaaaccatgcccacatgcattagctctcataatatcagctagaaacccaagaatggctgattacctggatccttgctattcagtggaaaagtataagctggcatatgcaggtgttattcatccacttccagataagtcccaatggccaaaagtcaatattggtttcaagttgttgccacctctcactaagagggatgtagggaggcaaagaaagaataggatagttgggtgccttgagaaaggaagcaagcctaggaccaaaggaaagtggcaggttcaatgtaagaagtgtcttaacatgggccatagacaaacatcctcaaaatgtccattaaatggtaccaagaaaaaaaaggtagccacatacatttacttcttctag

SEQ ID NO: 753 - DNA, 1191 bp, Oryza sativa
atggccgggctcggcggcgcgcccgccatggcgcccgggaccagcctcatcggctcgctggtgagggaggaagggcacatctactcgctcgccgccaagaccgacaccctgtacaccggctccgacagcaagaacatccgcgtgtggcgcaagcagaaggattccggcgggttcaagtcgtcgagcggcctcgtcaaggccatcgtcatctccggcgagcgcatcttcaccgggcaccaggacggcaagatcagggtgtggaaggtgtcgcccaagaacggcctgcacaagcgcgtcggcagcctgccccggctgcgcgacttcctccgcggctcgctcaacccgtccaactacgtcgaggtccgcaagaaccggacggcgctctggatccgccacagcgacgccgtgtcgtgcctgagcccgacggactcggcgcagggcctgctctactccggctcgtgggaccggaccttcaaggtgtggcggatcaacgactccaagtgcctcgagtccgtggtggcgcacgacgacaacgtgaacgccatcgtggcagcgttcgacgggctggtgttcaccgggtcggcggacgggacggtgaaggtgtggaagagggagctgcaggggaaagggaccaagcacgtcgcggtgcagacgctgctgaagcaggagcacgcggtgaacgcgctcgccgtgagcgccgtcgcgccggtgctctactgcggctcctccgacgggctcgtcaacttctgggaaggggagcgccacctggtccacggcggcgtgctgcgcgggcacaagaaggccgtgttctgcctcgccgccgcgggctccctcctcctcagcggctccgccgacaacaccatctacgtgtggcggcgcgacggcggcgtccactcctgcctctccgtgctcaccggccacaccgagccgatcaggtgcctcgccatcgtcgaggacaacaaggacaacgccgccgtgcccgtcgacgccgtggacagcagcttcgcgtcgggctcgtccacgcggtggattgtgtacagcggcagcctcgacaagtcgatcaaggtgtggcgcgtcgccgaggacgcgcctgacgcgctgctccgtggccccggtggcggcgacgcgccgcagatgttcgaccggtaccccggcgacccattcggcgccagcagctcgtcgttccgctag

SEQ ID NO: 754 - DNA, 1180 bp, Oryza sativa
atgagtcggaggaggagcaagagagataccgaggcgaagattgcagatcttgagtacaaggtatcgagctacgagctcagcatgcaagaggaggtggcaaggaagcagagcatggacgccatgcaaactcaggacgaaaccacctgccccgttgatgagatcacgtagcggacaccatgtgagctgcatattcccttcaagaacttatcaatcaagaaggtggcgttgggaatgaccatcccaacggacccttcagggacttaccattgcaggccgattccagcaggatactcgagggtcaaagttgagctggtggaagccgcgtacgaggtcctcgagttggactaccctggaggagacgtgagacgcatctacgagacacaagccacgccattatactatggcgcaagcgccctggggcgacaatcggtgtctcgtgcaccatctcttccggctccaccacctcctgcaccatctcctccagttcctccaccacctcctcctgcaccatctcctccggctcctccgcctcctccacctccaccgtgtctgcctgcacctcccaagacaaggtctcgccaagctccaccgcttgcccgcacaagggcaacgaagaaggcgaaagagaagtgaagaggcaactcaagcctcggagtcctgaaaataatatacctattgacctgagcgtgaagaacttcttcaaggaatgtccacaacaaacaaggaggccttaaagctatcggactatgaccgaacacttaagaaagcctattacaagaagtccaaaccagtccctcggcttggagaacaaccaaaccaagaggtcgagccgtgtccctaccgacatagatgtacaaattccatgaatggttcatggaaatgagcgccaagggtaaagagatgttcagagcgaggatcagaaaccccgacttcttgcaaggagaagaagttctgtgcatccatttcaagaatgtcttcgaactatatcatctagacgccctcgacgtctctcttctgagcgcatggattttagggggctttacgatactgggttcatcgaccctcagaaaatcaacaccgaaatgatcgacaagtacgagaaagacatagaggacaatctcgtccatctcctgacgcagcagcatttcaagacgttcatactactgtcgaacaacacata

SEQ ID NO: 755 - DNA, 1170 bp, Oryza sativa
  misc_feature (81)..(81): n = any nucleotide
  misc_feature (100)..(100): n = any nucleotide
  misc_feature (103)..(103): n = any nucleotide
  misc_feature (888)..(888): n = any nucleotide
atgtccttccccgacgaggaggaggacgaggccttcctcctcgccgtagcggccacggaggaagcggcgctggcctcctcngactcctccaagcgccgcngcntctccatgacctcgtcgacctcctcgtcaccgacttcggccactcctccccccgccgccgtccccgaggggccctacctggccgcgctcaagggaagccacagctccgcctggaagcagcagcaggagacgctgagccaggcgcgcaagcgtcccggtgggtcccaaaccctagccaccccaggtagcggcagcggcagcggcggcgcgcaggtcgcgaggggcggcgcgtgcttcaagtgcggggactcttgccactgggcaagagaatgcccgcaatccgtgccagctactggcggcggaggaggaggcggggcctttggtggaagcggaggagggggtggtgggtatggggacgcgggtggggcggtggaggagaaggcttgcccctgcggcgccgggagttgcctagtgctcacatccaacacgcccaggaatccgggccgcaagttctacaggtgccccatgcgggacaatggaggttgcaactactttgagtggtgtgataacccatctccaggtcctgcaaatgtcagtggcaatactgtttttcagtcagatacatcagttgcgcatatgctttgcccctgtggtgctggagcttgcttaattctcaccacaaagacaggaaagaatgttggaaggcagttttatcgttgcccagctaatcagggaggtagctcttgtggctatttcaagtggtgtgatgaacaacagcttaggacagctgctccactgcaagcttcaacacaatatcatactgatgttgcttcaagtggcaaattnccagcaagaggagctcctccgcctgcttcaaatgcgggcaagagaaccattgggcaaaggactgcccaaatcaatcttcagatccttatcctgacaaaggtgggagaacatttacttctgcaagctctcccgatgcgtgtttcaagtgtggtaagagcgggcactggtcccgtgattgccccaccgcaaattgtggttctagtaccgtctccagccatgtcaagtcctcttctactttgggctcatggaacagccacagatactgatagccggtacctgtga

SEQ ID NO: 756 - DNA, 1086 bp, Oryza sativa
atggctgatcgcgatgaggaacagatactgtacgatacaatcgcatcgggaagcagccagtactggaacgaagaagaggggaacgaggatccaaaccagtacttgaacgaggagagggatgcagaggggaacaaggagggaaacgtggagagagatgcggaggggaatgaggaggagaaaatggcagaacagttccagaccttcaagggagatctgtaccggaaatacatcctgaaggggcagacaccgaacttcgacgtattcccgaagctaagggatcactaggacgagttcgttgcttacaagacaggtcaacaagggcaggcgatgatggaaagaaacaaagaaaatgccgccaagaagaagtaccatcaccacttggggtcaggcggctatagcgtcgcgatgccgaagtgggaggagatggaggcaagcttgcttgagaggggtatcgaaccggccaccgctaaatggcctgatcgatcgaagttctggtactatgctcatggtgtaacgctcaacccagttgatggctccttggtcttcagcgatcagatacgcgaggctgcgagtcgactaatggacgcagtggaagcctcttctcagggcacgttccgacccgacagagagaaggacgagctgtcactcgccctacagactcccgagcatccaggacgaacacgagggaaaggcgtgattccctggaagatgggattcaaggaggacatccacacgtataggagtcggatgaggagcaagagagataccgaggcgaagattgcagatcttgagtacagggtatcgagctacgagctcagcttgcaagaggaggtggcccggaaggtggatgaacgcatggcagcacatcgttcacacgatccccagccgtacatacatcctccaatggtcagcccatcaggcaatcgtagcagctgcgcctcaacggggcaggtagtatcacatagcatggacgccatgcaaacccaggacgaaaccacctgccccgttgatgagatcacgcatcggacaccatgtgagctgcatattccctttaagaacttattaatcaaggtatgctcgatgtaa

SEQ ID NO: 757 - DNA, 899 bp, Oryza sativa
atggcgggtgcggcgtcgccggaccacctgttcggccttcgcaacagcttctacgtcggcgcgtaccaggccgtcatcaccggcgtccaggccatccccgcgcgcgctgccctctcccccgacgccctcgccgagcgcgactccctcctctaccgctcctacatcgccatcggctcccaccagcagctggtgatcgacgagatcgggccgggcgcggccacgccgctccaggccgtcaggttgctcacggtgtatctctccggcggcgccggcggcaagaaggaatccgcgatcaggaagctgaacgagctcctggcagatgatgcggtggggagcaacccgattctccggctggttgcagggacggttctcatgcacgagcgggactatgccggagcactgaagcacacaaattctggtgggactatggaattgcgatgaatgttcagatatgcctccagatgcacaggtctgatcacgcagagaaacagctgaggataatgcagcaattggacgaagaccacacactgacgcagctcgcaaacgcatgggtagaccttgtcatgggcgggtccaagatccaagaagcgcacctcatcttccaggacttgtcagagaagtacccagcaacttgcttaattcttaatggtaaagcactgtgcctgatgcacatgggtaactttgaagatgcagagggattgctgctggaatcactgaacaagggatgccaaggatgcagaaactctagccaacctcgttgtgtgcagtctgaacctaggaaagtctgcatcccgctacctgaaagccaactgaagctggcacacccagaccatatgctggttaagcgaatgtcctctgctgaagacagtttcgacagagcctgccaagcgatatcatga

SEQ ID NO: 758 - DNA, 864 bp, Oryza sativa
agtattatgactccctactacagtgaaaaaacagtatattccaaaagtgatcttgatctggagaatgaagatggttggaataatttcatgggaagaattaattccaaaagaggaagtgaagtcggggcaaatgaggaaaacgtcctacagcttcgtcattgggcttctcttagagggcagacactttgtagaacaggagttttcaattatgaagcaagcatggatgagggggaatagtgcaattcaagaagctatgggatctcagtcaattgtgcagctagatcttttgatgaccttagccaagactgaactagcaagaggtttcagaagcaccctgggggatttcataatcatgacgcttcagctctgttcagtgttcttcactttctaccttgggaccaagtcacattattttcgacacacaattctccatggtggtgcaaaatatagagcaactggcagatgtttttttgttcgccatgtaaggttgactgagaaatacagaatgtacttcagaagccactttgtgaaaggacttgagctgatgttgctgctagtagtctatcagttttaaggtgatgttgctacggattcatctgcctatatacttctgacatcatcaatatagctcttggttatcacttggctcttcaatccatcaggatttgattggcagaaaatggtagatgactggaatgactggaccaagtggattagcagtcgaagtggcattggggttcctgctaacaaagcttaggaatcctgatgggaggagaagcagaaacatttacagtctacaggtctactgggctgtttctgggagatcatactatctctcagattcttcatgctccaatactgtat

SEQ ID NO: 759 - DNA, 855 bp, Oryza sativa
tatgttacaaataaacgagggatgaagctctttgcatgccaatggagtcctttagaccatgaaccgaaagctctaatcttcctatgccatgatctttcaatgtttaggatatgccatggaatgcagcatttcaatgagagtcaggaacaggtgttcggttggcaaaggctggatttacagtgcacggattggactatcagggccatgggaagtccgaaggacttcaaggctatatcaatagttttgatgatgttgttgttgattgctcgaactactttgcaagtgtttgtggagtgcaaaggaaaaaagaagttccttcttggtgagtcaatgggaggcgctattgtgctgatgctacataggaaggaacctacaaattgggatggggctattttggttgcccccatgtgcaaggaagatatgaagcctcgtcccattgtgataacaatcctaagcaagcttagcaacgtgatacctacatggaaaattattcctactgaagatgtcattgataagcaggtaagaaacaatccatattgctataaaggaaggcctaggttaaagactggttatgaactttttatggcaagcttggatattgaaagcactcttgacaagcaggttacactaccattcatcattgtccatggtggtgatgatgccgtcacagatccatcagtaagtgaagaactgtatacatcagctcagagcaaggacaaaacactgaaactgtacccagggatgtgtcacgccctgacatctggtgagcccgcaagcaacattgacattgtatttttggacatcattaagtggcttgatgagagggtatcagtttcataatatgagatcagttaa

SEQ ID NO: 760 - DNA, 855 bp, Oryza sativa
gtgcttgtggagtacaaaagcaaggaccctgatcatgtagagtgggcaaaagctctaaaagagctcttcgtgcctagtttgcgtgactatgtgaagacattctaccctttgggccctgtgtggcaacctcctgggagttcaacaagcaaagcaccttctgctccctgccctccttctgcatctcttttcagttcttcagctcaatcatcacaaccaaaaaccggaatgtccgcagtcttcgctgaaatcagctctgggaaatcaatgacacaagggtcttaggacggtgacagctgacatgaagagcaagaatagaacggatagaactggtgttgtagctgctgaaggaaaagaagctcataagaaaccctcctctagttcaaccaaattaccttctaaattggagctccaaatgggtcgcaaggcaacaagaacttagtaattgaagattgtgataccaagcaatccatatatgtatttggatgcaaggattctgtgctacaggtcaaagaggaaaagtgaacaacataactattgataagtgtagcaaaatgggattattgttcaagtgttgtcgctgcttgtgaaattgtgaactgcaacagtatagaggtccaatgtgagcagggctctgtaccaactatatcgattgataacacttctggctgccaactttatttaagcaaggaatctttagagacatctataacaactgctaaatctagtgaaatcaatgctcttgttccagatgcaaacagcgacggcgattgggagcattccttaccccagcagttcattcatgctttcaaagatgggcaatttacaacattaccagcatgtcattcaggcggctga

SEQ ID NO: 761 - DNA, 842 bp, Oryza sativa
atgccctctcctgaaccactcgattcctcccttgccccctcctccctgtgcacgattcctcgtgtttttctttttccttgtccgttcttgatttcctggtgcttctccgcagatcatccgcaagggcttctaccagaccaagaacgtggagcacaagggccaggtggatttggtgacggagacggacaaggcctgcgaggacctcatcttcaaccacctccggaagcactacccggaccacaagttcatcggcgaggagacgtccgcggcgctcggcgccaccgcggacctcaccgacgacccgacctggatcgtcgaccccctcgatggcaccaccaatttcgtccatggttcccttttgtttgcgtctcgatcggtctcaccgtcgggaaaattcctactgttggagttgtgtacaaccccatcatgaatgagcttttcacagctgttcgtggaaaaggtgccttcctcaatggttctccaatcaaaactggtgaaggctcttctggtaacagaggagcaggttggaaccaaaagagataaggccactctggatgatacaacaaacagaatcaacaagttactattcaagagatctatacggatgtgtggctcgttggccttgaacatgtgtggagttgcctgtggtaggcttgatttgtgttatgagattggatttggtggcccctggatgtggccgctggagctctgattcttcgggaagctggtggttttgtttttgatccagtggtggggagtttgatctgatggcacgaagaatggcaggatcaaacagctatctgaaggatcaattcatcaaagaattgggagatacaagttga

SEQ ID NO: 762 - DNA, 834 bp, Oryza sativa
  misc_feature (354)..(354): n = any nucleotide
aggactttgcgcaagctctttgatgttgacccaggagactacatgctctccatttgcggggatgatgcactgctggagctttcatctcccggtaaaagtggaagtttcttttatttcaccaatgatgacaagtacatgatcaaaacaatgaagaaagcagaagttaaagtacttctgaggatgcttccagcctattataaacacgttcgttcttttgataatactctagtaacaaaatttttcggcctgcattgtgttaaaattacaggagctattcagaaaaaggttcggtttgttataatggggaatcttttctgctccaactattcaatccacagacgctttgatttgaanggatcatcacatggtcgcacaacggacaaacccattgatcaaatcgatgagactaccactttgaaggaccttgatctcaatttcattttccggttagagggatcatgaggcaattggacaaggattgtgagtttctggagcaagagagaattatggattacagtcttctggttggcgttcacttcaaagaccgatgcaaagaagctagggattggcatgccctcaagggtggagaatgttgtgaagaatcctgaaagcgaatcccagctcattggcgaaccaacaggggaattccaggacgttatcctgttctttggaatcattgatatcctacaagactatgatatcagcaagaagcttgagcatgcctacaaatccatgcaatatgatcccaactccatatcggctgttgatccaaagcaatactgcaaaaggttcagggatttcatttacagggcttttagtgaagacctacagtaa

SEQ ID NO: 763 - DNA, 810 bp, Oryza sativa
gttccaatgtttgaaaacatggatgatccgctcttggatgccttgtgcgaccacctaaagcctgttctatatacagaaggcagctgcataattcgtgaagaggatccagtatatgaaatgctcttcatcatgagaggtaatctcatgagtatgacaactgatggtggaataaccggcttcttcaaatctgatgttttgaaaggtggagatttctgtggcgaagagctcctgacctgggctcttgaccccacatcagtttccaggctccctagctcaaccaggacagtggagacaatgtccgaagtcgaagcttttgccctgacggctgaagacttgaagtttgtggccacccagttccgacggctctaccgcaaacagctccggcacacgtttagggcagcctgtttcatacaagcagcctggcataggtactgcagaaagaagatcgaagactctctacgcgagaaggagaagaggttgcagttcgcaatcgttaatgacggtgctacaactctcagcttcagggcagcaatatatgcttcgcgtttcactggcaacatgatgcggatcttgaggagaaatgccacccgcaaggcctggctgcaggaaagtgtgcctgcaaggttgttacaaaaaccagcagaacccaactttgctgcagaagagcactagttctgtttaccacgaatgcgtaaggaaatttttgtgcatggcttgtgcactttttacttgctgatatttttgctttcggttgacactgacctacaaattgaggagaggaaaaaaatcgcaataggtatctctctgtaa

SEQ ID NO: 764 - DNA, 735 bp, Oryza sativa
atgaacgacggcgatgtggcgcggcagctgaagcagatgacggacttcatccgccaggaggccgtcgagaaggccgccgagatcgaggccgccgccgccgaggaatttcaaatcgagaaactacagctggtggaagctgaaaagaagaggatcaggttggaatttgaacggaacgagaagcaaggaatactcaaagcagctcaatgcttcccgacttgaagttctgcaagctcaagatgatttagcgatgtctatgttggaggcagcagggaaagagctactgtacataacccgagatcaccatgtatacaagaatcttcttaggatatttattgttcagcagagcttgctgcgtttgaaggagccagctgtgattctgcgctgcaggaaggaggatcgtgagcttgttgaatcagttttggagtctgcaaagaatgaatatgcagacaaagcaaatatatatcctcctgaaataatggtagaccgtaatgtctatctgcctcctgctcccagtcattatgaggcacatggaccctcctgtttagctctggtggagttgtgctagcttcccgagatggaaagatagtctgtgaaaatacattggatgctagactagaggtggttttcagaaagaagctaccagaggtatgtaactgtgtcgttccttttccattgctctttctgaaaagtggctcttctgaatatttctctgcatcattatttttgtggatatag

SEQ ID NO: 765 - DNA, 699 bp, Oryza sativa
  misc_feature (203)..(203): n = any nucleotide
agaaatttttagacagctctaagctgaagaggcattttcttattcatacaggagagaagaactttgtctgccctcatgaaggctgtggaaaggctttctcattggattttaatttaaaggcacacatgaaaacacattctgtgataactatcaagtgtgcaagtacccagaatgtgctcgaagaaattaagggctcatatcangcaacagcatgaaaagaatccaggtgggtctgcaacaaaccgcagtggtctagcagaccactcccataatagtcacacaccgaaaccgtcagcagctccacccactccctcagctgatcgcccatacgtctgtccttatgatggttgtgccaaggcatacattcatgagtacaaacttaacctccatctgaagaaagagcaccctaatcactaccaggatgccggtgctcaagccgcctcttcgaagatgtcgaagcgaagaagcaagccctccttgacggccaagatgccactgcccaaggtccctaagcgcaggggttacacagagccataccaacctcctgttagtgttgtcgaagagcaccagtggccgaggaatgtgctgtacgaggacgatagcgaggagactgaggaagagggagataatgttggggacggggcgaggtacagagctgctagcagcgacgacgatgaggagactgaggacgaagaatga

SEQ ID NO: 766 - DNA, 684 bp, Oryza sativa
atgcagggggcgcgtgttaatctgaaggggtggcaacaggctgctgttgcattcggttctgcatttggggccttgcttgaccctagaagagctgatctgatagctgctcttggggagactactgggaagccagcatttcagcgtgtgcttcagcggatgaggaacagtgctgaaggcagggatgttctcctggagcgtcctcgagttatatccacacaagtttctcatgcctgggacatgcctcagaacacatttggtgcagcatatgctcagttcatgggatcaaggaacttctcaccggatgaccgcccacctgtccgtttcatggatacagatgagcttgcgtatgttgcgacccgcgcccgtgaagtccatgacttttggcatgtgctgttcggccttcctacgaacctgattggagagactgcccttaaggtcattgagtttgaacagatgttccttccaatgtgcatgctttcagtcgttgggggctctgcgaggttcaatgagaaacaaaggacactgttttttcagcattatttcccatgggcttcaaaagcaggtcttaagtgcacagatcttatgtctgtgtactatgagaagcattttcatgaagatttggatgaagtgaggaggaactggggaattataccatgccctgatcccaaaaggagcagtgtttag

SEQ ID NO: 767 - DNA, 621 bp, Oryza sativa
agggtgttcctctaccagcatttcctcagcgacgacgaggccaaccacctcgtctccctctcagcggtggctgataacctgtccggcaagagcgagctcagcgacgcccgcaccagctccggcaccttcatccgcaagagccaggagaatggtgaggatatccaagtgttaaggtataagcacggcgagaagtatgaacggcactatgattacttcagcgacaatgttaacactctccgtggtggtcatcgcatagctactgttcttatgtacttaacagatgttgcagaaggtggagaaacagttttccctctagctgaggtgaaaccacgaaaaggggatgcacttctgttcttcaaccttagcccagatgcttcaaaagattcattgagcctccacgctggatgcccagtcataaagggtgagaaatggtctgctacaaagtggattcgtgtagcctcattcgacaaggtttaatctcacacacaggacgacaatgagagttgtgaaaaatgggctgccttgggagagtgcataaagaacccagaatacatgattggaacagcagcattaccagttactgcagaagagttgcaacatatgttagcgatccaattgtaa

SEQ ID NO: 768 - DNA, 582 bp, Oryza sativa
gaggaagagcctcttattcagacagtagaatgtcgtatttgccaagaggaggataacatcagcaaccttgagagtccatgtgcttgcactggaagtctaaagttgcagtatgctcatcgggcttgcgtgcagagatggtgcgatgagaaaggagatttgacatgtgaaatttgccatgagtgtttgcagccatacaaacacgggtacactgcacttcctagagctcatcctgatgagacaaccattgatatagatttgcatgatccaaggattattgcaatggcacaaaatcacataatggaagctgactatgatgattattcagtaacaaatgcgagctctgctgccttttgccgctctgctgcgcttattctttttctactacgagtcaccgggtttctgctaccattctacatcatggcttgggcaatcaatatcttacagggccgaaggcggaggcaggcggctgctctagctgcaactgaggtggcattcattctacagtcaggacaaagaaggggcatgaatttcaccatcgcaccagattcccctgccacacctcagcatgagcctatcccttga

SEQ ID NO: 769 - DNA, 568 bp, Oryza sativa
ccctccttcaagctcatcctcgtcggcgatggcggcaccgcagggaagacgacgttcgtgaagaggcacatcaccggggagttcgagaagcgctacgaacacgatcggggtggaggtgcggccactggacttccacacgagccgcggcaaggtgcggttctgctgctgggacaccgccggccaggagaagttcggcggcctccgtgatggatactaatccatggtcattgcgcgatcatcatgtttgatgtcacctcgcgtctcacgtacaagaacgttcccacctggcacaaggacatctgcagagggtctgcgacaacataccgatcgtgctgtgcggcaacaaggtggacatgaagaacaggcaggtgaaggccaagatggtgaccttccacaggaagaagaacctccagtattacgagatctctgccaagagcaactacaacttcgagaagcctttcctctaccttgccaggaagctcacagggacatgaaccttcggttcgtcgaggagttggccctcctccccgccgacgtcaccatcgacctcatcgcgcagcaaaagtga

SEQ ID NO: 770 - DNA, 456 bp, Oryza sativa
atggcgatggcggtgcaggggagccgtgacccggatttcttcgtggagggcgacgtgtactgcgacacgtgccgcgcggggttccagacgaacgcgacgacggcgatccagggcgcgcgggtgcggctggagtgccggcacttcatgagcgcgagcggggcggtggagagatcggcggaggggacgacggacgcggcggggcactaccgcatcgagctggtggacaaccgcggcgccgaggaggtgtgtgcggtggcgctgctcagcagcccggaccccgaatgccacgagacggaggtgggtcgcgaccgcgcgccggtcaccctcgttcaggacgccggcctcgccaccatggtccgccgcgccaatcctctcggcttcctcaagacccgcccactccccatctgcggtgaccttctcaagagctacgcgctcggcaccgcaccaagctactag

SEQ ID NO: 771 - DNA, 456 bp, Oryza sativa
  misc_feature (355)..(355): n = any nucleotide
  misc_feature (382)..(382): n = any nucleotide
  misc_feature (385)..(385): n = any nucleotide
  misc_feature (409)..(409): n = any nucleotide
  misc_feature (423)..(423): n = any nucleotide
  misc_feature (436)..(436): n = any nucleotide
atggattcgacggagctgaggaaggtgttcaagatgttcgacaagaacggcgacgggaggatcaccaagaaggagctgggcgagtcgttcaagaacttcggcatcttcatccccgacgacgagctcgacgccaccatggacaagatcgacgccaacggcgacggctgcgtcgacgtcgaggagttcggcctcctctaccgctccatcctcggcgacgacgccgccggccgagcccccaggacggcggcggcggccatcggcggcaagggcggcgcccccgacgacgaggacgaggggatccgggaggcgttcaacgtgttcgaccagaacggcgacggattcatcaccgtcgacnagctccggtccgtgctgtccagcctcnggntcaagcatggccgcaccgccgacnactgccgccgaatnatcagcatggtgnacgccgacggcaacggccgc

SEQ ID NO: 772 - DNA, 442 bp, Oryza sativa
atggtgcacgggacgctggaggtgctgctcgtcggggccaagggcctcgagaacaccgattacctgtgtacgcatcagcttataattcctaatccttaaacgcatttgcttgaacatggatccatatgcaattctcaagtgccgttcacaggagcagagaagcagcatagcatcagggcaaaggaagtaaccctgaatggaacgaaaactttgtcttcaccgtgtctgacaaagctacagagctgttgatcaagctcttggacagtgatactggctcagccgacgactttgttggtgaagcaacattcctttggaagcagtgtatactgaagggagtattccaccaactctgtataatgttgtgaaggatgaacattactgtggagaaatcaaagtcggcctcacattcactcctgaggtagtttctaaaaaggctggctaa

SEQ ID NO: 773 - DNA, 357 bp, Oryza sativa
atggagttctacgaggaaacgacaaggactactcggattgtatccatattggtctctttagttctacttagacaaggggatatctatggtatacaaggcctcctagaaggagagggacacgccacaaggccacaagatgttgcacacaatacacaagccaacatacgccaagacaagccgtcggatatcgacatcagagataagcctaaacaatcccaatatggtgtctgcggaggccaacaagagggatctagcgctacctctgatctcgccgagtgcgaattcgaggaggaagactaccctgtcatcgactacgagttggttatccatgccgacaagtcgacgacaactagatag

SEQ ID NO: 774 - DNA, 316 bp, Oryza sativa
  misc_feature (3)..(3): n = any nucleotide
atnaggcccttcgacgaaacctgccgaaacccatggcgaaggctatggagcgagagcagcgcaaggcgaagagtagcgctaggccagaggcgtctcagacgaagggtgcaaggcgaagactgtctgccgaaggagatgacttcgccttgacaagtcgcccccgcgagggccgaggaagcctttccggcccatcaggccggcgatcgccacggcccatcaggggcccatgagcccctataacattatgtacccctgtaaatgccccttctttaagggtaatcatgtaaattcccctgtacaacctaaaccctggtag

SEQ ID NO: 775 - DNA, 1527 bp, Oryza sativa
  misc_feature (601)..(601): n = any nucleotide
atgactgcatctcggactagatcgagccgatcggagcgagcgcgagccgagttgtgcgcaccattcctggatcataatcacccccttataaacaaggcatggactccccagcgacccccgtgggcttatctctgccacttctcagtctgggtgccccgcaatgaaccatgttatacaaaagggaaaaggggtttattgtgtcagcggctagggtttgcggtggaccgggtgcacggcggcggctcacagaaacgaacggccgagatccatccatccaaaactgacggccaagatccatcggtccacgaccgggccacgggggacgacgacgatgacgtcagcggtgacgtcaccaccggcggcggctcgggcgtgcaagctcaccggcgaacgacggcgcgacggcacgaacggagggcaccagcacgtagagagcgacgcggcgaactaccgatcaacggacggcgacggcgtcgaggaagaagcggcggcaaccttcggcttgacgacgacggcggtgctccggcggtctacagcaacgatggaggggcggacgaggacggcgacgtgacggcgaccacgacggcggccttcccgagcnacggcgacgactggagcgacggcgacgcacggctggagcggcggcgacgacggcggcacgagggctctacgggcgaagagagacgaaggcgagggtggcgacgggtagcggaggacctgggggtgcttaaaaaggggctaggcacggcggcgaaggcccacggcgaccggcgacgcgaaggaaagattagggttcgggagagagagacgaatccgattcgagatcgaatccgcgaatttccaaagcgatttagacgatgtttccaaaagggaaaagccctcttcataaatttgtacaatcaatgccacgaagatagcaaactcgattgtcgaatatataaggaaagtggcgacgatttggcaccagatatccggttgtgtggaaagaccagctgtgatatacacaaaaaccatcaaacaacaacgattgctcgtgaaggggtcacatgtcgccgaaccggcttcgccactcagtggatcggcttcgctttctactggctgagctacgccaactgcgatccggcttcattattccgtgttctgctttgctattcagtggatgttggttcagtcgaatgtcctcatgacatgcctccaacaagcccctcacaggcaacggtgattatgaaacgtggaaaaacacgtggcgacacatgtcgacatgtggcatctatggatgatagggagatgatgcggatggatctaggccgagctgacgtggcaaggaaaaggattttggaaatccaacggtggagattggatctaggggatcgagcagctgagattgcttgcggtttttttaactgcttgacccaccacgccatggcatgctccagcgcggcatggtcgtcggcagtgcggtggcattcggcagctgaagcatctaggcccccgtcattgattttggtaattaatgacaagcgctaa

SEQ ID NO: 776 - DNA, 1458 bp, Oryza sativa
atggccgagaagacccaacaaacatgggccaggcccaaattgagcaatgcgggacagcccataaagggtgctatttatggcccagaaggcccaccaaacatgggccaggcacaacgtggaacaaacaggacggcccatgagggcactaataaggcccatccgatcaagcggcccgcccatccactccgtctccacccaacggcggaggcgacgacccgatattccgatccgccggcgccggcgccgccagtcgccgactttatcggcccaaggaggagatcccctgcggcggcgccgtcgagccggtgggggaagggagagcttgaggcggaggcggaggcagagcgtgagctccgaaccaccaccatggggacctctgcgcaggagccaaatctctggaagcaaatcgacgacgccgagcactatctggtcagcggattgttcgagcaggccgtatccactgccttatctgtatccagtcaagtacattcggctgccatggagaattcatgcgaccatgatgagcttctggaaatgcttgaattagctgggatggtacttgttcaggcgcttaaagaacttaagagggctacgatgcacatggcaggaggatctggatctgatcttagaccaatcttcgatgaataccttgctaaatggagatatactgatgatcaagtttatgttttagatgaaggaaagaacagctcctcaaatgggttggttgttacatcggttatgtcacctgaacaatattttgaggtggcagagttgtacacggtaacattccttagtgttgtctcccatgagactgcaactgctatctcatggactgaaaaggctgagttgactgaacaagatcggcaggacctattgagaaaacttcatgcgttacaatctgcagctaataagaagtccaccaatcagggtgcaaaactatcagaatcagcagaaagaaacctttccacttctcagaatggctcaatatcaccagcacatgaggatgctactaaaagctcagcacctacgcacaatgggaatatacagggacttagaaaggctttgccgaaatccattcaaccttcttttcaacgcgtcacaaatcaatttgatccattgttctggtggtttcattcatttcgcataaaatttggaaagataaatccactcgcagctgttcaacagagtgagaagcggtttgcaataagtgacatattcatggctgcaagcgatatgtttatgtatctagctttgtatgctatcgcctcctggttgagctgccccgtgacagtttacttgagcatcttcgtgctggcttctattgaaagaatggctgaaagaatgctaatgaaagaaggtggccatcttctagggcttgcttacctgagcatcttcatgccggcttcgactcacttgtcctttggtctcttggcaactgtggaagaaacgcaactgtag

SEQ ID NO: 777 - DNA, 1458 bp, Oryza sativa
atggagcggcggccggagctgcggcggacgatgacgctctcggagcagctgtccgcgcccgaccaggccatccgcgacttcctcaagatcccacacgacggcctcggcggcggcgacggcgagggagggaggatccccgccgccgcgggcgcctccggtggcggcggtggcgtcggtggcatgatcaactggaagccgctgcccttctccagcggctccaggcgcgccgcggtcgacggcggcggccacgccaatgaggacgacgacgaggaccacaccgacgacgacgacgacgacgacgaagaggagcaaggcaaggacgacgcgcccgcggcgcagatgtcgctgatggcgctactggagcaatcggacagccagtgggactcggaggacgaggacgaccaaggccacggcggtggcggcggcggcgggggcaacggcggcggcggcggcggcggcggcgcgcgcaagaacggcgacggcgacgacgacgaggacgacggcgaggggcgggaggaggagatggtgcacgtgtgctgcgtgtgcatggtgcgccacaagggcgccgccttcatcccgtgcggccacaccttctgccgcctctgctcccgcgagctctggccgcggcaactgccctctctgcaacggtttcatccaagaaatcctcgacatcttctaatcatcttcttcagaattcagatgcaaaccaagaaatcctcgacatcttctaatcttcttcagaattcagatgcagatagaacgatcatgcagcatggcggtttcctcaaaaaacgaattgacgccatcttctttccagacgaggtcgatgtgagactattttcctgggccgtgaaggccggcccggatgaatttgtacatggccgcttcagttgtgctgtacatatttaccatactcactattctgaaggaagccgaattattggtggcactgttgctaattgcattagtgcagccctgcattatagaggtgtgccctccttagaaatagggcgccaggtgaaatggttgagaactgctgcaaatgccagctttctacgctgccgcttcttcccccggcgagatcggtgcgaaactagtcgtggtccgttacaaaatggcccggcgcccggctggcccatgtgtgaaactaaatcatgggccgtgctggctgtgcaggccggcctggttatgctgctgggcttggaggcttggattggtcgcggactctgttcctgtctctgctcgttacatcaggagtcgcggctccgctccggcgctgggagggagaaaagcggccggcgagcacagctaaaatctaaactaaactttcgattatactgtgctgtactgtcagacataaataatgtgttctgttctgtgttgaatgtcatggttgtacgcttctatgtttgttacgtggcgcagagccgatttgctgcgctgtcgccgaaagagtag

SEQ ID NO: 778 - DNA, 1273 bp, Oryza sativa
atgcacgcacttgcatatttgctgtgtggcttgctgagtatgtcatatgctcaccttgcaataatcaatcaaacctcagttgaagacaagttgcgaaggagaagacgtttggcttatccccatttgagctgcctgtgggagtggagtcggagcttcgctagatttattttccgctgcagttttcttcatgtgactttacatgaacagaggtttgcggaagccaggaagaacttcaaaaagattaatcatgtctgtccttatatctatgggtccaacgatgatgatgatattgactccgaagtagcagcagccgagtgggttagaagtaagaaggttataccgtgccaatgggtgaaaaagttatggaaaagaagagagaatcaggaaaggagggttcaaagattgaggaacagacaacgcttccaagaagtcgagcaagagattaaccatcggctgaagaaaacgaagccgaggcaggagtggcgtgttaagaaccaagctgctacagccgatgaggtcaaagccgacgaagcaaaaaggttggctaaagggaaaagtgttgtcactgcgtcggttaacatggttttcacgttaccagctgagtttggagctaatcaagccgatgttgacgaaattgaagaagcttcggctagattggttttgttgccagaacaagcaagttttgagaagccagaagggacagacaatcggcacttaaaaccattgtatacaaatggctatgtcaacgggaagccgatgtccaagatgatggttgatggtggggctacggtgcatttgatgcaatatgctacattcaagaagctgggcagaaatgcaaaagatctcatcaaaacaaacatggttcttaaagactttggtggcaatccatcggagaataaaggagtgctgaatgtggagctgacaattggcagcaaaaccgtccctacaacattttttgtcatcgatgggaagggttcttatagcttgttgcttggaagggattggattcatgctaattgttgtattccttcgaccatgcaccaatgcatgattcaatggcaaggcgacaagattgaaattgtgccagccgacagggtgtgcattgattttcgagacctgaacaaggctaccccaaaagatgaatatccaaagccagtagccgatcaattggttgatgctgcttccaggcacaagatattgagttttatggatggtaatgcagggtacaatcagatctttatggccgaagaagatatccataaacagcttttag

SEQ ID NO: 779 - DNA, 1269 bp, Oryza sativa
  misc_feature (127)..(127): n = any nucleotide
  misc_feature (129)..(129): n = any nucleotide
atggacgccctcgtctgcaccaacgccttcgccaccgccatcgccgccggcaggtttcccctcccgcgaggccgctcgcccccgtacgccgcggcagccgtccccgccctccgctcccgccgctgcntnccgactcgagggctgctacgcctgcgctgcgccaggggggtggattggactgatccgtcgttcgtggcagtcgcggagaagcccgacgcgggggcggaggcatggaaggcgctcgcatccgcgggcggcggtggcatcgaggaggaggaggatggcccgtttgaggcgatcaacggtgatggaggatactcggtggaggagtctgtggtcttgccgccattcgagcagagcttggtggcggcggtggcggacagtgtcgaggacgatgcgctcagtcaggcgctcagctctaagttggatttcaaggagacgtctacttttgtcatgtatggcagtggtgctttcattgccggatggattttgtctgctgttgtttcagcaattgattccattcccttgttcccaaagatactgcaaattgtaggccttggctacacaatttggttcagcacacggtatcttcttttcaaggaaaacagagatgaactgtttgttaaagttgatgatctcaaaaggaaaattactgggtatgctaccgatcaagcgtgggagttcatggactcgccggaggaggagcgaggcgaccggcgatggcggaagaagaaggaagagcacggcgggctagtcgctgttttgtcgtcgcgtcgctcagcctccaccgctgcgtttcccctctcctccctggctccctccctctactctctctccactgaagaggacggcggagctatccgcgtggtggatgcggttatcggcccgctcatcgaccggggcagtagggcctgtggcgacgctgtcgcggcggaaacggatatggaagtgcgcgggttgtcactggcaagctcgagctccccttcgtccttccgacaacaggtagctccagatccccctctcttgtcattgcccccctcgccccctcccacgccgaccgttggtgagcacgagctcatggtccaactcccttgctacctccaggagcttcatcttctccgtgaaatcgtgtcggtaaagctcgagctccccttccccaagcgactcctcgtcctcgaccaggcggcggcgacgctgcacaagatgactcctccccacgcgggtggctccgatgaggtccacctttcccgctctgggaggcggcggtaa

SEQ ID NO: 780 - DNA, 1266 bp, Oryza sativa
atgggtttgggggaatttgggtgctgcattgggggttggtttggtgctctgcgtgaatctggtggggatagtgagatcgtggttatactgggctttcctcctgataaactcgttctaaagacattcggtgttgccatagttttccaaggaatggagcagttcaggaagcattcagttgcttcaacaagtttgctggtgctttctaatttctggctttctaggagcatcaaatccccaagattttcccacaggttgtcagctattgcaggctcaagttcaagagcctgccagtcgcaaataaagcaagtgacttcttgcatgcagcatttggccggattgcgttttggttctcaagttagagaagagcacgctatacaaattcttttagcaaagcttgctaatgcaacatttgggcgactgtggaacgaggtggaggagcgccatgcctgtaacattcttatgttagctgctgctactgtaccaccatttgaaaacatatcgccgaagatgcttgcagactcaatgacattgggaagagataatggtcgtaccagagaacctgttgatcagcattctttggaggaaaaccattcaggctgtacttgtgttgctgtgccaagaataattttaccagaagacgcaactgaaccaaaaactgggataaagttccctactcttctcgaggataattcaaatccaacttcagaggtgctcgtcgggatgggctttagaagcatgcgaataatgagggtcaaaaacctgaatctctatgcctttggattatatatacaaccagattctatttgcaaaaggctgagcccaaagtatgcttctgttccagtttctgaactgaaggaccacccagatttctatgaagatcttttgagggaaaatattcatatgacagtcaggctgatagttagctacaatggtcttagcattggcacagtgcgggatgcatttgagaagtccctttgcttccgattgcagaagatgaatcctaatactgattatcattgcttgaagacgtttggttcttattttagtgaagatatttgtatacctgcgggtacaaagatcgacttccggcaaacctctgatggccagctcataactgaaattgatggcaaacaaattggtgctgtccagagcaaagatctttgcagggctttcttcgatatgtatattggtgatccacctgtttcagtcgagaccaaacaagacattgcacagaatgttggtggactcattagaagatgttattga

SEQ ID NO: 781 - DNA, 1188 bp, Oryza sativa
atgatatttgagtttaatattaagtccacatgttatcacctaagattaactatagaatttcgggtatattacaccacctcctcactggcacacagggatgacaaatgtcgtaactgtggcaagctcggccattgggccaaggagtgccggagcaagcccaagcatgaagaccaggcccatgtggcccaagacgagcccacgctcatgctcctgactggaggctgcgtcgaaaccgcaggctccatgttgccgccaccgccgccaccagcgacgccggcgcctcagtgcgtctgcatcgagctcgtcgagaagaaggtgttcactgcgttagatgatgaagcagaccgcgacccgcgcagctggatcatggactccggcgcgtcaaaccatatgacaggttgccgagcggccttctccgacctcgacactagtgtcaccggcaacgttcggctcggggatggctcgatcgtccctatcgaggggcgcagcacggtgttgttcacctgcaagaatggagaacaccgcaccctcgccaacacgtacttcctgccgtggctcgctgccaacattgtcagcatcggccaactccacaaaactggcttccaagtattggttgaggacggcatcatgcgcgtccgcgacgagcagtggcgcctgctcacccaaatccctcggagcccagggcgcttgtatgtgcttgacatcaagctcgcgcggccagtttgcttgacggcgcgccccggcgaagacgcgtggcgttggcacgctcggttcgggcacatcaactttactgcgctgagaaaaatgagcagggagaccctggtacgtggattgccattattgatgcatgtcgatcaggtttgcgaggcgtgtctcgccgggaagcatcgacgggcgccgtttccacaacgcgtgctgtctcgctctaacgagcccctgcaactcctccatggcgatctctgcagcccgatctcgccagcgacgccgagtgggaaccgctacttccttctcctcgtcgacgactacagccgcttcatgtggatcaagctccttttgtcgaaggacgtcgcaccagccgccatcaagcagatacaagcggccgccgagagcaagtcgggaagctgctttgtgcactacgcacggaccgagggggcgagttcaccgccgaccactgttggtatttcttaa

SEQ ID NO: 782 - DNA, 978 bp, Oryza sativa
  misc_feature (222)..(222): n = any nucleotide
atgtttgtgtgctttctgaactttttcattccggtgaaaaacatcgcagccacgtgtgttaatatatgccaatattggcattatttgacaaaaagttcgtcgcgcgagtcacggagtgatttttcgacacgaactcacccaacatactccaataagtccaaaaatcatgttttggtgctttttgaagtttttcattccggtgaaaaacatcgcacccacatntatgtccaaaaccatgtttcggtgctttctgaagcttttcattccggtgaaaaacatcgcacccacgtgtgccaatatgggccaatattggcattaattgataaaagttcgctgcgccagtcacggagtgatttttcgacacagactcacccaacagactccaatatgtccaaaaatcatgttttggtgatttttgaggtttttcattccggtgaaaaacatcgcacctacgtgcgccaacataggccaatattggaattaattgacaaaagtttgctacgcaagtcacggagttattttttgacacggacgcacccaatacactcaagtatgtccaaaaatcatgttttggtgctttttgaaatttttcattccggtgaaaaacatcgcacccacgtgggccaatataagccaactttggcattaattgacaaaagctggctgcgcgagtcacggagtgatttttcgacacggacgcacccaatacacttctatatgtccaaaaatcatgtttcggtgctttttggactctttcattctagtgaaaaacatcacacccacgtgtggcaatatatgccaactttggcattaaatgacaaaagctggctgcgcgagttacggagtgttttttcgacacggactcatccaattctctacagtatgtccaaaaacatgtttcggtgctttctaaactttttcattccggtgaaatacatcgcacccacgtgtgctaatataggccaatattggcattaa

SEQ ID NO: 783 - DNA, 847 bp, Oryza sativa
atgtggcttctcccactttcaactgtgaagttgattttgaaaagaccagacgctgagcacccaaatctgctgcaaaggcttcagcagaaggggggattcttggtccctcgagcagagcccccattgaatcgatcagatctgagcttccattggcgacaaactctccttcttccaactggggaaaacctgggacagcttggcaggttggctgggggacaccaaggtagaggagaaacgctcgaggatgggagtggagagcggcaggagacgggcggcggcgcgggcttctctgttgctgtcaagtggtttgactactttcaatgtcctgtacaaaggtgtaatgctgattcaaaagcttgttatgtcctgattaattgtcctgactgtgcacgctgcaccgccgctgccatcgggaggggaggatggacaaataggagggcgccacgcatcgcacccgcttttctccctcctgtccacagcagcacagtgccgaagccactagtcttgccatcgcttcgagccatctgtcaccgcactaggtacgatgctggcagttttgcaattcactcgacggcgcaaggtgttggcgcttcagaccgccacacggtgagcagtgagcaccccaaacccctcttcgttcgacccctaggccctagctgtcgtgccctagtcgagcaggctctagccttgctggccggccgtgacaccaccagcggcatgtacctcaggggatgcttaggccgccaacggtgccaccagcctgcagatcggtgtagggtggaagcggaggatgagcttagtgctgccattaccagcctcgctgttgttccggaagcacaaatcgcac

SEQ ID NO: 784 - DNA, 693 bp, Oryza sativa
atggcacgcggaggcggctacgggtgggcgctcgcggcgggcctcaacgccgcgctcgccgccatctccgccaagttcttcgcgcctccgcttctgaaatacagcatggtgatacttttcaatgtgacaatgtggggctgctatgtgaacagcctcaaagcactgtcatccctccaagcaaccgtcaccaattttgctgccaacttcatttcatcaggtcttgcagggtactttctgttcgaggagccactgccttctaagtacgctgggcagagacaagagtttggctatcttgattctgaggatgagtcgaccaagggaccctttgcagggattgattggaaacgtttcattcagaaatttttatacgttccaaacgagacactgcgtgttgcttcgactacacgttgtgcgtccggcacgatacgacaaactttccagctgaagctggatgtatgcgagcagtgcaacggccggccgggaaacgaacacctcttgaatccctctcacagaagcgaacaagccagcttcgtggccagtaagtaccaagccacagctcaccgcggaatcgaccggggtgagctgagctggatgcagattgcgcccggagtaaccgagctggggacgggtagaaatggaagcctgggggctgtggctgtggcgtgggccaaagcagcagccatcaccagataa

SEQ ID NO: 785 - DNA, 647 bp, Oryza sativa
cagcagcatcgacacgcgtagattcatcgaagttcagtttacatgccgcattgttatggactatccatgattttcctgcatatgcctatttgtctgggtatactactagcggaaaatatggatgtccgaattgcagtgaacacacatcatcgaggtggctaaaaaaggggcgcaaatatagttatatgggccatcatcgatggttgcccaatgatcatgagttccgcaatcaaaggcagccatattatagtaacgtggaacatacaactactcctcaagcactaagcggacgatcaatccttagtaagctggaaggcagaaatttcactatgggaaaatcaaataaccaatcgagcgaggtagctgacaaaaagaagaaaaataaaagaaagagggtaactgaaggtgttggtgttgaaactcatagattcccgatgccgagctactattggtatagtttccaatcccctaccatgatgcacgaacccgcacgaacccgcggaagtttgaatagaaagaggaaaaggaaattctacgggttggattgctcatgtgtccacgggcagccacgctcgtccactttcttggtaaacgactcgatgcattttctcttccttgccgctagcatgcatgcactgataatttaa

SEQ ID NO: 786 - DNA, 576 bp, Oryza sativa
atggtgggttgtgagcacatggttttgatggtcgtgctcatgacaattaaggaccagctcacgagtttcggttgtgaaacattaatcgtgccaaccacaagccagcgtgggcaacggctttactttttgtatagtatggttcattgcggagcaccagactgtgaagtggcggagataagcccacgggggtcgctggggagtccatgccttgtttacaagggggtgattatgatccgggaacggtgcactgctttgaattgtgttatgcagaggtggtacacctctggccagagtaaaactattcgaatagccgtgcccgcggttatgggcgggtctaacaatgtctttcctcctggtttggaatggtatattcctggtttggagatagaactgtgcagccgcgattggttgttcagagtggttgggcctatgcaacaggactatattatgccatcctttgctatcccttgcacttgcatatttgctgcgtggcttgctgagtatgccatatactcaccttgcaatcattcatcagaggaggagttctacagtgatgttgatggtgtggaggattag

SEQ ID NO: 787 - DNA, 460 bp, Oryza sativa
atggatcggcaatggatgtacgctgaccggcggtccaaagagtttattgacggtgtgcactattttttgagagtgaccgaagctaacaggcaaaggggttttatttgttgtccatgcaataagtgtaagaatcagaaggagtattctgcatccaggactatttatttccacttgtttgagtcggggttcatgccaagctataattgttggacatcccacggagagcaaggtgttgaaatggaagaagatgaagtggaagacgacaatattccggactttgctcagtacgttggatttgaaggaaatcaaacgggcgaggaggaaagggatgctgatggtaacgacgttgcggatgatcttggtcagatgttgcaggacgccaaggaggactgcgaaagtgaaaagggggcccataaattggacaagatgttagaggaccacagaatgtcgttgtacccag

SEQ ID NO: 788 - DNA, 330 bp, Oryza sativa
atggttgatgatccttttttttcctcttccttccttctttccttccttactatggtgagaaacagacaggccctgcaaggaggagagaggagggaatgtgccaaaacgcgagcaggagcaagatttgaaggcctgaaagagaggaaggaggaggcaaaatatagggagggaagggctggcggtggagatggaggcttgcatgatgccaccacgttcggagaggagcatttgaccaagcacgtcccctccttggtgtgtgagaaccagaagcgttgtgtgcaaccaacatgcgcgccaccacccatcgctatagcagctccccttgcatag

SEQ ID NO: 789 - DNA, 300 bp, Oryza sativa
atgcccggaaggcaaagttatcaaggtcttaaattcgcccagaaatctccatcggcagtccacgatatccaccctaacgtcctatgtgccgttcctatcctaaccacctcgttgaaaaccaattgtgaaccctcagatcttcgacatttcgccgaaacaacagctgcttcgtggcatatggcaaagttatcaaggtctttaattcgccaagaaatctccatcggcagtccacggtgtcgcgcccgccagcctaccttgacggcgcggttagtcgacgtgcttgacaccgacgtcgtctaa

SEQ ID NO: 790 - DNA, 2625 bp, Oryza sativa
  misc_feature (208)..(208): n = any nucleotide
cataatgattggacccttgaggaagactcaaaagccctacattttctccaggtgattatggcaacgagaatgttcaacttgttaaaagcatttcagatcttcagctccccaaagcagctattcttgggaatcatgactgttggcacacgtatcagttttcagagaagtcatttatatggatttgcatctcttttttttttgaaagaantaaaagaagctgatactgcacttaaatccaagaagaaccttggtgagcagcatgttgggtacaaatgtttggattttccaacaataaagctgagtgttgttggtggacgaccattttcctgcgggggtaataggatatttagaccaaagcttctgtcaaaatggttgctgtcattcttagttgcttcaccgggttgggttcttattgcatactacttctgctgtgtagtaacatgcagtgaaatcgagctacagtggtatggtgtcaatgatatggctgaaagtgcaaagaggatatatgatgctgctacaaatgcaccaaaggagcatgctgtcatattactggcacacaatgggccaacaggtctaggctcaagaatggaggatatttgtgggcgggattgggttgctggtggtggtgatcatggtgatccagatctggagcaagccatatctgatctgcaaagagaaaccggagtttcgataccgctggtcgtgttcggtcacatgcacaagagcctcgcctacgggagaggccttcggaagatgattgcctttggagctaaccggactatatatctgaacggcgccgttgtgcctagagtgaatcatgcgcaatcaagcaggcagcctgcaatctccacaagcgaaaagactgggctcgaaggattaacaggactgatggttccgacatcgcgggcgttcaccattgttgatctctttgaaggcgccgttgagaaaatctccgaggtctgggtgacggtgggtgatgccaggacggagcttgagcaggaattagtcttgtacaagcaaccacataaaagtgtcccttccaacattgccatttggagctctatgggttggttgaccaaattttttagaggttcaacccacaaaatctcggaagggcaataccacagcaaacccgcggaggagacgatatggaatggaccctctaattccgcagttgtgacgatggtgtacccactagagtccacatttggtcaactcgacttgctattgttggctactgatctccgtcaacttgtcattgacgatgtagattgttgtgatttggatgtcccgtcagaatttgacaatgaagatatcgctcgtgctatatcactctctctattagaggaggaacaaagaaaggcaaaggcaatagaaaaggacatgcatttggaggaggatgaacaacttgcaagagctatccaggaaagtttgaatgttgaatcgcctcctcgtgctcgtgaaaatggcaacgccaatggtggcaatatgtatcaaccactgccatttatgttttcttctggattcaggacttgtgccggatgtcacagtgagattggtcatgggcgtttccttagttgcatgggagctgtttggcatccagaatgttttcgctgtcatgcttgtaatcaaccaatatatgactatgagttctccatgtcgggaaaccatccataccataaaacatgctacaaggagcgctttcacccaaaatgtgatgtctgcaagcaatttattcctacaaatatgaatggcctgattgaatatagagcacatcctttctggttacaaaaatactgtccatcacatgaggtggacggtactccaagatgctgtagttgtgaaagaatggagccaagggaatcaagatatgtattgctggacgatggtcgcaaactctgcctggagtgccttgattctgcagttatggatacgagcgagtgccaacctctttatcttgaaatacaggaattttatgaaggcctaaatatgaaagtggaacaacaagttcccttgcttcttgtagaaagacaggctttaaatgaagccatggaaggagagaagactggtcaccaccatcttccagaaacaagaggtttatgcttatcagaagagcaaactgtcagcacgatattgaggagaccaagaatggctggaaataaagttatggaaatgataacggagccatataggttgactcgtcgatgtgaagtgactgcaattctcattctttatggtctcccaagattgttgacaggttcaattttagctcatgagatgatgcatgcgtggttgcgacttaaaggatatcgcacacttagtccagacgtagaagagggcatatgccaagttcttgctcacatgtggattgagtcagagatcattgcaggatcaggcagtaatggtgcttcaacgtcttcatcctcatcagcatccacatcatcgaaaaaggggggaagatctcagtttgagcgaaagcttggtgattttttcaagcaccaaattgagtcagatacctcaatggcctatggcgatggttttagagctggcaaccgagctgttcttcagtatggtctaaagcgcacccttgagcatatccggttaacagggactttcccattttga

SEQ ID NO: 791 - DNA, 2403 bp, Oryza sativa
atggagaaagtcgaggtcgatgggaacttcattggtacgggtaattggaagctgcatggagcactatgtaagcaacttcacaaagtagttcttgaagtattggatgttattcctgtccttgaagctacaaggcctggaaacagttctggacttcttgcattgagttccttgcgcatagctgttgagaaggccaagaatctacttcagtattgctcagagtgcagcaagctatacttggcctttacagcagaaaatgtcctggcaaaatttgagaaagcaagatatgcgcttctggaaagtcttcaccaattggaagaaacacttccagaagcagccagttctcagatactagatatcgcaaaagatctggagaaagcagtttttaccttggatctgattgaaaagcaagctggtgtggatgtgaatcaattagttcagaatgaggcaaaatccaatggctttcttcatgacaatgaacttgaatttttccgacaaactgcatttcgggtcggcgttgcgtcatcggcaacagctcttaccgagagaagagcacttagaaggcttcttgagagggctcatgcagaggaagacataaagaaagaatcagttgcatcttatctactgcacctaatgaggaaatactcaagcatttttaggagcgaaacgacggatttcaccaacacatccatgtgctcaagcccttcttgctcttcccgttcattgtccagctcgattgatctccatggaaatggtcatgttattgaaaagtcgatatctagggttggctccttcaatctcaggcagatcaaaggcttatcaggtagcatgccattgccacctgaggaactaaggtgcccgatctccttgcaactcatgcatgaccctgttattatcgcatctggtcagacatatgagcgggcttgcattgagaaatggtttagcagcggcaacacaacctgcccaaagactcggaatgaattatcccagctctccatgacgcccaactattgcatcaagggtttgatagcttcatggtgcgagcagaacggggttctagttccatcggcgccgcctgattctcccaagctcaagtacctgaggatatcatccttgaatagtagcaaatgtcttgtgaccaatggcgttagcacggtcttgtttgaagacacatgcgcggaggatgatattaaggatggtggtaaagttgcttcggaggagtgcactcggcagaactccggagaggctccatctgagatatgtgaagttgatcaggcctcaccagaaaaacatcctcatgagaactccgagaaggtagcagaggcgacatgtgagctttggctgcgtgtgctgagcaaggacgacgatgagtgtgtcgacgagcaacgtgaggtgatcgagcagattagattccttttgaaggatgacaacgagcttaggaaatacgcgggtgctaatggtattaccgagctactcatccactttgtgaagaaggcagtctgcagagatgatgttcagtgccaggtggttggaacaatggctctgttcaaccttgctgtcagcaatgataggaacaagaaacaacttctctcaggtggagtcctccccttgatggagcagatgatacagaagcctgaaacctacgaggctgccgtcgcaatgtacctgaacatttcctgcctcgccgaggcgcaggcgatcatcgggcagagcgaggccgcgcctctcctgatcaagggcctgcaaggagacggcttccggatgagcaagacctgctgcctcgacgctctcctgacgctgtacaacctgtcgctgcaatcgtcaaacatcccgaccctcatctcctccggcatcatgcagagcctccacgacgtcctgacgccgtcctccccgacgacggagaaggccctggccgtgctgatcaacttggcgctgacccgcgccggcaagaaggagatcatggccgactcggacatggtgggcgccatcgtcgtcatcctcgagaacggggaccccgccgagaaggagaaggccgtgtcgtgcctgtggatcatctgcagcggcgatgacggcggcagccagatggtgctccaggaaggcgtgatcccggcgctggtgtccctgacggccaacggcacgggcaagacgaaggataaggcgcagaggctgctcctgctgttccgcgggaagcggcagcgggaggtcgagcagctgcagccaagggtgcagctgcacgaggtggtgagccaggcaaccgcgcagcacgagcagcagcagcagcagcaacaagaagaaagcagcgagccaggcagcgacaagatgtcgcggctgcgcaattcaaagtcgaagttgagaaggttcacgagggccctggctaggttgctcaagaaatggggcatccgctga

SEQ ID NO: 792 - DNA, 1764 bp, Oryza sativa
atggaggtgttcggcgatctggataaggtggacgatgctgagtgcgtggaggtggatccgaccaggcggtacatacgctacaatgaggtgctagggagaggagctatgaagactgtttacaaggcatttgatgaggttgaaggcattgaggttgcatggagccaagtggagatagatgaggttatgcaatctccagataatcttgaacggctatactctgaagttcatctactaaagtctctcaagcatgaaaacgtaatgaagttctataattattgggttgatgatcaaaagaagacaattaatgttattacagaacttttcacatctggaagtctcaggcagtatcgtcagaaacatccacgtgttgacttgaaggcaataaagaattgggctagacaggtactccgtgggctggattacctgcacacccaccaacctccaattatccacagagacctgaagtgtgacaacatttttgtcaatgggaatcatggagaagttaagattggagatcttggattagccacggtgatgctaacgcctagagcaaaaagtgttattggtactcctgaattcatggcgcctgagctatatgatgagaattatgatgaacttgttgatatatactcatttggaatgtgtatgttggagatgttcactcttgagtatccttacagtgaatgtacaaatgcagctcaaatttttaagaaagtatctaagggtgtcaagccggctgctctggctaaaatcacaaatattcaggcaaaacaatttattgataaatgtttagttcctgcttctgaaaggctgtctgccaaagaactattgcaagacccctttctttgctctgataattctagtgttcttgttggcactaagtttccgtcatcattacccaaatcagtagatgtctctttggaagctttgcacatggatgttgacaccaatgaatctatgtgtactagcacatgcaagagaaatgatcttggtggtccacatagatctgtgttggagttcacgcgaactaacaaaaacacagagctaaagctaacaggcgagaaacttgatgacaattcagtatcactggttttgcgaattgccgatttgtgtggacatgcaaggaacattcattttctcttctacttggattctgatacagctatgtctgttgctgctgaaatggtcgagcagttggagttagcagactgtgatgttactttcattgctgattttattgatcttttgatagtgaatcttgtccctggtcagcagctgatgaatgatgcagtaatgagtacttccagcgaatctaaaatgggtgaaagtgagcacgtaattacttcccagcagcatccatcggagttgacacatgattatgtactagttgaaggaggaccaaatagctctgaagggtcagacatttctgttcagcttgatgggagttccaaaagtcttagtgagtatggcgttgacgaatacaggacactggaatgtggtgcgtacaaaggaaccgataaactgggctgcagacatccgttaagtaatggttcaagtaattttgcaatctttcagatggatcaagcatcacatcactcggagttggtgatcggtgcatcggtttcaattactgaaaatcgagatgtgttaaatggagagcttggtctgattgaagctcagtacgagcaatggtttcgtgaattaacaaggatgcgggaagaagctttggaaggagcccggaagaagtggttaccagataaatga

SEQ ID NO: 793 - DNA, 1608 bp, Oryza sativa
atgggtgcggccggggctgttgttgagatcagttcggacgacgaggcgattcctgttgctgccaagcgtcccaacgttcctcccgtgtcgtcttcacatcctctacctgaagactgcaacggagttgaggagggtttaggtgatcctgctgccttggtggaattcgtggcatctatgctggatgacaaaaggtctgcgcgtgatgtggctgctgctgatgatggggacgacgacgattgcgtgatgctagatggtgaccctgataaagcggtcctcgttgtcaatgagcagagacctgggcaaggtggcccagaggaagaactgcagatagtttcagagaaaggagagttgcacttcagaccgtacattgtcttcgtggtgatagcatgcagggatttccctcatccacgccatctatgtgttagcatgccattcacaagttctcatgcagatcattgtgccatgtgccactgttatgtttgcgactctcctgctccctgtgccttttggggcaaaggtacagagcctactgatcattgtcatgctacggacaagaatgcaaaatggacgaaaatgaggcagtcattgaagcgcaaaaacctgccatcatctaaccgtagaggtatcaagaatcattttcagccaatctcagcaacagcatccttgcagttgcagcaatatacaggggatcgtttttcagttccacgtctatcaccattgtctccagtaggattccatgtttcgagaaatgtgagccaaaatcaatggatgatgaagctcattggagttccaccgaatgtgggacaacctgttaatctgcaggaagcaacatttcctagagctagcattccgcgcaaaagattcagaagtgatggttcagctcctccagttcatctatccacaaatgctaaccatttgcgccatcctgcccctaactctgtcctggttcagccagtatcctctgcagcatttcagacaacacaatctcaaccagcatcctctgcagtatctcagaattctgtcagtgctgctagaccattacgagttcagacaacacaatctcagccaccatcctctgcagtatctcagaattctgtcactgctgctagaccattacggggttactcacctcagaattctttcagtgcaccagttagggttcagtcgacatcatatcatcaggttgctccaggtatatctcaaggacttcaggttcagtcaacatcataccttcaggttgatccaggcagggcggttagtgctgaactgcagctttctcagtgttcctcgcttcaaactcagggaattcaacaccagcatgatccatcggcagatatttaccaaaacatatggaaggaggcacttgctaagctggcatcagagctgggggtttctgattacaatattgatccaccagggcgtcttccaagcactcctcaacccaatcagctgcatgctcaaatgaggcctggtcatcaacctactcaagcaacggcaaggcagggagttcaagctaatggtggtcatgttgcagcagcatcacagaaaaggacttccaatggccaccacttgccaaatcacaaacaattcaaccctggtgccaattga

SEQ ID NO: 794 - DNA, 1509 bp, Oryza sativa
  misc_feature (326)..(326): n = any nucleotide
atgggtggctgctcctccgccttcgcggtttccaccaggatgatccgcttcagccgcggccgcgtgccggcggccatcctccccgtcaccagcaacgacgagccctgctgcagctgctcccctgaaaacaacaacaaaaacaacgacggcggcggaggcggatgcgacggcggcgagcaccagaaggggaagtcgtggaggaggtggcagtacaggagatgcggcggcggtggcggtggcggggccgggaggaagaacgccatcctcggggacgcggccgacgtgaagacggcggcggggttcgcggagaggtacaggctgggggncggagctggggcgcggggagttcggggtgacgcggcggtgctccgacgcggccaccggggaggccctggcctgcaagacgatccgccggaagcggctgcgccgctgtgccacgagaacggggtgatgcacagagacctgaagccggagaacttcctgttcgccaacaagtcggaggactcacctctcaaggccatcgatttcggcctctcggtgttcttcaagccaggagaaagattcacccaggtggttgggagcacatactacatggcaccagaggttctcaacagaagctatggcccagaagcagatgtctggagcgccggcgtcatcctctacatcctgctctgcggagttcctcctttctggggagacaatgatgagaaaacggtgacggcgatactccagggtgggatcaacttccagagggagccatggcccaaggtgtccccgcatgcaaaggaccttgtcagcaagatgcttgaccccgatccttctacccggttgacagcaaaggaagtccttgagcatccttggctcaagaatgccgatagggctccaaacgtttcgctcggagagattgttcgatccagactgatgcaattctcagccatgaataagttcaaaaagaaggcacttggacatttgccgatgaaggtcgttgccaagaatttaccggtggaggagatggataaatatactcagatgttccacaagatggacaaagacaacagcggtaatttgacgcttgaggatctgaagttgggcctccagataaatggtcatcctgttccagagacagagatcgaaatgctgttagaagctggtgacatagatggaaatggaacattagattgcgaggagtttgtaacggtattacttcacataaagaagatgagtaatgaggagtacctacctaaagctttcaagttcttcgacaaagatggtaatggtttcattgaaatggaggagttgatggatgctttaggtgatgaactgggccctactgagcaagtggttaaagatattattcgagacattgacactgataaggatggtcgcattagctatcaggagtttgaatcaatgatgatatctggatcagactggagaaatgcttcccgacgatactcaaaagcaaatttcagctccctcagtcgtaagctgtgcaaaggaaattcatga

SEQ ID NO: 795 - DNA, 1434 bp, Oryza sativa
  misc_feature (320)..(320): n = any nucleotide
  misc_feature (832)..(832): n = any nucleotide
  misc_feature (974)..(974): n = any nucleotide
atggcagagcaagcaacagtagtcgcggcacgagcaatttcggtggcggtggcaaaagctcatcgtgatagtggcgagcaacactgcatcagtcggcatggtggacaagcagccgtcacaataacgatcggggacctcgtcggcatgaaatggcagcagtctcctccgactccgcccactgatgccccagacaccaatgctccctccgcccttgccttgtctgcggtcacccccaccgcctctgcagtctgcaccgaccggcgctcccaccggcgcccccgcgagctcctctgcattcaccaccaccggtgctcccatcncggggatgaaggaagagatggggaagaaagaagaggaataatggaggaagatagaactgacatgtgggtcccacgtccaggagggatcgggtggaaggtcggagaagccagtcttcaggtccatatttttggaaaaactgtgatgtctggagttggtaatgatataggtcctagaaatttggctggctacgttacttataaccgcagaacgagcaatgaatccccaacgacaaacgaacgtgcaacaattcctgcacccgcaactccatcctgcaagttcagtgctccatcagtgttcagtttcatccatcccaaagcagactctactggtggtattccccgaggcgactatatccccaccaatgtgatctccattacagatggacaaatctgtttggaaacagagctcttttatcgcggaattagacctgctattaacgttggattatccgtcagtcgcgtcggctctaggaggggtggagctggagctggagttgtgccaaacaggcccntagtctgcatggtctttttggcagctgctaaaagcgtcactgattgcctagaaggccacgtcttccctgctctagtgcttaggctgaaacctttattctatggcagcacttgtgtcatttggactactagcgatccatctangcttgagcaattgaaggaaattgctgttggaagacttctgcgtggtgcacaacccgaattgatggacactctaatccagtattcgaaggatggcgatgataacagcaagcatcctgttcttccttgcccaagtgaccagttaggacgcccagatctagccatggcaggcccagattgtgtggtcccactatgtccaggcaagctcactctaggaaggaaacctgataaatttgatggcactgtgcagttaggaggatctccaagcggttttggtttgccttgtatgcagcattgcacagcaggaagtgatcgtcactttagagcagcatcgcgtcctattgtggttaaggcatgtgacaagtgtcacaggtcttgcttctatcagctgtatgaattgagtagcagggcacatctccttggtatggatgatgtcccttttagtggcgtattggccaactag

SEQ ID NO: 796 - DNA, 1212 bp, Oryza sativa
  misc_feature (36)..(36): n = any nucleotide
  misc_feature (69)..(69): n = any nucleotide
  misc_feature (80)..(80): n = any nucleotide
  misc_feature (149)..(149): n = any nucleotide
  misc_feature (155)..(155): n = any nucleotide
atggcgaacaagcggcagcgggaagcgcggaagcgnttccgcgaggcgaacccgggcctcttccccgcnaacccgacccntcccgccgacggcaccaagaagaagaagaacaacaagaagagcatgttcaagaagacgagtaaggcggntggggnaggcgcggggaggtcgaagcacccgctccgggtccccgggatgcggcccggggagcggtgcttcatctgcaaggccgcggaccacgtcgccaaggtctgccccgagaagtccctctgggagaagaacaagatttgcttgctctgcaggcaacgaggtcatagcctgaagaattgccctgacaaaaatgatgaaaatttgaagaaattctgttataattgtggtgaatctgggcactcactttccaagtgccccaaacccattgaaaatgggggtacaaagttcgcaagctgttttgtctgcaaacagcagggacatttgagcaagaattgtcctgaaaacaaacacggcatttatccaaagggaggttgctgtaagatatgtggtgaagttacacacctggccaagcattgtccaaacagagggaggcaagacttgatatcttctggggatgatgctttcaatacggaggagcatcacctggaagacaatgctgttctccggggtggagatgaccttgatgacgattttattgaagaagaagaaacaagacacaccaaggcaaagaaggctaaacaatctagttcaaaatctaccacagagacaggcgatggtgacaagaataccaacactaaggcaaaagcgaactcagcgtcggggatggccgtgggcgacgagtgcaagctcaagttccaggagctcaagtcgaagaggagcttccgcttcatcacgttcaagatcgacgagcggacgcagcaggtggtcgtggacaggctgggccagccgggcgacacctacgacgacttcaccgcctccatgcccgccagcgagtgccgctacgccgtcttcgacttcgacttcgtcaccgacgagaactgccagaagagcaagatcttcttcatctcctggtcgccggacacgtcgaaggtgaggagcaagatgctgtacgcgagctccaaggaccggttcaagagggagctggacgggatccaggtggagctgcaggcgaccgatcccagcgagatgagcatggacatcgtcaaagcgagagccctctga

SEQ ID NO: 797 - DNA, 1122 bp, Oryza sativa
atgaacgttctttctcgtaaagttgatactaagtcgagtgctttggtttcttcttcttcttcttctttggatgttgatgcttcttcatctaagtcttcttttcttgctatttttaatgccacatccgatgatcaactcgaacagatcgaggaggaggatttggctttggttgctaacagaattgctcgagctatgaacaatgccaggtccaggaaaagaggtggtccaaatcgttgctttgaatgtggttcaattgatcatcttcgttcgcattgtcctaagcttgggagaggcaaaagagaagacaaagatggtgagaagaccaacgacaacaagtcgaagggtacatccaaagggaggaagatcaaggagaatctcaagaaggcttttgatcaagtctacgccgtgtttgagccactaagcgatgtggatggtgatagtggagatgaagctaagggaaagaacatctccggtgtttgcttcatagcgcgtggtgttggtgctagaagtggtgagattttggttaaacctgatactaacaaaactgtgtttaaatctgctggaaaccagacagaccgcagtaggtcccgcggtcagaccggcgaccggtcagaccggctactgtgcctcggtcagaccggtggtgaagcggcggctttggtggcaaggaaggaaaacgtgtggatcgtggattccggttgttcgcgacacatgactggtgataaaaaatggttcacctctctcaaaaaggcatcaaagactgaatcgattatctttggtgatgcttctactagtgccgttctcgctataggtttggttaagattctttggcttttatctactttgaaagattatggtcttacttttgagaaagtacctctcttttgtgataatactagtgctattaacattgctaagaatcctgttcaacactcacgcacaatgcacatatatattcgctttcactttttgagggatcatgttgagaagggagatgttgaattgcagtttttggacacaaagttgcaacttgctgatattttcactaaacctttggattctaatcgttttgcttttcttcatggtgaattgggaataattcatccttttggcatgttttga

SEQ ID NO: 798 - DNA, 864 bp, Oryza sativa
  misc_feature (189)..(189): n = any nucleotide
atgctagcggttatgatccagagagcaaataatgcaggacagcttgttggactggtgcatcatctcattgatggtggattgtccatcctccaatatgctgatgatattatactctttatggaacatgatctagagaaagcttgtaatctaaaaatgttgttgaacgttttcgaagaattatctggcttnaagattaattttcataagagcgagctttactgctttggtgaagcccaaacagctcaggatcaatatactaacctttttcaatgtgaggttggttcttttccattctgttaccttggcattcctatacatcataggagacctcgtaattcggagtggaaggaagtgattgagcggcttgaaaaacggttggcaagagcgatcaagaagattgattatttccgatcaaggttcttttggcaaggggatggacacaaaaggaaatatagactagcaaggtgggacatcatatgtcgtcctaaagaccaaggaggggccaagcctgattttctcaggtttggctccttcaacatcaaagatggctctcaagttcggttttgggaagataaatgggaccttactggctctaagttagtggcgtggaatcaccttctctcacgcatcgctaatattatattatctcacgaccaagatgagtttaaatggaatctaaccactgatgggagattctcggttaaatctctttatcttgcgttggtgcagaccgatgttatcttggctccgctcataggctatccttcagaaggtcaatttgcggggtactatcattgcggcttgtcaacaattggagctagtggccatggagttttctaccccggcgcatgggtggcgttctag

SEQ ID NO: 799 - DNA, 642 bp, Oryza sativa
atgccatcaccgttactttttctgtcagctccttccatcgtcgggcccacttgtcacatcgctcttctcgctctgctgcatcctggaagacgtgggaaacggtggtccggtgttgggattgacctgcacctcgtccaccatcaggaccggtcttccggcctctattgcaaagcacaaccatacttccacatgtctaaatgggtgtctagtagtcgagatgtcgtggcacaggacgggaatctaggtggtcactcccgagaggctaggttgagtgaagaactatgtcacgccctccgtccgtataccgtggtgtactatgggcagtctaaccggcgaggaggcagcggtctaaccggcagcaggcaggcggtcaaacccgcgacggcgatcatcagcaagcagggagacggcggtcaggctggccggacaacaccggttaggccggcggcaaagctgccgaatccggtgggctaccccgaaactggccccacgatagcaaggggaatgtgcggcgatttggctgagcgcgagaagagtggtcagaggcagcggtggcgtgctctaggggagagcaaacgagatgagaggggtgacggaacggtggcagcttgggtttcgtggttgtgggaaaaaaatccttag

SEQ ID NO: 800 - DNA, 333 bp, Oryza sativa
atgaggcgtggccagcagtggaggaggccgacacggtgcgaggaggagctaccagtgggtgcggtacggtctacggcgcatgaaggctggccggcggggggtgccggtgtagtggtcccacatgtcggcagaggttggacagtgtggagcatcggggcgccagccatggactcgcaggtggtgccatcttcgagggttctgcaggagacttgcaactacatcaggagcttgcatcaggaggtcgacgacctgagcgagaggctgtcggagctgctggccacgtccgacatgagcagcgcgcaggcggcgatcatccgcagccttctgatgtag

SEQ ID NO: 801 - DNA, 1909 bp, Oryza sativa
atggaggcgaaagacgggcaagcatggctggggacgaacggatacggcagcaggagggaggaagacggcgtgtgccacgacgacagcgcgacaccggtgagggcgaacactgtcgacgagctacactcgctgcagaggaagcctcagagtgcgtctttggcatcgatgacatgtgggattgggccaaaactcgtcaacggtgacccagcaaggaaaaaagaaatggctggcaaggctgtgacacatcaccaacaccatatcactgtccccacgatcactgtgagcgacagtgacctcaagttcacccatgttctgtacaacttatcccctgaactttatgagcatgcaatcaaatatgagaaagggtcattcatcacatccagtggggcgttagcgacgctatcaggagcaaagaccggtcgatcacctagggacaagcgtgttgtcaaggatgaaacaacagatgatctgtggtggggcaaggatcaccaaacattgaaatggacgagcaaacctttctgatcaacagggagagagctgttgactacttgaactcccttgataaggtgtttgttaatgatcagttcctaaactgggaccccaacaataggataaaagttcgaatcatctctgcgagggcctaccattctctcttcatgcacaacattgcatccggccaacatacgaggaactagagaattttggcgagcccgacttcaccatctacaatgctggacagttcccgtgcaaccgttacacgcattacatgacatcgtcaactagcatagacttaaatcttaagcggagagaaatggtcatcctgggaacacaatatgctggagagatgaagaaaggcctcttcagtgtgatgcactacctcatgcccaaaaagcagatcctctcgttgcactctggctgcaacatgggcagagggggtgatgtagccctgttttttggattgtcagcttcaaggtactggaaagacaactctgtcaacagacaggaataggatcttaattggtgatgatgaacactgctggagtgataatggtatctctaacattgagggcggctgctatgctaaatgcatagatctttctcaggagaaagaacctgacatttgggatgcaatcaagtttggcacaggtgttggagaatgttgttttcgatgagcactcccgtgaagttgattatacagaaaaatctgtcacaggagaatacccgtgctgcttaccctattgaatacatagctaatgctaagataccatgtgttgggccacacccaaagaatgttatcctacttgcatgtgatgcatttgggtgtcctccctcctgtcagcaagttgagccatgcacaaaccatgtaccattttatcagtggctacactgcattggtcgctggaactgaagatggtatcaaggagccacaggctacattttctgcctgctttggtgcagcttttataatgctccacccaactcggtacgctgccatgctggcagataagatgaacaagcatggagctaccggatggcttgtcaacactggttggatcgggggaagagttatggtgtaggtgagcgaatcagcttggcctacacaaggaaaatcatcgatgccattcactcgggtgagcttttggctagaagctacaaaaagacagatgtctttggactagacatccccacaaaagtggaaggagttccatctgaattgcttgacccaataaatacctgggaagacaaagactcatacaagttgacacttctaaagctgtcagatctgttcaagagaaatttcaaggtatttgcaaattacaagaaaggtggtgttagtgatctggctgatgagattgctgctgcaggaccaaatttctgattttaattgaatagtagtagtatgtcttaa

SEQ ID NO: 802 - DNA, 1251 bp, Oryza sativa
atggctgaggagctgaagctgctggggttcgttgtccggcgtgagcccgtacgtgatccgcgcgcagatggcgctcgccgtcaagggcttggcgcacgactacctccccgaggacctcacccgcaagagcaagctcctcctcgacagcaacccggtgcacaagtcggtgcccgtgctcatccacaacggcaagccggtgtgcgactcgctggtcatcgtcgacccgccgacccctaccaccgcgccgtcgctcgcttctgggccgccttcatcgacagcaaggtgttccctccgtgccttgccattctgaagacggcggcggcggaggcggaggaggagaaggcggcgaagctcaagttgctgggcgtgtgggatagcccgtacgtgaacagggtgcagatcgtgctcaacctcaagggcctgagctacgagtacgtcgaggaggatctcatgaacaagagcgacctcctcctcggctccaacccggtgcacaagaaggtccccgtgctcatccacaacggcaagcccatcgccgagtcgcgggtcatcgtggagtacctcgacgaggccttcgccgccggcgccggcggctccgtcctcccctccgacccctacgagcgcgccgtcgcccgcttctgggccgcctacgtcgacgacaagatggccggaggaggagatgagctgaagcttttgggcacatggttcagcccgttcgtttccagagtgaagttcgtgttccacctcaagggcctgagctacgagaacatcgaggaggacctcaagaacaagagcgagctcctcctcaagagcaacccggcgatcaagaaggtacccgtgctcttccacaacggcaagccactctgcgagtccatgatcatcgtcgagtacatcgacgagaccttcgccggcgtcggcccgtccgtcgtccccaccgatgcctatgaacgcgccgtcgctcgcttctgggtctcctacatcgacaacaagagcaagtcgatggaggagaaggcggaggggctgaagcagatcttcgtggcggtgatggtgctggaggaggcgttcaaggagtgctccaaggggaggccattcttcggcggcgacaacgccgggatcgtggacatcgcgctcggcagccagctcgggtgggtgcgcgcatcccaggcgctgtccggcatcaagctgttcgatcccgccaagacgccgcttctggcggcctgggcggagcgcttcctcgcgctggacgcggcgaag

SEQ ID NO: 803 - DNA, 1120 bp, Oryza sativa
atggcttcttccaagcctctccttcttgggcttctcctgtccatcacttgcctcttgcaggtcctactggcggcggcgaaccctcagccgccgccgccgccgtcgtgcgacaagtccgacaaggagctgaggttcatgttctcgcagtggatggccaagtacgcgaagcactactcgtgcccggaggagcaggagaagcggtaccaggtgtggaagggcaacaccaacttcatcggcgcgttccgcagccagacccagctctcctccggcgtttgcgccttcgcgccgcagaccatcaccgactccgtcgtcggcatgaacaggttcggcgacctcacctccaccgagttcgtccagcagttcaccgggttcaacgcctccggattccactcccctccgccgaccccgatctcgccccactcctggcagccgtgctgcgtcgactggcgctccagcggcgccgtcaccggcgtcaagttccaaggcaattgcggcgtcgtgctgggcgttcgcgtccgcggcggccatcgagggcctgcacaagatcaagaccggcgagctggtgtcgctgtcggagcaggtgatggtggactgcgacaccgggagcttcggctgcagcggcggccactccgacacggcgctcaacctggtggcgtcccgcggcggcatcacgtcggaggagaagtacccgtacacgggcgtccagggcagctgcgacgtgggcaagctgctgttcgaccactcggcgtccgtttccggcttcgccgccgtgccgcccaacgacgagcggcagttggcgcttgccgtggcgaggcagccggtgacggtgtacatcgacgcgagcgcgcaggagttccagttctacaagggcggcgtgtacaagggcccctgcaaccccgggagtgtgaaccacgccgtcaccatcgtcggctactgcgagaacttcggcggggaaaagtactggatcgccaagaactcgtggagcaacgactggggtgagcagggctacgtgtacctggccaaggacgtgtggtggccgcagggtacctgtggcctcgccacctccccattctaccccacggtttaatccgcgttcgtgtgcccggctggcttttcttaa

SEQ ID NO: 804 - DNA, 986 bp, Oryza sativa
atgaatataacaaaattcacttacaaggagctttcaagggttactgaaaattttagcccgtctaataagattggtgagggaggttttggatctgtgtataagggaaagcttgttgccgtcaaggtgctatctttagagtcaagacagggagcgaaggaatttctgaacgaactcatggcaatttcaaacgtatctcatgaaaatcttgtcaagctttatggctattgtgtggaaggaaaccaaagaatccttgtctacaattatcttgaaaataatagccttgcacaaacacttttgggtatgagcaacatccagttcaactgggcaactcgagtaaatatttgtgttggcatcgcccgtggactaacatacctccatgaagttgtaaatccccacattgttcaccgggatatcaaagcaagcaatatacttctagataaagatcttacgccgaaaatatctgattttggtttagcaaagcttttgcctccagatgcatcacatgttagcacaagggttgctggaacattggttacttggctccagagtatgccattcgaggacaagtgacacggaagtcagatgtttatagttttggtgttctgttactagaaatagttagtgggagatccaacaccaatacaagattaccctatgaagatcagatacttcttgaaagggcctgtatgttcctgaaaattgggcttttgtgtacacaagatgtcacgaaacatcgacccacaatgtcgatggttgtccgcatgctaacaggtgaaatggatgttgagctggcgaagatcagcaagcccgcaataatcagtgactttatggatcttaaggtcaggagcatgaggaaagaagtggacatagtttcatcctcaacatccacattgctatcttccatcatggcacactcttctcctttgttgtcgcaagagacaacagaagcctccatgacattcaccgcgatatcagatcgtgagtga

SEQ ID NO: 805 - DNA, 519 bp, Oryza sativa
atggcgtcgaaagcctttgcactcgtgctgctggcggcggcgacgctggccatggcggccagcacggcggcggcgcagagctcgccgcaggacttcgtcgacgcccacaacgacgcccgccgcggcgagggcgtcggcctccccgacgtggtgtggaacacgacgctgcaggcgttcgcggagagctacgtggcggtgctcgccgccacctgcagcctcgaccactcgaacagcgtgcagctgggctacggcgagaacctgtacatgggcggcgccggcagcgcgtcgacggcggcggacgcggtcggcttgtggatggaggagaaggcggactacgtgtacagcagcaacacgtgcacgaggggggcgctgctcgactgcggccactacacgcaggtggtgtggcggagcacgacgtcgatcggctgcgcgcgcgccgcctgcagcaacggcggcggtgtcatcatcagctgcaactatttcccgcccggcaacttccccgatcagcgcccttactag

SEQ ID NO: 806 - DNA, 511 bp, Oryza sativa
atgctgcgtgttttaattgcatcgttaagatttgcctctgaacatgcacactattgcatatgtgtcataatcattgatgtgttttatttgcagaccacacaacttgttaagatcgggacatggggtggaaatggaggaggtcgtgtagacctatctgtactcccaaggagcttgaaaagcgtgacaatccgtagtggtgcagccattgatgctattgcctttacatacattggcacagatgggaaggaacatcttgcaggtccttggggtggtggcggtggaaatccaactacggattacacttggatctcaggaattcgtgaagggaatctccggaacttttaccaacgtcgtgacaaaccttaaaattgtcaccaatgtcaccacttataattttggacaaggtggtggaactgcttttagcctcccgctgcagagcggcagtgtggttggtttcttcggacgcgcgggagcacttgtggactctatcggagtttatgtccacatatga

SEQ ID NO: 807 - DNA, 498 bp, Oryza sativa
atggcggggagcggtgtcctggaggtgcatctcgtcgacgccaagggcctcaccggcaacgacttcctaggtgagatagcaggcaagatagacccgtacgtggtggtgcagtaccggagccaggagcgcaagagcagcgtcgccagagagatcaagggaagaacccgagctggaacgaggtgttcaagttccagatcaactccacggcggcgaccgggcagcacaagctctttctgcggctcatggaccacgacaccttctcacgggacgacttcctcggcgaagcaacgatcaacgtgactgacctgatcagcttaggcatggagcacggcacatgggagatgagcgaatccaagcaccgggtcgtcctcgcggacaaaacataccacggcgagatcagagtcagcctcacgttcacggcttctgcaaagaggctcaagaccacgcagaacaggttggaggatgggcgcacagctttcgtcagtagaaagattgtga

SEQ ID NO: 808 - DNA, 305 bp, Oryza sativa
atgtttttgttgttgtttgtctggttgattttgttgcaggtttacccgctgatcgccgccatgaccttcgtcacggggctgtgcaccttccagctcacaaggaacgtgttcatgaacccggacgtcagagggtgaacaagaacaaccgtaaaagtgcggtgctggagaacgcggaggagggtgagaagtaccaccagcacgcgttccggcgattcctcgccacgcagcggccggaggtcttcccggcgctcaaccgcttcttcgccggcccggcgacggtggcgagaagtgatcgccacgactga

SEQ ID NO: 809 - DNA, 429 bp, Oryza sativa
atggtgctcatgctagtggcggaggaggaggcggaggtggtggttacagccaatacggtggatcgggatctggtagcggatatggctcgggctcaggctctagccagacctctcaaaatggatattatggttatggcggttcatccagtgctggcggcgctggtgctggtggcggtgccggacaagctggtggttactggccatccaatggtcatgggtctggtagtggtacgggttatggctctagctccgctaataattactacggaggaccatacgcaaatgctaatgctggtggcaatggtggtggtaatggtcaaggccaatatggtggccgtggcgttggcgcaggtgttggatcgggatacggtgacgccaacccttaatttcctacctagccgggctgcactggcttggggccccttgtag

SEQ ID NO: 810 - DNA, 3720 bp, Oryza sativa
  misc_feature (1678)..(1678): n = any nucleotide
atggctcaccgtggcgcctgcggctgcgagaagaacaccggagatggcgcaggcatcctcgtcgctctgccgcacaacttctttgagcttccgccgcctggtgagtacgccgtcgggatgtttttcatgcccacagatgacaaacgccgtgaaaagagcaagcttttgtttcgtgaggcagagttgctggggcataccgtcctcggctggcgccgggttcccacagacaactcgggcttgggtcaatcagcggtagatacagaaccagtgattgagcaagtgtttgtcaccaaaagtgcaagttcaaaggctgattttgagcggcagcagatgtacgtcctacggaggttctcagttatgtccatacgagaagttctaggcgtcaagaatggcggaacaaaagatttctacatgtgctctctatcttcaaggaccattgtttataagggtcagcttaagccaagccaactcaaggggtacttctttgcagacttaggcgatgaaagcttcacaagttacatggcactgatccactcaagattttccacgaacaccttccctagttgggatcgagcgcaaccaatgcgtgttttggggcataatggcgagatcaatacccttagagggaacaagaactgaaggcacgtgagggtctcttgaagtgcgagggactaggtctaacaagggatgaaatgttgaaacttctgccgatagtggatgctacatcttcggattcaggtgacaatgttcttgagcttctcatacaatctggaagaagtgcgccagaggctgtcatgatgatgatccctgaggcgtggcaaaacgatgttaacatggaccctgagagaaaagctttgtatgagttcttttcagcacttatggagccttgggatggaccagctctaatctcatactgatggccgctaccttggtgcaacccttgatcgtaatggtttgaggccaggccggttttatgtgacctacagtggccgtgtaattatggctagtgaagttggtgtggtcgatgttcctcctcaagatgtttcaagaaagggtaggctaaaccctggaatgatgcttttagttgattttgagaaccattgtgttgtgaatgatgatgaattgaagaaagagtactccaaagttcgtccatatggagagtggctgaaaagacaaaggatacaactcacagatatcatagaatctgtaaatgaagcagagagaattgcaccgagcatttcgggtgcacttccaatgggtatctgcggaattctgactccgctgaaggcttttgggaagcccttgaaatgctgatgctaccgatggccaaagatggacaagaagctcttggatcaatgggaaatgatactcctctagctgtgatgtcaaacagagagaagctgacttttgaatacttcaagcagatgtttgcacaagttacaaacccaccgattgacccgatccgggagaaaattgtcacatctatggagtgcatgattggtcctgaaggtgacttgtctgaaacaacagagcggcagtgccatcgcctcacgcttaagagtcctttactgaatacaaatgaaatggaggctattaaaaagatgaactaccggggttggcgcagcaaggtgcttgacataacttatcctaaaaagaatggcaggatgggcttaaaacngactttagataaaatttgtgctcaagcacgtgaagctattcatgagggctacactattctagttctctctgatagagttttcttcagagcgtgtagctgtcagttccctattggcagttggagctgtccatcagcaccttgtctcacatcttgagaggacacgcataggattgttagttgaatctgctgaacctcgcgaagtgcaccatttttccacccttattggatttggtgctgatgctatatgcccttatttagctatagaagcaatatggcggttgcaaattgatgggaggattcctcctaatgatgggaaaccttatacacaagaacaacttatcgagaaatatttttatgcttcaaactatggaatgatgaaagttcttgcgaagatgggaatatccactctggcatcttacaaaggtgctcagatttttgaggcccttggtcttgcttcggaagtggtcagcaagtgttttgaaggtactcctagtagagttgaaggtgcaacctttgaaatgcttgcacaagatgctcttcgtctccatgagattgcattcccatcaagaactttacctcctggaagtgcagatgcaaatgctcttcccaaccctggggattaccattggaggaaaaatggagaagtacaccttaatgatcctttttccattgcaaaattacaagaagcagcacggattaacagcagggaagcatacaaagaatattctaggcgcatttacgagctgaataaggcatgtactctgcgtggcatgctgaaatttagagaaattccaaaccaaatttccttggacgaggtagaacctgcaaaggagatagtgaagcggttctgtactggagcaatgagttatggatccatttccttggaagctcatacttccctggctgaggctatgaacacccttggaggaaaatctaacacagaggtgagggaggggaacaaccttgccgtatggtgcctcttcctgatggatcaaagaatccaagaataagtgcaatcaagcaagttgccagcggaagatttggagtttccatctattatttgactaatgcagttgaggtgcagataaaaatggctcagggtgctaaacctggtgaaggtggtgagctaccaggccacaaggtcattggtgatattgcagtcactagaaattctacagctggtgtagggctcattagcccacctcctcaccacgatatatattctattgaggatctcgcacaacttatccatgaccttaagagaatgcaaacccaggtgccagaatcagcgtcaaactagtctctgaagctggtgtaggaattgtcgctagtggtgtggtgaaaggacatgcagaccatgttctgatctctggacatgatggaggcactggagcctccagatggacagggattaaaaatgctggacttccttgggagcttggcttggctgcattatgatgaggaagtgccataccaacacttgccctgctggtattgctacacaagatccagtcaatattgtgttgagaagcaagatcatggcctcgacatggcattagataacaaactcatagataccatccatattaagctgaatggaagtgctggccaaagttttggtgcttttctctgtcctgggatcactcttgagcttgagggagacagcaacgattatgttgcgaccatcacgagtttcaaatgctgtaaagtaccgaggtttcataaaatatgagcgagagggtacttcttacagagatccaaatgagcgtgtaaaagattggaatgaagttgcaattgaattggttcctgggccactgctaaagacgcaatctgctcggtgcatggattgtggcactcctttctgtcatcagaagagagttgctattgttggcagtggcccagctggtctagctgctgcagaccaactgaacaaaatgggccatttcgtgactgtctttgaacgtgctgaccgtattggaggactgatgatgtatgggttccaaatatgagctgacaaagagggcattgttcagcgacgtgtc

SEQ ID NO: 811 - DNA, 3183 bp, Oryza sativa
atgcctggagcagctactgccgcagttgttgacagccgccagtgcaaacagcacgcggaaggccctgctgcggtcctcgccatcggcactgcaaaccccacaaatatcgtctatcaagatgggtttgccgactactacttcggtctaaccaagagcgagcatcttaccgagctgaaggacaaaatgaagagaatattcaggaatagagaaacgctacatccaccttgatgaaaagctcatccgtgagcacccggagatcatcgacaaacacatgccttcccttgaaaatcgcgtagacatcgttaccactgagatcccgaagctcgcggagtctgctgcacgaaaggccatcgccgagtggggccgtccggccactgacattacccacctcattttcagcacctactctgggtgcagtgctcctagtgctgacctcaagctagcatcactacttggcctcaacccttctgtctctcgcaccatccttagcctccacggttgctctggaggtggtagggccctccaacttgccaaggagcttgccgagaacaatcgcgatgcacgcgttctcatagcctgcgccgagttgacgctgatatgcttctcaaacccagatgaaagcaaaatcgtcggccatggactatttggggatggtgccggagcaatcattgtcggcgctgacccattggtcgatggagagcgcccgctgtttgagatggtccttgcctcgcaaacaacgataccaggtactgagcatgcacttggcatgcagaccacctgcagcggcatagatttccacctctctatccaggtgccaatgctgatcaaggacaacatccggcagtgcttgctcgacacattccgatcggttggaaacatgaatcctaattggaatgacctcttttgggcggtgcaccctggtggccgtgcgatccttgacaacatagaaggcgagcttcagctgcagccaacaaagcttgcagcaagccgccatgtgctgagcgagtacgggaatatgagtggcacgacgattgcgttcgttctggatgacttgcgtcgccgtcaggagaaggagggagatgagcatgaacaacctgagtggggagtaatgctagcctttggaccgggtatcacaatagaggcaatggtgctgcgtcagcacgcggaaggccctgctgcggtcctcgccatcggcactgcaaacccggcaaatatcgtctatcaagatgggtttgccgactactactttggtctaaccaagagcgagcatcttattgagctgaaggacaaaatgaagaggatatcgtgtagacatcgtctctactgaggtcccgaagctcgccgagtcagccacacggaaggccatcgccgagtggggccgtccggccattgacattacgcacctcatcttcagcacctactccgggtgcagtgctcctagcgctgacctcaagctggcatcactactcggcctcaacccttctgtttctcgcaccatccttagcctccacggttgctctggaggcggtagggcacttcaacttgccaaggagctcaccgagaacaaccgtgatgcacgcgttctcgtagcctgtgccgagctgacgctaatatgcttctcaaacccagatgaaagcaaaattgtcggccatggactgtttggggatggtgccggagcaatcattgtcggcgctggcccactggtcgatgaagagcgcccactattcgagatggtcctcgcctcgcaaacaacgataccaagtactgagcatgcacttggcatgcagaccaccgccagtggcatagatttccacctctctatccaggtgccaacactgatcaaggacaacatccggcagtgcttgcttgacacattccgatcggttggaaacatggatcctaattggaatgacctcttctgggcagtgcaccctggtggccgtgcgatccttgacaacatagaaggcgagcttcagctgcaaccagcaaagcttgcggcaagccgccatgtgttgaacgagtatgggaatatgagcggcacgacgatcgcgtttgttcttgatgacttgcgtcgccgtcgggagaaggaaggagatcagcatcaacaacttgagtggggagtaatgctagcctttggaccaggtatcacaatagaggcaatggtgctgcgtaacccactctcatgaagtcttaagcagcacgcagaaggccctgctgcggtcctcgccatcggcactgcaaaccccgcaaatatcgtctatcaagatgggtttgccgattactacttcggtctaaccaagagcgagtatcttactgagctgaaggataaaatgaagagaatatatagagaaacgctacatccaccttgatgaaaagctcatctgtgagcacccggagatcattgacaaacacatgccctcccttgaaactcgcgtagacatcgtcaccactgagatcccgaagcttgccgagtccgccgcacgtaaggccatcgccaagtggggccgtccagccactgacattacccacctcatcttcagcacctattccgggtgcaatgctccaagcgctgacctcaagctggcatcactactcggcctcaacccttcagtctcttgcaccatcctcagcctccacggttgctctggaggcggtagggcactccaacttgccaaggagctcgccgagaacaaccgtgaggcacgcgttcctgtagcctgcgccgagctgacgctaatatgcttctcaaacccagatgaaagaaaaatcgtcggtcatggactgtttggggatggtgccggagcattccacctctctatccaggtgccaacactgatcaagaacaacatccgacagtgcttgcttgacacattccaatcggttggaaacgtggatcctaattgaaatgacctcttctgggcagtgcaccctggtggccgtgcgatccttgacaacatagaaggcgagcttcagctgcagccagcaaagcttgcggcaagccgccatgtgttgagtgagtatgggaatatgagtggcacgacgatagcgttcgttcttgatgacttgcgtcgccgtcgggagaaggaaggagatgagcatcaacaacctgagtggggagtaatgctagcctttggaccgggaatcacaatagaggcaatggtgctacgtaacccactctcatga

SEQ ID NO: 812 - DNA, 2642 bp, Oryza sativa
atgccctcctccgcaagaacctctgcttccaggtcccctcctccctctttctttcttggcgcgtctccccgatttcgcaggttttggttcgatttcctcaccgtttcttgcttgcttgcgatttcttgctttgatgcagaggaggaacatgaagacgaacgcgtgcatcacggtgttcccggtgttcctgtgcgtgatcctcgtggtgctccagggggtgatcaaccacgagatcaacaagcccaagtaccagtgcggctgcgcctgcgtggacgccgcgccggacgggacctgccggaggacggagtgcggcgtcgagcactccacgctggaccaggtggggagctgcccgatcaagagcccgacgccatggccggccttggtccaggtcccccgccccgagtcccgggccgtcaggtgcagggacacagggtcttgccctgcctctgtccttgtcaccggaatgaaccgctcgcttgctcaaatgcgttcaaggcttatcattatggcgtgaaagtgcatcacaaattaataatgaactatttagagtatgattttctgaacacaaacaacaatggtcttgaaataaacatttggtacaactctacatataacaacaacactgcatatgacgtcatctcattgctacgagttccacgcttgggttaacacgtccaatgcatacatgaaatttcttaaaggaagtggagtggagatgctgcttgaatacgttaaagatatgccaaaagtaggaaccaaaccaaaatttgatctctcttctcttcttggtgctctgttcttcacctggatcattgaactactttttccagttatcttaacatatctcgtgtacgagaagcaacagaagctgaaaattatgatgaagatgcacggcttgaaggatgagccttactggatgatatcatattcttacttctttgctctatcagctgtctatatgatagtgtttgtggtatttggatccttgatagggtttaaatttctttaaaacaaataactacggcattcagtttgttttctacttcatctacataaatcttcagatcgcacttgcatttttcgttgcggccttcttttcttctgtaaaaacagccacagtatatatatgtatttggttctggcttactaggggcatttcttctgaggttttttgtggagtctactagttttccgagtagggttggatagtagtcatggaaatcatccctggattttcgctgtaccgagggttatatgagcttggtcaatatgcattctctggaaatgcaatgggaacaaatggtatggagtggactaatctgagggactctgagaatggaatgcgcaatgtcttgattatcatggttgtcgaatgggctattctactcccattagcattttatttggataaaatctcatcattgggtagtggagcccgtaaaacacccatgttcttcttgaaacgtttcaaaaatcgtgctgtatcactgcggaggagctttgggagacaagggtctaaagtagttgttgaaatggacaaccctgatgtttcccaagaagtcgagcaacttctgctggaaccaaatgcaagccaagcaatcatatgcgacaacctgaagaaggtttaccatggaaaggatggaaaccgggacaaacttgcagttcgagggttgtctcttgccctccctaaaggccaatgttttggtatgcttggcccgaatggagctgggaaaacatcatttatcagcatggtacagtggcaacaagggctcattccacccacatctggcacagcattagtccatgggatggacataaacactgatatggatagcatctacacaaatatgggtgtatgcccacaacacgagtatgattcttgctctaaaactaatttatttagtaccatttttatgctactttgggaaacattgactggaaaagagcatctattgttttatgggagattaaagaatcttaaaggcgctgaattagagaagcaggcagttgatgactccctgaagaatgttaacctgtttcacggtggtgttggaaataagcaagtggggaagtacagtggtggcatgaaacgaaggcttagtgtcgcaatctcattgattggggaccccaaggtactaatatgatttatgttgttttcatggatgagcctagcactggactagatccagcatcaagaaataacttgtggaatgttgtgaaggaggcaaagaaaaatcgtgctatcattcttacaacattcaatggaagaggcagaggtgctatgtgatagactcggtatttttgtagatggtggttttcaatgccttgggaatccaaaggagctgaaagctagatatggtggcacatatgtgttcactatgacaacatcttcagaacatgaacaggaggtcaaacagctggttcagcatttgtcaccaagtgcaaacaggatatatcacatatcagggacgcagaaatttgagctgccaaaacaggaggtgaagatagcagacgttttccatgcagttgagaaggcaaaaagacagttcagcatacacgcttggggcctcgtcgacaccaccttggaggatgtcttcatcaaggttgccaaaggagcacaaggagtcaatgtgatcgcgtaa

SEQ ID NO: 813 - DNA, 2566 bp, Oryza sativa
atgctgggagggctcaaggacaagctgacagggaaaaatggaaataagatcaaaggcttggctgtgctgatgagccgaaaattactggatccaagggacttcactgcctcgctcctcgacaacgtccatgaggacaatgagggcagggggatagttggatcagaggcgaatctggagcaggggttgacagatttaccatcggtatcacaaggggagtccaagctcacagtgaggttcaactgggagatggacaagcatggtgtgccaggggccatcatcatcaagaaccaccacagtaccaagttcttcctcaagaccatcaccctccatgatgtccctggctgtgacactattgtgtttgttgccaactcctggatctaccctgttggaaagtaccactacaatcgtatcttctttgcaaacaattaccttcccagccaaatgccagaagcactgaggccataccgtgaagacgagctgaggtacctcagaggggaggacaggcaagggccgtatcaagagcatgaccgcatctaccggtacgatgtttacaatgacctcggtgaaccagacagggacaacccacgccctgtcctaggtggctcgcagaagcacccctacccgcgtcgtggccgtactggccgaattccgaccaaaaaaggacccaaactcggagagcagattatcactgctggaacaaatttacgtgccaagcgatgagcgcttcgcgcacctcaagatgtcagactttgctgggtactcgatcaaggcaattgttcagggcatcttgcctgccattcgcacatatgttgatctcacacctggtgaatttgactcgttcgaggacatcttgaagctctacaggggaggcctgaagcttcccagcatcccagcactagaggagctgcgcaagagcttccctgtccaacttatcaaggacctgcttccggttggaggcagctacctgctcaagttccccaaacctgatatcatcaaagtgcttggaggacagatgaggaatttgcacgagagattctggaattcccaccaaaaagtactcttgatcctagcaagtacggtgaccagactagcacaatcaccccagctcacattgagaagaacctcgaaggcctcagcgtgcaacagaacaggctctacattctggatcatcatgatcatttcatgccattcctcattgacattaacagccttgatggtatcttcacctatgccacaaggaccctgttgttcttacgtgatgatgataccctgaagccactagcaattgaactgagcttgccacacatcgagggcaacctaacatctgcaaagagcaaggtccatacacctgcatcaagtggcattgagtcttgggtgtggcagctggccaaggcttatgttgctgttaatgactccggttggcaccagcttatcagccactggagcccttcgtgatcgctacaaaccgccagctcagtgtgacacaccctgtgtacaagctcctccagccacactatcgcgacacgatgacaatcaatgcattggcacgccagacactcatcaacggcggtggcattttcgaacaaactgtctttcctggcaaacatgctctggcaatgtcttcagcagtttacaagaactggaacttcacggaacagggccttccggatgatctaataaagagctactgatcaaggactacccttatgcaacagatggcctggcgatctggcaagcaatcgagcagtgggtcactgagtactgtgccatctactacccaaacgatggtgtcctccagggagatgtggagctgcaagcatggtggaaggaggtgcgggaagtcgggcatggtgatctcaaggacgcggactggtggcccaagatgcagagcttgcctgagctcaccaaggcctgcaccacaatcatctggattgcatcagcactccacgcagccgtcaatttcgggcagtacccatacgcgggctatcttccaaaccgtccgaccataagccggcggccgatgcccgagccgggttccaaggagtacacagagctggacgagaacccagagaagttcttcatccgcaccatcaccagccaattccaaaccattctcggtgtctcgctcattgagattctatcaaagcactcagcggatgagatctatcttgggcagcgtgacacgccagagtggacatcagaccccaaggcactggaagcattcaagaggttcagcaggcagctggtggagattgagagcaaagtgttgaacatgaacaaggaccccctgctcaagaaccgggtcggtccagccaatttcccctacacactgatgttccccaacacgtcagacaataagggggcggctgaggggatcactgccaggggcatccccaatagcatctcaatatgagactgctgcacgcgtcacgcgctgctgagttggtgtaggtttgtggctgttatcttaggccctagggcacaagcaatgaagctgcatagtactatttgctacaaattatgcaagaataaagttttagtgctaataataaagttactgttgtag

SEQ ID NO: 814 - DNA, 2337 bp, Oryza sativa
atgctggttcagctgcatgatctgcttgagaaggctgactcgaacataattggtatttggggtcaagggggtattggtaagacgacactactacatgccttcaacaatgatcttgagaagaaggtccataactaccagcaggttgtcatatttattgaagtatccaattcagagacacttgacacattggagatgcagaagaccatctccgaacgtcttaatttaccatggaatgaagcagagataactgtgaaacgggccagattccttgttaaggccttgtccaggaaaagatttgtactgcttcttgatgatgtaaggaagaaattccggctagaagatgttggcatcccaactccagacaccaacagccagagcaagctgatcctaacttcacgtttccaagaagtatgctaccagatgggcgcatagaggaacttgattaagatggatcttctggataatgatgctgcatggaaactgttcttgagcaagctaagcaccgaggcttgtgcagcagttgaatcacctagtcccagcaatgttgttagggatcatgccatagcaatagctcaaagttgtggaggtctaccacttgcgctcaatgtcattgggactgctgtggcaggctatgaagaaccaagagattggaattcagctgctgatgcaatcaaagagaatatgaagtttgaaggtgttgatgaaatgtttgctacgctgaaatacagcttcgacaggctcacacctactcagcaacagtgctttctgtattgcactctttttccagagtatggatcaattagtaaagagcatcttgttgattattggttggctgaaggtttgctacttgatgatcgcgagaagggtaatcagataatccgaagtcttatttcagcatgcttgttgcagaccactagttcaatgtcatcaaaggtgaaaatgcaccacataatcagacatttggggctttggttggttaacagggaagatagaagttttgttgttaaagcagggatggccttagataatgctccaccagcaatagaatggaaagaagctacaaggatctccatcatgtctaataacatcacagagctttctttctcaccaaaatgcgaaaacctcaccacactgttaatccagaataacccaaagttgaacaagctaggctggggttttttcaaatatatgcgatccttgaaagtgctagatctatcacacactgcaattacttccattccagaatgtgataaattggttgcattgcagcatctcgacctgtcatacacacatattatgagattacctgagcgcctatggttattgaaagagttgaggcatctggacctcagtgtgactgttgcacttgaagatactttgaataactgctcaaagttacacaagttgagagtgctgaatctcttccgcagccattacgggattcgtgatgttgatgacctgaatctggattcactgagggatctattgtttcttggtatcactatttattcacaagatgtgcttaagaaattgaacgagacccatcctttggcaaaatcaacgcatcgcttgaacctgaagtattgtggagatatgcaatcaatcaaaatttctgactttaaccatatgaagcaccttgaggagctgcatgtcgaatcatgctatgacctgaatacactggttgccgatactgagttgacgacttcttgcctacaagcactgaccctctccgtccttccctcattagaaaatgtccttgttgcaccaatgccccataattttcggtacgttcgcaaattgtccatttcacaatgccccaagttgttgaacatcacatgggtccgaagacttgaactgcttgagaggcttgtcatatccaattgtgatgagatgctgactattgttgaagaagctaacagtactgaagagcagcaatatggaacacaaacaataaaaatgcagggttattattctgaagaacaagacgatcatgcaatggctgagagttcacgcaatgagtggaatgatgattaccaaagcgtcaatggagaatcaaccaatggcgcaacgaggcaacctgacttcccaaagttgagatcaattgtgctgactgatgtgaagaagctgagaagcatttgcacgccaagagattttccctgccttgagactcttcgagtggaagactgcccaaatttgagacgcatcccactgtgcagcactcacaactgtggtaaactgaagcaaatttgtggttcatctgattggtggaagaaactgctgtgggaggacaaggaggcggtggcacatatggagagcaagtacttcattccaatctga

SEQ ID NO: 815 - DNA, 1590 bp, Oryza sativa
aagcggttcgaggcgatgaacgtctccgacgccgcgtgcgccggggtcgtcaagtccgtcctctgcgcggttcccgtcctgtgcaatggatcagcttcagctagttctacttgggaaacatgcaagaatgtgacaatactgaattctccttttcaatctcctttgcaaggtggtgcaacattacctagttcatcatcaaaacttactgatgtttggcagtcagaaaatgacttttgtacatcatttggtggctcatctgacaaccagtcagtatgcttaaatggaaatgaagtttcatttagcacttcagaaccatcacccagtcctaaaggggtgtgtattgagagaattggaaacgggacatacttgaacatggctcctcatccggatggatccaacagagttttcttgtctagccaagcaggtaaaatatggttggcaactgtcccagaacaaggctctggaggcattctgcaatttgatgaagccagcccatttattgatctaactgatgaagtccactttgattctgagtttggactcatgggtatagcatttcacccaaagtttgctaccaatgggcgcttctttgtttcttataattgtgacagaactcagtcatctaactgtgctggtaggtgttcatgtaattctgatgttaactgtgatccttcaaagcttggatctgataatggtgcccagccatgccagtaccaagttgttgttgcagagtactctgcgaaagtctcatcatcaaatgtttcggaggctaatccatccgaggttagaaggatatttacaatgggactgccatatacagcccaccatgggggacagatactttttggacctacagatggatatctgtaccttatgatgggtgatggtggaaacaaaggcgacccttttaatttttctcaaaataagagatcacttttggggaaaattatgaggcttgatgttgatggcgttcaaattgtggggtaattattctgttcctaaagacaacccattcagtgacgaccgagacttacaaccagagatttgggccttgggcttgaggaacccatggagatgtaattttgattctgagaggccttcctatttctactgtgcagatgttgggcaggatttatatgaagaggtagatttgatctcgaagggtggaaactatggatggcgtgcatatgagggcccatacatttatcatccagaatggactcctggagggaatacatcgcttaattctataaatgccatcttccctgttatgggctacagccattctgctatcaacaagaacactgggtctgcatcaattacaggtggatttgtttatcgagggtcttctgatccctgcctatatggaagttcggcgaggacaacaacaaggatgtcttccttctaacatacaaaggcgtctaccgagttgtccggcctagcctctgcggctacacctgtgccgcggagaaaccagagaccaacaacaatggaacgtctccctcaggctcttcatcatttgcttcaggaaggaggatagggaagttggcagtagtaatggcgtttgttttgtgtgcattattcttctga

SEQ ID NO: 816 - DNA, 1569 bp, Oryza sativa
atggcgctcgctctcgctcacctcatccttgccgccgcattgccgctgctcttcctctcacgtgcagatgggggcgaggtgggcgtgtgctacgggagggatgggaataatctgatagatccaccgtccgtggttagccttctcaaggcaaagggtatcaccatggtgaggatctacgacgccgacccgaccgtgctaaacgcgctggccaaccaaaacatcaaggtgatggtggcgatgtccaatagagatctagtagctggctccgccaaggatttcaatagtgcgctcagttgggtgaaaaactacgtgttgccgtactaccgttcctcacaaattaacggcgtggccgtggggaacgaggtgtttcagcaagcacctgacctgacctcacagctggtatcggccatgaggaatgtgcaggcggcgctggcgaggctgggcctcgccgacgcaataaaggtatcaacacccattagttttgattcagtcaaggtgtcattcccgccatccgcaggtgtgttccaagataacatcgcccagtcggtgatgagtcccatgatcgacttcttgcaacaaaccaactcctatctcatggttaatttctacccatatattgcctgggctaattctaatggccaaatctctcgtgattatgctgtatttggccccaacgcctctcctgtggtcgatcaagcaagtggcatcacataccatagcctctttgatgctcagctagatgctgtttacttcgctatagaccatgtttcaggtggtagtgtgagagtctcaatggcccaagcaagacgggggcgcccgtctccaaggatacccgtgaaatgttcagaatgtgggcatccctctggtggtcggctccctcagttgtccacactagatgatgttcaagtagacgtggctacaaaagccaacgcccaagcttttaacaatggtcttatcagtcgtgcactattcggagccaccgcagttgggagcacccggctgcaagcagcgttggattgggcttgcagtaatggtgcagattgtggtgctatccaaccaggcaagacatgctttgcaccaaacaccttggtcgcacacgcatcttacgcgtttaatgactactaccaacgtaagagccaagctagcggtacatgtgacttctctggtgctgcttttattgtctacaagccttcaccaagtatctgcgacccgaacccaagctggtgcattgcgaaaccggaggttggggacacacgtttgcagaatgcgctagactatgcatgcggtagctgcgcagattgcagcgctatccagcgtggtgcgcaatgctttgaccctgacaccaaggtagcgcatgcaacctatgcattcaacgactattatcagactaccggtcgtgccagtgggtcatgtgattttaacggcgctgctaccattgtcacacaacaaccaataaatggttttcaccggtgctcatttaatcatattttgcagagattggaaactgcgtactctcaccaaacaactcttgaatgtacagaagactcggcagtaagaggatgggattga

SEQ ID NO: 817 - DNA, 1332 bp, Oryza sativa
gaagagagggtaactgtattggtcattggtggaggaggaagggagcatgctctttgttatgccttggagcgctctccatcctgtgatgcagtcttctgtgcccctggtaactctggcattgctcaatctggagatgctacatgtataccggacctggacatatcgaacagcgacgcggtcatctcgttctgtcgcaactggggagtcgggttggttgtagttgggcctgaagcaccccttgttgctggccttgcaaatgagcttgtcaaagctgggatacctacttttggtccttcatcagaggctgcagcgttagaagggtcaaaagacttcatgaagaagttgtgtgataagtaccacattcccaccgcaaaggatccttcagatgctaagaaatatgttgaggagcaaggagcccctattgttgttaaagccgatggattggcagctgggaaaggtgtagttgttgctatgactttggaaaaggcatttgaagcaatagactctatgctggttgaaggttcattcggttctgctgggtcacgggtaatagttgaagaatatttagagggggaggaggtttctttctttgctctagtggatggagaaactgctttgcctcttgaatcagcccaggaccataaaagagttggtgatggcgatgttggtccaaatacaggtggtatgggtgcatactcccctgcaccaatagtgacggaaaaactcaagtgcaaagtgatggagagcatcattgtcccgactgttaaaggtatggcaactgaaggatgcaagttcgtcggtgtgttgtatgctgggatcatgattgagaagaaatcgggactgccaaagcttattgaatacaatgtgcgatttggtgatccagaatgtcagcaggttctgatgatgcggttacaatccgacctcgcacaggtcttgcttgctgcatgtaggggagaactggggtcagtctcactaacctggtcgcctgaattggcaactgtggttgtgatggcaagtgaaggttaccctggtgtttacaagaaggggacagtaataaaaaatatcgatgaagctgagcaggtctctcctgcagttaagatctttcatgctggaactgccctagatcgagatggaaacttcgtcgcggcaggaggccgtgttcttggtgtaaccgcgaaaggtaaggacattgaggaagcaagggcaaaagcatatgacgctctcgacgttgtcgactggccagaaggatttttcaggcatgacattggttggagagcacagaaatatcggcgcatggttgcacactgataggcatgtactgtaaatctgtaa

SEQ ID NO: 818 - DNA, 1277 bp, Oryza sativa
atggatttcttcagtgaatatggtgactccagccgatacaaaattcaagaaatcgttggtaaaggaagttatggagttgtttgttcagctattgaccaacataccggtgacaaagtagcaatcaagaaaatacacaatatctttgagcatctatctgatgctgctaggatcctccgtgagatcaaacttctccggcttttacggcatcctgatattgtcgagatcaaacatataatgttacctccatctagaagggacttcaaagatatttatgttgtcttcgaactgatggatacagacctccaccaggttattaaggctaatgatgacttaacgaaggaacatcatcagttctttctgtatcaaatgcttcgagcattgaaatatatccatactggctaatgtttatcatcgtgatttaaagcccaaaaatatattagcaaatgctaactgtaagctcaagatatgtgattttggactagcaagagttgcatttaatgacactcctacaacagttttctggacggactacgttgcaactagatggtacagggctcctgagctgtgtgggtctttcttttctaagtattcaccagctatagatacatggagtattggttgcatttttgcggagattttgactggaaaacctttgttccctggtaaaaatgtggttcatcaattggacttgatgactgatctcttgggtacaccatcaatggatgctatttcaaggcggaatgacaaggcaaggaggtatctgagcagcatgaggaggaagcagccagtacctttttcagaaaagttcccaaatgtagatcctttggcactcaagctcttacaaaggcttctagcatttgatccgaaggatcgacctactgcagaagaggcatgcaagctctacttgaattagttggctgatccatattttaaaggccttgcaaaagtggagagagaaccatcatgccaaccaatttcaaaaatggagtttgagtttgagcgaagaaaggttaccaaagatgatatcaaggaacttatattccgtgagatattagagtatcatcctcagcttctgaaggattacatgaatggctccgaaaacacgagctttctatatccaagagtgctgttgataatttccggaggcaatttgccatcttagaggaaaacggaggaaagagtggtgcactagataggaagcatgtttctcttccaagggtccggtattaccattcgagaatccaggcgccgcagatccgcacagcgcacggagggtg

SEQ ID NO: 819 - DNA, 1010 bp, Oryza sativa
atggagtactcttacagctacaggttcatgcttgtatgctctgttcttgtactgtgccttaatactcggggtgcgagatgccagttatccgacgatttctacgactacatatgtcctgatgtgtacaccgttgtccagcagcatgtttatgctgccatgaggactgagatgaggatgggtgcctccctcctaaggctccatttccatgactgctttgtcaatggggtgtgacggttccatccttctggacggtgacgacggcgagaaatttgcacttcccaacaagaactctgtcagagggttcgaagtcattgacgcgataaaggaagatctcgagaacatctgccctgaagttgtttcctgcgccgacattgtagcccttgcagctggctatggagtactatttagtggaggcccttactatgacgttcttctcggtagaagggatggtcttgtcgcaaatcaatcaggagctgacaacggcctcccttcaccgttcgaacccatcaaatcgatcatacagaagttcaatgatgtcggcctcgacacaaccgatgttgtcgtcctatcagaggagggcacacgatcggacgagcccggtgcacgctgttcagcaaccggttgtcgaccacctcaagctcagccgacccgacgctggacgccaccatggccgccaacctccagagcctctgtgccggtggagacggcaacgagaccaccgtgctggacatcacctccgcctacgttttcgacaaccgctactaccagaacctcctcaatcagaaaggcctcctgtcctccgaccagggcctcttctccagcgacgacggcatcgccaacaccaaggagctggtggagacttacagcgcagatgcccacaagttcttctgggattttggcagatccatggtgaagatgggcaacatcagcccactcaccggtgacgacggccagattcgcaagaactgcagggttgttaattaactgagcttcagtgtgttgaaaagata

SEQ ID NO: 820 - DNA, 997 bp, Oryza sativa
atggcttcatccaagactgttctttctgcaattttcactgcttctctgtgcttcactgtagctcttgctttccctgctcaccatgaggatcttcacccagttgtgcagagcccaccaaagccagttctttctccagattactataaggctacatgcccacaagctgatgagattgtggtctctgtcctaaagaaggctattgccaaggagcagaggattgctgcttctcttctcaggctcctgttccatgactgctttgttcagttcagggatgcgacgcgtcggttttgttggatgacagtgaagaattcgtgagcgagaaaaaggctattcctaacaaaaattctattagaggatttgaagttatagacgagatcaaggctgcacttgaagaagcttgtccacacacagtctcttgtgctgacaccattgccctagctgcgagaggttcaacagttctggagcggtggcccatactgggaacttccactaggaaggaaggattcaaaggcagcatatatgaaattagcaaacaagaaccttcctccaccaaatgcgacactgcatcgtcttgtgaaattctttgaaaggcaaggactggataaggtggaccttgtggcactgtcagatcttcttgttaaccacacggcagttcttgcggatttctccgtcgtaaccagtgaggggattgatgttccccatcttggttatcgagttcacgtagtgctcgaagaacagcggttcgttttctgcatagcttctgacgagacccgcgatctgcgggtctcgtcctgtccacagaacttcatctgaattgaggagccctcttccctcgatcagcagcttgtaataggtgttgtcgaatttcgaaggggtagcaaactccagtgggcgtaagttgttgtcaccgccgttgcgtgggcatgttgaggccagtgtggagtagaacattctctctagcgttttgtcaggctggttgtctctgtgctggttgtag

SEQ ID NO: 821 - DNA, 947 bp, Oryza sativa
atggcgtccgaacaacaacgccggcgatcaccacctaccatcctcgccgccatccttcttctctccttcttggcgacggccaacctcgccggcgccatcgatccagccggaaggagacggaacgtggtcgtcttctggggaggcaacaagaacgaaggcagcctccgttcagtctgcgacagtgactctacaacatcgtcatcatctccttctacagcctcttcggccatggccgctactgggacgacctctccggccacgacctccgccacatcggcgccgacatcacccactgccatttcaaggccgtctacgtcctcctctccatcggcggcggcgatggaaaagactactccctaccttcctccaaatccgccgccgacgtcgccgacaacctctacaactccttcctcggcggcagccgcccgggagtctaccacccattcggcgatgacgtcacagtcgtcggcattgacttcttcattgaccgcggtcaacccgaccactactacgagatcgccgagcggatcaactacgacacccgccactggcgtgaccccatcgggttcaagctgacggcgacggtgagttgtgcgtacgacgactctgaccccaggatgaagaaggcgctggaaacctaccttttccggcgaatccacgtcaggttctacgatgatccgaggtgttcatacaaccatgccgggctcgccggcgtcatggcgcagtggaacaggtggtcggcgagttacccttataatgggaagatttacttggggctcgcggcggcgaatttgacggggaagaatgacatggtcgccgtcggtgagctctaccggaagctgctgccggcggtgcagaagacggatacctacggaggagtgatgctttggaacagctactatgactccatcactcactacggacggtatgtcagtgcctgggcttaa

SEQ ID NO: 822 - DNA, 914 bp, Oryza sativa
agcaaaggattcaagaagtggctgtatatagttgtgattccagtggctggtttgattatgcttgctggcatggcatggatgttcttgccatgccgcaagaaatccgttgcgactattggcccttggaggactggactcagtggccagctgcagaaggcatttgtgtcagggagtgccccaattacagcgtccagaactggagcgtgcttgtgaggacttcagtaatattgtggcaagtcatccatactacactgtctacaagggaaccttatcatccggtgttgagatcgccgttgtatcgacaacgatttcacgaataaatcataagaatttcatcaatctgctggggttttgtgaggaggaagaacctttcacgagggtgatggtgttcgaatacgcaccaaatgggacgctttatgagaatctccatgcttcacattcaagtgataacatgctggtaaattatttgtgcagatgaggcctttgatcacatcgactggagaagtagaatgagaataatcatgggaatagcttactgtattcagcacatgcatgagctcaaccctgccaacgtgcaccctgatctgcattcaagtgcagtatttctttctgaagattgtgctgcaaagaacgtttacagttttggcatactgcttcttgaaatcatctcagggaaacccccttactctgaaaacgagggctccctggcgaatctgaaagaaaatgagctagatgtgatctgtcagataatcatggaatgcatccagagtgacccaacgaagagaccaggcatgagggagatcaccacaaggctgagagagaccatagccatttcgccggatgcagcaacgcccagattgtctccgctctggtgggctgaagtggaggtcctctcaccagtggagccaaggtag

SEQ ID NO: 823 - DNA, 876 bp, Oryza sativa
  misc_feature (336)..(336): n = any nucleotide
  misc_feature (338)..(338): n = any nucleotide
  misc_feature (402)..(402): n = any nucleotide
  misc_feature (413)..(413): n = any nucleotide
  misc_feature (586)..(586): n = any nucleotide
  misc_feature (596)..(596): n = any nucleotide
  misc_feature (605)..(605): n = any nucleotide
  misc_feature (628)..(628): n = any nucleotide
  misc_feature (661)..(661): n = any nucleotide
gagatcgtccggtacggcgagctggtggcggcgacgtacaaggcgttcgacctcgacgccgcgtcaaagcgctacctcaactgcaagtacggcaaggcccggatgctcgacgaggtcggcatggccggcgcagggtacgaggtcacgaggtacatctacgccgcgcccgacctcgccgccggcccgccgtgcccgagccggtggatcgggtacgtcgccgtggccacggacgaggcggtgcgccgcctcggccgccgcgacatcgtcgtgtcgttccgcggcacggtcaccgggtccgagtgggtggccaacatgatgagctcgctggcgccggcnangttcgacccggccgacccgcgccccgacgtgaaggtcgagtcgggcttcctctccgtctacacntccgacgacgncacctgccgcttcacctgcggcagctgccggaaccagctcctctccgaggtgacccgcctcatcgccaagcacaagcacgaggacgtcagcgtcaccctcgccggccacagcatgggcagctcgctggcgctgctactaggctatgacctcgccgtgccgatcaccgtcttcntccttcgccnggccctcgntgtcgggaacacggcgttcaaanggacaggtgcgacgagctcggcgtcaaggtgcntcagggtggtaaatgtgaacgaccccatcaccaagctccccggcatcttcctgaacgagaattctagggttttgggaggcaagctggagctgccatggagtagctcatgctacacacatgtgggagtggagcttgccctagacttcttcaaggcgagagacccagcttgtgtgcatgacttggaagcatacttagggttgctcaagtgccctaag

SEQ ID NO: 824 - DNA, 834 bp, Oryza sativa
  misc_feature (22)..(22): n = any nucleotide
atggccgcgcgcgtgctccccntcctcctcgtcgtcgtcgtcgccgcggccatggcgagagcccccacggcccacgcgtggggcaaggagggccactacatggtgtgcaagatcgccgagggtttcctgacgaaggaggcggcgacggcggtgaaggagctcctccccgggtgggccggcggcgagctcgcggaaacgtgctcgtgggcggacaccgagcggttccggtaccggtggtcgagccccctccacttcgccgacacccccggcgactgccagttcaactacgcccgtgcaggggattgccacaacacaaacggtgagaaggacatgtgtgtggtcggagcgatcaacaactacaccaacgcgctcgaggactcatcaagtccatgatccaaccgagagcttgatgttcttggcacacttcgtcggcgacgttcaccagcctctccactgcggccacgtcaaagatcttggtggcaacaccatcatcgtccattggtacacaaggaagagcaaccttcatcacgtgtgggatgtgaacgtcattgaaacggccttgaaggaattctacaacgaggacgatgagtggtccaccgaggagaagcagtgggagacttgccgtagccggacaaagacttgtgccgataatacgccgaggagagtgcaaagctcgcgtgcaaagcgtacgagggtgttgagcaagaatccaccttagaaggatgactatttcttcgctgccctgcctgttgttcagaagaggattgctcaaggtggcgtgaggcttgctgcaatactcaaccggatcttcagcgggaacaaggttcagagtag

SEQ ID NO: 825 - DNA, 751 bp, Oryza sativa
tacaaagccttcgataagctggagggtgtcgaggtagcatggagccaatcccggatcgatgactctgtcatggggtcctctaagaagatgaagcaactaaacacagagattcaacttttgaagacactcaagcataagaacattgagaaaatgtttgcttcatgggttgatggggagaagaagactgttaacataatcacagagttgttcacatccgggagcttgacacagtattaccgcagaaagcacaagaaagtgaatatgaaggctatgaaacgatgggcaatacagatattaacagggctagaatatctgcacagtcagaagccagcaattatacacagggatttaaaatgtgacaatatattcataaatggaaatcatgggaaagtgaagattgggcaccttagaatttatggcaccagagctgttaactgggcattacaatgaattggttgatatatattcatttgggatgtgcatgcttgaaatggtgacatgcgaatacccatacagtgaatgtcaaggcatggcccatatattcaaaaagattgatgagatatagggtaagaaaccagctgcgttctacaaaattaaagatgcagaagtaagatctttcatagagaactgtttagctccagtagagaacagaatgtctgcaacagagctgttgaaaagctctttcctccaggatgatgatcttatctcagtctctctggtcaagaatatgtctgaagatgggcagcagcct

SEQ ID NO: 826 - DNA, 734 bp, Oryza sativa
atgagaaagggcccgtggacggagcaggaggacgtgcagttggtttggttcgtgcggctgctgggcgaacggcggtgggatttcttagcaaaggtgtcagggtttgcagcgcagcgggaagagctgccgtctccggtgggtgaactacctgcatccagggctgaagcgagggaggatgagccccgaggaggagaggatggtggtgcagctccacgccaagctcggcaacaggtggtctcgcatcgccaagagcattcctggccgcaccgacaacgagatcaagaactactggcgcacccacctgcgcaagctcaagctcaaacagcaaaagcagcagcagtccgacgaccaccacaacgacaacgacgacgacgacgaccgcaactcctcctcctcttcgtcctcctccaacagcaacagcaacctgcagcagcagccgcagccagaggatgagtcgtcggccagtggcagcctgcaggcccaacatcatgaggaccagcaccaactgttccttcatcctctctggaacgacgacatcatcgtcgacgtcgactgctggagcagcagcaccaacgtcgtcgctccgccgccgatgcccgcctcgccgctctgggatatcgatgacgccttcttctgctcggattattcgctacctctctggggatagtatatatcatccatcagccgccaagacgatgacgactacatcaactcgatcgatcgatgcctcctaa

SEQ ID NO: 827 - DNA, 713 bp, Oryza sativa
atggcgagcccgcagtgctgcgcgaacccaccgacgctgaacccggccggcggggaggggaaggtggtggagagcttcggcgggatcaaggcgtacgtcgccggcgccgcggagtccaaggccgccgtcgtcctcatctccgatgtcttcgaggaagatagccgacaaagttgcctcgtctggatactttgttgtggtgccagatttcttacatggggatcctttagtacctgaaagtactgagaaaccgtttcaaatgtggataaaagaacatggcccgaaagcatttgaagaggcgaaaccaattattgccgctctgaaggagaaaggagtgtctagtattggggctgtaggttattgctggggtggcaaaggtggtggtagagttagtgaaagctcatgagatccaggctgctgtgatgtgtcacccctcttttgtgactgttgatgatatgaaaggtctagatttcagaggtcaaatgcccaattgctatacttggagctgaaattgatcgtatgtccccaccagaagtggtgaagcagttcgagcaggttctttcttcaaagtcagggttggccactttgtcaagatcttccctggggttgaacatggatggactgtgagatacaagaatgatgatgcagctgctgtcaagagcgccgaggaagccctggcggacatgattgactggtttaataagaacctgaagtga

SEQ ID NO: 828 - DNA, 688 bp, Oryza sativa
atggggcagctggagctgtcccaccgggtggtgctcgcgccgctgacgcggtgccgctcctacggccacgtgccgcagccgcacgccgcggtgtactactcgcagcgcgccaccaacggcggactcctcatcgcggaggccactgtcatctcccccaccgcgcagggctacccggacacccccggcatctacacgcagcagcagatcgaagcgtggaaacccatcgtcgacgccgtccaccgcaagggcgccctcttcttcctacagatatggcacgtcggcagggtctccaccacaggatttccagccaaatggacaggcgccgatctcgagcaccgataagctctactgccacatggtggagccaggaatggccatcgtcgaaggacggaggaagatcacccatggtctcctgccattcaggaagcagttcaatggcactttcatcgctgctggcgggtatgaccgggaggaagggaacaaggtggtggctgatggctatgccgatctcgtcgcctacgggaggctcttcttggctaaccctgacttgccgaggaggtttgagcttgacgcaccattgaacaggtatgacaggtctaccttttatacacaggatcccgttgttggttatacagattacccttttcttgaggagattgatgaggagtcaacaactacctatgcttaa

SEQ ID NO: 829 - DNA, 667 bp, Oryza sativa
atgagggtttcttcgctccttgtcgccgtggtcctcctcgccgcgctctcgttccaggcgtgcagcggccatggcggcatcaacgacggcgacgggcaggtcgacgccccggcaacgcctgcgtcgtcgtccggcgtgcggtccaaggggctgatcgccgtgaaggtgtggtgcctggtgatcctgctggtgttcaccttcgccggcggcgtctcccccctgctcatcgtcgcgctctgtttccactccgtctttgaagggatcgccattggtgtctcagaagagcgaggcgtggaggaacctgtggacgatcgggctgcacaagatattcgcggcggtggcgatgggaatcgcgctgctccggatgatccccaagcgccccttcctcatgaccgtcgtctactccctcgccttcgccgtctccagccccgtcggcgtcggcatcggcatcgccatcgacgccacctcccagggccgcgccgccgactggacctacgccatctccatgggcctcgccaccggcgtcttcatctacgtcgccatcaaccacctcatcgccaagggctaccgcccccaccaccccaccgccgccgacaagccgctcttcaagttcctcgccgtcctcctcggcgtcgccgtcatggctgtcgtcatgatctgggactga

SEQ ID NO: 830 - DNA, 653 bp, Oryza sativa
atggcgccggcgaaggtgtacgggccggcgatgtcgacgaacgtgatgcgcatcctggtgtgcctggaggaggtcggcgccgagtacgaggtcgtgcccgtcgacatgtccaccggcgagcacaagcgcccgcctcatatctcccgtaacccctttgggcaggttccagcgttcgaggatggcgacctgactctgttcgagagtcccgcgcaatttcaaagtacatacttcgcaaacatggatctgacctactaagggagagcaacctctctgagtctgcaatggtggatgtttggctggaagtcgagtcgagccatttcgacggcgcgatgtcgccgatcatcttccagtgcttcatcgtccccatgttcatgggtggagcaactgacattggagtggtcaatgagagcttagagaagctgaagaaagcccttgaagtctacgaggcgcagctgtccaaatccaagtacttagccggggatttcattagcttggcagatatcagccatttcccgacggtttattacctgctggcatctgcccatgcttctgtgctcgaagcctatccgcgtgtgaaggcttggatcgatgatgtgatgcagaggccgagcgtgaagaaggtgacagaggctctgaagatgccgtctgcttaa

SEQ ID NO: 831 - DNA, 641 bp, Oryza sativa
cagggttgtgatgcctccatccttctgaacgctacggactccatggagagcgagaaggatgccgagcccaacgccaccctcgccggcttcgacgtgatcgacggcatcaagtccgagctcgagcgcagctgcccggccaccgtctcctgcgccgatgttctcgcgctcgccgcccgcgacgccgtcgcgatgctcagcgggcccagctggggcgtgctcctcggccgcaaggactccctcaccgccagcatagacatggccaacaaggatctcccgaacccgaaagacagcctggccgaactcatcaggatgttcgagaagaacggcctcgacgaacgcgacctcaccgcgctctccggtgcgcacaccgtcggcatggcacatgactgcaagaactacgacgaccgcatctacagccgcgtcggccagggcggcgacagcatcgacccatccttcgcgacgccggccaagttcgacaacgcctactacatcgacttgcttgcgaggcgcgggctcctcacatccgaccaggagctctacacccaggggtgcgagaccggcgacctggtgaagacgacttcgtgagggccatggttaagatggggaacatacgcccaaagcattggtggactccggcggag

SEQ ID NO: 832 - DNA, 640 bp, Oryza sativa
gggtgcagagttctttggcacattcacactgatcttcacagtgctgtccaccatcatcatggatgaacaacacaaaggtgtagagtccctcctcggcatcgcgacatcggcaggattagcagtgacagtactggttctgtcactcatccacatttcaggctgccacctgaacccggctgtcagcattgccatgactgtctttggtcatcttcctcctgctcatcttcttccttacattgctgcacaaatcctcggctcgatcaccgcatcgttcgccgtcaaagggatgtatcatccggtgaaccccgggattgtgacggtgccaaaggttgggacagtggaagcattcttcctggagtttgttacaacgtttgtcctactgttcatcatcactgctcttgccactgaccccaatgcagtaagcagtcggagcaacaatcatgatgaacgctcttgtcgcaggtcgacaggagcatcaatgaatccagcaagaacacttggcccggccattgcaacagggagatacacacagatttgggtttatttggttgctaccccacttggtgctgtagctggagaagggttttattttgcaatcaagctgtagttaccttcaggcaagaacaatattcaatcgtag

SEQ ID NO: 833 - DNA, 606 bp, Oryza sativa
ccggtgtcgtggttgagctttctcctgcttctcgtgactggaggagggataattgtgtactacgacaaggaaaaaaagcgtcacattgaaggtagattactatggctgtcaagcaagaaccatcagtaggcactgcagccatcggtggtccattcaatcttttgaaccatgatgggaaacctgtcacgcaaaaggatttctttggcaagtggactctgctatattttggcttcacacactgccctgacatttgtccagatgaacttcaaaagatggctttggcaattgataaaataagttgtgccagttttcatcacagttgatcctgagagagatactgtagagcaagttcgtgactatgttaatggagtttcatccaaatctaataggactaactggcacaactgatgagataagaaaggttgctcgtgcttatcgagtttactatatgaagacagaggaggagggttctgattatctcgttgatcactcaattgtcattacttgatgaatccaaagatggagtttgttaaattttacggcaagaactacgatgcagattctcttgctgatggcatcatcaaagaacttaaagggcaccaataa

SEQ ID NO: 834 - DNA, 531 bp, Oryza sativa
atgggaagtgtaccgaagaaaggagctgcctttgctctggcggtggccattgcgaccatcgtgatggcgaccaccacgacgatggccgccgacctgtcggacgccgagaaggcacagttcgtcaagctccacaacgacgcccgggccgcggtcggcgtcaaggcgcaggtgtcgtggagcgaggcggtggcggcgaaggcccgggagcacgccagcacgtgccggacggaccacatacaggggccctacggcgagaacctgtggtgggggtggagcagcaccgccggctgggtcgggaagccagcggacgcgatggggagctgggtgggcgagaagccgtactacgatcgcagcagcaacaaatgcgtcggcgggaaggtgtgcggccactacacgcaggtggtgtggagccgcaccacccagatcggctgcgcgcgcgtcaccggctgcaacatcaacggtcgcagcagcacgctgatcgcctgcaactacaacccgcgtggcaacattaacggggagcgcccctactag

SEQ ID NO: 835 - DNA, 522 bp, Oryza sativa
atggtggtggcggtgctgtgtgcggtagcaactatggccatggcacaagaggcgtccaacgtgcgtgccacgtaccactactaccgtccggcggaaaacaattgggatttgggggccccggccgttagcgcgtactgtgccacgtgggatgctgacaagccgcttgaatggcgccagaagtatggatggaccgccttctgtgggcccgttggtcccactggtcaggatgcatgtggcaaatgtctctcgttgcaggtgacgaacacggcgacaggggatcagatcacggcgaggatcgtggaccagtgcgccaatggggggctggatttagactgggacaccgtcttctccaagatcgacagcgacggtcaaggctaccagaatggccacctcatcgtcgactaccagttcgtcgactgcggcgataactagcagctaattaaccactcttataaacttccctacatatatatacacatttcggacagaggagtaattaatatatctctgcctgatgaatga

SEQ ID NO: 836 - DNA, 486 bp, Oryza sativa
  misc_feature (27)..(27): n = any nucleotide
ccgaagcggacgacgaagaagaggccntggaagtgctgcgacaacatccggcggctgccgccgaggatccacccgccgttctggcgctgcgacgacgagctcaagcccggccagtgcttcgccgcgtgcaaggcttgccgggaggcgccggggccattcccggggccgctcatctgcgacgacgtctactggggcgccgacccgggtcccttctgcacgccgcggccgtggggggattgctgcgacaacaccacctgcaccaagtcgatccctccaatctgcagctgcggcgacaaggtggcggcatgcgacggcgcgtgcaaggattgccagccggtggcgtcgtcgtcggagccgcctcgcttcgtctgcaaggatcagttcaccggacagccagggcccaagtgcacaccatgcactcagaactgatccttgcagatatgatcgatgtccgtcaataactccagaccaagcagaagtacttga

SEQ ID NO: 837 - DNA, 348 bp, Oryza sativa
aagttataactgatgcctttgtcaagtcgggcctagtacttgaaagggatgcgaggcaagaattgaagagcaatatttgatgctaaaattgctgttttcttttcaacttcagttgcacgtgaccataatgaatgtgaggcacaggaagagcgctgcagcaagagatggaaccaaagaaacgactcattcgatgctcggaatattttcagaaaatatggggaacatgactggggcgaatacctcattcccgagatccatctttcgcagcgattcaagttcgatgaaagagggtactactactgctgctcttcaatccccttgcctgcggcggagatgcaaacggagtga

SEQ ID NO: 838 - DNA, 306 bp, Oryza sativa
atgggtttgagctgcttgggtgctgggatgatggggaagaagaaggtgtcgccggcgaagcagcagcagcagcaacctgtagatcagaatcagcagcagaagaatctgtactgctcgaagtcgaaggatgcagatgctgctgaagttggtgagaaggagaagaagattggaggaggatcagatggtgatcatcatgctggtgtggagaaggtcgagatgaggaagaagaagagtggatcatcatcatcatcagctccaatcttgatgtaccagttccccttccactcccgccctggcttgctctga

SEQ ID NO: 839 - DNA, 576 bp, Oryza sativa
atggcaggcactaagcttgcagctcttgggtttattgtcctcttgagcattggattagctagtgctgtaagggtagaaagatactcaaatgcccaaggttcgggcacaggaagtggagagggcacaggaagcgtgaatggtgcgggagctgggttgggaagtgggactgggtctggtagaagtggttacaatggtgcccatgcaagtggtggaggaggaggcggaggcggtggctacagccaatatggtgggtcagggtctggtagtggatctggttcgggctcaggctctagccagaccagtcaaaatgggtattatggttatggtggatcatccagtgctggcggtagcggtgctggtgctggagctggacaagctggtggttactggccatcctatggtcatgggtctggtagtggtaccggctcaggctctagtgaggctactaatacctggtatggacagtatgcaaatgcaaatgctggtggcaacggtggtggtaacggtcagggtcaatatggtggcagcggtgctggtgtaggttccggatctgggtttggtgatgcgaacccttaa

SEQ ID NO: 840 - DNA, 318 bp, Oryza sativa
atggtgagaagtgcttccgaggcgaagaagaagatggctcaccttgagaagacaattgacgagaaagaagaagagatatcagctaggcaaacggacggagccagccacgggcgtcgcgggcactggttgatgacttcagctagcaagggggcgccggcgcgcctgccgaggcggcgaaacggcggcgctagcgccaaccgccgccaccacccggagcccgtcacagtcgatgtcgtcgttgaggtcgaggagttgagaggagcagccgatgcgcgctgtgaaggaggagccaggtgcctgtctgtcgccgccggctga

SEQ ID NO: 841 - DNA, 2745 bp, Oryza sativa
atggcagaagctgcagtagtccaggccctcatcaagattggcacgacttttggagacgcggcattgcaatcgctcaaagacatcataaagaaagaagtagctctgttacaggaactaccagagctcgcaaaatccattgggagggaactggacatgatcaatagcttccttatgcaagtgcgggcgaagatccacagcactgacaatgaagttctgaaacgctgggtggtgagagtacgccaggtggcctaccatgttgaggacataatagatgagtactcctacaatgttgctctgctgcaggaggaaagctatttaagtagaatgatgcgtgcgacctactatggtgtaactttccatggcattgctactggactgaaagatgtacaaaatgatatcaagcaattgtcggatactaagacaaaatttgcagagttcttcaatgagttacatagcaacactggtagtaacacacaatctcatctatcacgtgatagatccctccatacagttaaagaaggtattgttggtatgacagaagaggtagatttactgaattcatggttatcacccaatgatctcactagagtagttttatctgtgtggggtctgtttgggctggggaaaacaactctggtgagaaaggtgtatgaatctgtgaaagagcagaagatctttgactgctattcttggattgaggtaccacacgagtacaacaatgatgtaatgttaaggcagttaataagggacctatcacaagaccaaagccaaatacctggaaacctggacagtatgtatggcagccagctggttgatatattatgtgtggtgttatccggcagaaggtacttgattgtgctcgataatgtctgggatgccgatgcatttcatggcatatcaagctttttgatcgacaatggtaatgctagtcggataatcatcacgactaggacaagtgatgttgcttcactggctcaagacacatacaagctcaagcttaagcccttgggtgatgaggctgcaatggaactattttgcagaagggcttttcataataaagacatgagatgccccccacacctgaaggatctgtgcgaacagattgtgagaaagtgtggtggcttaccatcggccatctatgctataggcaatgtgcttgctgtcagagaacagacagaagtagcatggaaaataatgaatgatcagttccagtgtatgttagaggacaaccctggcttgggagaagtgaggagtgccctgagtgttagcatcttgttccttccaaggcatctcaagaactgcttcctctattgcagcttgttcccacagaactaccggttgtcacgtgaaagccttgtgaagctgtggacagcagaaggattcataacgaagagaggaagcagcactctggaagaagttgcagatgaatacctgatggagctgatccgaggaagcttgttgcaactcctggagacagatgaaattggcagagtagccttctgcaagatgcatgacattgtgcgtgacttggctctgtcctactccagaaaggagatgtttggcctgagtgatggagacctccaaacagatcaaaaggaagatgttcgtcgcctgtcaatatccaagtgcaacaagaatgtgggatcaatcttggagtttcctcgccttcggaccttcgtcgctaccaatggaggcgcagagtcagacctgttacattctctcatacaaaaatcgaagtaccttgctgttctggagctgcaagactcacccatcgacataattccagcaaatattggagagttgttcaacctgcactatcttggattgcggaggaccaatgtgaaatcacttccaaaatctatcgagaaacttaccaatctggagactctggacctgaaatacaccggggtagatgtgctgcccaaggagatctgtaaactgaagaagctgaggcacttgttcgccgagaaactcattgaccgtaatcgccaagtgttcagatacttcaaaggtatgcagctgccacatggattttcacacatgaatgaaattcaaacccttgaaacagttgaggcaacgaaggactccattgagctgctggggaagctgactgcactgagaaccctgtgggttgagaatgtgcatcgcgctgactgcacaaagttgtttgattcattgtcagaaatggagaatctctcaagcctgctcgttagtgccagcgatgaatatgaggtccttaactttgatgcattcagtccttctgagatgaagctccagaagctcatcattagaggctgcctcgagaatgacacatttgacaagcttatgttcaaaaaccttggctcacacatcaaatacttgtcactaagttcctcgagactcggcaatgatccgttcccgctcctcgcaaagaacatgaagaacctcatctacctgagcatcaggaagtggtgctgtgctgaggaggtggctctccgtgaagggtggttccctcgcctgacaacactcttccttggtgacatgaagcaggtgcacactattgtcatcgagccgtcagcggttgagagcttggaggcgctgtacttggtttctctgacggctatgacagcggttccgacaggcttggagctcgttgggtcgctcaggaagctcgttgtgtgggggcagtcagacgatttcaagctggagtggaagagggagaactgggaaacgaagctgcgccatattccggaaattcgcatttaa

SEQ ID NO: 842 - DNA, 2412 bp, Oryza sativa
  misc_feature (1281)..(1281): n = any nucleotide
atggcaactggcaagacaaggtgcgcctccttcacagtgtgggccacacggacgcggggcgcagaaggtcgcatcaggtttcccgcaccgaggcgcccgcccggacccacctcccaggtcccgcggctgctgcctcgcctcgcctttggcgggctcggacgcccacacgggtcaacgcctagaggtggaaaccaccttaaaacgatttttgctacttccgtttcacaaatggagagagagagagagcaggagtatgtccaatatataggtagtcgcctagtccctcttaaaatattccggcatttcaaccccacccactccgcacccccgcaagtcaactctcttccttcctcctccgtgcttaatgctctccgcattataaccacccacctctcctcctccccccacctcctctctctctatctccatctccaccgctacgcttcccagccatgggcaactccctcgcctgcttctgctgcggcgcgcgccggcggccgaggcggccgccacgtcgcccccgccgcgctcccctccgacccggcctacgacgagggcctgggccactcgttctgctacgtccgccccgacaagttcgtggttcccttctccgcggatgatttggtggctgacgcgaaggcggccgcggcggcggagggggaggcgaccacgttccgggcgatatccggggcggcgctcagtgccaacgtatccacgccgctgtccacgtccgtgctgctgctgatgccggaggagtcgtcggcgtccgccaccgcgtcgtcggggtttgagagctcggagtcgttcgctgctgtgccgctgcagccggtgccgaggttctcgtccgggccgatctccgcgcccttctccggcgggttcatgtcggggcccttggagagggggttccaatctgggccactcgacgccgcgctcctctcgggccctctccctggcaccgccacctccggtcgtatgggtggcgccgtccctgcgctccgccggagcctctcccacggtggccgccgcctccgcaatttcacccgggcgctcctcgcgcgcaccgagaagtttcaggattctgcggatctaggctcgccggacgccgccgccgccgccgtcgccgcctgtgggggcgatccctgtggtctgcagtgggcgcaggggaaagccggcgaggaccgcgtccacgtcgtcgtgtcggaggagcgaggctgggtgttcgtcggcatctacgatgggttcaacggccccgacgccaccgacttcctggtatccaacctntacgccgccgtccaccgcgagctccgcggcctcctctgggatcagcgggagcagaacgtgcagcacgaccagcgccccgaccaacccggctcagccccaagcaccacggcctcagataaccaagaccagtggggtcgccgccgccgcacccgccgctcaagaccgccgcgtggcgccgacgacgaccagcggcggtggaagtgcgagtgggagcaggagcgggattgctccaacctgaagccaccaacgcagcagcgtcttcgttgcaacagcgagaacgaccacgtcgccgtgctcaaggcgctgacccgtgcgctgcacaggaccgaggaggcttacctggacatcgccgacaagatggtcggcgagttccctgagcttgcgctcatgggctcttgtgttcttgccatgctcatgaaaggagaggacatgtacatcatgaatgttggcgatagccgggctgtgttggcaacaatggacagcgtcgatctcgagcagatcagccagggttcattcgatggatcagtcggggattgcccgccatgcttgtcggccgtgcagctcacgtcggatcacagcacttcagtggaagaggaagtaatcagaatacgaaacgagcatcctgatgatccatctgccatctccaaggatcgcgtgaagggctcgctgaaggtgaccagagcatttggtgctgggtttttgaaacagcatacgtccaaacttgattataccaggagcggaataattaagcccaagtggaatgatgcactcctggagatgttcagaattgattacgttgggtcctccccatacatatcatgcaatccatccctttttcatcataagctcagcacaagggatagattcttgatattatcttcagatggactttaccagtatttcaccaacgaggaggcagttgctcaggtcgaaatgttcatcgcaacaacccctgaaggcgaccctgcccaacatcttgtggaggaagttcttttccgtgctgccaacaaagcaggaatggactttcatgaactgatcgagataccacatggtgatcgtcggcgataccatgacgatgtatctgtcatcgtcatctctttggagggcaggatttggagatcctgcgtgtaa

SEQ ID NO: 843 - DNA, 1587 bp, Oryza sativa
  misc_feature (25)..(25): n = any nucleotide
atggcatctgtggagacgtgggtanggttcgggtcggccctggccggcgtcggcttgctttggtcgaggatgccggagcacgtccatgacgaggctaggtacatcatcagtagcctggtccccatggcgatatcctacttcaacccctacgagcagatcaccgtgtccgagtacggcgaggagcggttccgacgcaacaagatgtttgacgccgtctccacctacctgagccgcgtgtgcgccggtggcgcctgcaagctcaaggccgagctctgcaacaacggcagggacgacccaattgtcactctggacgagaatcaggaggtcgtcgacagcttcgacggcgcacgcatgtggtggaggctgtgccccaaggcctccaagaacaagggggccatcaccgtcacctactaccccggggaagcggacaagccgcgctgcttcaagctagtgtttcacaaacgccaccgccagctcgtgctcaactcctacctaccaagcgtcgtccggcgttggcgcgagctaaccgcgatgaaccggcagagacggctgttcaccaaccatgccaatgaggcgaagaagagcgtgtggaccagtgtcccttacaacccccctgcaacgttcgacatgctcgccatggaccacgccaagaaggttgagatcgtggacgatctcacaacgttccagaaggggaaggagtaccactcaaaggttggcaaggcgtggaagcggggctaccttctgcatgggccaccgggcacgggcaagtccaccatgattggggccatggccaacttcctcgactacgacgtctacgacctcgacctaacttccgtcaagaacaacagcgagctgcggaagctattccttgatacgacggacaagtccatcatcgttatagaggacattgacgcgatcgaggtcgaactcactaccaagcgcaagggcaagaaggcagccaacggcgacgaaatccacgacaagcgtatgctgatagagttttccgacaagaacgatgaaaaaagcaaagtgactctgtcgggcctgctcagcttcgtcgacgggctgtggtcggcgtgcggcagtgagcggatcttcatgttcacgacgaaccacattgaccggcttgacccagcactaatccggccagggaggatggacaagcacatcgaaatgtcttactgccgcttcgaggccttcaaggtactcgccaagagctacttggacatcaccgagcactcactattcgctgaaatcgagcggctgctcgacgacactgacacaactccggcagacgtcgccaataacctcatgctgaggagcaagaggaacggtgaaatcagtcgactgctcgacgagatcgatggggcaccgcgggcagatgtggccaaatggtgcaagaggaagagagacacggacgagtgcctggcaggtttcgtagaaatactaaagaaatccaagatggaatctgcaacaactccaatggattcaatggaagaagccaaagaggaacgacctaacgcaaaagaaagctacaaaatggggcggatatatgatgagaactataggttgggaaatgccagctag

SEQ ID NO: 844 - DNA, 1572 bp, Oryza sativa
atggcgctgtggagtggtctggggcaggcggcgacggtggcgcagctggtcggggcagacgtcggtagtctcatctccatgatcgtgcaagcggcggtgacggctcagcacaacaagaaggagtgcgagcagctcgcccgccgtgccttcatgatcgcggagctgctgccgcatctgcgggatccggaggtggtgtgtctgcccgagatccggaggccgctggtcggcctcgacgacacgctccgggaggcacacgagctcgtgatgtcttgccaggagaagagcgtgatgcaccggctggtaatggcaggtcggcaggccgagagattcagagaagttcagagcaggatcgactcctacctccttgtcttccccttcatcagccacatcgatataacccggcgccttgatcggatatacagagttcttcttccgaatgaccacacgcccgtgccatctccatctgcaggctcccagactcgtgagctggagctcgcagaggaggccgctcaagaggtggtattccgtggcgaagaaggcgagaaattcaccatagcagagcttgcgacggcgaccaacaacttcgcctccgacagactaatcggtcgaggcggtgtcggcaatgtgtacatgggaaggcttcctgacgggagagaggtggccatcaagcactttcccgagtttcactacacatctattgaggatgatgagttcaatgcggagcgcatcatcctctcacgcatccgtcacaagggcatcatccgtctctttggctgctgcgtggagcgccacaagcaggaggctaataacaagcgctccacatgggttctggaaaaagaaagtcgccgaatgccggccttgcagacgccgatgacaacggagcctctcctcgttttcgagtacatgaggaacagctcccttgacaagcaccttcatggctcgctgtcgtcctcctcgccggtggccacatcctggagcatgcgcatggggatactgctgggcgtgtcgcgggccatcgagtacctgcacacccaccctacgcggccggtgatccatcgcgacatcaagccgtcgaacatcctgctcgacgaggcctgggtgccgcgcttgtcggactttgggttgtcggtcgcctgggacgggacggatcactgttgtgatctgtccattgacggcacgctaggatacatcgaccccgagtactttgtgacgcacagtgtgaagccaacgatagacgtgtacagcttcggggttgtgatgctggaggtattgacagggataaaaccaatttttaaacggaaggagaaggaagaagaggacgacggtggcatcatccccacgagcttgctggccttcgccctgccaatcgtcgaggcaggggaggtgcggaaggtgctggacaggcgcccgacgccggagccaacgccgaggcagctccaggcagtggaactggtggcgcagactgcagcttgctgcgtgcggctggagccccagggccgtccagccatttcggaagtcgtggccaacctccaggcagcgatcgacctcatctcatccaatgacgatgagtag

SEQ ID NO: 845 - DNA, 1287 bp, Oryza sativa
  misc_feature (201)..(201): n = any nucleotide
atggctgccaccaccaagctcgtggctctgggcctcgccgtcctcctcagcatcgggttcgctggtgccgcgagggtggccaggtacacgaactcgtactccggcggcgggggaggcggcggcggaggaggcggcggcggcgggacgaacggcgggtggggctccggctcgggcgccggcgccggcgccggatacggcganagcggcggcaactccggcaacacgtggaactacgggaagggttggcggcgctggcggaggcggcggcggcggcggcgggaccaacggcgggtacggctccggctccggctccggctacggcatgggcagtggctcgagcggcggctccggctcgtcggcgtcggcccggttgctctcagcagcggcggtaattacgccaccggtgatggcgagggcggcggcggcggcggtggcggcggctccaacggcggcagcgggtacggcgctggcgccggagttggccagggcgccggcgagagcggctcgtcgatagcgatggcgccgtctccatccagcggcggcgactacaacggcggctacgccgacgcagccggtggcggcggcggcggcggcggcgggcacggcggaggcccagcagcatctccgagctacggcgttggcgcaggcgctggctccggcgctggcgacgccggcagcgatggctcctccggcggaggctacgcgtcaggaatgggcggcggcaagggcggcggcggcggcggcggcgagaacggcggctacggcagcggcagcggcaagggatccggatccgtgcgggaggtggaggtggcggtggaggtggaggtggctcgtcagggggtggttccggctggggatctggctctggttctggatatgggcaggcaggtgggtctggtggagcgtatgctagcggcggcggcggtggaggaggtagtggcggcggggcgaatggtggatctggctatgggtctggttctgggtctggatatggtcaagccgggagttacgggccttatggtggaggatatgcccagggtgggggaggtggtggtggaagcggtggtggacaaaatggtggatcaggatcaggatctggttctggttctggatcaggtcaggcaggaggatacggaccttacgggggcggatatgctcaggcaggaggacaaggtggtggtggaggtggtggacaaagtggtccagggggcagcggatctggcagtggctcgggaagtggatctggaagtgcaggatatccatagaatttacgcactacctggatga

SEQ ID NO: 846 - DNA, 831 bp, Oryza sativa
  misc_feature (44)..(44): n = any nucleotide
  misc_feature (51)..(51): n = any nucleotide
  misc_feature (55)..(56): n = any nucleotide
atgcgtcatatcacgtactcctacggcgacaagtcggtgacganaggtccngtcnncgaagtggacaagttcacgttcgtcggcgccggcgcgtccgtgcccggcgtggcgttcggctgcggcctctttaacaacggggttttcaagtccaacgagaccggcatcgccgggttcggccgcggcccactgtccctgccgtcgcagctcaaagtgggcaacttctcccactgcttcaccgccgtaaacggattgaaaccgagcactgtcctgctcgacctgccggccgatctctacaagagtggccgcggcgccgtccagtccacccctctaatccagaatcctgccaatccaactttttactacctctcgctgaagggcatcaccgtcgggtcgacgaggctgccggtgccggagtccgagttcgctctaaagaacgggaccggcggaacgatcatcgactccggcacggccatgacgtcgctgccgacgcgtgtttaccggctcgtccgtgacgcgttcgccgcgcaggtgaagcttcccgtggtgtccggcaacacgacggatccctacttctgtttgtcggcgccgctgcgggcgaaaccgtacgtgccgaagctggtgctgcacttcgagggcgcgacgatggacctgccccgggagaactacgtgttcgaggtcgaggacgcgggcagcagtatcctctgccttgccattattgaaggcggagaggtgaccaccataggcaatttccagcagcagaacatgcacgtactctatgatctgcagaatagcaagctgtccttcgtccctgctcagtgcgacaaactttag

SEQ ID NO: 847 - DNA, 4348 bp, Oryza sativa
  misc_feature (34)..(34): n = any nucleotide
  misc_feature (60)..(60): n = any nucleotide
  misc_feature (63)..(63): n = any nucleotide
  misc_feature (72)..(72): n = any nucleotide
  misc_feature (103)..(103): n = any nucleotide
  misc_feature (151)..(151): n = any nucleotide
  misc_feature (153)..(153): n = any nucleotide
  misc_feature (195)..(195): n = any nucleotide
  misc_feature (201)..(201): n = any nucleotide
  misc_feature (216)..(216): n = any nucleotide
  misc_feature (286)..(286): n = any nucleotide
  misc_feature (2778)..(2778): n = any nucleotide
  misc_feature (2879)..(2879): n = any nucleotide
  misc_feature (3302)..(3302): n = any nucleotide
  misc_feature (3311)..(3311): n = any nucleotide
  misc_feature (3315)..(3315): n = any nucleotide
atgcagaaggtggtgagcctgaggaaaggggaangggggtcgtcgtcgcgggggccggcntcnatgtggtgnaccccggacaacgggggtgttctcgcggtcnagggcgtcgtcgagttgggaagattgggaagaccacgaggaagccctncngtttgccggcgctcgagaaagctgcccacgtacgaccgcgtncgccgngccgtactgccggtngtggaggagggcggcggcggacgggaggcggggaagaaaggtgtggactgctcagctcggcccgcaggancgcgggcgctgctcgagcggctcgtgcgcgtcgccgaggacgacaacgagcgcttccttctcaagctcaaggagcgcatcgaccggggtggggattgatattccgacgatcgaggtgcggttcgagcacctggaggcggaggcggaggtccgcgtcggcaacagcggcctccccaccgtcctcaactccatgaccaacaagctcgagggagccgcgaacgcgctggggattctacccaacaagaagcagaccatgcccatcctccacgacgtcagcggcatcgtcaagccccgcaggcaggatgactctgctgttaggacctcccgggtctggcaagaccaccttgctacttgctttggctggaaggcttggcaaagacatcaagagttctctggtcaagtgacttacaatggacaccagatggaggattttgtgccacagaggacagctgcatacatcagccagcatgatcttcatattggggaaatgactgttcgggagacactctcattctcggcacgctgccagggtgttggaagccgctttggatatgctgaccgagctgtcaaggcgagagaaggcagcaaatattaagcctgatgctgatattgatgcgtttatgaagaggcttcagcgatggagggacaagagaccaatttgattactgactatatactgaagagatattaggactggatatatgtgcagacacgatggtaggagatgatatggtgagggcaggtgagatgcttgttgggccagccaatgcacttttcatggatgagatatcgactgggctcgacagctcaactacatttcagatcgtgaagtcgctcagacaggccatccacatcctcggtggcacagcagtcatctcgctgttgcagccagctccagagacatatgacctatttgacgacatcatactcctctctgatggtcagattgtataccaggggcctcgagagggtgtgctagaattttttgagttgatggggttcaaatgccctgagaggaagggtgttgcggacttcttacaggaagtaacttccaggaaagaccagaagcagtactggatgcagcatgacaagccctatcggtacgtgccagtcaaggattttgctagtgcattccagtcgttccacactgggaaaagtatagcaaacgaacttgctactccattcgacaagagcaaaaatcatccggctgcattgaccacctcgaggtacggtgtcagtgccatggaactgttgaaggcaaacatcgaccgggagttcttgcttatgaagagaaattccttcgtttatatcttcagagcctgccagcagctgatggtggtgtcggcaattgcaatgaccgtcttcttccgtacaaagatgcaccgtgattccgtgactgatggagtcatcttcatgggcgcactcttcttctcagtgatgatgataatgttcaatggtctatctgagctaccgctaaccatttttaagttgccagtcttcttcaagcagagagacctcttattctttccagcatggacctacaccataccctcatggatcctcaagatcccaatgtcctttattgaggtcggtgggtttgttttcatgtcatactatgtgattgggtttgatccgagtgcaggaagaggttcttcaagcagtatctgcttatgttagcaatcaaccagatggcagcggcactcttcagattcgttggtggggcagcaaggaacatgatcgttgcgaatgtctttggatccttcatgttgctaatctttatggttctgggtggttttattctagtaagagagagaaagtgaagaaatggtggatttggggctactggatctccccgatgatgtatgcacagaatgccatctcagtgaatgagtttttggggcacagctgggataaagtcttgaataattctctctccaatgagaccctaggcgtacaagcccttaggtcccgtggcgtcttcccggaagccaagtggtattggattggctttggtgcattgctcggattcatcatgctcttcaatggtctctttactcttgcactaacatacctcaaacaggagctgaaggagaagcaagccaacatcaatggtaatgttctagacgttgataccatggcatcaagtactaatctagcaatagttgacaacacggaaactagttcagaaattgctgataattctcaacctacacaaaggggtatggttctcccttttgctccgctttcactcactttcgacaacatcaaatactctgtcgacatgccacagcaggaaatgaaagcgcatggaatagttgaggaccggttggagctcctcaaaggtgtcagtgggtctttcaggccaggagtgctaactgcgcttatgggtgttagtggtgctggaaagactactctgatggatgtgttagcagggagaaagacaggtgggtacattgaaggcaacatcaccatatcaggatacccaaagaaacnagagacatttgcacgtgtatcaggatattgtgaacagaatgacatccactcaccgcaagtaacagtctcagagtcactgcttttctcagcttggctacggnttcccaaggatgtagattcaaacacaagaaagagatgttcattgaggaggtgatggagcttgtggagctcaagcctttgagagatgctttagttggtcttcctggagttaatggcctctcaactgagcagaggaagaggttgaccattgccgtagagcttgttgctaatccttcaatcattttcatggatgagccaacttcagggcttgatgcccgagcagctgccattgtgatgaggacagtgaggaatactgtggatactggtagaactgtggtgtgcacaattcatcagcctagtattgacatatttgaagcatttgatgagagcttttccttatgaagcgaggaggagaagaaatatatgttggcccgttaggccatcaatcttcagagctgattaagtattttgagagggaatcaaangagtcagcngaantaaagatggctacaatccagccacgtggatgttggaggtgtcaacaatttctcaagaacaggcattaggtgttgatttttgtgacatatacaggaaatctgaactcttccagtaagaggaacaaggcattgatacaggaactgagcacaccaccaccaggttcgagtgaactatatttccctacaaagtactcgctatctttcttaaatcaatgcctagcatgcctgtggaagatgcacctgtcatactggaggaaccctccttacaatgccataagattatttttcactactgtcatagctctcctctttggcaccatcttctgggatcttggcggtaaaacgggcaagtcacaagacttgttcaatgccatggggtccatgtattccgcagtgctttttattggcgtcctaaactctcagtcagttcagccagttgtatcagtggagaggacagtcttttatcgtgaaagagctgctggcatgtattcagctttcccgtatgcatttggacagacaggttgccatcgaattcccgtatacactggttcagtctatcatatatggcatcatagtgtactcgatgattggttttaaatggacggcggctaaattcttctggtacctcttcttcatgttcttcacgtttctatacttcacattctatggcatgatggctgtgggcctgacaccaagctaccacgtcgcctcaatcgtctcatcggctttctatggcatctggaacctattctccgggttcatcatccccagaccggaaagttccaatctggtggagatggtactgctggatatgccctgtcgcgtggacgctgtacggtctggttgcctcgcagtttggagacattatgacgccaatggatgatggcactcccgtgaaaatcttcgtggagaactacttcgacttcaagcatagctggctgggggtggtggccgtggtgatcgtcgcattcaccatgttatttgccttcctctttggctttgccatcatgaagcttaacttccagaagagatag

SEQ ID NO: 848 - DNA, 3921 bp, Oryza sativa
  misc_feature (1537)..(1537): n = any nucleotide
atggacgcggcggcgaacggcggcagggatggcaaggagaagaaggcgaagaacggcagggacggcgaggacaagaagaaggaggaggacggcgacgccgggaagaaggtgtcgttcacggggctgttccggtacgccgacggcacggacctgctgctgatggcggtcggcacggtggcggcgctcgccaacggggtttcgcagccgctcatgaccgtcatcttcggccaggtcatcaacgccttcggcgaggccaccaacggcgacgtcctccaccgcgtcaaccaggcggttctcaactttgtctacctgggcatcgcgacagcggttgtttcatttcttcaggtggcgtgctggacaatgactggagaacggcaggcgacacgcattcgatctctatacctcaaatctgtcctgagacaggatatagcattctttgatgtagaaatgacaactgggcagatagtttcaagaatgtccggtgacactgtgttagttcaggatgccattggtgagaaggttggcaagtttctacaacttgtggctaccttcgccggtggtttcgttgtagcatttgtgaaaggttggcttctatcccttgtcatgttggcctgcatccctcctgttgtcattgctggtggagctgtatcgaagatgctagcaaaaatctctagcaagggtcaagcatcatatagcgatgcagcgaatgttgttgaacagacaattggagccataaaaactgttgtttccttcaacggtgaaaagcaggctgttgcatcgtacaataaactcataaacaaggcatacaaggcagctgttgaggaaggacttacgaacggttttggcatgggctccgttttcttcatatttttctccagctatggtttagctatatggtatggcggcaagttggtagtcagcaaaggatactcaggaggagacatcataaatatcttgtttgctgtcatgactggggcaatgtctttagggaatgcgaccccatgtatggcagcctttgcagaagggcaatctgcagcttatagattgttcaaaacaatcaagagaaaaccacagattgatcctgatgacataactgggaaacagttggaggacatcaggggtgatgtggaattgaaggatgtgtacttcagctacccagcaaggcctgagcaactgatatttgatggattttcattgcatgtttctagtggcacgacaatggctatagttggggagagtggaagcggcaagtccactgttattagtcttgtcgaaagattctatgatccacaggctggtgaggttttgattgatgggattaacatcaagagcttgaggcttaattggataagagggaagattggtcttgtcagccaagagccattgctctttatgacctccattaaagataatataacatacggcaaagaggatgcaacaattgaagagattaggagagcagctgagcttgctaatgcagcaaattttattgacaaattacctgatggctatgatacaatggttggtcaacgtggcncacagctctcagggggacaaaagcaaagaattgctattgctagagcaatacttaaaaaccccaaaatccttctgttagatgaggctactagcgcattggatgtggaatcagagaggatagttcaagaggcactgaacaggatcatggtggacagaaccacacttgtggttgctcatcgcttgaccacagtgaggaatgctgattgtatatcagttgttcaacaaggaaagatagttgagcaaggtccccatgatgaattggtaatgaaccccaatggtgtttattcgcaactcattaggctacaagaaacccacgaagaagaagagaagaaattagaccatcacatatctgattcaaggtctaaaagtagaagtttgtcattcaagcgatcaattagcagggattctgcaggaaatagtagcaggcattctctagcccttccctttggcttgcctggctcagttgaattgcttgaaggcaatgattcgactgtgggggaacagacagagcagggtggtgatggtgaggtccaacagaaagctcctattggacgactggctagactaaacaagccagaggtaccgatacttttgttagcaacactggctgcaggagttcatggagtgcttttcccaatgtttggagtaatgatttccaatgccatcaaaactttctttgagccagcagacaaactaaaaaaggatgctagcttttggggtttgatgtgtgttgtcctgggtataatttcaataatatcaataccggtggagtactttatgtttggaatagctggaggtaaacttgtagagcgtgtccgtgccttgtcattccggagtattattcaccaagaagttgcttggtttgatgatcctaggaattccaggtttggttgcccattctttattggttgttttctcttcctcctaaatatcaaggaattttacacattgggaactgatgatgaaatttcatcctacagtggagcgcttggtgcaagattatcagtagatgctttgaatgtccggcgtttagttggagacaatcttgcattggcagttcaggtcgtctcaacacttatcacaggaattgtcatagcgatgatagcggactggaagctcactttgatcatcctttgtgtgattccacttgtgggtcttcaaggttatgctcaagttaagttcctgaaggggttcagtgaagatgccaagatgttgtatgaagatgcaagtcaagtggctactgatgcagtaagcagcatcaggactgtagcttccttttgttctgagaaaagagtgatgacaatgtatgataataaatgtgaagcttcgaagaatcaaggagttagaacaggaatggttggaggccttggttttggtttctcattcttgatgttgtacctaacatatggtctctgtttctatgtcggagcacaattcgtacgccacaataaaactacttttggggacgttttcaaggttttctttgcactggtgttggcaactattggaatatctcaaacaagtgcgatggcttctgattctacaaaggccaaggattcagctatctccatatttgctttgctagaccgcaagtcacaaattgactcgagtagtgatgagggtaggacattggccaacgtcaagggaaacattgatttccgacatgtcagcttcaagtatccaacccgcccagatgttcagatcttcagtgattttactcttcacataccctctggcaagaccgttgcacttgttggagagagtggtagcggaaagtccacagcaatcgctttgctagagcgattctacaatcccgagtcaggaaccatcttgttggatgaagtagaaatcaagaacttaaaggtcaattggttgagggatcagatggggttggtcggccaagagcctgtgctctttaatgacacaatccgtgctaacatagcctacgggaagcatggggatgtcactgaggaggagctcatcaaagctgcaaaggcatccaatgcacatgagttcatatcgagccttccccaaggatatgataccaccgtgggggagagaggggtgcagctatctggtggccagaaacagcgggtggctattgcgagggccatattgaaagatccaaagatactacttctagatgaggcaacgagtgccttggatgctgaatctgagcgcattgtgcaggatgcgttagataatgtgatggttggcaggactacgattattgtggcgcaccgcctctcgacgatcaaaggtgctgatatcattgcagttctgaaggatggtgcgatagcggagaaaggaaggcatgaggcattgatgaacatcaaagatggtgtctatgcttcacttgttgaactccgttcaggctcatcataa

SEQ ID NO: 849 - DNA, 2528 bp, Oryza sativa
cagaagaatctccctccgttcacggaatatggacatatatcgcagcctgactgggatacgtttgttgcagatcatacaacagctgaagcattggctttgaggaaaaaaatgtccgagctcgcgaagaaaaatagatatccccatagattggggtcaagtggatacgctgggcacgtcgatcaatggcgggagaccgagcaaagatttgcagcggccggcaaaccactactggtagaccccatggtggaacgtagtaagaactgggtttgggcgcgcagcacaggtcaagtctcggatgagggagacatactattcgagactccggacatagaacaagtgactactaatttgcagcagatcgtcgagaaagaaagagcaggacagtttgtcccacggagggagcgagaccagcttactgtggcgttggggaccgccgaacactctggacgtgtaaggggtttgtcctcaaagccaagttggaagataggctttccacatgacgcaccaagttataagaagagagacaaatacaaagaacaactatcatacaaaatctatgcgcaagtgaaggaacacttctactcgttggtagctaaaaacccgacagcctttccaaggttattccctgatggccagcaacccacacaatccacacagcaaacaactaatgcacccagtagtgtaggatcagtggagacaactcccttccctatggatggtataactggaccaactccgtgcagtctcgtcgtacctatcggccgcgctagaaagactaaggaggttgcaactggtttagcgatacccggatgtcaatttacacaacacgggcaatcccttgaggattacgcaagggtacaggtcgccaaggtccatagagaccacatttccttggaactagacatacctgcacctgagaggattgaacttctcggtgatgcagtgaatcagtttatgttgtggcaccgcagagacataatcctgaccgcggccgttccagcagcaggatcttcaactccatcctcatcacaagcaaggacagttgccgcttctgcttcaccgtcgcctcctggaccaccatcacctccaaatctggcatcaccactaccgtttaggtcaccgcctcgccaacctacaccaccaccgcttaggtcatcggcctcaccaacctacaccaccaccctcccattctcaacagcctgctctcccggctccacaaccagttcaagcctctcccacctccccagctcaacagcatgctcccccgactccgcccttagttcaagcatctccacctacaccccaatctgctctggtagaacaagtgcacataccggaaggtactacatccgaaccgaagtctaatcctttggaacctcgtcgtataattccaaagttgatatcgacatatgacccaaaggagattgacaaggataaggagaagttcatgtttcagctttcaggaattctgagaagagaaaagaacttgctcacgtcatgtcagactcccagaagtcagtactagcagcccaagatgaattgcaatcatggttatctgccgatgtgcctgaaacttatgagtatggcaagccattcttgccaacatatcttatgaacaatctaccctgggaaatgagggcaatgcacgaatggtatatcaaggcatataggaagggtctcggtttcataagcatcgccgtcccggaaggtgctttcatgagattttttttatctctttccgagacctttacgccctctacaagctagataaaatggacgttaatctcgttgcggcattctgtctcatgaagctgatagaactggatcaccggttggatacatcgatccaacaagaatatgcaaaagacaacacaccgtagagctgagagaggactacgagcaattggttggcaagacccctcaagaaaaggaagaatatgtgaagcaattgcacaacaggaagaagctagaagtagcaacatacttagcaatagcaatgttggcgcacgccgacaaagatgtcttaatggtcccctacgcgttgacgaccactacatattattccttgtatatccaaaaaaccaattgatcatatcgttggaccccacacaatatgaaaaggagacctttatggaattcctcactattttgaatttaatagagcacacaagtactaccgcaaaagaggcggaccccagtacatattccatcccagaagcagttacccatcatgactggctggccggtacaaacaaccaccaggaaccaacttgtgcggttattacgtgtgcgcgatgctcagagtaaacgggaggtacaaaacaaccagtaaccaaatccccgaaatcccatatattgcacaacaaatcaacaacggtactacctggaacgtgggcgctgacctctgccgattcctccgtcgtgatgtctgcaacgcaagaggtctcttctacgacaacaagaatgaactcgcaatgaacgacaaatttaaacctctcagagagtgggagaaagaacatatgcaatga

SEQ ID NO: 850 - DNA, 2097 bp, Oryza sativa
atgtcctcctcgccggccgccagccggcgcgccgcagcgattgcccgccacctcgccggcattccggctgccaaattcgcctccctgctcgagccattctcctgcctgggctacgtgccgccggagtccaatgagcagcccccggcgttcgcgctaggcgacctccggaggctgctcgacgggcacgacctgggcgtgcgggactggatgttccgcgtcatggagcagagcacattgttctgcagccggcacgggggccccggacctgcaggcagggtgttcgcatcgccggacttcaacaaggacaaggaggggctgcgggaggcgaagatgaggcggatcgggtacctggcgcggcgcggcgtattccgtggatggctcacagacacggagggcgacgccgaggccgagctccgcaggatcgcgctcctcgactgcattggcgtctacgatcactcgctcgccatcaagatcggcgtccatttcttcctctgcatttctttttgcactccaggggcagcgcaatcaagtttcttggaacaaagcgccaccatgacaaatggttgtcggacacagaaaattatgttatcaagggttgtttttccatgacagaactgggtcatgggagcaatgtccgaggaattgagacagtggctacttatgatattaaaacaagagagtttgtgataaatactccttgtgaatcagcccagaagtactggattggtggagctgctaatcatgctacacatactatagtctttgcgcagctccatataaatgggagaaatgaaggagtccatgcttttgtagctcagattagggatgaacatgaaaatgttatgcctaatatccagatagctgactgtggccataaaattggattaaatggtgttgataatggacgaatttgaatatacgtgttcctcgagagaatttgctgaatcttgttgctgatgttttgccggatgggcaatatgttagcacgatagatgaccctgatcagcagaggtttgcagcatttttatctccacttacacttggtcgagttaatattgcagttaatgcggtttatatttcaaaggttggcgttgcaattgctgtgagatatgctttgtcaaggagagccttttcagttacaccggatggtcctgaaatgctgttacttgattatcccagtcaccagcgacgccttctaccactgctagcaaaagcgtaacctactagctttctctggatttttgtactttgcatatgagcagtgctggtaattttatgaaaaggatgtatgtgaagaggactcctgaacttaacaaatctatacacatttactctagtgctcttaaagctacacttacctggcagaatatgaccacacttcaggagtgccgtgaagcttgtggtggccaaggtttgaagacagagaatcgcataggaattttcaaagctgaatttgatgtccagtctacatttgagggcgacaataatgttctaatgcagcagcaggtaagcaaagccctttatgctgaatttttgacagcaaaaaggaagaatcaaccattcaagggattgggcttggaacacttgaatggtccttgccctgttattcctgattatctgacaagtggcacactaagaagctccagtttccagtgcttgagggagcgagatttactgaaacgattcaccacggaggtttctaactatctggcacaaggagaaaacagagagaaggctttgatgctgagctaccaactcgctgaagacttagctagagcatttactgagcgcacaattttgcaaatatttttggaggatgagaagaatattcctactggttctttaaaggatatattgggcttactaaggtctttatatgttatggtttgcatagacgaatctgcatcctttttgagatatggttgcctatcgcgagagaatgtagccgctgctaggaaagaagtgatgacactgtgcagtgaactcaggccccacgcacttgctattgtcagttccttcggaatcccagatgccttccttagcccactcgcttttgactggattgaggcaaatgcacggtcttctgggaatgaatga

SEQ ID NO: 851 - DNA, 2017 bp, Oryza sativa
  misc_feature (759)..(759): n = any nucleotide
  misc_feature (780)..(780): n = any nucleotide
  misc_feature (791)..(791): n = any nucleotide
  misc_feature (813)..(813): n = any nucleotide
  misc_feature (1253)..(1253): n = any nucleotide
atgctagctggatctgatgaccatcgtgctggtccgaggagaggaagaggccattgtcgccgccgtgtcggggagaagatgaggcggatgccaccacgcgacgcaagggagaggaagaggcagccgcacatggattttgttgtcccgagcttgtggtggccggaaatgatcgtcctcgagttcgtgctagctgaatctagttggccgccacgcaaggctaggagaggaagagtcagttggtagccaaacaaacacacgaaagaatgttaatggcgacatcaccaaaaacagcacaatgtcaagcacactgcccccgcccatccgtccagacaaaattgtgttttcgtctttgtggtttggtgggcctttcgatgaggcatggctgagaggaggagagggcttggtgtcggcgatggtacaatctagccctttccacgtgggccagagccaaggcttatttaatactgggctatagcatcgagtccattaggtccctctatttgtcgcccagtccgactttcgtccctcggtcgcaaaaccgggtcctcgtccaacgtggcattgacgtggcaaatgaatcccggaaaaataataaaaaaacgtgggacccacatgtcagctacacaaaaaattataagaaaagccacatgtcagccccctctccctcccttatagaatggcgagcggcggcgcagagggtgggcggtgggtgcagcggccgggcgacaaggggcagcttgcggcggcgcagaggggggncggtgggatgagcggcgcgtngtgcccgggtnagaggaggggccgctcgcggcngccgggcaaggagcccgccggcagccgcgcaccgccgtttctctctagtgtgggacgggggccagtggcggcggagacccgagagcggcgacggtggcgtgcgggcgagggccggagcggtggcggcggagatcgagaccgccgtggaaggttggccgtcggaaggaagaaaacgggccatcagaacggtcgcgtcctcgccaccctcggccccgcgaccgcactatcctccactgtgctccacgccctctctgccggccacgatgcacccgcctccgctgttctcccgccgcgcccacgaacgtgtaagggccgcctacgtctcgccaccgcgactcgcgtcggcatcccctcgaagatggcggcatctggtggtggcttcttctgcacctgcggcggcggcggcgttgaaggcgggaggagtggcgcaggcgggggangcggcgccgccgccgatggacgcggtcggcgtgccgagccggccgacaacgacgtgaccacacgcgtgttgggaggcatctgcatcacacggcttggagctcgtcgccatactgcgtgtccatagtgtcgttcaccgtggggtataatatccgctgcgagaaggaggagcagcgcgtgcccgtcgaggcggccggagcggacggcgtagctgatcgcctgcgggcggcggcggcgcccgagctgagcttcaccgccgcgaagacgaaggagaccacaacggtggcggtgggaggtacacgcggcggggtacggcgagctcggccgcgccctgctcgacctgcaggtcgccgtcgccacatccgcgtctccgccgcgccgctcgccggctgccgctccacacctgcgcctccgccgctcgggactccgtgcagccgccgccgctcgccgcagtctccgccagccgccgcgacacccggaacatctctcgggttttgaggggagctcggccgccgacgacatctcgatgccggccgtcgggtggtgcggatggtggtggtgcgagaggaacggcgagcggcgcgacatggactctagcctaccgctgccgccgccgcttaaactcccgctggccgccattgcttcagccctcgcccgccgccgctcgctccccgcggacggccgtcaataccgccacatcagcgccacgtcagcgaaaccgccctccaaaaccgccgagggagtcaaattgcaccggtttcaataa

SEQ ID NO: 852 - DNA, 1947 bp, Oryza sativa
  misc_feature (11)..(11): n = any nucleotide
  misc_feature (41)..(41): n = any nucleotide
  misc_feature (61)..(61): n = any nucleotide
  misc_feature (64)..(64): n = any nucleotide
  misc_feature (69)..(69): n = any nucleotide
  misc_feature (628)..(628): n = any nucleotide
  misc_feature (1364)..(1364): n = any nucleotide
  misc_feature (1395)..(1395): n = any nucleotide
atgccgcgttnggcggtcggcctggtcgtcgcgttgttgtngtgcgccgcgctgatcggtngcngcgcnggttcggggcaggacctcgcggcggacacggcggcgctgcttgcgttccgggacgcggtcggcccgcggctgccgtgggcgtcgtcgtcgtcctcgccgtgcgggtggcgcggcgtccggtgcgacgccggcggtgggcgtgtcgtcgcgctgcagctccccggcgcgaagctggtagggagggtgccgacggggacggtgggaaacctgacggcgctgcggacgctgtcgctgcgctccaacgcgctctccggcgggatcccggtggacatcggcaactgcggggagctccgggcactctacctgcagggaaaccagctcgccggcgaggtgccggaggggttcttctcgcttctgttgctacagcggctcgacctctcgcgcaaccgcatcacggggagcatctcgccggagttcaacaagctccggcggctcgccactctctacttggagaacaacggcctcaatggcaccctccccgccgatcttgatctcccgaagcttcaactcttcaacgtgtccaacaacgaccagctcaccggcgccgtgccggcgtcgntcgccgggaagccggcgagcgccttcagtgggacaggactctgcggtggccctctaagcccgtgtacaaacacttcgccgccatcgccgtcgccgtcgccgtcgccgccgattccgccgcctccggcagcttctcaagatagcaagagcagcaagctctccggtggtgcaatcgccggcatcgctgtcggcgccgcggcggcgttgttggtggcgctcgcggtgatcgtcctcctctgtttcaagcgtgggaggagaaaggaagggagaccagccgacgtcgacgaggacgcgtccccggtgtcggtcacggtggcgaggacggacaaggtcgaagtgaagcggtcgcggtcgcgcccgtcgcagcagacgacgacggcgagcggcgccaagaagctggtgttcgtcggcggcgagccggacgtgccctacgacctggacacgctgctgcacgcgtcggccgaggtgctcgggaagggctggctcggcacgacgtaccgcgccacgctcgagggcggcgccgccgtggtggccgtcaagcggctcagggaggcgcccatcgcggagagggagttccgtgacagcgtggccgagctcgccgcgctccgccacgagaacctcgcgccgctccgcgcctacttctacagcagggacgagaagctcctcgtctcggacttcgtcggcgccggagccctctcctccctcctccacggcggcggcggcgccgtgcgccgcgngcgcctcggcttcacgtcgcgggcgcgcatngcgctggcggcggcgcgcggcgtcgcgttcatccacggcgccggctcgtcccacggcaacatcaagtcgtcgaacatcgtcgtcaaccgcacgcacgacggcgcctacgtgaccgaccacggcctcgcccagctcctcggcgccgccgtgccgctgaagcgggtgaccggctaccgcgcgccggaggtgagcgacctgcgcagggcgtcgcgggaggcggacgtgtacagcttcggcgtggtgctcctcgagatgctcacggggaggtcgccggcgaacgcggtgccggggttcgacggcgtcgacctgccgcagtgggtgcgcgcggtggtgcatgaggagtggacggccgaggtgttcgacgccagcatcgccgacgaggcgcacgcggaagaggagatgatgcggctgctaaagctcgccgtcgaatgcaccgagcagcggccggagcggcggcccaccatggccgaggtggcggcgaggatcgagcacatcgtcgacaccgtcatccggaacgccgacgtggacgatttcgacagcgtttctcagtag

SEQ ID NO: 853 - DNA, 1926 bp, Oryza sativa
  misc_feature (1746)..(1746): n = any nucleotide
atgtactcggcgaaccactggggcgggtcgttcgagatcgccgcggacggcgcggcggaggatgaccacagccgcaacatggacctggaccgcggcgcgctgtcggcgcggcagcaccagctggacgagacgcagcagagctggctgctcggcccgccggaggccaagaagaaggacaagtacgtcgacctcggctgcgtcgtcgtcaagcgcaagctcctctggtgggtcctctggaccctcctcgccgccttcatcctcatcggcctccccgtcatcatcgccaagtccatccccaagaagaagccccacgcccttccccccgaccagtacaccgacgccctccacaaggccctcctcttcttcaacgcccagaaatcccttctttctctgacgaacaattttggccatgtctcgttctctgctctgacagccggccggctcccgaagaacaacggcatcaaatggcgcggcaactccggcctgtcggatggctccgatctgacggacgtcaagggcgggctcgtcggcggctactacgacgccggcgacaacatcaagttccatttccccttggccttctccatgacaatgctcagctggtcagtgatcgagtacagcgccaagtacaaggcggtaggggagtatgaccatgtgagggagctcatcaagtggggcaccgactacctgctcctcaccttcaactcctctgcttccaccattgacaaagtctatagccaggtgggcattgcgaagatcaacggcacccagccggacgaccactactgctggaaccggccggaggacatggcgtacccacgccccgtccagacggccggctcggcgccggacctcggcggcgagatggcggcggcgctcgcggcggcctccatcgtgttccgcgacaacgccgcctactccaagaagctcgtgaacggcgcggccgccgtgtacaagttcgcgcgcagcagcggccgccgcaccccgtactcccgcggcaaccagtacatcgagtactactacaactccaccagctactgggacgagtacatgtggagcgcggcgtggatgtactacgccacggggaacaacacctacatcaccttcgccaccgacccgcggctgcccaagaacgccaaggccttctacagcatcctcgacttctccgtcttcagctgggacaacaagctgccgggcgccgagctgctgctgtcgcggctccgcatgttcctcaacccgggttacccctacgaggagtcgctcatcgggtaccacaacaccaccagcatgaacatgtgcacctacttcccgcgcttcggcgccttcaacttcaccaagggtgggctcgcgcagttcaaccacgggaagggccagccgctgcagtacaccgtcgccaactccttcctcgccgcgctctacgccgactacatggagtccgtcaacgtccccggctggtactgcggcccctacttcatgaccgtcgacgatctccgctccttcgccaggtctcaggtgaactacattcttggggataacccgaagaagatgagctacgtggtggggtacggcaagaagtacccgcggcggctgcaccacaggggggcgtcgacgccgcacaacggcatcaagtactcgtgcaccggcgggtacaagtggagggacaccaagggggccgacccgaacgtgctcgtcggcgccatggtcggcgggccggacaagaacgaccagttcaaggacgcgcgcctnacctacgcgcagaacgagccgacgttggtgggcaacgccggcctcgtggccgccctcgtcgccctcaccaacagcggccgcggcgcgggcgtcaccgccgtcgacaagaacaccatgttctccgccgtgccgcccatgttcccggccacgccgccgccgccgtccaagtggaagccgtga

SEQ ID NO: 854 - DNA, 1917 bp, Oryza sativa
atggcggctagccgtgtcgccctgtccgtgccagtcgccgccgccgtcgcgctgctgctgctcgcgctcccccgcgccgcggtgtcgtacccgtgggggttgtgcaacgacacggccggcgaattcccggcgaggaggagcagctaccttgccagtatcaacctcatcgccgccaccctccccggcaacgcctcggcctcgccggacctgttcgccaccgccgagggcgtcggcgcgccgccggaccaggtctccgccctcgcgctctgccgcggcgacgccaacgcctccacctgcctcgcctgcctcacccaggccttcctcgacctccccaacgcctgcgcctaccacaaggtcgccgccatcttctacgactcctgcctgctcgcctactccaacgccaccatcgccgccggcgacttctcctccgagaagatcccgatttacgggttctacagcaacgcgaacgccacgacggagcaggcacggttcaaccgcctcgtggcagcgctggtgaacgccaccgccgactacgcggcgcgcaaatccacgcggcggcggtacgcgtccggggaggccgacttcaacgcggagttccccaaggtgtacagctgggcgcagtgcactccggacctgacgccggcgagctgccggagttgcctcgcgcagatcatagggacatatattgggttttttgagaacagggtcggaggattcgtccgcgcggtctggtgcagcttccagtacagtaccacgccctttctcgacggaccgatgcttgtaaggttacaaggaacgtcaggtgcctcgccggcgccgtcgccggcggccgtggtgcccgcagttaaccagacgccgccggcggcgacgccgacgcttgaaggagatgccaattactccactgaagcagaggacattgagaatttagattcgatgctcatcgacatctccattttgcgatctgcaactggtgattttgcagagagtaacaagctcggtgagggcggatttggtgctgtgtacaagggtgtgctcccggacggctacgagatagcagtgaagagactgtcgaagagctcaacgcaaggggtggaagaactgaagaacgagctggctctggttgcgaagctgaagcacaagaaccttgtcagcctcgtcggcgtctgcttggagcaacaggagcggctgctcgtatacgagtttgttccaaaccggagcctcgacctgatccttttcgatactgagaaaagtgagcagctggactgggagaagaggtacaagatcataaacgggatcgctagaggtctgcaatacctccacgaagattctcagctcaaggtagtccaccgcgatctcaaggcgagcaacatcttgctagacgtgaatatgaaccccaagatttcagactttggcctcgcgagaattttcggtcgagatcagacccaggctgtcaccaagaatgtcatcggcacatatggatacatggctcctgagtacctgacacgtgggaactactctgtcaagtcagacgtattcagcttcggcgtcatggtccttgaaatcgtgacaggtaggaagaacaaccacagctacaactcccaacaatctgaagatctcttgaccatgatctgggagcaatgggtggccgggacggtgctggagatggtcgatccgagcatgaacagcttcttctcggagagcgacgtgatgagatgcatccacattgggctcctctgcgtgcagggtgacccggcgaaccggccggtgatgtcgtcggtggtgctgatgctcggcacggacaccgtcgaactccatgcccccgcgaagccgacgctcttcgccaggaaaggcggcggcgacgaatccggcgtcgcgtccggcggcatgtcaatcgtgtcattggaggagcagtcgtag

SEQ ID NO: 855 - DNA, 1320 bp, Oryza sativa
atggagagtagagggaagatactaatggagaggtatgagttgggcagattgttggggaaaggaacatttggcaaggtgcactatgcaaggaatctggagtcaaaccagagtgtggccataaagatgatggacaaacagcaggtgttgaaggtcgggctttcggagcagatcagacgtgagatcacaaccatgcggttggtggctcataagaacattgttcagcttcatgaggtcatggcaacacggaacaagatctactttgtgatggagtatgtgaaaggtggtgagctatttgaaaaggttgcaaagcgtggaaagcttacagaggttgttgcacataagtacttccagcaactcattagtgcagtggattactgccacagtcgaggtgtgtatcaccgggacttgaagcctgaaaacctgctgttggatgagaatgagaacctgaaagtctcagactttggactgagtgcgctttcagagtcgaagaggcaagatggcttactccataccacctgtggaacacctgcatatgtagctccagaggtgatcagcaagataggatatgatggtgcaaagtcagatatttggtcttgtggtgttatcctgtttgttcttgttgctggttaccttcctttccagggcccaaacttgatggaaatgtatcggaagatacaacatggtgaattcaggtgccccggttggttttcacgcaaacttcagaagttgttgtacaagatcatggaccccaacccaagcacaaggatttcaatccagaagataaaggagtctacctggttccggaaaggtcctgaggagaatcgtattttgaaggaaagaactttgaatgaaaacaccaccaaaaatgttgctctggtgcttggtgtgagacgcaagaaaaatgctcatgaagatgtgaagcccatgtcagtgacaaacttaaatgcctttgaaattatctctttctccaaggggtttgatctctctggcatgttcattgtaaaggaatggagaaatgaggcaaggttcacttcagataaatctgcctcaaccataatctcaaagctagaagatgtagcaaaggcgctaaatctcagggtaaggaagaaagacaatggtgtagtgaagatgcaagggaggaaggagggaaggaatggtgttcttcagtttgacatagagatatttgaggttaccacttcctatcatatcatcgagatgaaacaaacaagtggcgattcattggagtaccgacagctactggaggagggcatccggccagctctgaaggacattgtcttggcctggcatggagatgaatag

SEQ ID NO: 856 - DNA, 1141 bp, Oryza sativa
tctttatcctagggtatcaagggactgcgtgatgagattgctgctgggattgcctcccgtgatggtttccctgcaaatgcagatgatatattcctaactaatggagcaagtcctggtgtatgtcctaccttggtacacatgatgatgcagttgctgataaggaacaacagagatggcattatgtgtccaattcctcaatactcattgtactcagcatccctagcacttcatggcggagctcttgtatgtgccatattatcttgatgaatcctcaggatggggtttggaggtttctaagcttaagaatcaacttgaagatgccaggtcaaaaggcataactgttagggcgttggtggtgatcaatcctggaaatcctactggacagcaatatgagctagtaaagttctgcaaggacgaggaacttgttcttctggcggatgaggtataccaagagaacatttatgttaccaacaagaagatcaactctttcaagaagatagcaagatccatgggatacaatggagacgatttacaattagtatcattgcattctgtttctaaagggatattacggagagtgtggcaagagaggcggttacatggaggtcactggcttcagcactccagttagagaacaactctacaaaattgcatctgttaacttgtgttcaaatatcaccggccagatccttgcgagcctcataatggatccaccaaaggtgcaataacatatctgtccttacacgaaatgctggggacgcatcttatgacctctacgaggaagagaaagacaacatcctaaaatctttatctcgtcgtgcaaaggagtctgcatttaacagtattgatggaattacatgcaacaagacggaaggggcgatgtatctgttcccacggatttatctaccacagaaggcaattgaggctgccagggctgtcaacaaagcacctgatgtattctacgctctacgtcttcttgataccaccggcatcgttgtgactcctggatctggttttggacaaggttgcagggacatggcacgtgagatgcacgatcctgccgcaggaggagaagataccttcgatgatctcccgcttcagggaattccatgaggagttcatgtcacagtatcgcgactga

SEQ ID NO: 857 - DNA, 1120 bp, Oryza sativa
tccaagtttactcagcaggagctcccagcttgcaagccgattcttactccaaaatgggtcatttcagttttcgttcttgtcggagtcatttttgtcccaatcgggcttgtttcgttgaaggcttcacgaaaggttgttgagattgttgatcgatacgatgatgcatgtgtcccagctaatacaactgacaagcttgcttacatccagaacccaacaataagcaaaaactgcagaaggactcttaagccaatctttgtgtattaccagctggataacttttatcagaatcataggaggtatgcaaatatactttctgatgtcacaagtatttcaactatcagtacaaataaacccttggatgggatatatgtccagtttatgcagcagttctgttgaaatggagatatgtcaagagccggagtgatgcacagctaagagatcccaaaaaggcaaatgacacctccacttgtgatcccgagggtacagcaaatggaatggcaattgttccttgtggtctgattgcatggagcatattcaatgatacatatggctttgttcgcaacagtaagaacctgccagtggacaagaaaaacatctcttggaagagtgacagggagcacaaatttggacgtgatgtctttccaaagaacttccagaatggttctcttataggtggaaaaacacttgatccaaataaatcgttgagtaaacaagaagaccttattgtttggatgagaactgctgcacttccaacattcagaaagctgtatggtaggatacacactgacctcaagaaaggtgacaccattacggtgacattggagaacaactacaacacatatagctttagtggcaaaaagaagttggtactttctacctcgacatggctcggtggaaagaatgattttcttggtctagcatatctcagtgttggtggactctgcttcttcctggcatttgcattcaccttgctgtacttgataaaaccaagggtgacaacaactacttgtcatggaacagaaaccctgcaggccgttaataagctcttcaaacttttaagttgcaaattcaacatgaagcaagttggattatggattcaaatgtatcttgtactagatag

SEQ ID NO: 858 - DNA, 1098 bp, Oryza sativa
atggcggcttcaatgaattcgaagcttcccctggctcttgtgctcctcctgctgtgcggcggcgcatgcgtagcggtagccatgcccagtgaattgtccatagttggctactcggaggaggatctggcgtcgcatgagaggctgatggagctgttcgagaagttcatggccaagtaccgcaaggcctactccagcttggaggagaagctgaggaggttcgaggtgttcaaggacaacctcaaccacatcgacgaggagaacaagaagatcaccggctactggctgggcctcaacgagttcgccgacctcacccacgacgagttcaaggctgcctacctcggcctcaccctcactccggcgaggaggaacagcaacgatcagttgttcaggtacgaggaggtggaggcggcaagtttgccgaaggaggtggactggaggaagaagggggcggtgacggaggtgaagaaccaggggcagtgcggcagctgctgggcgttctcgacggtggcggcggtggaggggatcaacgccatcgtgaccggcaacctgacgcgcctgtcggagcaggagctcatcgactgcgacaccgacggcaacaacggctgcagcggcggcctcatggactacgccttctcctacatcgccgccaacggcggcctccacaccgaggagtcctacccgtacctgatggaggaaggcacctgccgccgcggcagcacggagggggacgacgacggcgaggcggcggcggcggtgaccatctccgggtacgaggacgtgccgaggaacaacgagcaggccctgctcaaggccctggcccaccagcccgtcagcgtcgccatcgaggcctcaggcaggaacttccagttctacagcgggggtgtgtttgatggtccgtgcggcacgcggctggatcatggcgtgacggccgttggatacgggacggccagcaagggacacgattacatcatcgtgaagaactcgtggggatcgcattggggtgagaaggggtacatccggatgaggaggggcaccggcaagcacgacggcctctgcggcatcaacaagatggcctcctacccaaccaagaacgcttaa

SEQ ID NO: 859 - DNA, 1030 bp, Oryza sativa
atggcggcgcgtggtgcttgcgatcctcctggtcctggcgcctccctgcgccgcctcgtcctgctgctcgctctgtcggtgtcggcgctcgccgcggcggacgcatccggggtgttcgaagtgcagcgcaagttcacgcgccacggggacggcggggagggacacctctcggcgctccgggagcacgacggacgccgccacggccgcctcctcgccgccatcgacctccccctcggcggcagcggcctcgccaccgagaccggattgggatcggcacgccggcgaagcgctactacgtgcaggtggacaccggcagcgacatcctctgggtcaactgcgtctcctgcgacggctgcccgcgcaagagcaacctcgggttgcagattgagctgacgatgtacgacccgagggggtcccaaagcggggagctggtgacctgcgaccagcagttctgcgtcgccaactacggcggcgtgctgccgtcgtgcacctccacgtcgccgtgcgagtacagcatctcgtacggggacgggagctccacggccgggttcttcgtcaccgacttcctgcagtacaaccaggtctccggcgatggccagaccacgccggccaatgccagcgtctcattcgggtgatttgcaggtgtggtgctaagctgggtggggatttggggtcgtcaaacctggcactcgatgggattcttggatttggtcagtcgaactcgtcgatgctgtcacagctcgccgccgcgggaaaagttcggaagatgtttgcgcattgcttggacactgtaaatggtggggggattttcgctatcgggaacgtggtgcagccgaaagtgaagacaacaccgttggtgcccgacatccacactataatgtcatcttgaaaggaattgatgttggtggtaccgcactaggacttccaacaaatattttcgattcaggtaacagtaaaggtaccatcattgatagtgggacaacattggctgcttccaatattctggaaggtcgatgatggatttcctgaa

SEQ ID NO: 860 - DNA, 1003 bp, Oryza sativa
atggcgggggatggtgtggactgggagagcgtggcggaggccacgtccggggcggtgggcgcgctcgtcagcaccaccgtgctctacccgctcgacacctgcaagaccaagttccaggccgagctccagacgcagccgggcgcgcacaagtacagaggaatctttcagatgtcttttgggaagctgttcagaaaagacaaattctatccctatatcagggccttaagacaaagaacatccaatctttcatttcacaattcgtttacttttatggctatagctactttaaaagactctacttggagaagagtggagcaaagtctatcggcacaaaagcgaacttgttagttgcagctgctgctggtgcttgcacagttgttgttactcagcagccactagatacagcatcttctagaatgcaaacaagtgcctttggaaagtccaaagggctgcgggcaactcttgccgaaggcacttggcttgaggcatttgatggcttgggaatttctcttatactaacgtgtaatccttctattcagcagtatactgtatttgatcagctcaagcagaagctaattcagagacagagacgtaaaaatgcagaagcagggggtggttcttcaccagttgctctttctgctttctcagcatttctccttggtgccatctcaaaaagtgttgctacaatattaacctacccactaatcagaggtgcaaggtcatgattcaggctgcagaccctgatgaggatgatgacgatgaatctgaaaggccaggaaaatcaaaatctcccaaaacaatgttgggcgctttgcatgccatgtggagcaaggaaggcatcccaggcttcttcaaaggattacatgctcagatactcaagactgtcctgagttctgcattgctgctgatgataaaggagaagatttcaagatttacttggatttcactgcttgccctgcggcgatatctctttgtttctcagaagagaatcaagagtgcataa

SEQ ID NO: 861 - DNA, 1002 bp, Oryza sativa
  misc_feature (196)..(196): n = any nucleotide
atggctcggtcggcgctcgacgaggtcaccgacgccggcgccttcgaccggtcgccgtccaccttccggagctctatctccagggacagctccgcccggttccccgccgtgccggggaggtaccacctctacgtctcctacgcgtgcccctgggcgtcacgctgcctcgcctacctcaagctcaagggcctcgacnacgccatcggcttcaccaggaccagggagacggacgaccatcttgggtgggtttttccggccaccggagacgaagagcccggcgcagacccggatcctttcaacggagccaagaccatcagggagctatatgagattgccagcccaaattacatcgggaaaccaactgttccgctgtgggacaagcagctcaagactgtggtgaacaatgagagctcagagatcatccgaatgctcaacactgagttcaacgagatcgcaaagaatcctgacctggatctctatcctgctcatttgcaaacctccgtcaatgagatcaatgagttggtatacgatgcgataaacaacggcgtgtacaaatgtggctttgccaagaaacaggggccatatgatgaggctgtcacgagattatatgaggctctggacaaatgtgaggaaattctaagcaggcaacgttatatatgtggcaaccagttgacagaggctgatgttcgcttgtttgtaactcttataagatttgatgaggtttatgctgtccacttcaaatgcaacaaaaggctcctcagggaataccccaatctgttcaattacaccaaggacatctaccagattcctggcatcagcagcacggttaacatggagcacataagaaagcactactatggaagccatccgtccataaatccctacgggatcatccctgcaggccctaacatcgattacaacgctccacacgacagagagaggtttagtgcctaggagaagataagtagtactccctccgtttcacaatgtaagtcattctag

SEQ ID NO: 862 - DNA, 977 bp, Oryza sativa
gttagaaaacggacatagtggtgcagtcatggcttctaactcttcagatagatctgacagatctgacaaacttatggaccaaaagcggcggcttgctcaaaatcgtgaggcagcaagaaaaagtcggctgaggaaaaagaaggcatatgtgcaacaactagagagcagtaagctgaagcttgcacagctagagcaggaacttcagaaagctcgtcagcagcagggaatcttcatctctagctctggagaccagacccatgccatgagtggaaatgggggcattgacttttgacttagaatacactagatggctcgaggagcaaaataagcagataaatgagttgaggacagcagtgaatgctcatgcaagtgacagtgaccttcgtcttattgttgatggcataatggcgcattatgacgaggtattcaaggttaagggtgtagctgcaaaggccgatgtgtttcatatactttcaggcatgtggaagacacccgcagaaagatgcttcctgtggcttggtggtttccgtccatctgagcttctaaagctcctagcaaatcacctcgaacctttaaccgagcagcagttgctgggattaaacaacctccaggaatcttctcagcaggcggaggatgcactttcacaaggtatggaagcactgcagcaatctctggcagatactttggctggatctctcggttcatcagggtcttctgggaatgtggcgaactacatgggtcagatggcaatggccatgggtaaactaggaacgctcgagaatttcctttgccagcaggcggacaacctgcgacagcagacattgcatcaaatgcaacgaattctgacgatccggcaagcctcgcgtgctcttcttgccatacacgattacttttcacgcttgcgtgctttgagttcgctgtggcttgctaggccacgggagtaacaaaatggtcatgtgtgcctgtgacgaggttag

SEQ ID NO: 863 - DNA, 964 bp, Oryza sativa
atgtattgttttaaggcaagcacttttagcacagtcaaggtgagcaatgtgtcactgaaagcatcactgcgagatgtaaaggaattcttttccttttctggtgacattgtgcatgttgaaatgcaaagagcagtgatgagctgtctcaagttgcctacattacttttaaagacaatcaaggatctgagacggctatgcttcttacggtattctttctcacatcaatggaaatttgttgtcccagggtgccacaatagttgatatggctgtcattgtcacgccagctaccgattatgagctaccagcttctgttttagctgctctagagaaggcagaggacattgttgggaccatgctggccaagggattcattttaggtagggatgcactggacagagcaaaagccttggatgagaagcatcaactcacatcaactgcaactgctagagtatcttcctttgacaagaaaatgggtttaagcgagaagatcagtgttggcacttcggctgtaaatgataaagtgaaggaaatggatcagaaataccaagtctctgagaagacaaggtcagcactggcagctgctgaacagagtgtctctactgctggatctgccatcatgaagaacaggtatgtccttactggagcagcatgggtaactggtgctttcaataaggttgccaatgctgcaaatgatgttggcacaaaagcaaaggaaaaaatagcatctgagcaggagcacaagactgtagagcttgagtctgcagaacctaacagctcagaaggccatggaacacaaaaggatgtggatggtgaattcgccaagatacaggtctctgaatcccctgaagatattcccatctctacgactgcaaccgtccccattactgatgaggattccagtcaggcgtctccacctgccgcctctcccaaaaagccagaacctgcgcaggggttgatactatga

SEQ ID NO: 864 - DNA, 963 bp, Oryza sativa
  misc_feature (49)..(49): n = any nucleotide
tccatcaggactaagggccggggaagctctacactcccctcaatcgcgnaaccggagccgcttcctcggtacaacaagcattggagacgaaaggcacactcaatgtgtgtctgcaccatgcttcgcaaccaagcacggttcctgcgggaatggatcatctatcactcacgtattggtgtgcagcggtggttcatctatgacaacaacagcgacgatggcattgaggaggtcctcaacaccatggattcatccaggtacaatgtgacacgctatttatggccatggatgaaatctcaggaggctggatttgcacattgtgcactcagggctcgagagagctgtgagtgggtggggttcattgacatagatgagttcctgcacttccctggcaaccaaacactacaagatgtcctccgaaattactctgtcaagccacggatcggtgagctcaggactgcatgccatagttttggtccatcaggccggactaagatcccaaagaaaggtgttacaacaggctacacctgccggctggctgcacctgagcgccataagtcaattgtcaggccagacgcattgaacccatccctcatcaatgtggtgcaccacttccatctgaaggaagggatgaaatatgtgaacattggtcagggtatgatgctgatcaaccactacaaataccaagtctgggaggtgttcaaggataagttctccggacgtgtcgcgacatatgttgctgattggcaggacgaggagaatgttggatcaagggacagggctcctgggcttgggaccaaaccggttgaaccagaggattggccgagacgtttctgtgaagtatatgataacggtttgaaagattttgttcagaaagttttcacagacccacacactggaaatcttccatggtagattggtaaacactgtatttggtcttgcacagcacggcaccacaatacatga

SEQ ID NO: 865 - DNA, 916 bp, Oryza sativa
atggctgctgccgcggcaaggtgggccccggtcgtcggcctattgggcctcctgctgctcccgttcgcgcctgctccggcgggagccgcaacgcccgcgaggtcgccgccgtcgtcggcctcctccgccgtgttcctcctcagcggcgatgtctaccccaccgggttactatgaacattggggacccagcgaagccgtacttcctggatgtcgacaccggcagcgacctcacctggctgcagtgtgacgctccctgcccgtgtgcaaattcaatctgtactgcgttgcacagtggatctagccctaataagaagtgcaccacacaacaacaatgtgattatcaaattaagtacaccgacaaggcatcttctctcggtgtgcttgttatggacagtttctcactgcccctgaggaacaaatccaattgtggatatgaccaacaagtggggaaaaatggtgcagcaccagcaacaacagacggcttgcttgggcttggtaggggatcagttagcttgctctcacagctcaagcagcaagggatcaccaagaatgtactcggccattgtctcagcaccagcggagggggattcctcttctttggggatgatatggttcccacttcacgctttgacagtggtagcacatatacatacttttctgcgcagccataccaagcaactatttctgcgcttcctctgtgctggaaagggcagaaggcattcaaatctgtttctgatgttaagaaggacttcaaaaaaatgggaatgtgtgcttgggcatccttgatggatctgctgctaaggacattacaatgcaggatcagatggtgatatatgataacgagaaagcacagcttggttggatccgtggatcatgtagtaggagccccaagtctattatgtcttcctttccatga

SEQ ID NO: 866 - DNA, 879 bp, Oryza sativa
cttcaggcactttatcattgcatcccttttcgggagcagttgctggaatattatgcaacttacaaaaacacagaagactccgaggacaatttgttgacttgtctggctgatcttttttcacagaagaaaaggactggtgttcttgcaccaaaacgttttgttcaaagagtgaggaaacagaatgaattgttcagaagttatatgcaccaggatgcccatgagttctggaatttcttagtgaatgatattattgatattcttgaatacattggtgcacaggacttttcagcagggtattttgaccaatgaaaccaaatgcctaatgtgtgatactatcacagcaaaagatgagacgttttttgatttgagcattgacgtggaacagaatagttcgctcacaagctgcctgaagagcttcttttccactgagattttaaatggcgaggataagttcttttgtgacaaatgcagcagagtttgcaagaagcacacaagagaatgaagataaagaaggcgccacacgtattggtgatccacctgaagcgcttcaagtacgttgagcagcttagccggcacaagaaactgtcgtaccgagtggtatatcccctggagctgaagctgggcagcatgtctgaagacgctgactgcgagtactccctctttgcggttgtagtccatgttgggagcagccccaaccatggacactacgtaagccaaattaaaagccatggtaactggctttctttcgacgatgacaccgtccagatcagcgaggaatccaccctgcaaacattctatggctcttctcgggagcattgtggtggcaacacagatcatggctatatcttgttctatgagcgccttggtgggaagagctag

SEQ ID NO: 867 - DNA, 770 bp, Oryza sativa
gaagaacaaactgacccttacaagattccaacaaagcacaacataaggatggccatgtattggcttgtacaaggttgccagcctggagactcattggtattccattattctggtcacggagcacaacaaagaaactacagcggagatgaagttgatggaatggatgaaaccctctgcccattggattttgagacacagggaatgattgtggatgatgaaataaatactgctcttgtcagaccacttactcctggagttaaacttcatgcactgatagatgcttgtcacagtgggactgcacttgatttgcctttcctctgcagaatgaacagacaggagtgggcaatatgtatgggaagatcatcgacctcgatctggtgtctggaagggcactagtggcggcgagtgtatttcatttagtggttgtgacgatgatcagacatctgcagatacttcagctttgtcaaagatcacttcaactggcgctatgacattttgctttatccaagcaattgagcgtgggcagggcaccacctatgggagtatcctgacctccatgcgttcgacaatacgcagtacaggtgattcaatgggcagcggaggtggtgctgtaacatcgctaatcacaatgcttcttacaggaggcagcgttagtagtggcggcttgaagcagtgcaggatccacagctaactgcaaacgagccattcgatgtgtatgcgaagcccttttctctatgacacgatcctggtattctccaccgcgtctatga

SEQ ID NO: 868 - DNA, 732 bp, Oryza sativa
atggcggctgctggtgaagaagcttcaggaggcggggacaagtaccggtcgttcatgtacggcgagggggagaaggacaccgtgtggaggcttggatcccctccaaactacgacgtcgtcaacaagctcttcgaggaagagagaaccaagaggaatggccagaggggtctctggaggagaaggtccagagattgctgaagacctgggagatggagctcgtccacaaggtgcgaccagaggaccagaagagtgtccactcgcagaaattctgctccagcaccaatggggatgaggtttctgaatcggaaggatttgatggccatcggcagctacaacgcgttcttgcagacgaagctgccaccggagcaccgcatctacgacccggacaaggagacgctggagtccggcatggccaccttcctgacggcgttcccgcgtggcttcgccatcgaggtgctcgacgtctacagtggcccaccacggatcgtcttcaagtttcggcactgggggcacatggagggccccttcatggagcacccgccccatggcgagcgggttgagtttttcggcatttgcattttccatcattaggttgacgaggagatgaaggttgagaaggcggaattcttctacgaacgcggcaatttcctcgcgagcttcttgagcgcgcctgctgctgctgctactgatgctgcgtcaggctcaggatgccctgtcatgggaggaaattaa

SEQ ID NO: 869 - DNA, 687 bp, Oryza sativa
ctcatgacctcaactgtcggtaaatcaacaaacatccgatggcatgactgcccagtaaaccagcttgacagacaaaagttgctgaaccagaagggctgtgttgtttggatcactggcctaagtggttcagtcaacttcaggaaaaagcacccttgcatgtgcactgagccgtgagctgcactcaagagggcatctgacctatgttcttgacggcgacaatctccggcacggcctgaacaaagatctcagcttcaaagccaaggatcgtgccgaaaatatacgcagagttgggagaagtggcaaagctgtttgcagatgctggattgatctgcattactagtttgatatcaccctataagagtgatcgaagcgcctgccgcaaattactacccaattcttcgttcattgaggtgttcctgaatgtcccacttgaagtatgtgaagaaagggatccaaaaggcctgtacaagcttgctcgtgccggcaaaatcaaagggctttacgggaatagatgatccttatgaaacaccttcagattgtgagggggactgcccttcacctaaatcaatggctgatcaagtagtgtcatatcttgaagccaatggattctttcagaactagagagttgaatgattgtgaatttgtccatgtacctccagatgctgtagcaaagtcaggcccttttga

SEQ ID NO: 870 - DNA, 654 bp, Oryza sativa
atggcaggccttgatttgggcaccagctacctccaccaccaccaatcactgcatctccgccacgacgatggcggcgccggctccgacgacggcggccacgacgacctctcgccggggagcggcggtggcggcgggcccagcagcacggccggtggcgccgggatcggcggcggcgaggtcgtcgctcgccgcccccgcggccgcccgccgggctccaagaacaagcccaagccgccggtgatcatcaccagggagagcgccaacgcgctcagggcgcatatcctcgaggtagccgccggttgcgatgtgttcgaggcgctgacggcgtacgcgcgccgccggcagcgcggggtgtgcgtgctctcggcggcggggacagtggcgaacgtcacgctccggcagccgcagtcggcgcagcccgggccggcctcgccggcgacgctgcacggcaggttcgagatactctccctcgcgggctccttcctggccccggcccgcgccgccgggcgccaaccagccttcgccgcgttcctcgccggcgggcaggggcaggtcgtcggtggcagcgtcgccggcgcgctcatcgcggcggggcccgtcgtcgtcgtcgccgcgtcgttcagcaacgtggcgtacgagaggctgccgctcgag

SEQ ID NO: 871 - DNA, 644 bp, Oryza sativa
gcgcggagcatctcgcagctcgtcaagaccaacggccgccgcgccttcctcgtcgacaccctcgccctggtgaggaagctggagtcgcagggcgtgcccacgaagcaggcggaggcgatcacctccgcgatcacggaggtcctcaacgacagcctcgagagcatctccgagtccttcgtctccaaggccgagatgcagaagggctgagatgctgcaggagtccaatatctccaagttcaagtcgcaagtgcagagctcgcagaaccatttctctttgttgcagcgtgagactgagaaactccgtggagatattgataagatgaggagtgaactgaaaggtatgagattgacaaggtcactgcaggtcagcggctggatctaaaccttgaaagaggaggcgcatccgtgatgaactcgccaagcagaatgaggaaactacagaactcaccacaaagctagacaaggaaattcactcactgaaagcccagctcgaggcagcaaagtatgatgtcatcaagtactgcataggtaccattgtttcgatatcagctgttggactcgccgtgctccgcattgtgatgtgaagcacagatacgttctttcctttacccattcatccatggaaactgcaagaaagaggatag

SEQ ID NO: 872 - DNA, 617 bp, Oryza sativa
atggagctttccttgatagggcttcaaaatgctgggaaaacatcgcttgtgaatgtcattgctgtaggattcaacatgagaaaggtgaccaaaggtaatgtcacaataaaattgtgggatcttggaggccagccaagattccgtagcatgtgggagagatactgtcgtgcagtttctgcaattgttatgttgtggatgcagccgatcgagagaacatggctattgccaaaagcgagctccatgatcttctgagcaagccttctttgactgggatcccattactagtcattggcaataaaattgacaaacctgaagctttccctaagcaaagcttcacagacgtaatgtaagtacacgctaagctattacagaccgataaggttttcttacgcacaaacctgtgttcgacaagttatatgtgacattgcagggggctaaagacaatcactgaccgagaagtggcatgcttcatgatatcatgcaagaactcgacaaacattgactctgtcatcgactggctcgtgaagcactcaaaaaagaagaattgatctaaatttttagcttttgaagtacgcagattctctctttttgcatgttgcgtagcacttggcctgtaa

SEQ ID NO: 873 - DNA, 609 bp, Oryza sativa
  misc_feature (75)..(75): n = any nucleotide
  misc_feature (84)..(84): n = any nucleotide
atgggagtgctccgggcggcggtgcccctgcaggcggacgccgacctcgtcctggctaccggcggcggcggcgancgggggcangtggtggggctcgtcctcgtcgacgtctccaacgggttctgcaccgtcggcgccgggaacatggtggatgaggccgctaggctcgccaaggtgttctgcgagaggaactggccagtctttgcgtttcttgacacccactaccctgataagcccgagccgcctttcccgccacactgtataattggttctggcgaggctctggagtggctggaaaaggatccaaatgtaacgatcaggaggaaggattgtattgatggttatcttggtgcatttgagaaagatggctcaaatgttttttcagattgggttgcgaagtttcagatcaaaaccgttttaggaatatgcacagacttttgtgttttggattttgcaagttcagctttggctgccaggaacattggccgagtgcctccgctggaagatgttgtcatttattcagagggttgtgctacgtataacctcccagttgaagtagccaggagtatgcaaggaaccttggctcatcctcaggtattggatcactga

SEQ ID NO: 874 - DNA, 450 bp, Oryza sativa
atggcaagcaaaaggattcagaaggaactcatggatttgcggaaggatccaccaacatcatgcagtgctgggcctgcaggagaggatttattccattggcaggccacaatcatgggccctagcgacagcccctacgctggtggggtgttctttgttaacatccatttcccccctgactacccttttaagcctccaaaagtgaacttccaaacaaagcaggtgtatcacccaaacatcaactccaatggaagcatttgccttgacatcctcaaggagcagtggagcccagcattgaccatatcaaaggtcctcctatccatcagctctcttctcactgaccccaacccagatgatccccttgtcccagagatcgcccacgtctacaagagccagaggccacgttatgaggagacggcgagggcctggacccagaaatacgcaatgggttag

SEQ ID NO: 875 - DNA, 436 bp, Oryza sativa
  misc_feature (121)..(121): n = any nucleotide
atggcggcggcggcggcggcggcgaagaggaagccggtgttcgtcaaggtggaccagctcaagcccggcacgggcggccacacgctcgtcgccaaggtgctcagctccaagaccgtggtcnagaagcgcgccgaaacgcgagcgggcccggcggcgcgtcccacgaggatcgccgagtgcctcatcggcgacgagaccggctgcatcctgttcaccgcccgcaacgagcaggtgtattctatttacagttgacctgatgaaggctgacagcactgttattatccgcaatgcaaaaattgatatgttcaaaggatcaatgaggcttgctgtggacaaatggggccgcattgaagtgactgaaccggcaagtttcaacgtaaaggaggataacaatctctcacttgtggagtatgaacttgtcaatgttgaagggtga

SEQ ID NO: 876 - DNA, 320 bp, Oryza sativa
atgggcaagacatgggcgatcatcacccacctcaactccattgctggccaagcatcacgcttctctatccgcttacgcgtccatctgcgcgatggagagcccgaccaaggttgacgacgagcagtggctggcctactggatcctctactccttcatcaccctcctggagatggtcgccgagcctgtcctctactgggattccggtgtggtatccggtgaaggtgctgttcgtggcgtggctggtgctcccgcagttcaagggcgcctccttcatctacaagaagctcgtcagggagcagctcaggaagtaccgcgccagg

SEQ ID NO: 877 - DNA, 1203 bp, Oryza sativa
atgcagaaaagacagtgcaaaagcagtggtgtcatgtgtgtgccatgtgatgtaaagcaccagctcttatatagcttcaaaagcgtgaagattctttgtcaaacagcaaggatagttcaggttggtgctaaagccttcaggcagctgctaaatcgaacgcgacgccgcacccaccgcgcccaattcaccgccgagatctcaaccccataccccatggggatctcccacccgctgtccgacgacttcgacgcttctcccgtgctctcgccgccgccgccgccgtcctcatgctgcccccccgcccacgacgaccactaccttgagcatcagatatctgacatcaagagggcaaacagtttgatgactgacagccagatgttcgcacacaaaatgttgctcatacctctaccaggaagacccatgccatcctctgtaaggctcaatggttctggtcagaaaatgaagagagcgtgggctccaaacaatcagcaaaacagagatgttacggattcgctagactcatccaactacaattcttctaagcagcaaatgtcactcgccatgagcaccttgcagtcctattatggtctaactcctcaaaatggggctatgacagatgctggcactgagatgtccttgtacagtaagggcagtttggagcgtatcaacagtgaaacattggtcacttcatctagattaccagacacacataataccgacagaagtaggaactctgaagacacgtcgaatggcttttcagcaacaaacggtgccagtggggccaagatcaatgggacagccaaagcaaagcaagatggttccattcgtcggcggcaaaaagttgaagctgatcaagtgtctaacaccacagatacccaggacgatgtttttacagacccaattaagatgaccaagagtttgttgccaaggccaatttctagtatccgacaaaacatggacacaagcaacccagagtccagcctgaagagcaatggttcatttctgagcggatttagatcagtgcggaagtcgcctagcacaccaaactttgcagatgcagagaatgggatctctatgtggtcaagctcggcatggactttcaaccatgagtcgttcacgcgaccattgcttgatggccttccgaaacccacagcacctagggaggaccaaagctgctttggattgagctgcctgtggctgtag

SEQ ID NO: 878 - DNA, 693 bp, Oryza sativa
  misc_feature (60)..(60): n = any nucleotide
  misc_feature (111)..(111): n = any nucleotide
atgctcctcgtcagatcccaccacctcctcctccaccgccaccaccacgccgcccgcctntccccgcgcctccaccgcctcctcctccgccacccgccgccgctcccccgngccgcctccgcggccagtaggctccgcccgccacgcatgtcgtcggcctcctcctccaacgccagctcccccgccccctcgccgcctccccccgtggtgcccaagtcaaagatacgcttttgcccatcttgtggaagcccgacgaaactggctattccagatggagatgaaaagatgagggctgtctgctcttcttgtggaagagttcactatgagaaccccaaaatggttggagagtctgcagcggaaggagcctcccgggaaacattggaggaagcttgtgcagatgtagagatactttcaccttttgctcagttggatattccactgattggccaaacccccaacttctcacctggacctgaatcgctagaatgtgcactttttgccttggatgacataccatttgattctctagcattttcttcgatcattgtcaccttgaggatgtatcttgaagatgtcaagtccggaaatatcaaattccactactgcactataaacaaaaggtacgaccactacccacttgtcattaccatgtctgacaatcctgatggctattgcaacttgcaagtttgctaa

SEQ ID NO: 879 - DNA, 357 bp, Oryza sativa
gacctagcgggtggtaattggtggttgcaagtgcaaggcaaatatgtgggttactggccatcgtccatcttcacccacttgcagacaggcgttgctgacactgtggaatggggcggggaggtgaattcgcctcgaagtaccacacccatgggcagtggacatttccctaaagaaggattcggcaaggccacctacagcaaagcaatccaagttgttgattcctccaacaaacttaaatcaccaaatggtgtgagcttgatagctccgctacccaattactataacgtcatgactggttcctctagtaccacaagctggggcacttacatctactatggcggatctggatgcccttga

SEQ ID NO: 880 - DNA, 351 bp, Oryza sativa
atgcaccgggcaacaagaaggggatatacgggcgatccgccaacaaaggtactagagagagagaacgccgatgcgcacaaggatcaagtcaagggcttaaacggcagaatcagtaaattaaacgacacaataaaagagttaaacgacacgatcgaggcgctggagaggcaggttcagaacctgaccaggtacaaggaagagaagcagaagcagcacgcgaatcttcagaaagaattcgcagagctggagaggaaatacagagacctggatgcagcccacaggaattgcggccccactgtcagattccctgttttcaccgtcggacaaccctactatcaccgccacaattga

SEQ ID NO: 881 - DNA, 3582 bp, Oryza sativa
  misc_feature (294)..(294): n = any nucleotide
atgggtaatcaccgcttgctgctgctcctcctcctcctgctcgcggtcgttggctctgatcatgggggcgtgctcgccgccgacgagttcacctacaacggcttcggcggtgccaacctcacgctcgacggcatggccgccgtggcgcccaacggcctcctcgtgctcagcaacggcacgaaccagatggccgggcacgcgttccacccgacgccgatccgcctgcggggcggcgcggcgggcggcgccgtccagtccttctcggccgcgttcgtcttcgccatcgtgtccaanttcaccgtgctgagcgacaacggcatggcgttcgtggtcgcgcccagcacgcggctctccaccttcaacgccggccagtacctcggcatcctcaacgtcaccgacaacggcaacgccgataacaacatcttcgccgtcgagctcgacaccatgctcaacccggagttccaggacatgaacagcaaccacatcggcgtcgacatcaacagcatgaagtccgtgcagaaccacagcgccggctactacgacgaagccacgggggccttcaacaatctgagcttgatcagccgccagccgatgcaggtgtgggtggactacgacggcgccaccacggtgctcaacgtgacgatggcgccgctcgacgttcccaagcccagtaagcccctcatctccgcgcccgtcaacctctcgtccgtcgtgaccgacacggcgtacgtcgggttctcggcggccacgggcgtcatctacacgcggcactacgttctcggctggagcttctcccagaacggcgccgctccttctctccacacctcaagcctcccggcgctgccgcggttcgggccgaagccccgttccaaggtgctggagatcgtgctcccgatcgccaccgcggcgttcgtcctcgcgctggtcatcgccgccttcctgttcgtccggaggcgggtgaggtacgccgaggtgcgggaggactgggaggtggagttcggaccgcaccgcttctcctacaaggagctctaccaggcgacaaaggggttcaagaacaagcagctgctcggcaccggcggattcggcagggtgtacaagggcgtgctcgcgaaatccaacctcgagatcgccgtgaagagggtgtcgcacgactcgaagcaagggatgaaggagttcatcgcggaggtcgtcagcatcggccacctccggcaccgcaacctcgtgcagctgctcggctactgccggcgcaagggcgagctcctgctggtgtacgactacatgtccaacggcagcctcgacaagtacttgtacgacaagaccaagcctgttcttgattgggggcagaggtttcagatcatcaagggcgtcgcctccggcctgctctacctccacgaggactgggagcaggtcgtcatccaccgggacatcaaggcgagcaacgtgctcctcgacggcgagatgaacggcaggctgggcgacttcggcctcgcgaggctgtacgaccacggcgttgacccgcagacgacgcacctggtgcgcacgggcaaggcgacgccggtcaccgacgtgttcgcgttcggcgtgttcgtgctggaggtcacctgcgggcggcggccgctcggctgcatcgcgcccgacgaccagaacgtgctgctggactgggtgcaggagcacgagcgccggcacgcggccctcgacacggtggacgcgaggctgtgcggcaagtacgacgccgacgaggcgaggctggcgctcaagctggggctcatgtgcgcgcacccgttgcccgacgcgcgccccaccatgcgccaggtcacgcagtacctggacggcgacgcacccatgccggaggtggcgccgacgatggtgagctacaccatgctggcgctgatgcagaacgacgggttcgactcgttcgccatgtccttcccttccaccgtcacgtcgaccgccagccccatgtccgccgacgtctcggccgtgtccggcctctccggtggaaggatcgcgctggttaccgggggcaacaaaggggtcgggctggagacctgcaggcagctcgcgtcccgggggctcagggtcgtcctgacggcgaggaacgaggcgagggggctggaggcggtcgacggcatcaggcgctccggcgccgccgattctgatgtcgtgttccaccagttggatgtcaccgacgctgccagcgtcgcccggctggccgatttcgtccgggatcagttcgggaggcttgatatcttgatcaataacgcaggaatttcaggtgttgatcgggatccagttttggttgccaaagttaaagatcagattgaaggcatggatgtagatcagagagttgaatggatgagagaaaattcaaaggagacctatgatgaagctaaatcatgcattacaacaaactactatggtgccaagcttgtcacagaagcactacttcctcttcttctgttatcctcctcgggaagaattgttaacgtgtcatcaggatttggactactgagaaacttcaacagtgaagatcttagaaaagaattcgatgacatcgacagtcttactgaaaagagactagaggagctgttggatttgttcctagacgatttcaaggtgaacttaatagaagcacatggttggccaaccggtggatcttccgcctacaaagttgccaaagctgcccttaatgcatacacaaggattcttgccaagaagtaccctacactacgtatcaactgtttgacacctggttatgtcaagactgacatctcaatgcacatgggagtattgacacctgaagagggtgctagtaactccgtaaagaacagaaaccgtggcactacttcatcagcaatagctcttccagggacgctacgaagcagggttgctgtggtcaccggcggcaacaaagggatcgggctggaggtgtgccggcagctggccgccgacggcatcacggttgttctgacagccagggacgagacgaggggcgtggaggccgccgagaagctcagagggatgggcctttcctgtgtcatcttccatcatctggaggtcacggacagttccagcgtttctcggttggctgatttcttgacgactcgttttggcaagctagaaatactggtgaataacgcagcagttagcgggatggagcacgcccaaagagtagatactaacgaggaacagtggctcgtcaacaacgaggatctgaggaaggagctggacgacgttgataacctcaccgaggaacggctggacgaggtgctggacagcttcctgaaagacttcgaggccggcgcgctggaggcgcacgggtggccgacggcgccgttcgtggcgtacaagatggccaaggtggccatgaacgcgtacacgaggatcttggcgaggaggcacccggagctgcgcgtcaactgcgtgcacccgggctacgtcaagacggacatgaccatcaactcggggttcctgacgcccgaggagggcgggaggaacgtcgtgacggtggccctcctgccggacggcggcccgaccggcgcgtacttcgacgagggcagggaggcgtcattcctggaatga

SEQ ID NO: 882 - DNA, 1182 bp, Oryza sativa
atggcgggaaaaggaggtaagggcttgctcgccgcgaagacgacggccgccaagtcggcggagaaggacaaggggaagaaggcccccgtctcccgctcgtcccgcgctggtctccaggaaggtggtagtatgccagtggcaccaactgtggtggtttcagctaccatggaagccaaccatgataggactctgttccctgttggccgtatccatcgccagttgaagcaaaggactcaggcaaatggacgtgttggtgctactgccgcagtttactctgctgctattctggagtacttaacagctgaggttctggaactggctgggaacgctagcaaggatctgaaggtcaagcgtatcacccctcgccatctgcagcttgccatccgtggagatgaggagctcgacactctcatcaagggtaccatcgctggtggagtggtcaagagctttgttttctttgtcacttttcattattttacactccaggctgactggatccagcatagatatacggtacgtggaggatggtctactactcaaatccgagctaaagctactaaccctaatgaaaggttatcattctgttccaagtcaattcttgcatcaataaccaatacaagttgcccccctgctgtttatccccagaaacttacttaccctttactttcacccttggctgtcattcagtggtgtgactgtgaaggtggcggagcctgcatggaagggctgacgagcgagcagatggtggcgttccaggaggcgttcttgctcttcgacaagaacggcgatggatgcatcaccttggaagagctggctgcggtgactcgttctcttggccttgagccgaccgatcaggagctcaacgacatgatgagggaagttgatacagatggcaatgggatcatagattttcaggagttcctgagcctcattgccaggaagatgaaggatggggatggcgacgaagagctgaaagaagctttcgaggtcctagacaaggatcagaatggttttatctccccaactgagctgaggacagtgatgaccaatcttggggagaagatgacagacgaggaggttgagcagatgataagggaggcggataccgatggcgacgggcaggtgaactacgatgaatttgtgataatgatgaaaaacgctgaacggaagatatctgggtga

SEQ ID NO: 883 - DNA, 891 bp, Oryza sativa
atgtcagcaactaacgcgctcgcttccttcccgcctcgcctcaacgcaaagcgagatccccccctatacctattaatacctcatcttgtcgtctcgtatcatctcatctcatcacatcagcacacatcacacgcgccgattccgaagaaatcaatcaaccaactactaggcgaaagcaagagcggatcgggtgctgcatttcgcggtcgttttcttcctctgaattctggtgtttgcggttgcggcaatggcgttggtggcggcagcggcggcgaatccgaagcagaaacagaagcagcagaaggcgtcgatcgggaggcgggcgtggcggctgctgcgcctggcggtgctctgggcgaggaagggcagcgcggtgcacagcctccgcctgctcagcaacctgcggcgcgccggcgtgggcctcggcgtcgtcggccgaggcaccgcctggggtacggcgagcgggagtactcgatcgaggagacgccggcgttccggttccgcaagccgtcggcgcgggtgctccgcctaatcccctgcatcgcccccgccgtcccggacacgcccgggctctacggcgacgaggaccgctacttcttcgcccgccgcgacacggagcccgagtgcggcggcggcgtcgggtattacgactacaatggcgagccgggcgagtgcggcggcgtggacgacgagagcttccgcgacggcgcgatggaggagcagctcctcgagctgtccatgctggaggcgagcgccgccgccgtgacggaggacgccggcgtggacgccaaggcggaggagttcatcgccaaattccacgcgcagatgaagctacagaggcaaatctcatggctgcagtacaacgagatgatggagaggagcctccgctag

SEQ ID NO: 884 - DNA, 708 bp, Oryza sativa
atgcatcgcgcacgcctcctcgtcgtcgtcgtcaccgccgtcgtcaccctcctgctcctggcgccggccgccggagccgaggaagacgatcagttcggctacatccccggcacaccgagggggccggagaactggggcagcctgaagccggaatgggccacctgcagcagcggcgagatgcagtcgccgatcaacctcggcctcctcgacctcaccctggcccccggcctcggcgacctcaactacacctaccgaaacgccaaagccaccgtcgtcaaccgtggccacgacatcatggtcaggttcgacggcggcgatgacgccgccgccgccggcgggctggtgattaacggcacggcgtaccggctccggcaggtgcactggcacgcgccgtcggagcacgccgtcgatggccggaggtacgacatggagctgcacatggtgcatctcaacacccagaaccagaccgccgtcgtcggcatcctctacgccatcggcgcccaggatgagttcctgcacaagttggagccatatattattgaagttgcagaccaaaaagataaggagaagattgtcaatggtggggtggatccaaacgtggccaaagagcatgatatcgtgtattaccgctacatgggctccttaaccacaccaccttgcaccgagggagttatctggaccattgtcaggaagatgaagaggttctaa

SEQ ID NO: 885 - DNA, 556 bp, Oryza sativa
  misc_feature (63)..(63): n = any nucleotide
  misc_feature (124)..(124): n = any nucleotide
  misc_feature (151)..(151): n = any nucleotide
gacggcaaatggcgcgcgctccgcaagttcgccgccgccgagatgctcgcgccgcggcggatntcgtccgcggcggccggcgcgcaagctgcagaccaagatcgtggaagcgctccgccgcgangtgtccggggaagcggcgcggggcgcngccgtggtgttcaggcacgcggtgctcgactccatcctgagcctcctcctcggcgtgctctactccaccgacctggagcgcgaggagcgcgccatgttcagggacctcattgaggagatcgtcgggatgctggggacggcgaacgtctccgacgtgttcccgccggtggccgcgctcgacctccagggcctccgccgcaggatgaccgacctcctcaccatcatgtaccgccacttcgacgaccaggtcgccctgcggcggcgcagccgggacgccggcgaggcgcgcaagaacgacgtgctcgacaccgtcctcgacaaggaggagagcgagtggaagcaggagggctccctgctaagccatgacgtcatgcgagttctcctctccggagggagtagattttaa

SEQ ID NO: 886 - DNA, 4470 bp, Oryza sativa
  misc_feature (1077)..(1077): n = any nucleotide
  misc_feature (1079)..(1079): n = any nucleotide
atggccgacgatctgccgccaccgtccatcactcccgtgaccgccgtcgacgccgcatcgaccgccgtcgccgacgccatccgcgcggtcttccaacctgacgctcggcatggcatcgaccccaccactgctgccaatgtcaccgaatcggcggctgcaatctcctccacagccgcatggaaagcgttgatttccttcatcgagaagctctcggcgtccacatcctcgcagccggacaatccgtcagccagtgccccggtcaactccactgcagcagccaccatctcctccgcgtcggctgcggccttcttcgccgggctccacaccagctccgccggcctccagccgcagcacgacgccatcccgcaaggctctggcgcgcctccaccacacggccacggctctctatccttcgtcgccccgtcaccaacagcaccgcaagccgaccacttctacaacgtcgaccttgatgataaggccaccgccaacctccatgcacaggcgatatccgtcctcaacatcaagtcgcttgtaccggtcaccctcgacgtcaactccggcacatacacttggtggcgtggtcttcttctcgtcatcctcagcaagtatgcacttgctgatcatgtcctcactgacaactaccgaccagaccaccccgactggatgcgcatggactgtgtcgtcctctcctggatgtacggcaccatctccactgacctcctggagtcagtcatgacgcatacgactacggcaagattggtgtggcgcagcctcgagcatcaatttcttggaaatcgtgaagctcgtgctctcaaccttaacgccgagttttacaatttccaacaaggcgatctatccgtcaccgactactgtcgtcgtctcaaagccatggctgccgaccttgccgatgtcggcgaacccgttggcgaccgcacactcacgctggctacgatccaaggtttggatgaaaattttgcacacttgcaatctgctttcaccatgcggaagcccttcccgtcattcgccgaggtgcgctcgcaactcctgctggatgaactcaccaagaaccgctcccanancccggctaccaccctcatcgctgccacaagcggccgcacttccgggggggccgcaaactccaatccagcacacattaccggctacggcaacaacagcaacaccggcaaccgcaactccaacggccgtcaaggtgggaacaaccgtggccgccgtcataacaacaacggcggcaacggtgggcaacagcaacctcaatttcgcccacctggcagctcggcgcaagcggcctcctggccgtccccgctcaacccgtggaacggcactctccagatgtggcccgttcctgtcggcatgatcccgtcacgtgtcgtcggctccggttccggtcttcttggacctcgtcccggcgcaccatcgcacttcgctggctccatggttgccgccagccacaatggtgtgccccagcaccctgccgcaccctctgtgctgggacatgccggaccggcccagtccctcgccgcctccaccagctaccagccggtcttcgccgcaatgccctccactccgggcacaccagcatcatggaacggcagcgccaacacgcaatgggatcaacaaggcctcatcaacgccttcaacacggtatcactgtcccaacctccgtctagcgactggtatatagactcgggtgcttcttctcacatgacgtccgatgccggtaccctctccttttcctcccaacctaaccctaatacactgtctcatattattgttggcgatggttctcctctacccatcactgccactggctccactcatttatcttttccacaccgttctttcgtccttaataatgttctcgttagccctgagatcattaaaaatcttattgttgttcatcgttttgctcgtgataatgatgtttctgtcgaatttgacaaagatggtcttgatgtgaaggatttccactccaggaacgtgatcgtttggtgcaatagcttcggggacctctacctcgtccgccctaccgagctccactacgccctcgccgcccgggagtcctccgtcctatggcaccactgccttggtcatcttggatctgaagccctcacccgccttgctcgttcctctgttatcccaccatatagagaactattagccagtctcccctcctccttctgggttgaggctctccacaccgccacacaccttattaaccgtcaccccaccaagaccctccaattccatacacctttctttgccctttacggtatccatcccacctacaatcatctccgtgtttttggttgtaagtgttatccaaacctctccgccactgctccagataagctatcagttcgttccacagcatgcgtctttcttggctatcccagagatcacaaagggtatcggtgtatggaccttagttttaaccgagttatcatctcgcgtcatattgtgtttgacgagcactcgtttccttttgccaagttgtctaacgggacatgtgctactgacctctcctttctagatgattttacagcatcatcgttgcccactcccactagcactcgacggactacagcagcggctcggacttcttcaccgggtggatcaccgcccgcctcgtcggccaccattgacggccaccactgctggcacccactacccggctcgccggctccctccgccgactcgtcagcaccctccgtcgacccaccggcctccccggccggctcaccgaccaccactgccggctcgccggcctccacggcgccctctccaccgccagttgtcagtactacatcagcaccaactcttccgcccgtacccactcgtccacgcagtgctcgagtccccggcggccgtcatctacctcctgtccttggagcttcaccggcactcaactctcacaacatggccactagcagcaagtacggcttccacctgccgaccgaccggctcaacctccacgcctccgctctttcaccgatcccgcgcacataccgagtagcgctcgcggatccgcactggcgtgctgctatggaggaagagttcgctgcactgcgcgccaacaatacatgggacttggtaccgcttcctcctggtgctaacatggtcaccggaaagtggatctttcgtcataagttcaagtccgacggcacgcttgacaggttaaaggctcgatgggtactccgtggtttcactcagcgtcctggcattgattttgatgagaccttcagtcctgtggtaaaaccggcaacggttcgcactgttctcagcttagccgtctctcagaactgggccattcgacagcttgacgtgaagaatgccttcctgcatggcacactacaggagactgtctactgttcccagccgttaggtttcaccgaccctgctcatcccaaatcagtatgtcgtctgaaccgcagtctgtatgtcctgacggcctcctcggcgccgatacttcagtggaccatcacacagcttcagtcagagtttgccatgaaggatcttggagtccatcattttctgggcatcagcgtcacttggaattccattggtctgattctctcacagcgacagtattgttccgagatcctagagcgagctggtatgcttcactgtaaaccgtgttccacgccagtcgacacttgcgcaaagctatctgcttctgatggacaacctgtggcagaccctaccgattatcgcagcctagctggtgctctccagtacctcaccttcactaggcccgatattgcttatgctgttcagcaggtgtgccttcatatgcacgacccccgcgagacgcatctcgctgccatcaagcgcattctccgctatgttcgtggtactatggactacagcttacacaaatctcgctcttcgtccaccgatctggtggcctactctgatgctgattgggtcggctatcctgacactctccgctccacctcgggatatgctgtttttctaggagataatctcatctcctggtcttccaagcgacagaatacagtttcacgctccagtgctgaagctgaatatcgcgctgttgctaacgcagtccccgagacatgctggttgcgacagctcctccacgagttacacactcccccgacacgggccaccttggtttattgtgacaatgttagtgcggtgtacctctccaccaatccagtacaacatcaacgtaccaagcacatcaacattgatctccactttgttcatgacaaggttgcccttggtacagtccgcgtgctgcatgtacctacttcgtcacaatacgccgacatcttcaccaagggtctaccaagctcggtgttttgtgagttccgctccaatttgaacattcactccgcccacgttccaactgcggggggtgttagagatattgtatttgtattcggttcggtttccctcaatcctatgccaattttgtttctataa

SEQ ID NO: 887 - DNA, 3694 bp, Oryza sativa
atgagtgccgcggcgaccaccggcggcggcggcgagcggcggagcctccgtggcatgttcaagttcgcggaccgggtggacgtgctgctcatggcgctgggcacgctgggtgccatcggcgacgggtgctcgaccaacctgctcctcatcttcgccagcgacgtgatgaactcgctcgggccaccggcgtggacttcatgcgcgaggtcgagaagtcttgcctgaatttcgtgtacctggcgttcgcggtgctggcagtggcgtttatgggaggggtattgctggagcaggacgagcgagaggcaggtgctgaggatcaggtacctgtacctgcaggccatactgcggcaggaggtgggcttcttcgactcgcaggaggccaccacctcggagatcatcaacagcatctccaaggacgcctcgctcattcaggaagttctcagtgagaaggaacaggttccactctttctgatgcactctacagttttcatctctgggctggcattctccacatatttctcctggaggctggctctggtttcttttcctctggtcctgctcctgataattccagggctcatctacggcaagtatctcctgtacctctcccgacaatcgcgccacgagtacacaaacgcaaactcgttggttgagcaagctcttggctctatcaagactgtctactctttcactgctgagaaaaggataatccagagatacacagcagttcttgacaagacgatcaagctggggattagacaaggtattgcgaaaggtttggctgtcggattcacgggcctttccttcgccatctgggctttcctcgcttggtacggcagtagactggtgatgtaccatcatgaaagcggaggaaggatatatgctgcagggatttccttcgttttaggcggcctatcccttggaatggcactccctgaactgaagcatttcacagaagcgtcggttgctgccacaagaattctcgatcggataaaccgtgtgccagagataaatgctgatgaccccaagggacttattttggatcaagtccggggagagcttcagtttgagtctgtccgctttgtttacccatcgaggcctaacatgacggtcctcaaagacttcaacctccagattcctgctgggcaaactgttgccttggttggatccagtggcagcggcaagtcaaccgcaatagcattggttcaacggttctatgatgccactgaaggaactgtcaaggttgacggtgtcaacattaaagaactccagctcaagtggatcaggagcaagatggggcttgtcagccaagatcatgcactcttcggtacatccataaaagagaacatcttgtttggcaaaccagatgcaacaatggatgaactgtatgcagcagccatgacagcaaatgctcacaacttcataagggggcttcctgaggaatatgagactaagagattggcgagcgtggagcactgctatctggtggccagaagcaacgtattgccattgcacgggcagtcatcaagaacccggctatacttttgctcgatgaagccacaagtgcacttgattcagaatcagaaaagctggtgcagcatgcacttgaccaagcatctatgggaagaacaacactggtagtagctcataagctttccacagtgaagaatgccgatcagattgcagtggttgatgggggcactatagctgaaattggcacacacgatgaactgattaataagggtggcccatattcacgacttgtgaaactgcagaagatggtgagctacatcgatcaagaaggtggtgaccaatttagggcctcttcagtggcaaggaccagtaccagccgtctcagtatgtccagagcaagtccaatgccacttacaccaggtatttcaaaggaaaccgattcctctgtttctcccccggcaccatctttctccaggcttcttgcgatgaatgcaccagagtggagacaagcagtcataggaagtctctctgctttggtatatggttccttgcagcccatctatgctataaccatcggaggaatgattgctgcattttttgttcaagatctcaaagagatgaatgcaattatcagccgctatgccttgattttctgctcattgtcggtgatatccattgttgttaatctacttcaacattacaattttgcttacatgggagagcatctagtaaggcgtatcagagtccaagtacttgaaaagatcttaacctttgaggcagcatggtttgatgaagaaactaattcaagtggttcactgtgctctcggcttagcaatgaggcttctcttgtcaaaacccttgttgcagatagaatttccctactgcttcagacagcttctggaattataattgcagtgacaatgggccttatagtagcttggaaacttgctcttgtcatgatcgctgtacagccaactacgatgatatgctactatgccaaaaagatagttctctcaaatgtgtcaagggacttagcaaaggctcagcaccaaagtactcagattgctatagaagctgtttacaaccacaggatggtgacctcttttggatgctcatcaaaggttcttcagctctttgagcatacacaagaggaaccactgaagagagcaaggaagaaatcatgggtggccgggatcaccactggactgtcaccttgcctttcattcttgtcatgggctcttgacttctggtatggtgggaaattggcacaatctggggagatctccgcaggtgatgtcttcaaaacattttttgtcttggtgagtacaggaaagttgattgctgatgctggcagcatgacatccgacctggctaagggagcaaatgcagttgcttcagtgtttgaggtgctagacaggaaatctatctctccacaaaattcacagcaggtggaaaaggacaatcagaagaacaaaatacaaggaaggatagagttcaaaagggtagattttgcatatccgacaagaccacaatgccttatcctgcaggattttagcttggatgtgaaagcaggaacaagtattggtcttgttgggagaagcggctgtggaaaatctaccatcattggtttgatccagaggttctatgatgttgacagaggggctgtaaaggttgatggtatggatgtgagggagatggatatcctttggtatcgaggatttacagcccttgttagccaggagcctgcaatattttctggtagtgtcagggacaacattgcttttggtaaaccagaagctgatgaagacgagatcgtggaagctgctaaagctgcaaatgcacatgaattcatatcatctctaaaggacggatatcatactgactgtggtgagcatggattacaactatcaggagggcaaaagcaacgaattgcaattgcgagggcaataatccggaatccagcaatacttctacttgacgaagcaacaagtgctctcgatgcacagtcagagcaagttgtgcaggaagcccttgatagaatcatgtcaggaaggactacaattgtggtggcacatcgactgaacacaatcaagaatgtagattcgattgccttcttaggagagggtaaggtagtggaacgtggtacttatccacacctcatgagtaagaaaggagcattctacaacctagcggctcttcagaaataaactgcttgtataat

SEQ ID NO: 888 - DNA, 3605 bp, Oryza sativa
  misc_feature (3343)..(3343): n = any nucleotide
  misc_feature (3357)..(3357): n = any nucleotide
gcgctccacatcctccccaacaagaagcagccgatgaccgtcctccatgacgtcagcgggatcatcaagccccggagtgtaggatgaccttgctgctgggacctcctggctcgggcaagaccacgttgctcctggcgttggcagggaagctcgacaaggacctcaaggtctcggggaaggtgacctacaatggacacgggatgcacgagttcgtcccggaaaggaccgcggcgtacatcagccagcatgatctccacatcggggagatgaccgtgagggagacattggccttctcggcgcggtgccaaggcgttggcactagatatggaaatgctgactgagttggcaagaagggaaaaggcagcaaacatcaagccagatcatgatattgatatctacatgaagtacatgtaggcctcagctatgggaggacaagaatctagtgttgttacggactacatattgaagatattaggattggatatttgtgctgatacggtagtaggaaatgagatgttaaggggtatatctggtggacaacggaagcgtgtcacaacagacaggtgaaatgcttgttggtccagcaagagctttgttcatggatgagatatccactggactggacagctcaaccacgtaccagatcgtgaattcccttaggcagactatccacatccttggcggaactgctgtcatctcattgctccagccagcacctgaaacatacaacttgtttgatgacattatactcctctctgacgggcaggttgtgtaccagggtccccgtgaacatgtgcttgagttctttgagttcatgggcttcagatgccctgccagaaagggtgttgctgatttcttgcaggaggtgacatcaaggaaagatcaggggcagtactggtgtaggcgtgacagaccataccgttttgtgccagtgaagcaattcgcagatgcgttccgttccttccatgtgggccgatccatacagaatgagctttctgagccatttgataggaccaggagccaccctgctgctctggctacttcaaagtatggtgtcagcaggaaggagttgctcaaagccactatcgatagagagcttcttctcatgaagaggaatgcatttatgtacatttttaaagctgttaatgcattgatcgtgatgaccacatttttccgtaccagcatgcgacatgatagagattatggaatgatctatctgggggcattgtactttgctcttgacacagtcatgtttaatggtttcgcagagcttgccatgactgtcatgaaactacctgttttcttcaagcaaagggatcttctcttctttcctgcatgggcctacaccataccatcatggattcttcagattcctatcacatttctcgaagttggtgtttatgttttcataacatactatgtcattggatttgatcccagtgtaagcagtatctgctgctacttgcactcaaccagatgtcatctgcactattccgcttcattgctggaatcggaagagacatggttgtgtctcacacatttggaaagaaatggtggatttggggttactggatatccccgctatcgtatgcacaaaatgctatttcgacaaatgaatttttgggtcacagttggagccaacgtggtatctttactgaagctaagtggtactggattggacttggtgctttgcttggatacactctcctctttaacctgctctacactgtagctctttcagttttgagtctctgaggacgcattgaaagagaagcatgccaacttaaccggtgaagttgtagagaagggaatggtgctcccatttgcaccactatctattagttttaacgacgtaagatactcagtggacatgccagagggcataacagaagaccgtttgttgcttctaaagggtgttagtggttctttcaggccaggtgtacttactgcattgatgggtgtaagtggtgccgggaagacaacactgatggatgttttagcagggagaaaaactggaggatacatagagggagatattagaatatctggctatccaaagaagcaagagacctttgcacgtatatcaggatattgtgagcaaaatgacatccattctccccatgtgacagtatatgaatcacttgtgttctctgcatggctgcggctaccctcggaggttgattcagaagccagaaagatgtttattgaggaggtcatggatcttgtagagctcacatctctgaggggagcacttgttgggcttcctggagtgagcggcctgtcaactgagcaacgcaagagacttactattgctgtggagcttgttgcaaacccttcaattatttttatggatgagccaacatctggtcttgatgctcgggcagctgcgattgtgatgaggaccgtaaggaacaccgttaacactggcaggactgttgtttgtaccattcaccagccaagtattgacatctttgaagcatttgatgagcttttcctaatgaagagaggaggtgaagagatatatgttggtccagtgggccagaattcctcaaaactgattgagtactttgagattgatggcgttagtaggataaaagatggatataatccagcaacatggatgttggaagtgacctcttcagcccaggaggagatgctcggtgttgattttagtgaaatctacaggcagtcagagctatatcaaggaacaaggaacttattgaggagctaagcacaccacctcctggctctactgatctcaacttccctacgcagtactctagatcgttcattacacagtgcctagcttgcttgtggaagcagaattggtcatattggaggaatccatcctacactgcagtgagattactcttcactatcgtcattgccctaatgtttggaacaatgttctggaaccttggaacgagaacgatctattcaatgccatgggatcaatgtatgctgcagttctctacattggagtgcaaaactctggttctgttcaaccagtggtggtggtggagcgaacagtcttttaccgagaaagagcagctggcatgtattcagctttcccgtatgcatttggacaggttgcaattgagttaccatacatcatggttcagactctgatatatggcgtgctggtatactcaatgattggatttgagtggactgttgccaagttcttgtggtacttgttcttcatgtacttcacactgctatatttcacattttacggaatgatggcggtagggttgacaccaaatgagagcatagcagcaatcatctcgtccgctttctacaatgtgtggaacctcttctcaggatatctgatccctcgacngtagatccctgttnggtggaggtggtactgttggatttgcccggttgcatggactttgtatggattagttgcttcccagtttggtgatatccaacatgtgctcgaaggcgacaccagaactgttgcacagtttgtcactgattactttggcttccatcataacttcctgtgggtggtggccgtggtgcacgtcgtcttcgccgtgaccttcgccttcctcttcagttttgcgatcatgaagttcaacttccagaggagatga

SEQ ID NO: 889 - DNA, 3139 bp, Oryza sativa
atgtcccggtacacgccggacttcaaacagaaagatgtcccggtgcacgccgccgtgcacaaatccggcattccggcccagcccatttgcccactcctgacgtgcccaactaccaagtccaccaacccgcgctgcaggtccacccactgctgccgtgccaccctctcttcgcgttgtctccggggacaaacttgttactcgccgttccaactgccaagccaacttcgcgtcttcgcggacgcagtccactccaactccaacaccacccaccgccagcggcggcgaatccgcggcggccgcaatggcgggttcgaggccagcgcgcgagacgacgaccgacgcccccgccgagccgtcgtccgacggcgcggtcgcggccgcaccctcggcggcggcggcggcggagggcgacgcggagatcaccaggccccgcaacgacaagcgcgggtaccgccgcgtcgtgctccccaacgccctcgagtgcctcctcgtcagcgaccccgacaccgacaaggtctccgtgctttcgctggctccttcgatcggggatgtgccgggggttttggtgcctgcctcctgggtttttggcttgaatgggtgaatcccggctttgtttgtttgcaggcggcggcgtcgatgaatgtctcggtgggctacttctgcgatcccgagaggctccctggccttgcacatttccttgtttatagagcatatgcttttctatgctagcgagaaataccctgtggaagacgattactcaaagtatattgcagagcatggtggttcaaccaacgccttcacatgtcgtgaacgtacaaacttttattttgatgtgaacaatagttgcctggatgatgctttggatagaggtttgcacaattttttataaagccattgatctcacccgatgcaactctaagggaaattaatgctgttgactctggaaaataagaaaaacttgttgtcagatcctttgcgaatgagtcagcagctccagaaacatttttgctcggagagccatccatatcacaagtttagcactgggaaacctggacactttgctggttaatccaaataaggaaggattggacacactggaagagcttattaaattttataattcacattactcagctgcagatcattgttaaagcggttcccataaaagaaggccacactttgagaatacagtggccaatcaccccaaatattcagcactataaggaagggccttgcaagtatgtgagtcgtctagttggccatgaaggagaggggtctctattttacgtgctaaaaaatttagggatgggctatgagtttgtatgcatgggaaggtgactggagttatgagttttcattcttcaatgttgttatacagctcacagatgtaggctatggagcacatggaggacattattggactgttattccgatacatagcattgctccagacctctggaactcgtcagtggatttttgatgagcttgtagctatttctgagatgggattccactaccgagacaagagtcctcctatccattatgttgtcaatatttcctcaaacatgcaggattggctgattgcatcatctgtgccatcaaagttttctccagatgctattcagaatatattaaatgacttgactccagataatgttagttcagaatattctgggaatcaaaaaagtttgaagggcaaacaaacttaacagagccttggtatggtacatcatattcagttgaagcagtcactccttccatcatacaggtgtacatttggattgggtaaatatggctcccatggaagatttgcacattccaaaacctaatatcttcattccaagtgatctttcattgaaaaatgttgaggaaaagcttaggaaaacaatgttttcaagagtatggtataagcctgatacaatgttcttcacacccaaggcctacgtcaagatggatttccactgtccactgtccaatagctctcctgaatcgacagttcttactgatatgttcacgaggttgataatggattatttgaatgattttgggttataatgacaaaatgagaacccttctggatactgtcattggaaaaattgctgagtttgaagtgaaggttgaccgttttgctgttataaagtacgagaatttcaaatttcgacaaccatatgagcaggcattttactattgttcattgatattagaggaacaaacttgggcatgggatgaaaaacttgctgcagtttctcatattgaagcaagcgatctacagatttttttgcctcgtcttctgggcaagacatttattgaatgctattttgctgatattagggaacatggaaccgggtgaagcaaaaagtgttatacagcatgttgaagacaccttattcaatgcacccatcagtttctgcaaagcattacccccatcacagcatcttacaaagcgaattgtaaaacttgaaaggggttggaggtattattatccagcattgtgcctaaatcaccaggatgaaaaaaattcttccatcctgcattatattcagcagattcatcaggatgatctcaaacaaaatgttctacttcaattgcttgctcttgttgctaagcaaccagcttttcaccaattgcgttcagttgagcaacttggctacataacagtgcttacacaaagagaaatgattcaggtgttcggggattgcaattcataattcagtcaaccgtgaaggatgacagagtggaagcttttcttaatatgtttgaagggactctataccaaatgcctgatgaagagttcaagagcaacgtgaatgctctcattgacatgaagctggagaaatacaagaatataagagaggaatcagcgttcttctggaaagaaatttcggaaggaactctgaaatttgatagaaaagaggcggagctcaataaagaggagttgattgagttcttcaataatcatgtcaaaaagaaaattcttagcattcaagtttacggcggtctccattcctccgagtacgaaaagatagttcacgatgagccacagccgcactcgtatcaaataaccgatatattcagcttcaggaggtcgagacctttatacggttcattcaagggaggtgttggtcagatgaagctatag

SEQ ID NO: 890 - DNA, 3018 bp, Oryza sativa
  misc_feature (1103)..(1103): n = any nucleotide
atggcggggaacgactggatcaacagctacctggaggcgatcctcgacgcgggcggggccgcgggggagatctccgccgcggcggggggaggtggagatggagcggcggccaccggggagaagcgggacaagtcgtcgctgatgctccgggagcggggccggttcagccccgcgcgctacttcgtcgaggaggtcatctccgggttcgacgagaccgacctctacaagacctgggtccgcgaggagcccgcaggagaggaacacgcgctggagaacatgtcgtggaggatctggaaccttgccagaaagaagaagcagaaacaacgtcttgagcgtgagaaggctcgtagatatgctgctgccgatatgtctgaagacctatctgagggtgaaaagggagaaaacattaatgaatcatcatctactcatgacgagagcacaagggggagaatgcctaggataggttcaacagatgctattgaggcatgggcaagtcagcacaaggataaaaagctatacattgttctgataagagcattcatggtcttatacgtggtgaaaatatggagcttgggcgtgattcagacactggtggtcagcaggtcaaatatgttgtagaacttgctcgggcattaggttcaacacctggagtatatagggttgatcttctgacaaggcagatttctgcacctgatgttgattggagttatggggaacctacagagatgctgagtccaagaaattcagagaattttgggcatgatatgggtgaaagcagtggtgcttatattgtgaggataccttttggaccaagagataaatatatccccaaagagcatctctggccccacatccaggaatttgttgacggtgcacttgtccatatcatgcagatgtccaaggttcttggagaacaagttggcagtggacagctagtatggcctgttgttatccatggacactatgccgatgcaggtgactctgctgctttgctatctggggcactcaatgtcccaatgatattcacaggtcattctcttggcagagacaagttggagcaacttttgaagcaagggcgtcaaaccagggatgaaataaatacnatatacaagataatgcgtcgaattgaggctgaggaactttgtcttgatgcatctgaaatcataattacaagcactagacaagagatagaacaacaatggggattatatgatggttttgatttaaccatggcaaggaaacttagagcaagaataaagcgtggtgtgagctgctacggtcgctacatgcctcgtatgattcctcctggcatggagtttagccatatagtgcctcatgatgttgatcaggatggtgaagaagctaatgaagatggttcaggttcaacagatccacctatttgggctgatagataatgcgattcttctccaaccctcgcaagcccatgattctagctcttgctcgtccagatcctaagaagaacatcactacactggtcaaggcatttggtgaacatcgtgaattgagaaatttagcaaaccttacacttatcatgggtaaccgtgatgttattgatgaaatgtcaagcacaaattcagctgttttgacatcaatactcaagttaattgacaagtatgatctatatggccaagtggcataccccaagcaccataagcaatctgaagttccagatatttatcgtttagcggcaagaacaaagggggtgtttatcaattgtgcttttatcgagccatttggactaaccttgattgagaggctgctgcttatggtctaccaatggttgctactcgaaatggtgggcccgttgatatacatcgggtactggttcttgacaatggtattctcgttgatccccacaatcaaaatgaaatagctgaggcactttataagcttgtttctgataagcagttgtgggcacagtgccgccaaaatggtctgaaaaatattcatcaattttcttggcctgaacattgcaaaaactatttgtcacgggttggtacactcaagccacgacatcctcgatggcaaaagagtgatgatgctactgaagtttccgaagctgactcacctggagattccttgagggatgttcatgatatatctcttaacttgaagctttccttggacagtgagaaatcaagcacaaaggaaaatagtgtaagaagaaaccttgaggatgctgtacaaaagttgtcaagaggtgttagtgccaacagaaagacagagtctgttgagaatatggaggctaccacaggcaataaatggccatctttgcgaagaaggaaacacattgtagtcattgctatagattctgtgcaagatgctaacctggttgagattatcaaaaatatttttgtggcttcaagcaatgagagattatctggttctgttggttttgttttgtcaacatcccgagcaatatcagaggtacattctttgctaacatctgggggcatagaagctactgattttgatgccttcatatgcaacagtggtagcgatctttgctatccatcctcaaattctgaagacatgcttctcaaattgagtaccgttggggtggagaaggtttaaggaagacactaatttgttgggcagcagaaaaaagccgagggtggtcaagtgcctcctgtgaaagagcttaggaagacaatgagaattcaagcactgcgctgtcatgttttgtacagtcatgatggtagcaagttgaataggtacttgtatataagatggggggtagagctgtcaaatatgacagtggttgttggtgaaagtggtgatactgattatgaaggactattaggaggcgtgcacaagaccattattctcaaaggctcatttaatgctgttcctaaccaagtccatgctgccagaagttattcattacaggatgtcatatcctttgacaaaccaggaattacttcaatcgagggatatggtccagataaccttaagtcagctctacaacaatttggtatactgaaagacaatgtttaa

SEQ ID NO: 891 - DNA, 2896 bp, Oryza sativa
caggagaaactgcgggttgcggtgctggtatcgaaagctgcactacagtttatacagggtaatcatctttcacttcgaagtgagtatgttgttcctgaagaagtcaaggctgcagggtttcagatttgcgctgatgaactgggctctattgttgagggtcatgatagtaaaaagttgatcacccacggtggagttactggaatagcagacaagcttgcgacatcaccagcggatgggttaagtacagctgaggaaagcattaagcgcaggcaagatgtatatggactaaacaaattcacagaaagcgaggtccggagtttttgggtgtttgtatgggaagcacttcaagatacaactcttataattcttgctgtctgtgcctttgtatcgttggttgttggcattgccatggaaggatggccaaaaggtgctcatgatggtctgggaattgttgcaagtatcctcttggtcgtgtttgttaccgcaacaagtgactatcggcaatccttacagttcaaggacttggacaaggagaaaaagaaaatacaagtgcaagtcacaaggaatggttttagacaaaggctatcaatatatgatcttcttcctggagatgttgtccatttagcaattggtgatcaggttcctgctgatgggctattcatttctgggttttctctactgattaatgagtccagtctcactggcgagagtgaacctgttgttgtaaatgaagataatccttttcttttgtcggggaccaaagttcaagatggttcctgcaagatgctgattacaacagttggcatgcgaacccaatggggaaaactaatggctactctcagtgaaggtggcgatgatgaaaccccactacaggtcaagcttaatggtgttgcaactattataggcaagattggtctatttttcgcagtcataactttcattgtcctttctcaagggttaatcagcaagaagtaccatgaggggctgcttttaagctggtcaggagacgatgcactggaaatgttagagcattttgctattgcagttaccattgttgttgttgctgttcctgaggggttacccttagcagttactttgagtctggcattcgcaatgaagaaaatgatgaatgacaaggcattggttcgtcacttagccgcatgtgaaacaatgggctcagctacgaccatctgcagtgacaagacaggaacactgacgaccaatcatatgactgttgtcaaggcctgcatttgtggaaacataaaggaagttaacaatcctaagaatgcatctgatttgtgttctgagcttccagaaactgttgtcaaaacccttctggagtctatttttaacaatactggtggtgaggttgtgattgaccaagatgggaaatatcagattctaggtaccccaacagagacagctttgttggaatttgcattgtcacttggtggaaattttaaggcaaagcgtgatgaaactaagattgtgaaaatggaaccctttaattcaacaaaaaagaggatgtgtgttgttcttaagcttcctggaggaggatgccgtgcacattgtaaaggtgcttcagaaatagtgttggctgcctgcgataagtttatggacgagacaggtgctgttgtcccccttgataaaacaactgctgacaagcttaatgggattattgaaagctttgctaatgaagctcttaggacattgtgccttggttatcgggaaatggaagaaggcctttctgttgaagaacaaataccactgcaagggtatacatgcattgggattgtaggtattaaagatcctgttcgcccaggcgtgagggagtctgttgcaacctgccgatctgctggaattatggtgagaatggtcactggtgacaacataaatacagcaaaagcgatcgctcgtgaatgtggcatacttactgaagatggcctggctattgagggaccggagttcagagagaaaagtcttgatgaactactcaagttgattccgaaaattcaggtaatggcccgatcatcaccacttgacaagcatacacttgtaaagcatttgcgcacaacattcaatgaagttgttgctgtaactggtgatggcacaaatgatgcgcctgcgcttcatgaagcagatattggacttgcaatgggcattgctgggactgaggtggcgaaagagagtgccgatgtcataattctggacgacaacttctccacaattgttactgttgccaaatggggacgctctgtttacgtcaacattcaaaagtttgtgcagtttcagctgactgttaacgttgtggctttacttgtcaacttctcttcagcttgctttacagaatgcacctctgacagctgttcaacttctttgggtgaacatgatcatggacacccttggcgcccttgcattagctaccgagccacctaacgatgacttaatgaagagagagccagtgggcagaacagggaaatttatcacaaatgttatgtggaggaacattctggggcagtctttctaccaattcattgttatgtggtatctccagacgcaagggaaaagcatgtttggccttgatggccctgatgctgaagttgtgctaaatacaattattttcaactcgtttgtcttctgccagcaggtgttcaatgagataagctccagggagatggagaagatcaacgtgctgaggggcatactgaagaactacgtcttcttgggtgttctcaccagcacggtagtcttccagttcatcatggtgcaattcctcggcgagtttgcgaacacgataccactcaccaggctgcagtggattgccagtgttctccttggcctcattgggatgcccatctctgccattatcaagcttcttcccgtcggctcgtcgtga

SEQ ID NO: 892 - DNA, 2650 bp, Oryza sativa
  misc_feature (1182)..(1182): n = any nucleotide
gttatctttccagcacttgatattcgagtgaaaaatgtagcaggcacgtattcccttgaacataagggggaaaatgatctgtttgcacacctgttctctctgttaaagcttgatgtgcggaatgatgatggtcttcggagggaactcgcgtcctgtacaggtgcaattcaaacgtttataacccaacatatgtccaaggaagaagagcaggtttccttttcccctgtttactctgttaattcctttgtatcaggtcttcccactgctcattaagaagttttcacatgaagagcaagctgatttagtctggcaattcttatgcagcatccctgtcaatatgatggcagagttccttccatggcttgctacttctgtttcatctgatgagcaccaagatattcttaactgcttacataaaatagttccggacgagaaacttctccaaagtattgcagaggatcaggttatatttccagcagtcaacgatcaagtgtcctttgagcaggagcacgctgaagaagaacggcggtttaataaatttagatgtttaattgaacaaatccaaataacaggagccagatcaacagcagtggatttttactctgagctatgttcacaagctgatcagataatggagaaaatcgagaggcacttcaaaaatgaggaaacaaagatccaggtacttcctcaagctaggattcatttttcatcagagaaacaaagggaacttttatataagagtctctgtgtcataccgttgaagttattggagcgtgttttaccgtgcgatcgctgtctctcaattattctgctccttcattgtattcaagtcttttttcatgggagacagatgcagccttttctggcccagataacatttcaaggccaattgacacaatattcaaatttcataaggcaattcgcaaagatttggagttcttagatgtggaatctagaaagctcatagatggggatgaatcttcccttcgccaattcatcggaaggtttcgtttactgtggggtctttatagagcacacagcaatgctgaagatgaaattgtatttcctgctcttgaatcgaaagagacactgcacaatgtcagccactcatatactcttgaccacaagcaggaagaagaattatttaaagatatatccactattctttttgagctttcacanttgcatgctgatttgaagcatcctcttggtggtgctgatgcagttggagcgaaccacattcatccatataataggatcgattggtccaaaaagaataatgaacttttgacaaagcttcaaggaatgtgcaagtctatccgggttactctgtctaatcatgtccatagagaagaacttgaattgtggccactatttgataaacatttttctgtagaggagcaggataagattgtaggccgtataattggaagtacaggagctgaggttctgcagtcaatgttaccctgggttacatcagcgcttagtctagatgaacagaacaatatgctggacacatggaggcaagtaactaagaatacaatgtttgatgaatggctaaatgaatggtggaagagatcacctacttcttctggcccttcaagcgatgcctcccatccagaaggatcatttccaggaaaagttcgatcagagtgaacagatgtttaagcctggttggaaggacatcttccgaatgaaccagagtgagcttgaggctgagatacgaaaggtttctcgtgattctactcttgacccaaggaggaaggcttatctaatccaaaatctcatgaccagagccgctggatagctgctcagcagaaatcgccccaacctcagtcagaagatcgcaatggatgtacagtattacctggatgttgtccttcataccgagatccagagaatcagatttttggctgtgagcattacaaaaggaaatgcaaacttgttgctgcatgctgcaataaactgttcacatgcaggttttgtcatgataaagttagtgaccatacaatggaaaggaaatgatgtgcatgcaatgcctgaaagttcaaccagttggtccaaattgccagaccccttcttgcaatgggctatccatggcaaagtattattgcagcgtatgcaagttttttgacgatgaaaggtgtaccattgcccctttggcaatttgtgtcgtcttgggcaaggattgggtattgattttttccattgcatgaagtgcaactgttgcctgggcatgaaattgatagagcataaatgtcgagaaaagatgctagagatgaattgcccaatctgctgcgacttcctatttacatcgagtgcagcagttaaaggtctaccttgtggccatttcatgcattcagcttgctttcagtttcaggcgtacacctgtagtcactacacctgcccaatctgctctaaatccttgggagatatgacagtatactttggcatgcttgatggcttgctggccgcagaagagcttcctgaggaataccgggaccggtgccagcaggatatactttgtaacgattgtgaaagaaaaggaaggtctcggttccattggctgtatcacaaatgcggcttctgcggttcatataacactagagttatcaagattgatagagctgattgttcaacatcagattaa

SEQ ID NO: 893 - DNA, 2589 bp, Oryza sativa
  misc_feature (514)..(514): n = any nucleotide
cagaacactttatctggacaatttaggataggggggatgacatgcgctgcatgtgtgaattctgttgagggtatcttgaagaaattgcctggtgttaaaagagctgttgttgcattagcgacctcattaggggaagttgaatacgatccttctgtcatcagcaaagatgaaattgttcaggctattgaggatgctggttttgaagctgcactgttacaaagtagtgaacaagacaaggttttgctaggcttaatgggattgcatactgaggtagatgtagatatattgcatgatatcctaaaaaaaatggaaggcttgcgtcagttcaacgtaaatttggtactctcggaagctgaaattgtatttgatccagaagttgttggtttgaggtcaattgtggataccatcgagatggaaagcagtggcagactgaaagcccatgtacagaatccttacatacgggctgcttcaaatgatgcacaggaggcctccaaaatgcttcatcttctttgcnctagcttattcctaagcattcctgtattttttattcgcatggtatgccctcgcatacacttcactcgttccctcctactcatgcacttgggaccattttatataggagacttgttgaagtggatactggtgagtatagtacagtttggtgttggcaaacgattctatgttgcagcctatagggccctgagacatggctctacaaatatggatgtactagttgttcttggcaccactgcatcatacgtctactctgtatgtgcgcttctttatggtgcattcactggatttcatcccccgaaatattttgagacaagtgccatgataatcacatttgtgctatttgggaaatatcttgaggtgcttgctaaaggcagaacatcagacgctattaagaagcttgtagagctggtccctgctacagcacttttgcttctgaaagacaaaggagaaggagattgatgcatccttaatccaacctggagatgtcttgaaagtgctcccaggttccaaggtacctgctgatggtactgttgtttggggtacaagtcatgttgatgagagtatggtaactggtgaatctgcacctatctccaaggaagtatccagtatagtaattggaggcacaatgaatttacatggaatcctccatatacaagcaactaaagtaggatcagggacagtcttgagccagataatctctcttgttgaaactgcccagatgtctaaggctcctattcagaagttcgctgattatgtggctggcatttttgttccaatagttgtcaccttgtccttggttacgttcattgcatgggagcatacccaaattcatgggttgatgaaactagcaattgctttgtcttctctctcatgttctccatctctgttgtggtgatagcctgcccatgtgctcttggtctggcaacgccaactgctgtcatggtagcaactggagttggggctaatcatggggtacttgtaaagggtggagatgcactggagagggctcagaatgtgaaatatgttatatttgataaaactgggacactgacacaaggaaaggctaccgtaacatcgacgaaggtattctcaggaattgatcttggagacttccttactttggtagcatctgcagaggcaagcagtgaacatccacttgcaaaagctatattggattacgcatttcatttccatttctttggcaaactcccctcatcaaaagatgacatcaagaaaagaaaacaacagatattatcccagtggcttctggaagtagcagaattttctgccttgcctggcaaaggggttcagtgtttgatcaatgggaaaaaaatcttggtgggaaatcgtactttgataactgaaaatgggataaatattcctgaagaagctgaaagtttcttggtagacctcgaactgaacgcgaagacaggagttcttgtagcatatgacagcgaactcattggctcaattggaatgactgatcccttgaaaagggaggctgttgtagttgttgaaggcctaaaaaagatgggcatctatccagtaatggttacaggggacaactggaggactgcacaagcagttgcaaaggaggttggcattgaggatgttagagctgaggttatgcctgcgggaaaagctgatgtcgtacgttctctccaaaaggatgggagtgtcgttgcaatggttggggatggcatcaatgactccccagccctagcagcagctgacgtcggaatggccattggtgcaggaacagacattgcaattgaagcagcggactatgtgctggtgcgaaacaaccttgaagatgtcatcacagcaattgacctctcaaggaagacgttcagccgaatccgatggaactacttctttgccatggcgtacaacatcatcgctatcccggttgctgctggagcactcttcccattcaccggcctccaaatgccaccttggctggctggtgcttgcatggcgttctcatctgttagtgtagtatgttcctctctgtggttgaggagatacagaaaaccaaggctcacaaccctgttacaaataactgtagagtga

SEQ ID NO: 894 - DNA, 2568 bp, Oryza sativa
atggtttcaaagtcatatacaaatcttctagatatgagtggtgaagatgtgtttgactttcagcaaccatttagatcgcttcctcgttttgtgacttccccaagcatcacatctaatcctgattgggatacaagtaatgctgatgattcagttggtcctgcatcttgctgtgtaaggaaaataatcgtctccaactttcttccactaaactgtaccaaagatgaagctactggacagtggtccttctcaatggatgacaatcaacttcttgttcaacttaaagatggatttccaatggagagcgaagttgtttatgtgggtagcttgaacgctgaagttgatcctggtgagcaagatcaactttcacagaaacttttcagagaatacaaatgcatacctactttcctcccagctgacctccagcagcagttctatcatggattctgtaaacaacaattatggccacttttccattatatgcttcctatttgcctcgacaaaggcgagctctttgaccgctctctatttcaagcctatgttcgggcaaacaaaatatttggtgacaaagttatggaggccatcaattcagatgatgactgtgtgtgggttcatgattatcacctcatgcttctcccaacctttttaagaaaaaagcttcatcgcatcaaaattggtttcttccttcacagtccatttccctcctctgaaatctataggacactgccagtaagagatgaaattttgaagtctcttctgaatgctgatctcattggctttcaaacatttgactatgcccgccacttcctttcatgttgcagcagattgttaggccttaattacgagtcaaaacgtggtcacatcggtatagagtactttggccgtacggtgagcctcaagatccttgctgtgggtgtacatgttggtcgtcttgagtctgtgttgaggctgcctgccacaattagcaaggttcaagaaattgagcaaagatataagggtaagatggtgatgttgggtgtagatgatatggatatcttcaaagggatcagtctaaaattgcttggcttggaatttcttttggagagaactccaaagctaagagttgtgccagattataaatcctgcaagaagcactggaaaagatgtggaggaagcaataaatgaagccgtctctgtagctgaaaggataaacattaagtatggttctgctgagtacaagcctgtcatccttatcgactaccccataccttcttatgagaagattgcatactatgctgcatctgattgctgtattgtaaatgctgtgagggatgggatgaacttgataccatatgagtatactgtctgcaggcagggaaatgaggagattgataagctcagaggtgttgataagagctcacatcacacaagcacactaattgtgtctgagtttgttggttgctccccatcacttagtggtgctttcagggtaaatccttggagtattgaagatgtagctgatgcattatataaagcaatggatttgactcaatcggagaggaaattgcgtcatgataagcattatcgctacgtcaaaactcatgacgttgcttactgggcgcgcagtttttcccaagatctagatagagcgtgcaaggatcactatagccgaaggtgttggaccactgggtttggtttgaattttagagtcattgctctttctcctggatttagaaggctatctttggaacactttgcttcttcttataagaagactaatagaaggctgatatttatggattatgatggcacccttgtcccccagtcatcagtcaacaaagttccaagtgcagaagtcatttctatccttacaagcttgtgcaatgatccaaagaactgtgtgttcatagtcagcggaagagatcgtactaccctaagtgagtggtttgcttcatgtgataagcttggtattgcagctgaacatggctattttatcaggaatgggaaacaagctcctcagctcaagattgtgaatggaagaacatcgccgagcctatcatggaagtatacaaggaaacaaccgatgggtctgccatagagacaaaggagagtgggctagtttggcattatcaggatgcagatcatgacttcggttcatgccaggcgaaggagctagtgagtcatcttgagagggtgctggcaaatgaacctgttgtggttaaacgtggtcatcaaatcgtagaagttaagccccagcagggtgttagcaaggggattgctgtggacacagtcattcggacggtaatcaacaacgaaaacgcaccggattttctgatgtgcattggtaacgatcgatcggacgaggacatgtttgagagcatcaatgaagccgtctcacgttctgtgtttcctactgctccagatgtctttgcctgctctgttggccagaaggctagcaaagcgaagtactatgtggatgggtgcagtgaggtgatcagattactcaagggtgtaaccgccattacaccccgaagggaggtgatcagccagagtcaagtaacattcagggatatacttgaggttgtcagctga

SEQ ID NO: 895 - DNA, 2419 bp, Oryza sativa
  misc_feature (517)..(517): n = any nucleotide
atggagtcgtcggccggcggcggcggcggcgagtctccgcctccggcgaagcccgtgctgctccacggggacctcgacctgtgggtggtcgaggcgcgcctgctcccaaacatggacatgttctccgagcacgtacggcggtgcttcgccgcctgcaagccgcccacctcctgcgccaccgccaggcagccgcgccacgcccgcggccaccaccgccggaagatcatcaccagcgacccctacgtcacgctctccgtcgccggcgccgtggtggcgcgcacccgcgtcatccccaacgaccaggaccccgtctgggacgagcgcttcgccgtgcccctcgcccactacgccgccgcgctcgagttccacgtcaaggacaacgacacgttcggcgcgcagctcatcggcaccgtcaccatccccgccgacagggtcgcctcgtgccaggaggtggaggactggttccccatcatcggcaacaacggcaggccgtacaagcccgacacggcgctccgcntccgcctccgcttcaaccccgcggccgacaacccgctctaccgccgcggcatccccggcgaccccatcgagctcgacgaggggggcaaggtgttcgaccacaacgcgtgctgggaggacatctgccacgccatcctcgaggcgcaccacatgatatacatcgtcggctggtcggtgtacgacaaggtgcgcctcgtccgggagccgtcgccgtcgaggccgctgccggaaggcggcgacctcaatctcggggagctgctcaagttcaagtcgcaggagggcgtgagggtgtgcctgctcgtgtgggacgacaagacgtcgcacgacaagttgttcatcaaaacgggagtgatggcgacacatgatgaagaaactagaaaattcttcaagcattcctcagtcatttgtgttctttcacctcggtatgccagcagtaagctgagcattttcaaacaacaggttgttgggactttgtttacccatcatcaaaaatgcgtgctggttgatacacaagcttggggaaacaagcggaagattactgcttttatcggtggcctggatctttgtgatgggcgttatgatacacccgaacataggctttttaaggatcttgacacagtattcgataatgattatcataaccctacatttccgcctagacaaccatggcatgaccttcactgtaggattgatggtccagctgcgtatgatgtcttgaaaaattttgagcaacgctggagaaaggcaacgaaatggcgtgaacgatttagaaaagtgtctcattggaaagatgatgccctgataaagttggaacgtatctcatggatacttagcccttcgcctactattccaaatgatgatattagtttgcgggtttcaaaagaagaagatcctgaaaattggcatgttcagcaggtattccggtcaatagactctggttcgcttaaagggtttcctagtgattgcaaagaagcttcaaagcaggataagagcatccacactgcttatgtccgggcaatcagatccgcccagcatttcatttatattgaaaatcaatatttccttgggtcatcatatgcttggccgtcctatgttaattcaggcaggtgctgacaatctggtacctattgaattggccctcaaaattgcaagcaagattagggctggtgaacggtttgcagtttatgtagtcataccgatgtggcctgaaggagtccctacagcagcttctgtacaagaaattcttttctttcagcaggcacagacaatggagatgatgtatcgtataattgcacaagagctcaaggccatgaatattaagaatgcacaccctcaagattacttgaacttctattgtctgggcaatcgagaagaatcatcatcatcaaatggcagccctgaatctaacgataaaagtgcagcgcgttttatgatctatgttcatgcaaaggggatgattgtagatgatgaatatgttattctggggtcagcaaacatcaaccaaagatctttggctggttccagagatactgaaattgccatgggcgcataccagcctcaccacacatggtctacaaaggggggtcatcctcgcggtcagcgtttgcaggtatacgggtatagaacttccctctgggcagagcatcttgggatggttgatgacctcttcaaggatccatcaagtttggagtgtgtaaattatgtcaatgaaatagcagaagagaactggagaaggttcaccgcagaacaacttataacgttacaagggcacctcctcaaatacccagtcaaggtagaggctgacggtaaggttggtccattgccagaacacgaatgctttcctgacgttggtggcaagattcttggagctccaacttcactccctgatacgctaacaatgtaa

SEQ ID NO: 896 - DNA, 2397 bp, Oryza sativa
  misc_feature (21)..(21): n = any nucleotide
  misc_feature (36)..(36): n = any nucleotide
  misc_feature (39)..(39): n = any nucleotide
atcctgacgggcctcgcgaanccgggaggcggagcnganttcgggaaatactacagcctgcccgcgctatccgatccgcggatcgcgactcccttactcgataaggattcttctcgagtcggcaatcagaaactgtgatgagttccaggtcaccgggaaggacgttgagaaaatcctggactgggagaacagcgcaccaaagcaagtcgaaatcccatttaagccagcccgtgtcctcctccagttacaggatttcactggtgttccagcagtggttgatcttgcgtgcatgagggatgctatgagcaaacttggcagtgacccaaacaaaattaatcctctggtacctgtagatcttgttattgatcattcagtacaagttgatgtggcaagatcagaaaatgctgttcaggcaaatatggagctagagttccatcgtaacaaggagaggtttggatttttgaaatggggttcaactgctttccgtaacatgcttgttgttccacctggatctggaattgtgcatcaggttaaccttgaatatctggccagagttgtgtttaacaatggtgggatcctttaccctgatagtgttgttggaacagactcccacacaactatgatagatggtcttggtgttgctggatggggagttggtggtatagaggcagaagctacaatgcttggccaggtggccatgatagagtcttacctgcgtgccaataagatgttcgtcgactacaaccagcctgaagctgaaagagtgtactcatcttatctggaacttaacttggaggaggtagagccatgcttgtctggaccaaaacggtaataggcctcatgaccgagtgactttgaagaacatgaaatcagattggctgtcttgcttggataatgatgtaggcttcaagggttttgctgtccccaaagaatcacagggtaaagttgctgagttctctttccatgggacaccagcaaagctaaagcatggtgatgttgtaattgctgctataaccagttgcaccaacacatcaaatcctaatgtaatgctgggagctgctttagttgccaaaaaggcttgtgaattaggccttgaggtcaagccatggattaagacaagtcttgcacctggttctggagttgtgaagaagtacttggacaagagagtggtctgcagaaatatctagaccagcttggcttccatattgtaggctatggttgcacaacctgcataggaaattctggagaacttgatgaaacagtatctgctgcaatttctgacaacggatattgtcgctgctgccgtgttatctggaaacagaaattttgaagggcgtgtgcacgcattaaccagagcaaattatcttgcctctcctccattggttgtggcctatgcccttgctggcacggtcaatattgattttgagaaagaaccaattggcatctcgaaagatgggaaggaggtttacttcagggacatctggccttccactgaagagattgctgaggttgttaaatcaagtgtgctacctgacatgtttaagagcacatacgaggcaataaccaaaggaaatcctatgtggaatgagctgtctgtatcagcaagcactctctacccatgggacccgacatctacttacatccatgagcctccttatttcaaggatatgacaatgtcccctcctggcccacggcctgtgaaggatgcttactgtctcctgaactttggtgacagtatcacaactgatcacatctcacctgccggaagtattcaccctgacagccctgctgctagatatctgaaggagcgtggtgttgaaaggaaggacttcaactcatatggcagtcggcgaggaaatgatgagatcatggctaggggaacttttgccaacattcgccttgtgaacaagttcttgaagggtgaggttggcccaaaaaccatccatattccatcaggggagaagctctctgttttcgacgctgctacgtacaagaatgaaggacatgacactattatcctggctggtgctgagtacggtagtggaagctctcgggattgggctgcgaagggtccaatgctacagggagtcaaggctgtgattgctaagagctttgaaaggattcaccgcagcaaccttgctggtatgggtatcattcctctatgcttcaagtcaggggaggacgccgacacccttggattgactggccatgagcgtttcacggttcacctcccggccaatgtaagtgagatcaagcctgggcaagatgttactgtgacgactgataatgggaagtccttcacttgcacacttcgatttgacactgagggtggagcttgcatactacgacaatggtggcattttaccgtatgtcatcagaaagatcgccgagcagtag

SEQ ID NO: 897 - DNA, 2308 bp, Oryza sativa
atgggccgccggggtttggtatctctctggttttttggcttgaaccccgacttgtttgtttgcttgcaggcggcggcgtcgatgaacgtctcggtaggctacttctgcgaccccgaggggctccctgggcttgcacacttccttgtttacagagcatatgcttttctatgctagcgagaaatatcctatagaagacagttactcaaagtatattgcagagcatggtggttcaaggaacgccttcacatctcgtgaacacacaaactttttttttgatgtgaacaatgattgcctggatgatgctttggatagaggtttgcacaatttttcataaatccactgatgtcacctgatgcaattcttaggaaaaccagaaaaacttactgacagatattttgcgaatgagtcagcagctccagaaacatatttgcttggagagccatccatatcacaagtttagcactgggaaatcggaacactttactggttaatccaaataaggaaggattggacatattggaagagcttattacattttatagttcacactattcagccaacttgatgcaacttgttgtgtatgggaaagctagttaaagcagttcccataaaacaaggccacacgttgagaatactgtggccaatcaccccaaatatccagcattataaggaaggtccttgcaagtatgtgagtcatttagttggccatgaaggaaaggggtctctgttttatgtactaaaaaaattagggatgggctatgagtttgagagcaggggaaggtgattggagttctgtgttttcgttcttcagtgttgttatacggctcacagatgtaggccatggaacatatggaggacattattggactgttgttcagatatataacactgcttcagacctctggaactcctaaatggatttttgacgagatccgtgagacaggattccactaccgagacaagagtcctcctagccaatatgttgtcaatatttcctcaaacatgcaggattggctgattgcatcgtctgtgccatcaaagttttcaccagatgctattcagagtatattaaatgacttgactccagataaagttagttcagaatattctgggagtcaaaaaagtttgaagggcagacgaacttaacagagccatggtatgtgggtaaatagagctcccatggaagatttgcacataccaaaacctaacatcttcattccaagtgatctttcattgaagaatgttgaggagaagctgcggaaaacactgttttccatagtgtggtataagcctgatacgatgttcttcacacccaaagcctacatcaagatgtatttccactgtccactgtcccgtagctctccagaatcaatagttcttactgatatgttcacaaggttgctaatggattatttaaatgattatgggctataatgacaaaatgagaacccttctggagactgtcattggaaaaattgctgcatttgaagtgaaggttgaccgttttgttgtgataaaggaaactataacaaaggcgtatgagaatttcaaatttcagcaacctcatcagcaggcatcgtactattgttcattgatattagaggaacaaaaatggacatgggatgaaaaacttgctgcaatttctcatactgaagctagtgatctagagaaatttttgcctcatctgctggggaagacatttattgagagctactttgctgcagattcatcaggatgacctcaaacaaaatgttctacttcagttgcttgcccttgttgctaagcaaccagcctttcaccaattacgttcagttgaacaacttggctacataacatggcttaaacaaagagaaatgattcaggcgtccgtggcttgcaatttacaatccagtcaactgtgaaggatgccagagtggaagcttttcttaagatgtttgaaggaactctatacagtgacgtgaatgctctcatcaatatgaagctggagaaatacaagaatataagagaggaatcagctttcttctggcgagagatctctgaaggaactctgaaatttgatagaaaagaggcggagctcaagaaagaggagctgattgagttcttcgataatcatgtcaaagttaatgcaccacgaaagaagatactcagtatacaagtctacggccgtctccacaccaacgagtacgaaaaggtagttcacgacgagccacagccgcattcctatcaaataaccgatatattcagcttcaggaggtcgagacctttatatggttcattcaaaggaggtattggtcagatgaagttatag

SEQ ID NO: 898 - DNA, 2300 bp, Oryza sativa
atgccaccgatcccatctctgtggatccgcgtcttcttctcctggctgctgctgtcgctgcccgccgcggctgccgccgatttcagccactgcggcggctgcgacgacggcgacggcggcggcggcatatggagcacggacaacatcctgcaatgccagagggtgagcgacttcctcatcgccatggcctacttctccatcccgctcgagctgctctacttcgccacctgctccgacctcttcccgctcaagtggatcgtcctgcagttcggcgccttcatcgtgctctgcggcctcacccacctcatcaccatgttcacctacgagccgcactcgttccacgtcgtgctcgcgctcaccgtcgccaagttcctgaccgccctggtgtcgttcgccaccgcgatcacgctgctcacgctcataccgcagctgctcagggtcaaggtcagggagaacttcctcaggatcaaggcgcgggagctggaccgggaggtggggatgatgaagaggcaagaggaagcgagttggcacgtgcggatgctcacgcacgagatccgcaagtcgctcgatcgccacacgatcctgtacaccaccatggttgagctctccaagacgctcgagctgcagaactgcgccgtctggatgcctagcgagagcgggagcgagatgatcctgacacatcagctgaggcagatggagacggaggactcgaatagcctgtccattgcgatggacaacccggatgtacttgaaataaaggcaacaaaggatgcaaaagttctcgcggcagactcagcgcttgggattgcaagcagaggcaagcttgaagcaggtcctgttgctgcaatacggatgccgatgttgaaggcgtcgaatttcaaaggagggactccagaagtgatggaaacaagctatgctattttggtcttggtactacccgaggatggttcactaggatggggtgaagaggagttggagattgttgaagtggttgctgatcaagtcgcagtcgccctatcacatgctgcagttctggaggaatctcaattgatgcgagagaagctcgccgcgcaacacagggacttgctgagagcaaagcatgaaaccacgatggccactgaagctaggaactcctttcagactgccatgtatgatggaatgcgacggccaatgcactcgatccttggtctagtctcaatgatgcagcaagaaaatatgaaccctgagcaaaggcttgtaattggatgccattgtcaagacaagttagcgttgcgtcaacattgatgaatgatgtcatgcaaacatcaaccgtaaatcgtgagtatttgtctttggtgaggagggcattcaaccttcattcgttggttaaggaggcaatcagtgttgtaagatgcctaactggctgcaaggggattgattttgagtttgaagtggataattctttgcccgaaagggtcgtcggtgatgagaagagggttttccacatcgtcctgcacatggtaggtactctaatacagaggtgtaatgcaggctgtctatccttgtatgtgaatacttacaatgagaaggaagagaggcacaatcaggattggatgctgcgaagagcaaacttctctggcagctatgtgtgtgttaagtttgagattaggattagagagtccagaggtaatcttttgagttcgtcatccagtcggagacttcaagggcccaactctaccagttctgagatggggcttagcttcaacatgtgcaagaaaattgtgcagtgcagatgatgaatggtaatatttggtcagtctctgattcaaaaggccttggagaaactatcatgcttgcccttcagttccagctgcagcatgtgactccggtctctggagcatcctcggacttgttccgatcagcgccaattcccaattttaatggactccaagtcattcttgtggacagtgatgacaccaatcgggccgtaactcacaagctcctggagaagcttggttgcctagtcctctcggttacttccggcatccaatgcatcaactcctttgccagtgctgagtcatctttccagctggtggttcttgacctcaccatgcgtacaatggatggatttgatgtagctcttgcaatcaggaagttcagggggaattgttggccaccgttgatagttgctcttgcggcaagcaccgatgacaccgttcgggatcggtgccagcaggcaggaataaacggtccgatcccaaaaaccagtcactttagcagcactgggagatgaactgtatagagtccttcaaaacaattga

SEQ ID NO: 899 - DNA, 2220 bp, Oryza sativa
  misc_feature (1316)..(1316): n = any nucleotide
gttttgtctaagaaagaccaacaacaatactggagtcatactgaggaaacatacaactttgttactgttgatcacttctgtgagaaatttaaagcatctcaatactctctaaccaagtgggatctcctcaaggcatgttttgcaagggaaattcttctcatgagaagaaatgccttcatctacataacaaaagttgttcaggctgttattactgggacagtgtttctacggacacatatgggggtcgatagggcccatgctgactattatatgggttccctcttctatgcgctcctccttcttttagttaatggtttccctgagttggctatggcagttaccagacttcccgtcttttacaaacaaagagactactatttctatccggcgtgggcttatgcaatacctgcttttatactaaagattccagtttctttagttgagtcaataacttggacatcaatatcttactacctcattggctatactccagaagcatccagtctatgcctaattggctaaaatggggattttggatctctccattgtcatatgctgagatagggttaacagtaaatgagtttttggcaccacgatggctaaagacacttggaaggagggtaataatggatcgaggactagacttctctagctacttttattggatttccgtcggtgcattggttgggtttattttgttgcttaatatggtgttacctttcacaccacttacaatatcatttcaagatgtgaactactatgtagacacccccgtggaaatgagggagcaaggttacaaggagtgaaagttacaactactgcacaacatcacaggagctttccaaccaggggttctatcagcactcatgggagttactggagcaggaaaaacaactctacttgatgttcttgctggaaggaaaactggtggtgttattgaaggagatatacgagtaggaggttatcctaaaattcaacaaacttttgcaaggatatcaggctattgtgaacaaaccaatgttcattccccacaaatcacagtggaggagtcagttgcatattcagcttggttgcggctaccaacagaagtcgattcaaaaacaagaagaacaattgagttggatgatattagagatgctttagtaggactaccgggggcagtggagcttgtgtccaatccttcagtcatattcatgcttggatgcacgagcagctgctattgtcatgcacaaggtgaagaatgtcgcagacacaggtcgaacagttgtgtgcaccattcaccaaccaagtattgaaatatttgaggcctttgatgnggtactttcaacttttgctaatgaaaaggggtggagagttgatatatgctgggcctcttggattccattcatgtaacgtcatccactatttcgagcccaagatcaaggataactacaacccatcaacatggatgctcgaagttacttgtgcatctatggaagctcaattgggagtagaatttgcccaaatttacagggaatcaaccatgtgcaactagtgaagagtttgagcaaaccagctctaggcacgagtgatctccatttcccaacacggtttccacagaggtttggggagcaactaaaagcttgcatctggaagcagtgtttgtcatattggagaagtccttcctacaacctagtgcgacaacaaggtctattcaccatactagggtgcctgtacggcaccactctttttactggcatcaataactgccaatcggtgatgccgtttgtctccattgagcgctctatcgtttatagggagaggtttgcaggaatgtactctccttgggcctactccttggcacagacgtttcctaactacttgggaatgatgatagtggcactcaccccaaatgtggcatctatattggcatccatgttctacaccctgcagaacctcatgtctggcttcatcgttcctgcaccatggatatggctgtactacacttccccattgtcatggacactcaacgttttcttcaccacacaatttggggatgagcatgagaaggagatttctgtatttggagagactaaatctgtggccgccttcatcaaggactacttcggtttccaccgtgacctactgccactagcagccataattttggccatgtttcccaccttgtttgccatcctttttggtctcagcatctccaagctcaacttccaaaggcgataa

SEQ ID NO: 900 - DNA, 2202 bp, Oryza sativa
atgaggccgccgacgcctctccccttcctgctgctcctcctcctcctcctggtgctcctcctcccgtcgccgtctgcggcggccgcgggcggcgccgacgggtgggaggcgatcggcgcggcggcggcggggggaggccgccgcagggtcgcgtcgccgggagagcaggaggcggccgccgccgggttgctccgcaggctcctcccctcccacgcccgcagcttccgcttccagatcgtctccaagtgcggcgggtcaagctgcttcaggattagtaatgcggatggctcgcgcagaaatggagcagaaattctgatccagggtaccacagcggtcgagctcgcctctggtctccactggtatctcaagtactggtgtggtgcacacatttcttgggacaagactggtggcgcacagctggcctcggttcctttgcccgggtctctaccgcaagtaaaagggacaggagtgaagattgagcgacctgttccgtggaattactatcagaatgttgtcacctctagcttcatttgtctggtgggattggaaaagatgggagaaagaaattgactggatggcacttcaaggaattaatttgcctttagcatttaccgggcaggaagctatctggcaaaaggtttttaaggacctagatgatttttttggtggaccagctttccttgcttgggctagaatgggtaacctgcatggtggggtggaccactatcacaaaattggctggatcaacaattgacactgcagaagaaaatattgtcccgtatgattgagcttggaatggtcccaggttctaccatcgttctcaggaaatgtaccgtctgtgtttaaaaaattatttccatctgccaacataaccaaacttggtgactgggaacactgttgatggtgatcctaggtggtgctgtacttatcttcttgatccttctgatgcattgtttattgatgtggggcaggcgtttatcaggcaacaaatgaaaggacaccttcaacgagaatacaccacccacatggctgttctactcagatgcagctttctggaaggagcctcaaatgaaagcattacttcattctgttccaactggtaagatgatagtccttgatttatttgctgatgtgaagcccatatggcaaatgtcctctcaattttatggtgtgccatatatatgtgcatgttacacaactttggtggcaatattgaaatgtatggcatacttgactcaattgcatctggccccattgatgcacgtacaagccacaactcaacaatgggttggcgttggcatgtgcatggagggaatagagcataatccagttgtttatgagcttatgtctgaaatggcattccgtagtcaaaaagttgaagttgagcaggattggttaaaaatatactcctacaggcgatatggtcaatcaaatgttgaggtggagaaagcttgggggattttgtatcatacaatatacaattgcacagatggaattgcggatcataataacgattacatagttgaatttccagacgaggtgtctgcaagcctaccacatccacatctatggtattccacaaaggaggctatcaaagcccttgaattatttcttaatgctggaaacgatctttcaaaaagtttgacatatagcttgttgacctgacaaggcaatcactgtcgaaattagcaaatgaagtgtaccttgatgccatgaatgcttaccgaaagaaagattcaaatggtctaaacttttacacgaagaaattccttgagctcattgtggatattgatacactactagcttctgatgataattttctgctggggccttggcttgaagatgcaaaaagccttgctaggactgaaaatgaacgaaagcagcagtatgagtggaatgctagaacacaggtaacaatgtggtatgacaatacaaagaccgagccgagttaactacacgactatggccaataaattttggagtggactgctgaagagctactatctaccaagggcatcgaaatacttcagtcgattaacaaaaggcctacaagagaaccagagttttcagctggaggaatggacgaaagattggattgcctactcgaatgaatggcagtccgggaaggagctctatgctgtgaaggctacgggtgatgctttggcaatttccagctcactattcaaaaagtacttcagttag

SEQ ID NO: 901 - DNA, 2018 bp, Oryza sativa
  misc_feature (442)..(442): n = any nucleotide
atgggattatattcttcttctcgtgcaattctactactttacttttgcacattgttgttcagagcacacggatctcgtaagctttacatagcatatctcggtgatgtaaaacacagccaccccgacgatgtcatcgcttcacaccatgatatgctcaccactgttcttggaagagcaaggaagattctttggcctctatcatccacaactacaagcatggtttctcaggcttcgccgtgatgcttactgaagatcaagcaaagcaacttgcaggaatttccggaagtccttagtgtggaaccaagcaaaacgtatacgacggcgaccactcggagctgggacatgcttggactgaactacagaatgcccactgaactgctccagcgaaccaactacggcgaggagataatcattggcattgttgacactgggagtctgccangtcggcgaaggatggggcagcaacaatgagccgcaagatatcggcgcgcggttacacgccggggtggacgaggacgacctcaagatcgactacctctcgccccgcgacgcgaacggccatggcacgcacacggcgtccaccgcggcgggctccgtcgtggaggcggggtccgggagcaccgccaccgtgctggccgccatcgacgacgcgatccacgacggcgtggacgtgctgtcgctctccctggagaactccttcggcgcgcagcacgccgtccagaagggatcaccgtgtttacgccgccatgaaccttggcctgcgcctcaggtggttcagaacactgccccttgggtcatcaccgtcgcggcgagcaagatcgatcggtccttcccgacggtgatcacgttgggtgacaagcgacagatagtgggacaatctctctactctcaagggaagaactcatcgctcagcggtttcagacgccttgtcgttggagttggagctgaatggcacggatgtcaaaggaagcattgtgctgtgcgcatcttttactctcaacaaaccatctatccttttccaagaagctctaggaaacgtcgtgaaaggcggaggggtgggcatgattttcgttcagtatacgtgggatattgtaagttcgacagccagatgcaacggtattgcgtgtgttattgtggactattacacagtgaaacagatcggaaaatacatactcagtgcaagagttcacccattgtgaagatcgatccagcacgcaccgtaacggggaatgagataatggcaccaaaagtggcagatttctcttcaagaggcccttcaactgattaccctgaaattatcaagccagacatagctgcaccaggattcaacatcttagcagcagtgaaaggcacatacgcatttgcctcagggacgtcaatggctactccgcatgtagcaggcgttgtcgcgctgctgaaagctctgcatccaagctggtcacctgctgcactaaaatcagccatagtcaccacaggcatctgtaactgatgagcgtggcatgcccatactggccgaagggttgcctcggaagattgctgacccatttgactatggaggcgggcacatcaaccctaacagagcagctgatcctggcctgatttacgacattgatccaagcgattacaacaaattctttggatgcactgtaaagccatatgtaaggtgcaatgcgacatcgttgcctgggtattatctgaacctaccgtccatctcagttcccgatcttaggtatccggtcgtcgtatcaagaacggtcacaaatgtagctgaggttgatgctgtttaccacgctgcaatcgagagcccacctggcgtaaagatggatgttgagccacctgttctggtgttcaatgctgcaaacaaagttcatacgttccaggtaaagctttcacctctatggaagctgcagggggactacacgtttgggagccttacttggcacaacggccagaagacagtgagaatcccgatagcagtcaggattacaattcaggatttctacgcagacattgcataa

SEQ ID NO: 902 - DNA, 1883 bp, Oryza sativa
atggggcagtgctacggcaagggcgcgtcggggaggacggcggacgatgagggcggggtggtgacggagcaccagtcgccgccgccggcgaacgggctgccgtcgacgccgccgcggcagcaggcgcaggcgcaggcgcagcaggtggggacgccgaggcggcttgggagtaagtccggatcgacgacgccggggcaccagacgcctggggtggcgtggccgagcccgtacccgtccgggggcgcgagcccgctgccggccggggtgtcgccgtcgccggcgaggtcgacgcccaggaggttcttcaagcggccgttcccgccgccgtcgccggccaagcacataaaggccacgctcgccaagaggctgggtggggggaagcccaaggaagggacgataccggaggagggaggcgtgggcgctggcggcggcggtggaggggccgcggatggggcggagacggagaggccattggacaagacgttcgggttctcgaagaacttcggcgcgaagtacgagctcgggaaggaggtggggaggggccacttcggacacacttgctccgccgtcgtcaagaagggcgagtacaagggacagaccgtcgccgtcaagatcatcgccaaagctaagagatgacaacggcaatatccattgaggatgttcgtagagaagtaaaaattttgagagcgttatcagggcacaataatctcgtcaaattctatgatgcatgtgaggatggcctcaatgtctacattgtcatggaattatgtgagggaggagaattgctagacagaatattagccagaagaggcgggagatacacagaggaagatgccaaagcgattgttgtacagattttgagcgtagtagccttctgtcatcttcagggggtagtgcatcgtgatttgaagccagagagaatttccttttcacaaccagggatgaaaatgctcccatgaagttgattgattttggtctctctgatttcattagaccagcagatgaaaggcttaatgatattgttggaagtgcatattatgttgccccagaggttttacacagatcatatagtatggaagcagacatttggagtataggtgtcataacgtacattctgctctgtggcagtcggccattctgggcacgaacagaatcaggaatattccgatctgtgttgagagctgatcccaactttgatgattcaccgtggcctacagtatcagctgaagctaaggattttgtgaagagatttctgaacaaagattaccgcaaaagaatgaccgctgttcaagcactgactcatccttggttgcgagatgaacaaaggcagatcccgctggacatactcatcttcagattaattaagcaatacctccgcgctacacctcttaaacggttggcattaaagaggcactatccaaggctttaagggaagatgaacttttgtatctcaaactgcagtttaaactgctcgaacctagagatgggtttgtatcacttgacaactttcggacggcactaacgcgatatttaactgatgctatgaaggaatcgagggttcttgaatttttgcatgcgaccacttgcatacagaaggatggactttgaagagttctgtgccgcagcaatcagtccttaccagcttgaggcactggaaaggtgggaggagattgctggaacagctttccagcaatttgaacaagagggcaaccgagtcatatcagttgaggaattagcacagacaggaattaaatcttgctccaactcattactccatcgttcaagactggatcagaaaatccgatggcaagctaaactttctcgggtttaccaaatttttacatggtgtcacaataaggggctcaaatacaagacggcattaa

SEQ ID NO: 903 - DNA, 1875 bp, Oryza sativa
atgaggacggcgcggaggctcgggatccccaccgtcgcggtctacagcgacgccgaccggggggccctccacgtgcgcgccgccgacgaggccgtccgcctcggcccgccgcccgccagggagagctacctcaacgcctccgccatcgtcgacgccgcgctccgcaccggcgccgctatccacccaggatatggttttctttcggagagcgcagatttcgcgcagctctgtaaagccgaggggcttacattcattggaccaccaccatctgctatccgagacatgggcgacaagagagtgcttctaagaggatcatgggtgctgctggtgtaccgctcgtcccagcaagacattgagctgttaaaacttgaagccaataagattgggtatccagttttgatcaagcccacacatggtggagggggcaagaaggggatgagaatagttcaaaggcctgaggactttgtggattctgtattgagtgctcaacgagaagccgcagcatcatttggcataaacacgctgctggttgagaagtatattacccaacccagacatatagaagtccaggtgaagatatttggagatcaacatggaaatgtgattcacctttatgagagagattgtagtctacaaagaaggcaccaaaagattatcgaggaagctccagctggtgaagctgctgtatcagctgcaaaggcgttgaaggcagttggttactacagtgctggaacagtggagtttatcgtggatactctttccggagaattctatttcatggaaatgaatactcggctccagttgaaggttgaacacccagtgaccgagatgatcgttggccaagatcttgttgagtggcaaatacgaattgcaaatggagagtgcctaccattatctcaggagcaggttccgttaaatggtaatacttcttagtcaggacatgcgtttgaagcccgaatatacgcagaaaatgtgccaaggggatttcttcctgctacaggaaccttacaccactacaggtaagagttgaaactggagttgaagaaggagatactgtcagcatgcattatgatcccatgatagccaaacttgtggtttggggtgaaagtcgcaatgctgcgctagtcaagctaaagaacagcctgtcaaactttcagcagattgcaggtttgccgaccaatgttggtttcctccaagaactcgcaggtcatagtgcctttgaaaaaggcctagtcgatacacatttcattgaacgctatcaaaatgatcttctgagtacttctactcaagccttgagtggatcacatgaagcagaagagcttggtgcaattttggctgctgcctgcatttgcaagaaggatcatgtttcctctgaagtgtcacttctggtacgcccatccacctttcaggatgcatcattttgccaagcgtctaatggaatttgagttggatagagaacttggtggatcaagtgatgatcttcttaaactgtcggtaacatatagatctgacggaacctacttcgttgagcatatacacatctggcatgggaagcatcatcatcattacaggcagacgttgagagctgagcagtcacctgatgacagttctcaacctagcgcttcctctgaggcgaggtcacatccaaaggggagtgttttggcaccaatggctggtctggttgtaaaggttttgcttaaagacggggcacgggtggaggaaggtcagcctgtcatggttatggaagcaatgaagatggagcatgttgtgaaggcgccttgtgccggatatgtggaagggctgaaggctactgccggacaacaagtttttgactctagtgtccttttcaccgtgaaggtacgtcacaattattga

SEQ ID NO: 904 - DNA, 1815 bp, Oryza sativa
atggatgatgatgactactcctgggtgcggcgcaccaagttctcgcactccattgttaaatccaactctggcagggagcagtttggtgcattccttgatccgtttgacagttccactgcatggaggcagaaaggattcagtggagagctcatgattcatggacataatttacagccgagggcaaaaggagcagtctcaaagtcacctaggccttcaatcccgttggcgaaatcaccagtttcacaggcagagcggaagctgaaagctaagttttcagatggtgaattgaaacaacgggggaaaattagtgatggctcgttgcgagaagcatcgaaagagaaggatcgcaaggttgggcataaaggagaaggccttagcctggatatttcttgtccaattctggatcggacagttcaggatgacagttcagacacgcttgacttctctttccactcagaagagcaaagtttaaggttgctgagagtatgctcgagtccagctcctttctattcgaaggatacaactacgtttggtgattccaaaatacatagtacgtctgttaagattgttggagagggatcgaagccgaggaggagagcgaaatccccaatgccgacccgtgtcatctctgaagtttttaaggaggccaaagctgccactaagaggttctctagcccacagcggcaaaggaaatctagttctccacattcaccacgttcacccgatgatagtccccggtttggctttccttcaatgagaacaccgggtaacttgaaagctaggagggcctcgtcctggccaaggaactatgacaatggagtggccaaggctgttgcattggatatacttgagagatggacaattgaccgctcacagttactcattggtcaaagatttgcatcaggggcatatagtcgtttgttccatggaatttacaaggagcagccagttgctgtcaaatttatcaggcagcctgatgaagaagaagatgcagaattggctgctaaacttgagaagcaattcactgctgaagtaaccattctggctcggctccatcatcgcaatgtcattaagctgattggggcatgtaatgctccaccggtcttttgtgtcatcactgagttcctgtgcggggggtctttgagagcttttttgcgcaagctccagcgccaaaagcttcctttggagaagatcatttgcattgctttggatattgcacatggtttggagtacattcactcgcaaagagtaatccatcgtgatgtgaaacctgagaacatcttgtttgatggagaatgttgtgcaaaggttgttgattttggagtggcttgtgaagaagtatactgcaactcattggaagatgacccaggtacttacagatggatggcaccagagatgtataagcgcaaaccatatggtcggaaggttgacgtctacagttttggcctcgtattgtgggaattgtttagtggctcgatcccttatgaagagatgactccattgcaggcagcttttgcagttgttaataagaacttaagaccagttgttccttcaagctgtccggcgcaacttcgacttttgatcgagcaatgttggtcttgtcaaccagagaagagacctgagttttcccaagtagttcagatcctcaaaaatctcaaggaggccctggatagagatggaacgcttgacaagatcccaagcaccaactgccaggaacctcctgatcagaacaagaagagactgtccaattggatccaaagactctcgtacagtcaggccgatttctccggacctccaccgccaaagttattgtaa

SEQ ID NO: 905 - DNA, 1805 bp, Oryza sativa
  misc_feature (74)..(74): n = any nucleotide
atggccgggctcgacggcggcggcgacgccgaggagggggccacgcatgcccgcggcggcggcggcgcgccgcngccgtggcgggagcagctgacggcgcgcgggctggtggcgagcctggccgtgggcgccatgtacagcgtcatcgtgatgaagctgaaccttaccacgggcctcgtccccacgctcaacgtctcagccgcgctcatcgccttcgtcgtcctccgcggtccgcccgttcacgcggcaggagaacaccgtcgtccagacctgcgccgtcgcctgctacagcatcgcagttggaggcggtgggtttggttcttacttgcttgggctcaacaagaggacttacgagatggcgggcgaggacacggagggcaacgtgccggggagctacaaggagcccggcattgcgtggatgactggattccttctcgccgtcagcttcgtcggacttctcgctctcgtccctcttaggaagattgactacaaattaacttacccaagtgggactgcaacagctgtgcttataaatggattccacacacctcatggggatgcaatggcaaaaggcagcaagtaaatggattcaccaaatattttagtttcttttggagcttcttccagtggttttactctggtggagacaattgtgggttctcgcagtttccaacttttggactaaaagcttggcaacaaacttcttcttcgatttcagtctcacatatgttggggcagggatgatttgctcccaccttgttaatctgtctctcctactcggcgccattctctcatggggagtaatgtggccactgatcagtgatttgaaaggggattggtattcagcagatatacctgaaagcagcatgaaaagcctgcaagggtacaaggccttcatctgtgtagctctcatcctagctcgatgaacttcatcgtaatgaagtttttacaacagacaatattccttcctggctagccttctctggttatcttggattaacttttattgcagtaattgccattcccatgatgttccatgagatgaagtggtattatgttgtcatagcatacttattggcgcctgcccttggtttctgcaatgcctatggagcaggcctaactgacatcaatatggcctacaattatggaaagattgccctcttcattcttgcagcctgggctgggaaagactctggtatagttgctggcctagtaggctgtggtttggtgaaatcgctggtgtccatatctgctgatctgatgcatgatttcaagacgggacatctaacattaacatcaccgagatcgatgattattgctcaggccattggaactgtcatgggttgtgtaatttcaccactaactttcttcttgttctacagtgcctttgacattggcaacccagaagggtactggaaagcaccatatgctctagtctaccgaaacatggcgattcttggtgttgagggcttctctgctctgccccagcattgcttgcagctctgctatgggttttttggctttgcagtggcagctaaccttacgagggacctttgcccaccgaactaccgatggcaatgggggttcctttcctggttggtgcaagctttgccatcgacatgtgtatcgggagcctgatagtcttcacctggcatataattgacaaaagcaaagcagcactaatggtgccagcagttgcatctggtttgatatgcggggatggtctttggatcttccctgcgtccttgcttgctttggccaagatcagcccaccaatgtgcatggcatttaggtctacaaactag

SEQ ID NO: 906 - DNA, 1795 bp, Oryza sativa
  misc_feature (88)..(88): n = any nucleotide
  misc_feature (94)..(94): n = any nucleotide
  misc_feature (127)..(128): n = any nucleotide
  misc_feature (133)..(133): n = any nucleotide
  misc_feature (234)..(234): n = any nucleotide
  misc_feature (242)..(242): n = any nucleotide
atggggaacacgtgcgtcggccccagcatcagcaagaacggcttcttccagtccgtctccacggtgctctggaaggcgcgccaggacngcgacnacgcgctgcccggcgccaatggcgcccctgacnnctgcngccagggccggttgccggcgccgccgccgccgacttccgacgcgccgctcgccgtccaaaacaagccccccgagcacgtcaagatcgtctcgaccacgganaccgcctncgccgagcagacgcctccaagtcgagcgccggctcggactccggcgagccgccaggccgcggccgaggtgccgccggtgaagcgcgtctccagcgccgggctgctcgtcggctcggtgctgaagcgcaagacggagagtctcaaggacaagtacagcctggggcggaagctcgggcaggggcagttcgggacgacgtacctgtgcgtggagcgcgccaccggcaaggagttcgcctgcaagtccatcctgaagcggaagctggtcaccgacgacgacgtcgaggacgtccgccgcgagatccagataatgtaccacctcgccggccaccccaacgtgatctccatcaggggcgcctacgaggacgccgtcgccgtgcacctcgtcatggagctctgcgccggcggcgagctgttcgaccggatcgtccagaaggggcactacaccgagcggaaggcggcggagctcgccagggtcatcgtcggcgtcgtcgaggtgtgccactccatgggcgtgatgcaccgtgatctcaagcccgagaacttcctcttcgccgaccagacggaggaggccgctctcaagaccattgactttggtctctccatttcctttcgcccagccaggtcaagtattcactgatgttgttggtagcccttactatgtcgcgccagaagttctgaaaaagaaatatggtcaagaggcagatgtctggagcgctggtgtgataatttacatcttgttgtgtggtgtgccgccattttgggcagcagagaacgagcagggtatatttgaagaggttttgcatggtagacttgactttcagtcagaaccatggcctagcatctctgaaggtgccaaagatctcgtaaggagaatgcttgttagggacccgaagaagagattgacagctcatgaagttttaaggcatccatgggtccaggttggtggtttggctcctgacaagcccctggattctgctgttctatctcgtatgaagcaattctcagctatgaataagctgaaaaagatggctcttagggtcattgcagagaacctatctgaagacgaaatcgccggcctgaaagaaatgttcaagatgatcgacacagacaacagtggacagatcaccttcgaagaactcaaggttggtctgaaaaaagtcggtgctaacctccaagaatccgagatctacgcactcatgcaagccgcagatgtagataacagcggcacgatagattacggtgagttcatcgctgcaactctgcatatgaacaagatcgagcgggaggatcacctgttcgcggcgttccaatacttcgacaaggacggcagcggctacatcacggccgatgagctgcagctcgcctgcgaggagttcggcttgggagacgttcagctcgaggagatgatcagagaagtcgacgaagacaacgatggtcgcatagattacaacgagttcgtggcgatgatgcagaagccgacgatggggctgcagaacagtttcagcatcggcttcagggaggccttgaggatgtcttgagaaacagccactaga

SEQ ID NO: 907 - DNA, 1638 bp, Oryza sativa
atggcgaccgatggcggcgtgttgcagctgcacccctacgccatggccgcggctgccgtggcattggcttcggcgtacatggtgtggttctgggcgctgtcgcggcggctgtccgggccacggatgtggccgctcgtcggcagcctacccagcgtcgtgctgaaccgggcgcgggtgcacgactggatcgccgacaacctgcgcgccacgggtgacgccgcgacgtaccagacgtgcatcctgcctctgccattcctggcgcggcggcaggggctggtgacggtgacgtgcaacccgcggaaccttgagcacatcctgcgcgcgcgcttcgacaactaccccaagggccccatgtggcaggcatcgttccacgacctcctcggccagggcatcttcaactccgacggcgagacgtggctgatccagcgaaagacggcagccctcgagttcaccacccggacgttgcgccaggccatggcacgctgggccaaccgctccatcaagtaccgcctgtggcgtatcctcgacgaccactgcaacgcggccgcaagcgtggacctccaggacctcctcctgcgcctcaccttcgataacatctgcggcctcaccttcggcaaggacccagagacgctgtcccccggcttgccggagaaccccttcgccaacgcttttgacgaggccaccgaggcgacgatgcagaggttcctgttcccgagcttgttgtggcgcatcaagaaggcgttcggtgtcggcagcgagcggagcctccgcgacagcctcgccgtggtggaccgtcacatgacggagaccatcgcggcacgcaaggcgacgccgtcggacgacctgctgtcccggttcatgaagaagcgcgacagcaagggcaaagcgttcccggaggacgtgctccagtggatcgcgctcaacttcgtgctcgccgggcgcgacacgtcgtccgtcgcgctcagctggttcttctggactctcatgcagaggcgggacgtggagcgcaaggtggtcctcgagatcgcctccgttctcagggagacgcgcggggacgacacggcgaggtggacggaggagcctctaaacttcgacgagctggagcgactggtgtacctcaaggcggcattgacggagacgctgcggctgtacccgtctgtgccgcaggattccaagtacgtcgtggcggacgacgtgctgcccgacggcacagtggtgccggccggctcggcgatcacctactccatctactcagtgggaagaatggagagcatatgggggaaggactgcgcagagttccggccggagcggtggctatcggccgacggcagccgcttcgagcctgtcaaggacgcgtaccgcttcgtggcgttcaacggcgggccgcgaacgtgcctcggcaaggacctggcctacctgcagatgaaatccatcgcgtccgccgtgctgctgcgcaactcggtggagctcgtgccggggcacaaggtggagcagaagatgtcgctgacgcttttcatgaagaatggactgcgagtgcacgtcaagccgagggacattgccagctacgtcgagccgtcggagccggcgccgccgcagggctccctcgtgataccgactaccaccgcagccgctgcgtag

SEQ ID NO: 908 - DNA, 1605 bp, Oryza sativa
  misc_feature (1173)..(1173): n = any nucleotide
atgggcggcggcggcggggagcagcagcagcttgaggtgctccacgccctggacgtggccaagacgcaatggtaccatttcacggccatcgtggtggccggaatggggttcttcaccgacgcctatgacctcttctgcatctccctcgtcaccaagctgctgggccgcatctactaccgcgtcgacgggtccccgtcccccggcacgctccccccgcacgtctccgcctccgtcaacggcgtggccttcgtgggcacgctctcagggcaactcttctttggctggctgggcgacaagctcggccgtaagcgcgtctatggcatcaccctcatgctcatggtgctctgctccctcgcctccgcgctctcctttggccacaccccgacctccgtcatggccaccctctgcttcttccgcttctggctcggcttcggcatcggcggcgactacccgctctccgccaccatcatgtccgagtacgccaacaagaagacgcgtggcgccttcatcgccgccgtcttcgcgatgcagggcttcggcatcatcaccggcggcctcgtcgccatcctcgtctccgcctccttcagggccgccttcccggcgcctccctacggcgaggaccccgtggcctccacgccgccgcaggccgacttcgtgtggaggatcatactcatgctgggcgcgctgccggcggcgctcacctactactggcgcaccaagatgcccgagacggcgcgctacacggcgctcgtggccaacaacgccaagcaggccgcggccgacatgtccaaggtgctgcaggtggtggagatgcgtaatattggtaataatggtggcagcaggaggccgttcgggctgttctccggcgagtttgtccggcggcacgggctgcacctggtgggcacgtcggcgacgtggttgctgctggacattgcgttctacagccagaacctgttccagaaggacatattcagcgcggtggggtggatccccaaggcggcgacgatgagcgcgctggaggagctgttccgcatcgcgcgggcgcagacgctgatcgcgctgtgcgggacggtgcccggctactggttcaccgtcgcgctcatcgacgtggtgggccgtttcaagatccaggccgttggcttcttcatgatgaccctcttcatgctcaccctngccctgccgtaccaccactggacggcgccggggaagaaccacgtcggcttcctgctgctctacggcctcaccttcttcttcgccaacttcggccccaactccaccaccttcatcgtgccggcggagattttcccggcgcggctgcgggccacgtgccacggcatctcggcggcgtcggggaagctgggcgccatcgtcggatccttcgggttcctgtacctggcgcagagccccgaccggagcaagacggagcacgggtaccctccgggcatcggcgtccgcaactcgctcttcctgctcgccgcctgcaacctgctgggcctgctcttcaccttcctcgtgccggagtccaaggggaagtcgctggaggagatgtccggcgacgccgaggcccaggaggaggcgccgccgcccctgcaaactgtactgtag

SEQ ID NO: 909 - DNA, 1584 bp, Oryza sativa
  misc_feature (37)..(37): n = any nucleotide
  misc_feature (65)..(65): n = any nucleotide
  misc_feature (76)..(76): n = any nucleotide
atgtcgctcgaaatccatgaaggttacggggcggcanaagacaccgacctgcacgtggcggcccncggaggggacnccggggcgctgcgccgcgcgctggacgaggcggcggcggccgtggccaccggggaggggagggaggcgctggaggaggtgcggcgggccgtggcggcggagcccaacgaggccggggagacgccgctcgtcgccgcggcggagagggggcacctggaggtggtaagggagctgctcaggcacctcgacgccgagggggtcgccgcgaagaacaggtcggggtacgacgcgctgcacgtcgcggcgagagaaggccgtcatgctgttgtgcaggaaatgttacttcacaataggttgcttgccaagacctttgggcctgcgaatactagtccacttatttcagcagctacgaggggtcacaccgaagttgtcaaattgttactagaactagatgattttggattggtggaaatggctaaagataatgggaaaaattccttgcattttgctgctcgacaagggcacgttgaaattgttaaagcattactcgagaaagatcctcagctagcaagaagaaatgacaagaaaggtcaaacagccttgcatatggctgtaaaaggaacaaactgtgatgtgcttagagcacttgtcgacgctgatccagcaattgtaatgctgccagacaaaaatggaaacaccgccttgcatgtagcaacaaggaaaaagcgagcagagatagttgctgttctcttgcgattaccagatacccatgtcaatgcactaaccagagaccacaagactgcgtatgatatagctgaagccttgccactctgtgaggagtcttctgaaataaaggatattttatctcagcatggcgcactcagatctagggagctgaatcagcctcgagatgagctccgaaaaacagtgacagagatcaagaaagatgtccacacacagctggaacagacaagaaaaacgaacaaaaatgtgcatgggattgctaaggaactcagaaagttgcacagagaaggcatcaataatgcaacgaactctgtaactgttgttgcagtactttttgccacggtagcctttgcagccatattcactgtgcctggtggaaatgccaacaatggagttgcggttgttgttcaggcagcctcctttagaattttcttcatcttcaatgctatagctctgtttacatcattggcggtggtcgtagttcagataacggttgtcaggggagaaactaagtctgagaggaaggttgttgaggtgatcaacaagcttatgtggctggcatcagtttgcactaccatttctttcattgcctcttgctatattgtgctaggccgccatttccaatgggcagcactactagttagtttgataggtggcatcacaatggctggtgttctgggtacaatgacatactatgtggtgaaatcaaagcgcatgaggaagataagaaaaaaagagaagatgtcaagaagaagtggatctagctcctggtatgataatactgagctctcagagactgagcttaaccaagtgtatgccttgtaa

SEQ ID NO: 910 - DNA, 1564 bp, Oryza sativa
atgcagacccttgaatatacaggtgatggatctgtttgcatccgtgggcatcctgctttaaggaaacatacagaacctagtcagttatctcacaaaagttctacatgaaacaaacgtggccgctgcaagagatgttgcaacttggtcaggaacaagttatcttgcacctctggttggagccttcttagctgattcatatctggttgcttctgtcagcagcagttccattaatctctactggtcctcactcatggatcatatggacagatccagtctcttctcagaacatcatattctttgtcggtttgtacatggttgctttagggtatggtgcacagtgcccctgcatatcatcatttggtgctgatcaatttgatgacactgatgaaaatgagagaacaaaaaagagttcttttttcaattggacctatttcgtagccaatgcgggctcattgatctcggggactgttattgtgtgggtgcaagatcacaaaggttggatctggggttttaccatttctgcactatttgtgtatttaggttttggtacttttatctttggctcctctatgtatagatttcagaaacctggaggaagccctcttgcgagaatatgccaggttgttgttgctgctattcacaaacgcgataaagatttgccatgtgattcctcagttctttatgagtttctggggcagagttcagcaatcgaaggcagccgaaaattggagcatacaactggacttaagatagagctgcaatggtgacaccatctgattttgaatctgatggcctactaaacacatggaagatttgcacagtcactcaagtggaggaactgaagattttgatcaggatgttccccgtttgggcaacgatgatattatttgctgcagttctggacaacatgttttcgacattcatagaacaggggatggtgatggagaaacacatcggctctttcgaaatacctgcggcgtccttccaatccattgatgtcattgctgtccttatactagttccagtctatgaaagagtccttgttccagtgttcagaaaattcactggcagagcaaatggcattactccactgcagcgaatggggatcggcctgttcttttccatgctctccatggtatcagcagcattggtggagagtaatcgggttgcggattgcgccaggatgaaaggttttggtgcacaggtggctgttccaatgagcatcctgtggcagggaccccagtacttcctgataggcgtgggagaggtgttctcaaacattgggttaactgaatttttctaccaggaatcaccggacgccatgagaagcttatgtctcgcattctcacttgctaacgtttcggcaggaagttacctcagctcgtttatcgtttctcttgtgccagtgttcacagccagagaaggcagtcctggatggatacctgataacttgaacgaagggcatttggatcggttcttctggatgatggctggcttgtgtttcttgaatatgctggcctttgtgttctgtgccatgaggtacaaatgtaagaaggcttcctga

SEQ ID NO: 911 - DNA, 1561 bp, Oryza sativa
  misc_feature (1229)..(1229): n = any nucleotide
  misc_feature (1238)..(1238): n = any nucleotide
  misc_feature (1256)..(1256): n = any nucleotide
  misc_feature (1402)..(1402): n = any nucleotide
  misc_feature (1406)..(1406): n = any nucleotide
cagtgcttgcctgagccgatggacgctcactacggtggcggcatcatccgcaacggcgacttcagcgccggactccagggctggtcggccttcgggtggcaacgaaccggacgcggccgtaccagagcgtcagccagaaggtgctcctccaggacgacacgcactacaccctctcagagcttggttgcaggttagtgacgggatcgccgacgtgagagccgttgtgaagacggccggcggcgacttcatccactccggcggcgtcgaggcgaggtccgggtgctggtccattctcaagggcgggctcaccgccgccgccgccgggcaggctgaactctacttcgaggtggacatatgggtggacaacgtgtcgctgcagccgttctcgagggaggagtggagcgcgcaccacggggcggccatcaagaaggcgaggaagaagacggtgcggctccaggcgagggacgccgcaggcaacccggtcgccggcgcgcggatgcacatcgagcacgtccgcaacggcttccctctggggtcggcgatgagcaaggagatcctgaccaacccggggtaccagcggtggttcacgtcgcggttcacggtgaccacgttcgagaacgagatgaagtggtacagcacggaggcgatcccggggcgggaggactactcggtgcccgacgcgatgctccggttcgccaagagccacggcatcgcggtgcgcgggcacaacatcttctgggacgacccgagcacgcagatggggtgggtgaaggcgctctccggcgagcagctccgccgcgccacggagaagcggatcaagtcggtgatgtcgcggtactccgggcaggtgatcgcgtgggacgtggtgaacgagaacctccacttcgacttcttcgagggccggttcgggtgggaggcgtcggcggcgttctaccgcaaggcgcaccagatggacggcggcgcgctcatgtccatgaacgagttcaacacgctggagcagccgggcgacctgacggtgctccccggcaagtacctccgcaagctgtggcagatcaaggcgttcccggggaacggcaacgccgcccggatgggcatcggcctcgagggccacttcagcgcgcaacccaacatcccttacatccgcgccgcgctcgacaccatggcgcaggccaacgcgcccatctggctcaccgagatcgacgtcgcgccggggcccaaccaggcgcgcnacctcgacnagatcctccggagtgtancccaccacccggcggtgcacggcatcatcctctggacggcgtggcacccgcagggatgctacgtcatgtgcctcaccgacaacaacttcaagaacctccccgccggcgacgtcgtcgacaagctcatctgggattggaagacgcgntccnacgtcggcgtcgccgacgccgacggctactacgagaccgagctgttccacggggactacaaggtcaccgtcacccacccggcggcgaactccaccgtggcgcagagcctcagcgtcgacagggagtccgacaacgagttcaccatacacgtctag

SEQ ID NO: 912 - DNA, 1548 bp, Oryza sativa
  misc_feature (365)..(366): n = any nucleotide
  misc_feature (370)..(370): n = any nucleotide
gcagtgtcgtttaagtctagagaggatcaccggaagcagctcgagctcgaggaggcgaggaaggctgggctcgcgcccgccgaggtcgacgaggatggaaaggagatcaatccccatatcccccagtacatgtcctcagccccatggtatcttaacgctgataagccgagtttgaagcatcaacggaattggaaatcggacccgaactacaccaagtcatggtacgataggggtgctaagctttttcaggctaacaagtacaggaaaggagcttgtgagaaaagtcatgcatggaacgacctcgcagtgtgggagctaaatggactaacatcaatatagcaccagatgagaaagtggagtcattnnaacnggattatgatggaaagcgtgatcgctggaacggttacgacccatcgacgtacacccgtgttattgcagattatgaagctagagaagaggctaggaaaaagtatctgaaagagcaacagctcaagaaacttgaggagaaggatggtgaggagggtgacgagaacgtggctagtgaggaggaggatgaagaagatggtttgaagatagatgaggctaaagttgatgagagtgctcaaatggattttgctaaggtagagaagcgtgtacgtacaacaggtggtggaagcactggaactgtgaggaatttgcgtattagggaagacactgcaaagtatcttctgaaccttgatgtgaactctgcatactatgatccaaaaacccgctccatgcgtgaagatccattgccagatgcagaccccaatgataaattctatgtgggtgataaccaaaatcgacttagcggacaagctctggagttcaagcaactcaacatacatgcgtgggaagcttttgataagggacaggatattcacatgcaagctgccccatctcaagctgaacttctattcaagagttttaagatcaaaaaggagaaattgaaatctgaaaacaaagataagattatggagaagtatgggaatgctgcatctgaagaaccaatccctcgggagcttcttcttggacaaagtgaaaaagagattgaatatgaccgaactggtcgaataatcaaaggacagcaggatgtagcccttcccaagagcaaatatgaagaggatgttttcattaataaccatacaaccgtatggggctcatggtggaaagatcatcagtggggctacaaatgctgcaagcagactatccgaaatagctactgcactggcttagctggaattgaggctgctgaagcatcggctgatttgatgaaggcaaatatggcccgcaaggaagctgcagaaggaagaaaagcgactggccacctggggaactgatgtgcctaatgatattgttcttgacaagaagctgcttgatgaagccctaaagaagaggaaagaggagatggatgaaaggaagaggaagtacaatgtgaaatggaatgatgaggtcaccgcggaagacatggaggcttaccgcatgaagagaattcaccatgatgatcctatgagggatttcctccattag

SEQ ID NO: 913 - DNA, 1478 bp, Oryza sativa
  misc_feature (547)..(547): n = any nucleotide
ccgccggggccggcggccgtgccggtgttcggcaactggctgcacgtcgggaacgacctgaaccacaggttcctcgcggcgatgtcggcgcggtacgggcccgtgttccgtctgcggctgggcgtgcgcaacctggtggtggtgtcggacccgaagctggcgacggaggtgctgcacacgcagggcgtggagttcggctcccgcccgcgcaacgtcgtcttcgacatcttcaccgccaacggcgccgacatggtgttcaccgagtacggcgaccactggcgacgcatgcgccgcgtcatgacgctgccgttcttcacggcgcgcgtcgtgcagcagtacaaggccatgtgggaggccgagatggacgccgtcgtggacgacgtgcgcggcgacgcggtggcgcagggcaccggcttcgtggtgcgacgcaggctgcagctcatgctgtacaacatcatgtaccggatgatgttcgacgcgcggttcgagtcggtggacgaccccatgttcatcgaggccaccaggttcaactccgagcgcagccgcntcgcgcagagcttcgagtacaactacggcgacttcatccccatcctccgtcccttcttgcggggctacctcaacaagtgccgtgacctccagagcaggaggctcgccttcttcaacaacaactacgtcgagaagagaagaaatgcaggaaggtgatggacactccgggagacaggaacaagctccggtgcgcgatcgaccatatccttgaggcggagaagaacggcgagctgacggcggagaacgtgatctacatcgtggagaacatcaacgtggccgccatcgagacgacgctctggtccatcgagtgggcgctggccgaggtcgtcaaccacccggcggtgcagagcaaggtccgcgccgagatcaacgacgtgctcggcgacgacgagcccatcaccgagtccagcatccacaagctgacttacctgcaggccgtgatcaaggagacgctgcggctgcactccccgatcccgctgctggtgccgcacatgaacctggaggaggccaagctcggcgggtacaccatccccaagggatccaaggtggtggtgaacgcgtggtggctggccaacaacccggcgctgtgggagaaccccgaggagttccggcctgagcggttcttggagaaggagagcggcgtggacgccaccgtcgccgggaaggtggacttcaggttcctgcccttcggcgtgggccgccgcagctgcccggggatcatcctggcgctgcccatcctggcgctcatcgtcgggaagctggtgaggagcttcgagatggtgccgccgccgggcgtggagaagctggacgtgagcgagaaaggcgggcagttcagcctccacatcgccaagcactccgtcgtcgccttccaccccatctctgcctgaactcatcgaatccctttgaatcaagttcgtgccatcagtcgataa

SEQ ID NO: 914 - DNA, 1462 bp, Oryza sativa
atggtgctcgaggttcgccgcgcagctcgccgccctccctcccacagatcgatttcgccgagctctgattcacttatttatcgctttttttgcgtggctcccctctccgcaggcgacgatgatctgcatagacaactcggagtggatgcggaacggcgactactcgccgtcgcgattccaggctcaggccgacgccgtcaacctcatctgtggcgccaagacccagcagtccaacccggagaacacggtgggcgtcatgacgatggccggaaagggcgtgcgcgtgctcgtcactcccaccagcgacctcggcaagatcctcgcttgtatgcacgggacttgaagttggtgctgaagcaaatttggctgcagcaattcaggttgctcagctggctctgaagcatcgccagaataagaggcagcaacagcggattatagcttttattggaagagccctgtgaaatacgacaagaaagttttggaaacaatcgggaaaaagctgaagaagaataatgtggctcttgacatcgttgactttggtgaaaccgatgatgataagcctgagaaactggaagcgctaatctctgctgtgaacagtagtgatagcagccacatcgttcatgtccctcccggtgaaaatgccctttccgatgtgcttataagagtactcctatcttcactggtgaagaaggtggaagcggttttgctgcttctgcagcagcagcagcagctactggtgcagctggatttgaatttgatgtggacccaaatgtagatccagaattggcactcgccctgcggttgtccatggaagaagagcgagcaaggcaagaggctattgcgaagaaggccgcagaagaatcttctggtgctgaaaataaggaccatgcctcaagctcaaacgctgattctgttatggcagaagcggaacctgcctcaaatgctgctgatgataaaaaagatcagccgaagaggaagatgatgatgctcagctactacaacaggctcttgcaatgtcaatggaggagggttcttcaggggctgcagcggctgatgctgctatggcagaggctgctgtagatgaccaggacttggcactagagctcttcaaatgtctgtccaggacgcaggcgggtctagtcagtctgatatgagcaaggtgtttgaagacagatcatttgttacatccatccttaactctctccctggtgttgaccccaatgacccctctgtgaaagatttgctggcatcattgcatgggcagggcgagagcaagagaagaaggaagacaaatcagacaagccagaagatgagaagaaataaatcaactcctttgtgtcttccttgtaagatttcagtatgctgtcttacctccatatccgatatgcatgttttgcatatagtctattcagcccttgatgactatcgttctggttgtacgatatcttctactataaactag

SEQ ID NO: 915 - DNA, 1452 bp, Oryza sativa
atgttgatgaaaaagtatgagatggggaaattactcgggcaaggaacctttgccaaggtttaccatgcccgtaacaccgagacttctgagagtgttgctatcaagatgattgataaagagaaggttttgaaaggcgggctcatggatcagatcaaacgtgagatttctgtgatgaagttggtgaggcatccaaacattgtgcagttatatgaggtcatggctaccaagactaagatatattttgtgctggagcacgtcaaaggtggagagttgttcaacaaagttcagagaggaagactaaaggaagatgcagcaaggaagtacttccaacaactgatttgcgctgttgacttttgccacagcaggggtgtttatcaccgtgatttgaagccagaaaatcttcttcttgatgagaacagcaatctgaaggtttcagattttggcctaagtgctcttgctgattgcaaaagacaggatgggctgctccacacaacctgtggcacacctgcttatgttgctccagaagtgatcaacagaagaggctatgacggtgctaaggctgacatatggtcttgtggagtgatactctttgtgctattggccggctatctacctttccatgataagaacttgatggatatgtataagaagattgggaaagcagaattcaaatgtccaagttggtttaataccgatgttcgaaggctcttgctcaggatacttgatcctaacccaagtacaaggatctcaatggacaaaatcatggaaaatccttggtttaggaagggtctcgatgcaaagctgctcagatataatctacaaccaaaggatgcaattcctgttgatatgagcacagattttgactccttcaatagcgctccaacattggagaagaagccgtccaacttgaatgcttttgatataatttctttgtcaactggacttgacctctctggtatgtttgaggagtctgataagaaagagtccaaattcacatccaccagtacagcttcaacaatcatatctaagattgaggatattgccaagggcttgcggttgaagctcacaaagaaagatggtggactgttgaagatggaaggctccaagcctggaaggaaaggtgttatgggcattgatgcagagatattcgaggttaccccaaactttcatcttgtggagctaaagaagacaaatggtgatacacttgaataccgtaaggtcttgaaccaagagatgagaccagctttgaaggacatagtctgggcttggcagggtgagcaaccgaagcagcagcagcagccaacgtgctaaaaaactttgacaagggcaagttttttgcaatttgagtcgacttccaatcgtttatgtatttctgcagcttttgttcctcttgttattcattttcattcctcatgtattgttaatattaatatcgatgctatcttcaaatga

SEQ ID NO: 916 - DNA, 1445 bp, Oryza sativa
gatctcgacaagtccacttccaccagcgcgtccatgaagaagctgcaggaggacggcgctctcccttgtcgcgggaccatggagagagaaccaggagggtttaaacagcaaaaccgtggagcaccgcgtcggttaggtgatgatcagcggccctacgacggcaagcaacgtccccatccctctttgtgagaaggggaaggctgatcgcgaggctacgatcatcgctctccctctgactgacgtcatcgggccgctcgtggaccaccaggcagcggcctcattgaaagagggcattgccaaggaggcatctgacattgctgctgctgctgctgctacaatgagtggcagcaacattccgaagagagggaggaagttctcctctgtgccttgggaatcgtcggaaggcgcctaccccattgccccggcctcagcgccggcaaaggctggtgacacttggtgagaatccagcgcgtctcctgcagcggcttcgacagatgtcgtggtcgtgcccaggagccgtgaggcgacgcccagcggccctgccggcagccttgtgcctacttgcggcccgcccgctgacgtcctcacctggggggagttccaaatcgagatggagcgcatcctccaggcagatgctcacggcatagggcgcgagattgaggaggttaaggcggcggcggcggcgtcgtcggcgaacgaacgcgctgacaagctgacgcgtgacctggcggaggtccgcgaggacctccagaagatgagggagctggtggccggcaacgagcggcagcggcaggggctcgagcaccacatgtcgacgtcgaggatgtccagcagcgcgggcagcctgagtcgccggtagtcgtttcggcacttgcgctcgagccatatgtgctgcaggactacgtagatcagaacttgtccatggaagcgagcatggcgacgacttccttagagatcgtcggatccaatattggaggacaaagttcgaggtggctgaactcgagaggactatggtagaagttaagaaggaccgagccgtagaagcactccgaggtcgcgaggtgtggttcaactcgtacctcaggagctattgtacggccatggccggagtctgcagggaactccgagtacctcgcgggcaccccgaggagtcagcggctggatacatctcgtggctgaatggggcctgtgctcagcttgaaggcatcggcaagcgtatcgatgaggcccttaagcaggagtgtcgtcgatcgagccaatatgctggagggcacgtgttggcctgtatccagtatcaccacccgcagctgcacctcgagttcctccacgaagggttttctccttctcggaggactcccgcagagatagataatctggcgaagtcgattgcgccgcttgcagagaaggtcttccagtccatggactggcgttggccttcctggtag

SEQ ID NO: 917 - DNA, 1437 bp, Oryza sativa
  misc_feature (38)..(38): n = any nucleotide
  misc_feature (56)..(56): n = any nucleotide
  misc_feature (498)..(498): n = any nucleotide
  misc_feature (1200)..(1200): n = any nucleotide
atggatcccgccgccggctcgccggatccggcgccggngccgggggcgaccacctncacggcggcgaccgtcctcgacggcctcggcgcggaggtgctcgcggtgatgtcgccggtctccatctgcatggcgctggtcgtgctcctcatctccctcctcgcgccgccctccgctccggggtccgccgcggccgccgcgcagccgccgccgccggtcaccgccgcgacgctcgtctacctcgagagccccaccgacaccccggggcagaagctcgtcggcgcgctcctcgacgccgccgtcttcgtcgccctcgtcgccgtcgtcaccttcgtcctcgtcgcgctctactactaccgctgcacgggcttcctcaagaactacatgcgcttctccgccttcttcgtcctcttctccatgggcggcgccatcgccgccgccgtcctccgccgcctcggcgccccgctcgacgccgccaccgcgctcgtgctcctcttcaangcctccgccgtcggcgtcctctccgtcttcgcctccgcggtccccatcgtcgtgcgccagggctacatggtcgccctcgccgtcatcgtcgccgcctggctctccaggctgcccgagtggaccacctgggtcatgctcatcgcgctcgccctgtatgacctcgtcgccgtgctcgcgccgcggggtcctctcaggatgcttgtggagctcgcctcatccagggacgatgagctccctgcgctcgtctacgagtcgagaccgacggttgggccggcctccggttcttcctcctacgcttcagccatgggatcagttgagatgcagccggtggccgatcccggtcgatcgggtggaaatcagtatgacagagtagagcaggaggatgattcgagccgcgccgtggtggaaatgagggatgttggtggtagccgatcaagcattcgtgagaggaacctcgaaagggaggcgccgatggcggtatcggtatcagggcattcatcgaatcagggtgggagttcacagcatgctgtgattcagattgagcagcacgaggaaggagagacagtgccattggtatcagcggcatctgccaacaatgcagcccctaatgaggagcacagagaaaactcttcttcagactctggtatggagttcgagatgttcgagtccaccaggggcatcaagctgggacttggtgatttnatcttctacagcgtgcttgtggggaaggctgcgatgtatgatctgatgacggtgtatgcgtgctaccttgccatcattgctgggcttggctgcacccttatcttgctgtcaatatgcaagcatgcattgcctgcactcccgatctccatcttgctgggtgtcacattctacttcttgactcggttgctgatggagccgttcgtcgttggctcttcaaccaacttggtgatgttctga

SEQ ID NO: 918 - DNA, 1404 bp, Oryza sativa
  misc_feature (59)..(59): n = any nucleotide
  misc_feature (64)..(64): n = any nucleotide
  misc_feature (244)..(244): n = any nucleotide
  misc_feature (655)..(655): n = any nucleotide
  misc_feature (666)..(666): n = any nucleotide
  misc_feature (696)..(696): n = any nucleotide
  misc_feature (704)..(704): n = any nucleotide
atgccccctcgccgcccatttgcaggcggccccccgcacagtacaaaatcgccctcgcngaggncggcaagggggccgcctgcaaaattccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgngagggcgatttttaaaaatcgccttcccagagggcggtaggcgactacttccgtcaattttcaaaatagaaaattatttttgtaaaacttttaataaaaaaattaaaaataaaaaaattcgtgctccgtgctcccttcccgcacacgcgacccaccagcaagaaggcaccaaaacgaccacgagcacgcgccaccaacaccggccgcggcggctgcaggacataggaggatatcgcgagatatcacgggcgcgcggccgaaaaagcgcaggctaccacgcgagaagcgaacgcgacccggcaccaccacacctctcctccagctcgcggtctcctcctcctcggctcctcccaaaaaagagctctagaataaaagagaaggggaaacccccccccaaatcccaggccgctnggctcaccgantgctgcatcggatcggatcgggacggcgtngcgacccnaaatttggatcgtggcgctacgctggccggcgccgccggaaacaacgtcggcaaggtcctccagaagaagggcacccacatcctcctcccctctccttcaagctcaaggtgattagggcgtacgcgttgaacaggctctggatcagcggattcctcatggacatgtgcggcgccgcgctcatgctcaccgcgctctcgcaggcgccggtctccgtcgtgcagccgatcgccggctgtggcctcgccatactctgcgtgttctcccatttctacctcaaggagtccatgaacgggctcgactgggtcgccatcacattggccggtctaggcacgatagggagttggtgttggaggcgaggagcagaaggttcttctcaacacttggcttcatatctacaaaaggcaaaggcgtgaacaagagttgtcagtgatatctaagacaggattcgtgatgtctgaaatgggttttccaaagattgttgtaccggctgccatttcttgtagtgtgggctgcagtgctgtgggatttgtttatcagttcatgcagactcgaggtctgaagcatggaagggcaattgttgtgtccacttgtacatcagttgcatctattgtgtctggcgttgtagctggtatgattgcgcttgatgaacatcttcccacagctcccacgggccgcttttttctcttacttggatggtaa

SEQ ID NO: 919 - DNA, 1354 bp, Oryza sativa
gacagccgcgggaaccccaccgtggaggtcgacctcgtcgccggggacgggcggctgcaccgctccgcggtgcccagcggcgcatccacggggatctacgaggcgctcgagctccgcgacggggacggggcggcgtacggcgggaagggcgtgctcaacgccgtccgcaacatcaacgaggtcatcgcgcccaagctcgtcggcgtcgacgttgatgcaatcatgctagacattgatggaactccgaacaagtcaaaattgggtgccaatgctattcttggagtctctttaagcgtatgcagggctggtgctggtgcaaaggaagttcctttatataaacatattcaggagttggctggaacaaaggagcttgtcatgcccgtcccagctttcaatgtaataaatggaggtagccatgcgggcaacaatctggccatgcaggagttcatgcttttacctgtgggagcatcttcattttctgaggctcttcgcatgggtagtgaaggtttaccatgccctaaagggcatcattaaggcgaaatatggtcaagatgcatgcaatgttggagatgaaggtggctttgctcctaatgttcaagacaacagagaaggccttgtcttgcttatggatgccattgagaaggcaggctactctggaaagcagattaaaattggaatggattttgcagcatcagagttccttacaaaggatggaagctatgacttaaactttaagaatcagcctaatgatggagctcatgttctttcagcccagcgtctctgtgatctgtacaaagaatttgtcaaggatttccccattgtatcaattgaggaccctttcgatcaagatgactggagctcatgggcatcattgcagtcttcagttaatatccaaattgtgggggatgatttactcgtcacgaacccaaaacgtattgcagaggctattggcaagaaggcttgcaatgctcttttgctgaaggttaatcaaattggcactgtcactgaatcaattcaagctgctcttgattcaaaagctgctggttggggcgtgatggtcagccacaggagtggggaaacggaagataatttcatcgcagatctggctgttggtttagcaagtggtcagcagatcaaaactggtgctccatgccgtagcgagagactggcaaagtacaatcaggtaaatattcttatcctgttccatatccatttttcaccaacctatactgagattatgtacttccacatgtcatttcctgattctacctcaagtttctccctcgctattttccccattacaccatactatgttttgttcctgtacagcttctgcggatcgaaatggagctag

SEQ ID NO: 920 - DNA, 1334 bp, Oryza sativa
atggatgggcgagggagaaagcacaggattttgatggtgtcagatttcttctttccaaactttggcggcgtggaaagccacatctattatctgtcgcagtgtctccttaagcttggccataaggtgattgtcatgacgcatgcatatgggaatcgttctggagtacgatatgttacaggtggcttgaaggtttattatgttccatggaagccattcctgatgcagaatacattgcctacattattcttgacatttccgattgtgaggaccattcttattcgtgagaagatctctgtggtgcatggacatcaggctttctcaacattgtgccatgaagcactgatgcatgctaggacgatggggtacaaagttgtcttcacagatcactcgctttacggttttgctgatgctggaagcattcacatgaataaggtgctgcagtttactcttgcagatattgatcaggccatatgtgtctctcacacaagcaaagagaatactgtcttgagatcagggatatctccagagaaggttttcatggttcctaatgcagttgatactgcaatgtttactccctctccagatcgcttgagctgtgatgaaattgttattgttgtgataagtagattagtgtatcgaaagggtgcagaccttcttgtggaagttattccagaagtatgccgtctttttcctaaggttcgctttattgttggaggtgatggtccaaaacgtgtgcgaattgaagaaatgagggagaagttttcccttcaggatagagttgagatgttaggagctgtgcctcatgctcaagtgcgatctgttctgatatctggtcatatttttttgaacagagttcgcttacagaggccttttgtatagccattttggaagcagcaagttgtggattgttgacagtaagtactagagtcggtggtgttccagagttttcaggttttaccagatgatatggtagtacttgcagaaccagctcctgaagatatggtacgagctgtcaggaaggctatcgatatgcttcctggcatagatccccaagttatgcatcttcgaaaaagaacagagattgtgtatgatcgtgcaatgcagtcaccacaaacagatttgctagaacgccttccacgagatacctcagatgtggagcttgggcaggcaaactgttttgtcttgttatgatcatcaactacctactatggtgcctcctagaatatctgcagcagcccactgaaggtattgaagaggtcccagatatcaggccagtacatgctcgtttagaatcagtagatgatacatgtgaaactcaaggaaaaggaatttag

SEQ ID NO: 921 - DNA, 1329 bp, Oryza sativa
atggcgccattccagctgcgcttcggcctccggatgtccccctcgcgctcctccgacgaggaggaggaagacgacgaggacgaggaagggttcgagtacgaggagatactgagcgacgacgggacggactcgccgccgccgctgatgatgcaggcggagaagggagggggagggctggtcggggcggtggtgggggcgctgcggaggtcgctggtgatgtgcagcgccgggaaggtcggggaggaggaggacagcgaggacgaggaagaggaggggatggagatcgggcggcccacggacgtgcggcacgtctcccacgtcaccttcgaccgcttcggcggcttcctcggcctccccgccgacctcgagcccgaagttcccagccccacgcccagcgccagtgtaaatgtatttggtgtttcaccaacctctttgcaatgttcatttgatcacaaaggaaatagcgtgcccacaatactgttgatgatgcagaggaagttgtatgaacgagagggacttaagatcgaagggatcttcagaattaacgcagagaatagccaggaaatctgtgtcaggaaacaactaaacagtggtgtggttccagatgaggttgacttacactgccttgcagggttgataaagtggaagccgcattacctcgattgggctatcaatctgatggctgatgttgtggagcatgaaaactacaacaagatgaatgctagaaacatcgctatggtctttgcgccaaacatgactcagatggccgatccattgactgccctgatacatgcagttcaggtcatgaatttcctcaagacattgatcttgaagactttaaaggaaagagaggcagccggaacacctaagacaacggaaccatgctccggttctccaaacggacaagataaacctccgacgccagagaatttggagagacccatcatttgttcagatcagaaaggcatagataaacctatgtttgatatggctacttgtgatcagctgctgtttggacctaaacaattccttgatcatcgtgagaacaacaaatttgaaggaccggagaagcatgacataggccaaccgaagcgccatagcgaagcttctcctcttggtaatgattcgaataaccaagtcagcagccctggaaaagaatttggcaacagaaatgtggaaggcctgttcgacaaatttagttttaggaaaggtgtcgagaggctttgcaggcaccctgtgttccagttgagtaggtccatgaagaagtctgcagacgttgtggtctttgatgctcctggagaagcaagacaagcttggggtttgatatga

SEQ ID NO: 922 - DNA, 1295 bp, Oryza sativa
gggcacttggtcgtcgaagggcttctcattgccgcaatactcttccagctctccaggaagagctacaagcctccaaagaagccactcactgagaggcaggaggttgatgagctctgtgatgagtggcaaccagagcctctctgcccacccatcaaggagggagctcggattgaggctcctacattagaaagttgatcagtgctgctggaccgcatacaattgttgatggaaaagaagttgtaaactttgcgtcagcaaactaccttggtttgattggcaatgaaaagatactcaaattgcaggattcctgtattggttcggtggagaaatatggcgttggatcatgcggacctcgtggcttttatggaacgattggatgttcaccttgactgtgagactaaaattgcaaagttcctgggaacgcaagattcaatcttgtactcctatgggatatcaaccatcttcagtgtgattcctgccttttgtaagaaaggagatataattgtagcgatgagggtgttcattgggcagtacaaaatggtttgcagctttcaagaagcactgttgtttatttcaagcacaatgacatggcttcacttgcgagcactctggaaaaactaactcatggaaacaaacgtacagaaaagattaggcgctatattgttgtggaagctatttaccagcagaattctggccaaattgcacccttggatgagatagttcgattgaaggagaaataccggtttcgtgttattttggaggagagtcattcttttggcgttcttggcaagtctggacgtggccttgctgaacattatggagttcctattgaaaaaatagacattatcactgctggaatgggaaatgcattagctactgatggtggtttctgtacaggaagtatcagagtggttgatcatcagcgtctaagcagctccggttatgttttctctgcctcgttaccaccatatcttgctagtgcagcaatttctgctgtggacgcagagttgtcagatgtacaggggcttgaaattgctagtaatatattgtcacctattgtcttcctcaaattgaagacatcaacaggttctgctgttgctgacctggagctccttgaggttatttcagagaagttgaaggaagattcagtcttcattgcagcgacgaaacgatcgagtttggacaagtgtcgtcttccggttggaatccgcctattcgtatcagctggtcacactgaatctgatatcctcaaagtatctgaatccctgaaaagggttgcagcatcagtgctctag

SEQ ID NO: 923 - DNA, 1293 bp, Oryza sativa
atgggcaacgccggtagcaacggcggagggggttcccctggtcaccgccgacgaggctccgccgcccagggccacggccaccatcaggtccacggccaccaccaccagccgtcctcgcctcccccgcctccgccgccggagtcgtccccgagccactacgtgttcgccgccgccacgccgtaccctccgccgcagtacaccaaccccaacctgccgcggtactaccctcagtacgggaactactacccgccgccgccgtccctgcaggtgcccctcccggcgccgtacgaccaccaccacaggggcggcggcgcgggggtgcccgccggaggggagttcccgccgtcggcgcacccgcaacactacccggggtggcctggggtctctgggcggccgcacccctgcggattgcagccggccatgccgacgccgtacgtcgagcaccagaaggctatcacaatccgcaacgacgtcaacctcaagaaggagactcttcggattgagcctgatgaggagtgcccgggccgcttcctcgtcgccttcacctttgacgccacccttgctggaagcatgactgtttacttctttgcaaaagaagagctcaactgcaatctaacggcggtgaaagaagacctgattaagcctgttactgtaagcttcaaagagggtcttggtcagaagttcagacagccttctggcactggaatcaacttctccgtgtttgaggattccgagttattgaagcagggggacatggatgtatatccacttgcagttaaagctgaaacaaccatgcctgttgatcaaaagttggaaggagaagatcaaaagatgaaaactccaaactcacagatcacacaggctctgtttgaaaagaaagaaagcggtgattatcaagttcgagttgctagccagatcctttgggtcaatggaactaggtatgagttgcaggaaatatatggaataggaaactcggtggaaggcgatgctgatgccaatgatcctgggaaagaatgtgttatttgcctctcggagccaagggatactaccgttctcccatgtaggcatatgtgtatgtgcagcgagtgtgccaaggtcctgaggtaccagacgacccggtgcccgatctgccgacagcccgttgagcggctacttgagatcaaagtcaacaacaaagctgaagagcagcagcagccgtcacccgattcaccgatcaaagtcaacagcaaagccgaagagcatcagcagcagccatcccaatcgctgccaatcccacacagggaagaggtgtag

SEQ ID NO: 924 - DNA, 1283 bp, Oryza sativa
tacgcgaagtttggcagcgtgttcaccgtaagcgtggccggattgctgaaggcgacgttcttggtcggaccggaggtctcggctcatttcttccaagggttggaatcggaggtcagccatggcgacctgttcgagttcacggtgcctatgttcggcaaagaggtcggccatggcgtagacaacgccacccggatcgagcagggtcgattctttgctgaggcactgaagccgctgcaggactactttgcgaaatgggggcaacacggcacggtcgatctgaaacatgaactggagcaactactactgttgatctcaggccgatgcctcctcggcaaggaggtgatggggacgaagttcgacgaggtctgcaacctgttccgcgatatcgagggtggcgtgaacctgatgagcgtcttcttcccctacaccccactcatcccttccaaccgccgccgcgacatggcgcgcgagagactccacgccatcttctccgacatcgtgagatcccgcaagcagcagcagggagatcaggaggaggtcaatgacaaggacgtgctccagagctttatcgattccagtccaggtacaaggccgatggtcgcgccacgacagaggcggaggtcgctggcctcatcaccggcgttctcttcgccgcgaagcacacgagcacccataccagcgtctggaccggcgctcgcctgctcacccacgagaagttcctggccgcggccgtcgacgagcaggatcagatcgtcagaaaacacggcatcatcaatggcagaatcgtcacagatcactatggtttcctgatggagatgcacatgctgcacatctgcatcaaggagacgctccggctgcaccctccggcgccgatgatcgtcaggacagccctcaggcagttcaccgtccggacgagagaaggccatgaatactgtgtcccggcagggcacaccatggctagccctatagtgatcagcaaccgtgtgccttacatctacaaggatgctcacctgtatgatccagacaggtttggtcctagaagagaggaggacaaggtcggcgggaaattctcttacacatctttcggcggtggaaggaacagctgcgtcggcgagaactatgcttacatgcagattaaggcgatctggagccatttgctgagaaactttgagctcaaattgttgtctccatttcctaagacggactggagtaagcttgtgcctgagccccaagggaaagtgatggtaagttacaagagaaggcaattgcttcctacctcttaa

SEQ ID NO: 925 - DNA, 1282 bp, Oryza sativa
  misc_feature (42)..(42): n = any nucleotide
  misc_feature (47)..(47): n = any nucleotide
  misc_feature (54)..(54): n = any nucleotide
  misc_feature (141)..(141): n = any nucleotide
  misc_feature (289)..(289): n = any nucleotide
  misc_feature (291)..(291): n = any nucleotide
  misc_feature (546)..(546): n = any nucleotide
ccgcggcgggtggcgttagagcacgggctcctcgagatcccnaagcnggtgttnccggagggcacgctgacgcagaccctggcccgggtgggcgccgcggcgctcgcggaggcgctgcagatcccgcgggagctggcggcnctggtgctcgggacgctcgccgcggtgctccccgcggaggaggaggcggaggacgccgacctccgcgacgtgctcctcttcctctacatccagtcctacaagcgcctcgtcccgcgcgcgcacaaggattcgcccgcggtcaccgacntntggccctccacctccgccttcgatggctacctctccgcgctctccccgatccagaacagtcgccggtttatgccttcacaagcagatgaagaagctcatcaattatcttatctgcaaaagcatatggtcaacattctgagtcttttggcagattctgttgatggagagggcgatgagtctatgtttgagcatctcggatttttatttcagttttctgaagggactcctttaagccaagtggctacattttttgcnaattctgatccagacatgcctgctgcacctgttcccgctgctcaggagggtttctccaaaacttctgtagtgaaacaagcatcagatatcaaagggcattcaataaaggttttgaactgccatgactctgttatctacatattagctcctgttaaatatgccactgtctatgggtgttctgacactactatcgttcttggtgctgttggtaagaaagtggagcattgtgaacgagtgcaaatcattgcagcttcaaagcgaatttgtatcgccaattgtcgtgaatgtatcttctacttgggagtaaatcaccaaccgcttattgtgggtgacaaccataaattacaacaggttgctccattcaatacttattatccacaattgggagaacatttggtgcaagttggtgtggattctaacatcaacaagtgggaccaaccttttgtgctgggagttgttgatccacatgattcattatctcatcctgcaggggtttctgatgtccaagctgaatctgctacttgtctagatcctgatctattcaccaactttttggtatcagattcccagttggtttgaggcacaaggacctacaaaatataatccatttacattgcctgaagtttattgggcatcccaaaggaaaaagcggaaaaaagaattggcatctgcccttcatgcccaattcaaggactggctatacggtaatactcacctattgataaaatttgcttag

SEQ ID NO: 926 - DNA, 1267 bp, Oryza sativa
atgctcccctccgccgcccccgccgccgccgccggagaagaagaagaagaaggcgagcggcggccgtgggagccgcccttcgacgcgtcccagccggcgccgcccatctcctaccccatcaccacgctcgcggcgctcgcctcccgcgcctacctctccgaggccggcaacttccacctccccttcaaccgcgcctcctcctcgccccgggccgcgccgctcccgccccggcgccgcatcctcgcgtgccacgacttccggggcgggtaccgcgacgacgcggcgccgcaggggggccacgacccgggcgcctacgcgctctggcactggcacctcatcgacgttttcgtctacttctcacactacctcgtcacgctcccgccgccgtgctgggtcaacgccgcccacctccacggcgtcaagaaggttttggggacgttcatcacagagtgggagaaaggtgcagagatctgcgaggagatgcttgctacggaggcttctgcccaaatgtatgctgaaaggctaacagagctggctgcttacttgggctttgatggctggctggtaatcactttcatgatcaatattgaggttaaactcgacatacaattcattgataacctgaaagaatttatcaatcatctaaccaagacaatgcatgctgctgttcctggatcattagtcatatgggtgcccttgactggcagaataagcttaacgagtataacaagccattctttgacttgtgtgatggactgtttagcaattatacttggaagtatccacaagaatcagctgtagttgctggtgaaaggaagtacgacgtgtacatgggtattgatgtttacggacgaaacactttcggtggtggtcagtggaataatgttgcccttgatctactcaagaaagatgatgtctcagctgccatatttgcacctggatggtggtggggtcttgttcaagaatcatggggtgttcttcagagttatccaaaacagttgcctttttactctgattttgatcagtctactttctttcagggtcatggttaccaggtatcaattgaaggggtcaaagtttatggtgctccatgggacaatatttcttgccaaagtttccaggtaaaagccgatgaacgctctggtttagggttgtcactggatttgtcatccggaaacaatgagagcagttccattcttattgctattcatgaagtacaatgtctatgttgagaagccttggagttgccagcgtacaagtcttctat

SEQ ID NO: 927 - DNA, 1258 bp, Oryza sativa
atggggggccggaagcgcgcgctgctggtgggcatcaactacccgggcaccaaggcggagctcaaggggtgccacaacgacgtggcccgcatgcgccgcgccctcgtcgaccgcttcggcttcgacgaggccgacatccgcgtcctcgccgacgccgaccggtcggcgccgcagcccacgggggccaacatccgccgggagctcgcgcgcctcgtcggcgacgcccgccccggggacttcctcttcttccactacagcggccacgggacgcggctgccggcggagaccggccaggacgacgacaccggctacgacgagtgcatcgtgccctccgacatgaacctcatcacaggatttcacagaactcgttcaaaaggtcccagatgactgcttattcaccatagtatctgactcctgccacagcggtggtctacttgacaagaccaaggagcagattgggcacagcaccaagcagaaccaggcccagcagatcaagcgagaagaacgttctgactctggcaccggcggtttccgatccttcctcaaagaaaccctcaaagaaacagtccgggacgcgttcgagtctcgaggagttcacatccctcaccagagcagccgccgcaacgacgacgaggatgaggagccacacatgggctcatcctcccatggtggcgatcgcatcaagaaccggtcattgcccctctcgacgttgattgagatgctcaaggagaagaccggcaaggacgacattgacgttggctcgatccggatgacgctgttcagcctcttcggtgacgacgcgagccccaagatcaagaagttcatgaaggtcatgctgaccaagctccaggagggccagcacggcggcgtgatgggcttggtgggcgccctggcgcaggagttcatgaaggctaagctggagggcaaccaggaggcggacgccctcgagccggccatgaaacaggaggtgcacagcgtccacgaggcgtacgccggcacgacggcgagggtgagcaatggcgtgctgattagcgggtgccagaccgaccagacatcggcggacgccacgacgcccaagggcgtgtcctacggcgcgctcagcaacgccatccagaccatcctgtcggagaagagcggcagggtgacgaacaaggagctcgtgctgagagcgcgcgagttgttgtccaagcaagggtacacccagcagcctggcctttactgcagtgacaagcacaccagtgtggccttcatatgctga

SEQ ID NO: 928 - DNA, 1182 bp, Oryza sativa
  misc_feature (40)..(40): n = any nucleotide
  misc_feature (64)..(64): n = any nucleotide
atgagtgacaatctgatggacaaggttagcgcctttggcnagcgtctgaagatcactgggtcanaggttagcaagaagatgacggctggcatgtcctccatgagcttcaagatgaaggagatcttccaggggcagactcccgcggacaagattgtggaggaggccacctcagagaatttggacgggcctgattggtcggcaaacctggaaatctgtgacttgatcaacacggagaaagttaacagtgtcgagctgatccgtgggatcaagaagcggatcatgctgaaggatgctagggtccagtacctctccttggttcttcttgagaccattgtgaagaactgtgagaaggccttctcggaggttgctgctgagagggttcttgatgagatggtcaggttgattgatgatcctcagacagtggtaaataacaggaacaaagcccttatgcttattgaggcatggggagagtctggtgatgagcttcggtacttgcctgtctatgaggaaacctacaagagcctgaaatcaagaggagtgcggttccctgggcgtgacaatgagagcttggcccccatatttactcctgcgcgttcagtagctgaagctgaagttgatgcaaacttttcccagcagaccttcgaagatgtgcaagtgcatacatatactgctgaagaaacgaaggaagcttttgatgtggctcgtaacagcatagaacttctttcaactgttctttcatcctctcctcagcaggatgctttgcagcaggatgacttgacatccactcttgtgcaacaatgctaccaatctcagcacactatccagagaatgattgagactgctggagacaatgaggccatgctttttgaggccttgagtgtgaatgatgagatccaaaaggtgctgtccaaatatgaacagatgaagaaacccgcagcgtctgagaacgcagaacaacggccggtagtcataccaattgccacagaacatgaagattctgctacggtcggcaatgaagatgccctggtcagaaaaccagctggttctcgagcaaggtcaggtggagatgatgatatccttgatgatctcgatgagatgatatttggcaagaagggaggaagcagttcccaagaagggcccaaaaagcaggatccgaagaaagatgacctaatcagcttttaa

SEQ ID NO: 929 - DNA, 1178 bp, Oryza sativa
  misc_feature (175)..(175): n = any nucleotide
  misc_feature (239)..(239): n = any nucleotide
atggcgtactaccggaagctcggggagagctccaacatgtcgatcgatagcctcaatagcctgcagaccagcacgcatggcggtggctccgtggcaatgtcggtggataacagcagcgtcgggtctagtgattcccacaccaggatgctcaaccacccgggcctcagggggcatntcgcagccaattactcggttgggcacagcattttccgccccgggcgggtgtcgcatgcgttgantgaggatgcgcttgcacgggcactgatggacccgaggtacccgactgagacgctcaaggattacgaggagtggacgatcgatttgggtaagctccacatggggatgccctttgcacagggtgcatttgggaagctatacaagggcacctacaatggggaggatgttgccatcaagcttttggagaggccagaggcggatccggagagagccgggctaatggaacaacagtttgtgcaagaagttatgatgcttgcaactttgaggcatcccaacatagttaaatttattggggcatgcaggaagccgatggtttggtgcattgtgacagagtatgcaaagggtggctcagttaggcagtttctgatgaagaggcagaacaggtcagttccattaaagcttgctgtgaagcaagccttggatgttgcaaggggcatggcctacgtccatgctcttgggttcattcatagggacctcaagtcagataatctcttgatttctggcgataaatcgattaagatagcagactttggagttgccaggattgaagtcaaaaccgaggggatgacacctgaaacaggaacctatcgttggatggccccgaaatgattcagcacaggccatatgaccagaaagtagatgtctatagctttggcattgttctatgggagctcattactggcatgctccctttcgctaacatgacagcagtacaagctgcatttgctgtggtgaacaagggtgtccgtccagccataccacaggactgcttgcctgttctcagtgagatcatgacaaggtgctgggatccaaaccctgatgttcgccctccattcaccgaagtagttaggatgctggagcatgctgaggtggtgatcctgagcacagtccgcaaggcccgatttcggtgctgcatctcccaaccgatgacaactgattga

SEQ ID NO: 930 - DNA, 1163 bp, Oryza sativa
  misc_feature (257)..(257): n = any nucleotide
atgtcccgcgccgtcgagccgccggcgccgaggccgtgcggcacggagggtggcccgccggtgaccgcgacgaggctgaggctgcgcgacggccgccacctcgcctactgcgagagcggcgtccccaaggaggaggcccgcttcaaggtcgtcttctcccacggcttcaccggctcccgcgaggacagcgtccgcgcctcccagcgcgccgtggtgccgccgccgccgccgccgcggatctgcgggtcgcccggtgngccgcccgtggcggcgccccgggtgcggctgagggacgggaggcacctggcgtacgcggagtccggcgtgcggaaggaggacgcgcggtacaaggtcgtcttctcccacgggttcacgggctccggcctcgactccgtccgcccttgccggtcggaggtggctgaggagttgggcgtgtacatggtaggctttgatcgcgctggatatggtgagagtgatccaaaccccaatcggtctgtgaagagcgctgccctcgatgttgaggagcttgcggacgctctaggattaggccccaagttctatgtgatcggtatctccctcggctgccatgctgtttggggcgccctcaagtacatcccagaaagaggattgctggagcggccatgatggcaccggtggtgaactactggtggccggggttccctaccgatctggctgccgaggtgtacaacaagcaggaagtgggtgaccagtgggcgctgcgtgtttcacaccatgcacccagcatcctccactggtggatggagcagagctggcttcccacctccaccgtcgtggctggcaccactcccctccccaacaagcgtgatgccgagatccgcaaaaatatgaaggcggatggctcgttccagaaggcgacacaacaaggcattcatgagtcgtactaccgtgacatgatggtgatgttcggcaagtgggagtttgacccgatgagcttgccgaagccgccatgccctgtgcatatctggcagggcgacgaggacgggcttgtgccggtggtgttgcagagatacctcgttagccggctcagctgggcgaactaccatgagctccccggaaccgggcacttcctgtctgcggttcccgggcttggagacaccgttcttaggaccattttcggttga

SEQ ID NO: 931 - DNA, 1158 bp, Oryza sativa
  misc_feature (923)..(923): n = any nucleotide
atgatcacagataatgcgattctggcttttgaatgttttcactctatacaaaagaatagaaagcctgagagcgctgcttgtgcttataagcttgatctttcaaaggcttatgatcgggtggattggggttttttggagcagtctctgtataagctgggtttcgctcaccactgggttagatggataatggtttgtataaccacggtgagatactctgtcaaattcaatggaactctgctctctacttttgctccatcgcgaggtcttcgtcagggagacccgctatccccctttctatttctgttcatagccgatggactatcattgctgttggaagacaaagtggctcagggagctctctcgccagtgaagatttgtaggcaagccccggggatttcacacttgctttttgctgatgacacacttttgtttttcaaagctgataacgttcaagcccaggctgtcaaagaggtcatttctgattatgcttcagcaacaggccaactcataaacccggcaaagtgctcaatcatgtttggggaatcctctccgctgcagactcgggatgctattagagtgaccttgcaaatagctaattctggctttgaggacagatacttgggcttcccaacccctgaaggaagaatgtgcaaagggaaattccaaagcttacaggaaagaatctggaaaaggcttattatctggggcgaaaacctgttgtcgagtggcgggaaggaggtgcttataaaatctgttatccaggctattccggtatatgtgatgggcatctttaagctaccggagtcagtatgtgaggagttaaccaagttaacacggaatttttggtggggtgtagaaaaggggaaaaggaaaacacattggaaatcctgggagtgtttaactcggccgaagagcaacggggncctgggttttagagattttcgtctcttcaaccaagcacttctagcacggcaggcctggcggctcattgttaatcctgacagtctatgtgcaagggtactcaaggcaaaatattttccaaatggttcccttgtggatacaagttttggaggaaatgcctccccggtgtggaaagcaattgagtatgggctgtcacttcttaaggaaggaattatatggagaatcggggaatgggaa

SEQ ID NO: 932 - DNA, 1147 bp, Oryza sativa
  misc_feature (975)..(975): n = any nucleotide
ctgagccgggagtcggtggtggacgtcgccggcgtcgtctcgttgccgcgggagcccgtccgcggcaccacgcagcaggtgcaggaagtggagatccaggtgaagaagctgtactgcatcagcaaagcgactccgaatctccccatcagcgtcgacgacgcggcgcgaagcgaggaagacgtcgtgaaggccaaggctgtcgggcaggacaagcgcttggacttcagagtgatcgacctgcgcacacctgcaaaccaggcgatttttcgtgtccaatgcgaaatcgaaaacttcgttggcatccacacgccgaagctgatcggcgggtccagtgaaggcggcgcggcggtgttcaagctggactacaacggccagccggcctgcctggcgcagtcgcctcagctccacaagcaaatggcaatttgtggtggattcgagcgtgtgttcgaggttggccccgtgttcagggcagaagactccaacacgcaccggcatttgtgtgagttcgttggacttgacatggaaatggcaatcaaaggccactactctgaggatgttgtggataggctgtttgttgctatgtttgatcatctgaacaagaactgcgccaaggaacttgaggccattaacaggcagtatccgttcaaacctttgaagttacccaagacactgcgcattgagtatgacgaaggcatccggatgctcaagggaagctggggtccacgtggaggccatgggagacctcaacacagagtctgagaagaagctgggcgagctggttcataccaatatgacactgatttctacatgctctgccggtacccgtcggcggtgaggccattctacaccatgccctgctccgacgacccacgctacagcaactccttcgacgtgttcgtccgagggggaggagatcatctcgggagcgcagagggtgcacgtcccggaggtcctggcacgacaggcggaggagcnggggatcgacgtcggcagcatcgccgcctacgtcgacgcgttcaggtacggcgcgccgccgcacggcgggttcggcgtcgggctggagagggtggtgatgctcttctgcggcctcggcaacatcaggaaggcttctctcttcccacgcgaccccaggaggctgaacccctga

SEQ ID NO: 933 - DNA, 1120 bp, Oryza sativa
  misc_feature (154)..(154): n = any nucleotide
  misc_feature (159)..(159): n = any nucleotide
  misc_feature (197)..(197): n = any nucleotide
  misc_feature (200)..(200): n = any nucleotide
  misc_feature (232)..(232): n = any nucleotide
atgtttcacccacccctccaaaaacaactcgtcgccctggcccgtgtctctctcctccccttccccttccctttctccatttttgcaaggggaaaaaaagagaggagagagagagagagagagagggaggaagcttcgagccctagcaatggcngggtngtacgaggaggcggtggggctgctgcggcggccgggcngtngcggagatcggcggtggacgtgctgctgtgcncggtgccgatctgggcggccgtcatgatcgggctcgtcatcggctggtggcggccgcgatggacggggctgctctacctggggttccgaagccgcctccgcctcctctacgttcccccgggcctcggcgcgcgccgcctctggctcgcctgcaccgcgctctccgccttctccgtcgtcactgagaaggacctagaacacctcgtacaacttcttgataacaaggagagtggggatacaacatggcagcatttgatggaacgtaccacttccaacatgacttacaaggcctggcgccgtgagcctgagtactgtagtcgcactatttttgaggatgctactcctgagcttgttagagatttcttctgggatgatgaatttcgtctgaagtgggatcccatgcttgcatatttcaaaattttggaggagttcccccaaaatggaactatgattattcactggataaaaaagttccctttcttttgcagtgaccgtgaatacatttttgggcggcggatatgggaatctgggaaaacttactattgtgttacaaagtcaccgaaacaagatggacagcaatccgcatgtgaagtaacgctggtccactacgaggacatgggcatccctaaagatgtcgccaaggtgggtgtccggcatggcatgtggggtgctgtaaagaagttccagtccggatttagagcataccagcaaatgagagacacagagaacaccctctctcgcagtgccatcatggctcgagtaaccaccaagcgactggaaatgggtggtgttcggtggcgcagtggctgccgtctgcgtgctcaacactgggcttgttgggaaggctctcctcatcggagctgcatcaagaaggcaggcgaagaagtga

SEQ ID NO: 934 - DNA, 1108 bp, Oryza sativa
aatgggtacatccggatcgactgctacggcgggctcaaccagctgcgacgcgatctatgtgatggaattgcggttgcgcgccttctcaacgcaacaatggttctgcccaagtttgaggttgctgcctactggaatgaatctagagtggatttgcagacgttttcgatgttgattacttcattgagcaaaccagaggttatgtggaagttgtgaaggacatgcctgaagagatagcatcaaaagagccctttaaggttgattgcagcaaacgaaaaggacattttgattacgtggaaacggtgcttccagctctcttggagcatcagtatatttcactgacacctgccatgagccaaagaagagacagagaaatccttcatacgcgaaagcttcttactgccaaggctgctacaatgcactgcggttgaataagaatgtggaaacaaaagctattgagcttctccaagccataccaaaacctttcttgtctcttcacctgagatttgaaccagatatggttgcctacagtcgatgtgtatacactggtctgtcttctaaatcactcagtgcaattgaagctgcacgtggggaggacaggaaggcattgactggtgaggctgcccttctgtggaggaaccgtggcaagtgccctctaacaccaagtgaaacagcatttatacttaaagcattaggtatccccacagacacaaacatttatttagctgctggcgatgggctaatggaacttgagggcttcacttccatttacaaaaatatatacactaaatcatccctcctaactcatgatgattttgagaagatgcatggcaatacaaaagctgctcttgattactatgtttcagtcagcagtgatgcttatgttgccaccttctttggaaatatggataagatggtaactgcgatgagaacaatgcaagggcaccagaagactctggtcttgagtaggagggcctatgcaaactacacagctgttggactttcaggggagcaactagctatggccatgtgggatgcccatcgagaggaatatatcatggggaggggatcagcccttcctgagcagtgcttctgtgagttcaaattgtaa

SEQ ID NO: 935 - DNA, 1091 bp, Oryza sativa
atggcgcggcgatccgcccccctcctccgccgcatcctctcctccccggcccccgccccggcgcaccatggcggcgccggcgcgcgccgcacggtgacctacatgcccaggccaggggacgggaacccgcgcgccgtgacgctgatcccgggggacgggatcgggccgctcgtgacgggggccgtgcagcaggtgatggaggtgatgcacgcgccggtctacttcgagacctacgaggtccgcggcgacatgcccaccgtgccgcccgccgtcatcgagtccatccgccgcaacaaggtgtgcctcaagggcggcctcgccacccccgtcggcggcggggtctcctccctcaacatgcagctccgcaaggagctcgacctctacgcctcgctcgtcaactgctccaacttccccggcctccccaccaggcaccaggacgtcgacatcgtcgtcatcagggagaacaccgagggggagtactcggggctcgagcacgaggtcgtgcccggcgtcgtcgagagcctcaaggtgataacaaagttttgctctgagaggattgccaaatatgcttttgagtatgcttaccttaacaaccgaaagaaagtcacagcagtgcataaagcaaacatcatgaagcttgctgatggtttgttcttggaatcttgccgtgaggttgcctcaaagtatcctggtattcagtataatgagatcattgtcgacaactgctgtatgcaacttgttgcaaagcctgagcaatttgatgtcatggttacaccaaacctttatggcaatttggttgctaacacggctgcagaggtaatgtgggtcaggaccatgctgtctttgagcaaggtgcttctgcaggaaacgtcggaaacgagaacatcttagagcagaagaaagcaaaccctattgcgctgcttctatcatccgccatgatgttgaggcatttgcagttcccgtcattcgccgaccggctggagacggcggtgaagcgtgtcattgcggaaggcaagtacagaacaaaggatctaggcggcaccagcaccacccaggaagtcactgatgcagtaatcgccaatctggattag

SEQ ID NO: 936 - DNA, 1060 bp, Oryza sativa
atggaagccaggaacggccatcggatcccgccgacggaggagaaggtcatcatcgacacggatccagggatcggtacactaattctgatttctccacttctcctacctgcatctgtgactgtgatccatccatccatcttgacaattactaattcatatcaattcccagatgacagcgtggcgatcatgatggcgttcgaagctcccggcgtgaaggtcgtcggactcaccaccatcttcggcaactgcactacctcccacgccacccgcaatgccctcatcctggcaggccgtcctgaggtgccggtagcagagggcagcgctgagcctctcaagttgcagggagggaaacctcacgttgctgattttgttcatggatcggatggacttggtaacacgtcctttcctgatcctaccaccaccaacaaagttgagcagtcagctgcagagtttctggttgataaggtatcagaatctccaggagagatctctgtactcgccttgggccctctcactaatatcgcattggccatgaagaaagactcctcctttgcaagcaaggttaagaggatagttgtgctgggtggagctttctttgcagctgggaatgccaccccttcagctgaagcaaatgacccagaagcagctgacatagttttcacttctggggcagatatctacgtagttggccttaacataacaacccaagtctacttcacaggacaaggatatgttggagctaaggaactcgaaagggaagcacgcacaattcctttgtgacatctgcaagttctacagagactggcatgtccactcctacggcgtcgatggtccgcacatgaaacatctctcctttccttcttacaagttcaggctttgggaaattaacgttccagctcacatttgtgtgatttcttcagctctttttctccatgatcctgtgagtttcaccgcgctagttcaccccgagtacttcacgttcaagaagggcgtggtgagggttgagacccagggcatctgcaaggggcatacttccatggacatgggactgaagaagtaa

SEQ ID NO: 937 - DNA, 1032 bp, Oryza sativa
atgggggtcgcggcggcggcgggccggctcctggcggcggtggactgggagcgggaggcctacccggcgtaccgcgacttcttcgcgctccccttgttcgccgtcttcttcctcgtcgtccgctacctcctcgactgcttcgtcttcgagattgtttttcttttattttcgtttcagtggattggaagaaaacttatatttggaaaggaaaaggttgattatgagaaggaggaaacaagaaagaagataagaaaatttaaggaatcagcttggaaatgtgtctatttcctatctggagagattttatctttgtcagttacatataatgagccttggttcacaaacactaaatatttctgggttggacctggtgaccaggtttggcctgaccaaaagataaaaaacttaaggctgtctatatgtatgctgctggattctacacatattccatatttgcacttatgttttgggaaacaaggcgttcagattttggcgtgtcaatgtcacatcatgttgcaactgttgcgctgatagttttatcttatgtgttcagtttgctagagttggctcagtagtattggcaattcatgatgcaagtgatgtgttcctggaagtagggaaaatggccaaatatagccattgtgatttgcttgccaatgttgcatttcttcttttcgtcgtttcatgggttcttctccgtctcacatattttccgttctggattctcagaagtacaagagctatgaagtcttgttgaccttggacaagaagaagcacaattttgatggtcctatatattactatgtgttcaattctctcctattttcactacttgttcttcacatatattggtgggttctgatatatcggatgcttgtgagacaaatcaagacaagaaatgttggagatgatgttcgatctggtaagctctgcccccttagaatcttgtttttgcacaggatgagcatgcaaaattgcatggtcttattttcagtcccatctgcattgggacaagacaaagtctgcttataa

SEQ ID NO: 938 - DNA, 1022 bp, Oryza sativa
gagcgggaggcggccaagaaggccatcgccgaggcgccgccggtgatcaaggagatcgtcgtgcaggtcgtggacaccgacaaggtggactcgctcgccgccgaagtcgcccgcctcaagcaggagctgttgatcaagtgcatatctgaagatcttgggttctctattggaaggcctattgccgcatacctcatctaccgatgcctgatccactggaaatcatttgaagaggacaggacaacagtttttgatcgcattattcagaagataagtgctgcaattgaggacaacaatgagacattagcatattggctatccaattcatgcacactgctgctgcttctccaaaaaacactgaaaatcaacggggcagctgctttggctcgtcagaggcgaagagcatcacccctgaagacgccacagcaggttgaagccaagtatccagctcttgctttcaagcagcagctcactgcattgctggagaaggtctatggaattatcaggcacaatttgaagaaggaactgtccccactgcttggtctctgtattcaggcacagcaagcttctatggcacattggcagagcatcatcaaaattcttacaaattcgctgaatgtcctaaaatccaattatattcatcaatgttcaactcttcaacagagtcttctgctacggcgtgaatgctgttcattcagtaatggagagtatgttaaagctgggttggatgagctagagcactggtgcttttggctgactgaagagtatgcaggttcttcctgggacgaactgaagcatattaggcaggccgtagcacttctgatacttgaagagaagcacagcaagtctctcaaagaaatcactgatgagtactgcccacttagcatgcagcagctatacagaatcagcacaatgtattgcgacgacaaagtataccgttctccatcgatgacattgcaaagctgatggttcacatcgacatagcagatatggatctgccacccctgattcaggagaacaagggc

SEQ ID NO: 939 - DNA, 1010 bp, Oryza sativa
  misc_feature (187)..(187): n = any nucleotide
  misc_feature (211)..(211): n = any nucleotide
  misc_feature (733)..(733): n = any nucleotide
atggtcaagaacgccatccagtacgccgtgggtggacgcgttcgcggccgagccgttcaagggcaaccccgccgccgtatgcctcctggaaggggaggatgccgcggcggcggcggacgagcggtggatgcaatccgtcgcagccgagttcaacctctccgagaccgccttcctcatccgcgacccntcctcctccgcagccgccgccgangccgccccgcggttccgcctccgctggttcacccccgtcgccgaggtaggtgaatctctgcggccacgcgacgctggcatccgcccacttcctcttcaccaccgtcctcgcgaagcagcagcacgccgccgccgccatggtcgagttcgtgacgaggtccggcatcctgaccgccaagaaggttcctgctccgccgcctccggcgaacgatggcggcgtcccgggtgaggagaagctgttcatcgagctggatttccccatgatcgatctcgtggagtacgattccgcggagacgctgtcgattccggagactctgaatggcgcccgagtcgtggaactttcttccggaaaagaggttgctgatattatccctaacattaatgaaattaaaaaatgtgatggtagaggagttattgttacgggaccagcacctgctggatctgattatgacttcttttcacgattcttctgcccaaaatttgggatagatgagaggatcctgtgtgtggaagcgcacattgngttctggcaccttactggggtggaaagctggggaaacaaaaacttaacggcgtttcagtcaggcttcgccaaggagtggaacattgtacttggagctggacggcgagaacaggagagtccggatccagggagaagctgtcactgtgatggccgggactctcttggcgtagcatctctctctgtcagagtgtctggcgatctgcttgctcttgtatgcttgagagttcagcggagaaattgttgttgttcgacgcgtaccgcgaacgattgtaattga

SEQ ID NO: 940 - DNA, 1008 bp, Oryza sativa
atggggggttccaaggcggaggagaagcccgccggcggcggcggcggcggcgaggattggtggtgctaccagttcggcaacaaggaaaaaggggatttttgattctttggcttgtgatccattattgattaaggaatatgatgttgggcagcaggacgcattgattgtgaagtcctctaagaaatcacccctcgcattgagaatggttgttttcgctatgactatgatctgcgggatatttatctgcacgatgtgtatgaagcaactaggaagtgatagcttgtctagaatagtgaagatcgaggttgcagaacagctatgcaataagtctgcaatcctgcattcagaggttcactttgtgcattacccacaaccgataacttatagcagaggagtgaatgcaagtgtacacctgtccggttcttcgcgattatctcgtcacaacgttctggaagtggctggtttgaaactcttcttaacagccatatgaatgttagctccaatggtgaaattttctcttcaaaagaaaggagaagtaacatttcatctataacaaagacactggataaggtgtacaatttggattggaatagtagtgcttctaagaatgaatgcactgctgctgttggcttaaaatggatgcttaatcagcagggtcttgtggcaaatcatgctgatatagctgactacttcaatcgaagaggagtctctgcaatatttctcttcaggtggaacctcctccgtcagttggtatctcaacttgcgaataatcatgacagatacctcaagcagttgaatggaacgcacaaggcccatgttcacacggcatatgagaaacttcttgatgtcctggatttcctcaaagtgccaaggagcaaactagtcagccgacacgtgaagatacacaccaaaccactttcggagcaaattgaaaattgggatgaagtctacaatgctctaaatggcactcagtatgagagcttcttgaatgctgactacagaatatga

SEQ ID NO: 941 - DNA, 1006 bp, Oryza sativa
  misc_feature (811)..(811): n = any nucleotide
  misc_feature (817)..(817): n = any nucleotide
  misc_feature (824)..(824): n = any nucleotide
  misc_feature (847)..(847): n = any nucleotide
atggcgcttgacggcgccgcggcggccgtgtccacgttcggcgccgtgacggtcgaccagagcggcgccggcaacttcacgaccgtctcggacgccgtggcggcggcgccgacgaacctcgacggcaccaagggctacttcgtgatacacgtcaccgccggcgtgtacgcggagaatgtggtggtgcccaagaacaagaagtacgtgatgatggtcggcgacggcatcgggcagacggtgatcaccggcaaccggagcgtcgtcgacggctggacgaccttcaactccgccacgttcgacacatgcagctgtgctcgggcaaggattcgtggcggtgaacatgacgttcaggaacacggccgggccggcgaagcaccaggcggtggcgctccggtgcggcgccgacctgtcgacgttctaccagtgcagcttcgaggcgtaccaggacacgctgtacacgcactcgctccggcagttctaccgcgcctgcgacgtctacggcaccgtcgactacgtgttcggcaacgccgccgtggttttccaggactgcaccctctacaaccgcctccccatgcaggggcagagcaacaccgtcacggcgcaggggcgcaccgaccccaaccagaacaccggcaccaccatccagggctgcgccatcgtcgcggcgcccgacctcgccgccaacacggcgttcgccaccaccaactacctcggccgcccgtggaagctctactcgcgcacggtgatcatgcagtccgtcgtcggcgggctcatcgaccccgccgggtggatgccgtgggacggcgactangcgctnagcacgntctactacgccgagtacaacaantccggcgccggggcggacaccagcaggagggtgacctggccggggtaccacgtgctcaacagcaccgccgacgccggcaacttcaccgtcggcaacatggtgctcggcgacttctggctgccgcagaccggcgtgccgttcaccagcggcctcaactga

SEQ ID NO: 942 - DNA, 997 bp, Oryza sativa
atggtgaaggagacggggtactacgacgtgctaggggtgagcccgaccgccaccgagtccgagatcaagaaggcgtattacatgaaggcgcggcaggtccatccggataagaaccccaatgacccgaaagccgcggagaatttccagcaggcactaggagaggcataccaagttcttagtgaccctacgcagcgccaagcttatgacgcacatgggaaatctggcatctcaacataattgatccagcagcaatttttgcaatgctatttggtagtgagttgtttgaagattatattggtcaactggctatggcatcaatggcttcacttgataatttcggtgaagctgttcaaaaggaaagggaagagaaacttgcagagacactgaaaaaccgactgcacatttacgttcaaggaaataaagaggaatttgtccagcttgctcaagctgaggtgaccagacttagcaatgcagtcttgtgcagcatatggcactgttatgttaaacactatcggctatgtatattcgagacaagctgcaaaagaacttgggaagaaagcaatattcttgggtgttccatttgtagctgagtggttcagagacaaaggccatttcatcaaatcccaagtaacagctgcagcagttgatgcagttgcaagaagacttgaagaagtatcttagtgctgaaggccattacacagaggaggaactagaaatgttcatgcaaaaccacaaaaaggttatggttgattccttgtggaagcttaacgttgctgacatagaagccaccctatcacgagtctgtcaaatgcaggtgcttcaagatggaagcgtcaggagggaggaactgcgtgctcgtgctaaaggactgaaaacattaggcaaaattttccagagcccatatgtggaggccccacagtttggaggaacctattacccattcaatttcccaatgccaacagctccacctggtgcgcagagggatccaattccatga

SEQ ID NO: 943 - DNA, 986 bp, Oryza sativa
  misc_feature (243)..(243): n = any nucleotide
  misc_feature (269)..(269): n = any nucleotide
atgccgggcgtcggcgtgaagatctacagcgtcttcttcaagttcctcctccgccacaagctccagttcggggtctcctgccgcgcggacgaggccacggcgccgtcgaacccggccttctccgcggcggacggcgtcgcctccaaggacctccacatcgaccccaactcctccctctccgtccgcatcttcctcccccagttccacggcggcgggttcgtgtccgggagcagcagctccgcngccaacgacgccttctgcaggaaggntggcccaagatgtgcgacgccatcgtcgttcgccgtgggatacaggcttgcgcccgagagccgctatcccgccgcgttcgatgacggggtcagggtgctcaggtggatcgccaagcaagcgaatctcgccatgatgagcaagccgtggattgctgcccatggtgatccggcaagagatgtgtactacttggtgtaagctgtggtgccaatattgctaattttgtcactcggaaggcagtagaagatggaaagctatttgaccctatcaaggttgttgcacaggttctgatgtacccattcttcataggaagcgttccaacacactcggaaataaggcttgcgaactcatacttctatgacaagtccacatgtatacttgcttggagattatttttgtcagagaaggaattcagcctggatcatcctgctgcgaatcccctggctcctgatagaggagggccaccactgaaatgtatgcctccgaccttgacagtcatcgcggaacatgactggatgagggatcgagcaattgcatactcggaggagctccgcaaggtgaatgtcgatgcacctgttcttgattacaaggatacagttcatgagtttgcaaccctcgatgttttcctcaagacaccgcaggcccaggcctgtgccgaggacatcgccatatggatgaagaaatacatatccctccgaggacacgagttctcgtattag

SEQ ID NO: 944 - DNA, 985 bp, Oryza sativa
  misc_feature (84)..(84): n = any nucleotide
  misc_feature (170)..(170): n = any nucleotide
  misc_feature (172)..(172): n = any nucleotide
  misc_feature (182)..(182): n = any nucleotide
atggccgccgcgctcctctcgctcctcatcctggtgccgcccatcgggctcctcgcggcgctagcgttcctggcgcgcctaggncgcgcggatcccgctcaagggccggcacgtgctcatcaccgggggtccagcggcatcgggctcgccatggccacggcggcggcgangnagggggcccnggtgtccatccttggccccggaacgccgcaaggcttggaggaggcgcgcggcgccatccgggccgccacggggcgggacgtcggggtccacgccgccgacgtgcgggacgccgacgccgtggcgcgcgcgctcgccgaggcgggccccgtcgacgtcctcgtctgcaaccacggcgtgttcgtcccgcaggagctggagaagcaggagatggaggaggtcaagtggatggtggacatcaacctcatgggcaccttccacctcgtcaaggcggcgctccccgccatgaaggaacgcacaaaggagacgcgcctcccggcgtccatcgccatcatgtcctcacaggccggccaggttggagtttatgggtacaccgcttactcagcgagcaaatttgcgcttcgtggattgggtgaggccttgcagcatgaggttattgcggacaacattcatgtctcgttgatcttccctcctgacacagagacaccgggtttcgctgaaggagaataaaaggaggccagagttgaccaatatcatagcaggatcatctggtggcatgaaagctgatgatgttgctaggaaggctttagatggcatcaaatccggaaagtttattgtaccctgcaatttcgagggagcaatgttagctgtagctactgctggtctatccccacagagttccccgctaacagcattcctggagattattggtgctggagtcatgcgatttgcagcaatttgcttccaatttaattggttcatgaccatcgagaactggtatgccaagaacaagaagcatgcgtga

SEQ ID NO: 945 - DNA, 977 bp, Oryza sativa
atggctacaggtgttctgtgctccagggaatttgctctctgcctggcttgtgtgctcctggccgtgccattgctagtggctcaggacccttcaagcctgagcttggagcactactcaaagacctgcccgaattatgagcatgtcgtccggactgagatggaatgtgctgtgcgtgcggattcccgcaatgcagctctgatgcttcgtcttcatttccatgactgtttcgttcagcagggttgcgatggatcagtgctgcttgacgacactgcgaccctgattggagagaagaaggcagaacagaatgtcaactcgctgaaggggttcgagctggttgacaagatcaagcagaagctggaagctgagtgccctggaacagtttcctgtgcagacttgcttgccattgcagcgagggacgcagttgtgctgggttggtgggccttactgggatgtcccagttggaagattggactccaagaaggcaagcctggacctagcaaacagggacattcccactgctcaacagggccttgtcaccctcattgccaagttctgggagaagggcctcgatgccactgacatggtagcccttgtcgggatcccacacaatcggattcgcccggtgcgccaacttccgggacaggatctacggcgactacgagatgacgaccaagtacagcccgatctcccagccctacctgagcaagctcaaggacatctgccccctggacggcggcgacgacaacatcagcgccatggacagccacaccgccgccgccttcgacaacgcctacttcgggaccctcgtcaacggcgagggcctcctcaactccgaccaggagatgtggtccagcgtcctcggctactccacggccgacaccgtcagcaagtactgggccgacgccgacgccttcttcaagcagttctccgactccatggtcaagatgggcaacatcaccaaccctgcaggtggtgag

SEQ ID NO: 946 - DNA, 965 bp, Oryza sativa
atggaaggcgcggcggtggacgaggtggtgcggcgcctcgtggagggcgggcgcggggggaggcaggtgcagctgtcggaggcggagatccggcagctctgcgtcgaggcgaagcgggtgctcctgtcgcagccgaacctcctgcgcatccacgcccccgtcaagatctgcgggtgatatccatgggcaatttgttgatcttctgaggctgtttgatttgggcggttatcctccaacttccacttatcttttccttggagattatgtggacagaggcaaacaaagcttggaaaccatatgcttgcttctggcatacaaagtgaagtatcctgataagattttcctgttaaggggaaaccatgaagatgcgaaaattaacagagtgtatggtttctatgatgaatgtaagaggcgattcaatgttcgactgtggaagattttctgtgattgcttcaactgcttgcctatggcagcactcattgacgataagatactctgcatgcatggtggcctctcacctgaactgaatagcttggatcaaataaaggatatcgagaggcccactgagattcctgactatggtcttttgtgtgatttagtttggtctgatcctagtcctgactcagaagggtggggagagagtgacagaggtgtttcctgcacttttggtgcagataagcttgtagaatttttggagaagaatgatcttgatcttatatgccgcgctcatcaggttgttgaggatggctacgagttctttgcgcaaaggagattagtgacaatcttttcagctccaaactattgtggggaatttgataatgcgggtgctctgttgagccatagatttaatgtgttcttttcaaatcttgaagccaaatgatacaggggctccacattgcaaggaaaaccaacttacaaacaaggtgaaaatatcaagtttaaattcacttacatctttttcataa

SEQ ID NO: 947 - DNA, 963 bp, Oryza sativa
  misc_feature (422)..(422): n = any nucleotide
atacaggggtgcctcatctgtttaactcttggtcttggatgggctgttgctgcacttgttaggggaatagttttgcatttctttgtgatgatgtcaatgagcttgagcactctgttcaagagaaattacctagggtctctgtaatcatgccgttgaagggctttggtgaacataatttgcaaaattggagaactcagcagatcacatctctttatggggggccactggaattcctgtttgtagtagaaagcaaagatgatccagcttatcatgctgtttcacgtttgatagcagaatacaagcaggacaagttggaggcaaaggtggttgtagctgggctctcaacaacatgtagccagaaaatccataatcagttagtacattggcgttgaaaagatgcataaggacagcaaatatgtttngtttctggatgatgatgtgagactgcaccctgggacaattggagctctcacaaaagaaatggagaaaaatcctgagccttgttcaattggatttgcaactggtgggaagactttctttttgtggggtggctgcatgatgatgcatgctgatgattttcggcaagacctatatggcgtcgtcagtggattaagagatggtggggcagcataaaaggctcatatcttcaccacctgttgcagtgtttccacaccctctttcaagtgatcttagtttctccagtggaattacctaaggaaacaaacttttgttcttgaatcatatgtatcaaaggttaactggatgatgaaccgtgcactatttgcatcgcactgctatttgtcctggggatttgtttggccctatatcatggctttgttgttaatatgcactctcacagaacttgtttcaatgtggaatttgacaaaggtggaaattcaactgtgcaacatgttgtctcccgaagggccaaaagtctctcttggttcttataactggggactc

SEQ ID NO: 948 - DNA, 957 bp, Oryza sativa
atggcgatgaagaggggagccacggccgcgctgtggctggtcgccgccgtcgccggcatgctcctgcacgccgacgcgcagacgctcgtgtacaagtactacgcccagaagtgccccgccgccgagtccatcgtgttcgacgaggtccagaaggcgtggaacgccgaccggagcatgccggccagcctcctccgcctccacttccacgactgcttcgtcaacggttgcgacgggtcggtgttgctggaggcgagcgacgggcaggcggagaagaacgcgcagccgaacctgagcctgcgaggctacgacgtcgtcgacagggtgaaggcgaggttggaggcgacgtgcaagcagacggtgtcgtgcgccgacatcctcgcctacgccgcccgcgacagcgtcagggtcatgaccggcggctacaagtacgaggtgcccggcgggaggccggacgggacggtgtcgcgggcgagcatgaccggcgacctcccgccgccgaagcagcggaacgtggaccagctggcgcggtacttcaccagcaagggcctgaccgtggacgacatggtggtgctctccggcgcgcacacgctcggcgtcgccaggtgcggcacgttcgggtacaggctgacgagcgacggcgacaagggcatggacgccgcgttccggaacgcgctgaggaagcagtgcaactacaagtccaacaacgtcgccgccctcgacgccggcagcgagtacggcttcgacaccagctactacgccaacgtgctcgccaaccgcaccgtgctcgagtccgacgccgcgctcaactcgcccaggaccttggcgagggtcacccagctcaggggcaaccaggcgctgttcacgagcagcttcgccgccgccatggtcaagatgggcggcctccgcggcggctacgccggcaaggtccgcgacaactgccggcgggtcaggacatga

SEQ ID NO: 949 - DNA, 953 bp, Oryza sativa
  misc_feature (58)..(58): n = any nucleotide
atgggctgctccatctcggggctcaacgccctctacgacgcggcgacgggcggcggcnacgtgtggatcaacgagcgccgcttccgcgtcctgcgccagattggggagggcggcttcgccttcgtctacctcgtcagggaggatgggacatatgctatgaagaaggtgctgatacagagcaaggaacagctagatctggtgaaggaggagatccgtgtttcgtcattgttcaaccatcctaacctgcttccgcttcttgatcatgccgtgatagcagttaagggagattggaaccatgaagcctacttgctcttccctgtctatatcgatggtactctgtttgacaatgccaaagtcatgcaatccaggaaggaattctattcaacaatcgatgttttgagaatattccaacagcagctctgtgaaggactgaagcacatgcacagttttgatccaccatatgcccataatgacgttaagactggcaatgttcttataactcacagaaaaggacaagcacctcttgcaactttaatggattttggaagtgcaaggcctgcaagaaaagaaatccgttctcgtgctgaagcattacgattgcaggaatgggccgctgaacattgctctgcgccttaccgtgcacctgaactgtgggactgcccaagtcatgccgatatcgatgagaggacagacatctggtctctaggatgcaccctttatgctatcattacaatgtttcaccatttgagtatgctctcggtgaatctggaggaagcttgcaattagccattgtcaactgcacgctgaagtggccggcaggacccagccctccttaccctgatgcacttcatcagtttattacctggatgcttcagccacaacctgcaatgcgccctcacatcgatgacataattctacatgtcgaaaagcttatggaaaaatattcgtcttaa

SEQ ID NO: 950 - DNA, 910 bp, Oryza sativa
atggcatcagacaagtgctcatcgtttctactagcagcggcagcggctgcagtgctcgtcctcgcgtcggcgccggtggctcattcgtggagcaaggagggtcacatgctcacatgccgaatcgcgcagcaggatctgctggagccagccgcggcgcacgcggtgaggaacctgctgacggaggaggcggacggcgacctgtcggcgctgtgcgtgtggccggatcaggtcaggcactggtacaagtacaggtggacgagccctctccacttcatcgacacccctgacaaagcctgcagcttcgtctactcaagtacgcttaggatatgtgcgtcgctggcgcgatcgcgaacttcacctctcagcttatgcactataatcacggcagcgccgatcgcaaataacatgactgaagcactgctattcttgtcacacttcatgggagatgttcatcagcagccaatgcatgttgggttcacgagcgaccaagggggcaatacgattaatctacgctggttcaggcacaaatccaatctccatcatgtgtgggatagggagatgatactcacagctattgctgaattctacggcaaggacatggatgcgtttcaaaaggaccttgtgcacaacttcaccacggggaacgtggtctgatgacgtatcctcttggggagactgcgaggatctcctgtcttgctcaaccaaaacaggtacgctacagagagcataaatttggcttgcaaatgggcgtacaacgatgtccgtgaaggcgaaactctgtcaggatgactacttcggctcacggctcccgatcgtgacacgacgaatcgcgcaggggggagttaggctggccatgttcttgaatcggctcttcggggagcacaaccgtgacgtcgcatcaccagcctga

SEQ ID NO: 951 - DNA, 904 bp, Oryza sativa
atggcgcggagtgccttcttcttccactgcgtcgccgccgtcgcggcgtgcatcgccgcgacggccgcggcgctcagtggcacggccacgttctacggcgggagcgacgcctccggcacaatgggtggcggcgcgtgcgggtacggcaacctgtactcgacggggtacgggacgaacacggcggcgctgagctcggcgctgttcaacgacggcgcggcgtgcggcgagtgctaccagatcacgtgcgaccagtccaactcgaagtggtgcaaggcgggcacgtcggtgaccatcaccgcgaccaacctctgcccaccggactactccaagccgagcaacgacggcggctggtgcaacccgccgcgccagcacttcgacatggcgcaacccgcctgggaacagatcggcgtctaccgcggcggtatcgtccccgtcaatttccagagagggtgtcgtgcacgaggaaaggaggggtgaggttcaccatcaacgggaacagctacttcgagctggtgctgatcaccaacgtgggcgggccggggtcgatcaagtcggtgcagatcaagggaacaaagacggggtgggtgaccatgtcccggaactggggcgccaactggcaagccaacaactacctcaacaaccaggccatctccttctcggtcacctccaccgccggcaagacgctcgtcttcgaggacgtcgcgccgtccaactggcagttcggccagacattcaccagcggcgtgcagttctactagctagcggctcgcgcgcgcgcgcggcggcgcatgagccgccgccgccgtcgcgcgcttgcccaacggcgagcggcgcatgccacctgccgccatttccgttcaatttttgcatttggaaaacttgtcaaaaagaccagcttatttag

SEQ ID NO: 952 - DNA, 867 bp, Oryza sativa
tcgacggacaacgtgaaggggatcgtcctggcgctcctctccagcggcttcatcggcgccagcttcatcatcaagaagaagggcctccgccgcgccgccgtcgcctccggcatccgcgcaggtgcaggggttggtgggtactcgtacctcctggagcctctatggtgggttggcatgatcaccagtaagattgtgggagaagttgccaatttcgtcgcatacgccttcgctcccgcggttcttgttactcctcttggagcactgagcataattgttagagtgcagtgctggcacattttatcctgaatgagaggttacacgcgcttggtgttcttggttgtgttatgtgcatcgcgggatcagtggtgattgttattcatgctcctcaggagcaagagattacttcagttagagaaatctggaacatggcgatacagcctggctttcttgctatatgttgcttcagttatagtggtggtcttcgtgctagtgttccatttctcccctctatatgggcagtcaaatgtgttgatctacactgccatttgctctttgatgggttctctttcggtaatgtaatgagtgttaaagctcttggtacatccttaaagttgacgtttgaggggacaaatcagttggtatatccagagacttggttctttgtgcttatagtggccacttgtgtgctaacacagatgaattacttgaacaaggcacttgatacatttaatactgcaattgtatctccaatctattatgtaatgttcacaacactaacaatacttgcaagcgtcataatgttcaagttgtctggtaccattttgttacatgtgacgaaggattatgaaaggattccgcaatcaagaa

SEQ ID NO: 953 - DNA, 832 bp, Oryza sativa
atgcgcggcgcgctgctggcgctcgcgctgctgctcaccgcgacggccgtcgtgccgctgctcctcctcggagaggccggggacgacggcgtcggggccgtcgccgccgcgccgccgttcaacgcgtcccgcgtcagggcggtgtcgtggaggcccagggtcttcgtctacaaggggttcctctccgacgacgagtgcgaccacctcgtcaagctgcagaggtcgatggtggcggacaacaagtccggcaagagcgtcatgagcgaggtgcggaccagctccggcatgttcctcgacaagcgccagaaggatccagtggtgagcaggattgaaaaaagaattgcagcatggacctttcttcctgaagcagatactccgatacgagcatgggcagaagtatgagccgcactttgattatttccatgacaaggtcaatcaagcactgggaggccaccgttacgcgacggtgctcatgtatttgtccactgtcgagaagggaggcgagactgtgttccccaatgctgagaaaccagttaaaggcgacacggtgctcttctttagccttcatatcgatggcgtaccggacccgctcagcctccatgggagctgcccagtgatagaaggtgaaaaatggtctgcaccaaagtggatccgtatcaggtcctatgagcatcctcctgtctcaaaggtgacagaaggatgctccgacaacagtgcacgttgcgcgaaatgggctgaagctggagaatgcgagaagaacccggtatacatggtaggtgccgagggtttgcccggcaattgtcggaagagttgtggcgtttgtgattcctag

SEQ ID NO: 954 - DNA, 825 bp, Oryza sativa
  misc_feature (571)..(572): n = any nucleotide
  misc_feature (719)..(719): n = any nucleotide
agcatatttcttgcacaatctgatcatcttccctggaagcgcaagcgcaagggccgccggtcgccggcgacgagaagacgccgcgcgggtgggcgccacggaggtggtacttcttcagcctgcacgaccgcaagtacgccacggggcagcgcaccaaccgcgccacccgctccggctactggaagccaccggcaaggaccgcgccatcgtcacccgccgccgcgccgccgccggagaggccgtcgccggcggcgaggtggtcgggatgaggaagacgctggtgttctaccaagggagagccccccggggcagcaagacggagtgggtcatgcacgagttccgcgtggacggacatgccgttgccgaccacccctcctcgtccacctcctcctcctcatctaatcttctcaagaggaggactgggtgctgtgcagggtgttctacaagagcagaacggctacaccaagggcagtagtctccggtgaggctgccgtgtcactgtccggtgagctcagcttgccgccgccgctgccgccgcccgttgcccccgccgtcgtcgacggctacaccnncggcggctattacgagcaagacagctcagctgggtaccaccaccaccaccaccaccggccgccgccgtcggcagcattgccgttcaaggacctgacggacttcagggacctgctgagcaacatggcacaaggcggcggcggcggcgntgccgccgccaagacggaggggttccatcttggctggagcgaggaggagtcctccggctacgtgcagcagagcgccatggcgtcgcaggcgtggaacccgttctag

SEQ ID NO: 955 - DNA, 823 bp, Oryza sativa
atgctagtgtggactcaagtcgacgaaatcgtcttcccggtttacaccacggtacctatctcggctggtccatcaatgaccggaaatgagaacgccgtggctataaccccgggcaactccatgtcgaaggatcctcccgccgtagcggagaacgaaacgtcgacgtcatacgagcctgagaagtgtcctatccacaagtccaggaaacacaacttgcaagcttgctgggtttttctctggaatccagcgtacttctctaactcgtgatgtctattgtcctattcacaagatgaagaatcacgacttctcaagctacaaggtccttctctgcgccattaagacgccgcttcctaaggtccagcaatcaaaaatctctcttaaggatgcagacaaggaacaaggagcgacgttgatctcggatcgattcattggagtaatcgacatcgatccccacgagtcgtcagtcctacacttgctcgaagactatggctcatcatcctccagtacaccacgcgacgtatttgccatcggtgggaccagcacgtctgcacacgctaacgcagaggcggagaatcaagcggtcacaccggcccaacacctcggcaccatcaacgcaatactgacagaaaccccctatgatcctgtacttaacgatgatctcgcatgatggacataacgactacaggaatcggtagccaatctcagtaacgcgttcgaggaggccgctaccagagcacaaccagaacatccgatagctgacgacgcattgagacgcaagaacgacaagccaaagacggggggagagaagaagccagccaaggat

SEQ ID NO: 956 - DNA, 797 bp, Oryza sativa
gtacagattgcaggtaaactcaatagcataataagggagcaaggtcttcgagatgttggacagctagagcaagatcttgtatttggtgatgctggaactaaagaattaatcaattttttgaggacacaattgagtcgtgaaaacaagttgcgtttgctgatgatctatgcagcaatcaacccagacaagttcgaaagtgacaagggtgaaaaattgatgcagttggcaggattatccactgatgacatgattgctgtgagtaatatgcgttgcttatgtggccctgacaccaaaaagtcctcgggaggaggttttacgtttaaatttgatgttcacaagagaaaggagcgaactggggaagaatctacatgggcactttcccgattttatcctgttctagagttgattgagaagcttagcaagggagaattaccaaaagacgaatactattgcatgaacgaccctagcccaagtttccacggtctgccaatgagcagctcagtcagaactagcccagctcaccaaccagctcattctatgagatccagacggacaggtggtacatgggctcggccacgtggctctgatgatgggtattcaagagtgattcagtgctgaagcattcgtcgagtgacttcaaaaagcttggtcagcgtatatttgtgtttgtcattggtggcgccactcggtcggagcacaagcttacatccaagctaaagcgggaagtcatacttggttcatctagtctggatgatcctccccagttcatcacggtaagtactttatattgtttctaa

SEQ ID NO: 957 - DNA, 786 bp, Oryza sativa
ggaagccagtgcaattcggctacacaaacatttgacggagttgacctgatgggtgaaaggttggcaaatgaggttttatcagttgtagaacaaagaagaggtgtgaagaagatctcatttgtggcacactctctaggtggccttgttgctagatatgctatagggaggctttatgaaccaaataacaaaactaaatcttcttcggagaagagcagagatgaaggtgagcgcttggagggtttcattgctggcttagaacctatgaattttataacctttgcctcaccgcatcttggttcaagtggaaataaacaggtaagactaatatcctttattgtttataaactagacagcagctccctttcttatgtggcctgcctttcctggaaagaagagcttcggaaactgcacatttgcttgttgggagaacagttatgcagatcagcgttgcgctctttcaaacgacgtgtggcatatgctaataaagatatggttgggtggagaacgtcatcaatccgtcgccaacatgagctaccaaaagtatgtcttagaactatattcatgcctaaagaaacctatggaattattacatatttcttttctgttctctttaaattgttggtttacctttcttctgcggttctgcctcttctcagcatcgacttcttgttcgtgatgagaaatatcctcatattgtccatgttgataaaggagcaacgaacagtaatgaagcagaagctcgttctgatctttatgacccagaaggtatatttttctgtttgttag

SEQ ID NO: 958 - DNA, 774 bp, Oryza sativa
atgccggttgccggagcggggtggtgggatctcgtgaacggctcgacggcgtggcaggacgggatcttcctctccctcgccgctctctacggcctcgtcgccgcatcctccttcatccaagttgttaggatacagtacagagttcctgaatatggatggacaacacaaaaggtctttcaattacttaatttcattgtgaatggagcagcatgttattcttgatcttccggggcttgcattcttcacaacgtatgcaatgttggcacttttctgggctgagatatcttatcaagcacgtggtctagagactgaagggcttagatcaggtttctacactattaatggtgtaatatatgtgatacagctgtgggcgttgttgtggcacaatccaaacccatctatgatagtcctttcgaagttgttcattgcaggcctatccttttctgcagccttgggttttctgctatatggagggagggcaggcttttcttcatgctgaagcgttttcctattgagtcaaaagggaggcagaaaaaactgagggaagttgggagagttgccactatatgcttcctttgtttcttggcacgatgcattatgatgtgctttgatgcatttgacaaaaaagctgaccttgatgtgcttgaccatccaattcttaatttcatctattacctggttgaaattcttccttcatctcttgtcctgtttattctgaggagaatcccttcgaagctacggctcgcccagtatcatcccctcaacagtggctag

SEQ ID NO: 959 - DNA, 739 bp, Oryza sativa
  misc_feature (305)..(305): n = any nucleotide
atggcggctgctggtgaagcttcaggaggcagggacaagtaccggtcgttcatgtacggcgagggagagaaggacaccgtgtggaggcttggatcccctccaaactacgacgtcgtcaacaagctcttcgaggaagagagaaccaagtaggaatggccagaggggtctctggaggagaaggtccagaggttgctgaagacctgggagatggagctcatccacaaggtgcgacccgaggaccagaagagcgtccactcgcagaaattctgcgcgagcaccaacggggatgagatttctgagccggnaggaggtgatggctatcggcggctacaacgcgttcctgcagacgaaactgccgccggagcaccgcatctatgacccggacaatgagacgctggagtccggcatggccacgttcttgacggcgttcccgcgtggctttgccatcgaggtgctcgacgtctacagtggtccaccacggatcgtcttcaagttccgacactgggggtacatggaggggcccttcaaggagcatcccccccatggcaagcgggtcgagttctttggcatctgcatcttccatgtcgacgaggagatgaaggtggagaagacggagtacttctacgagcgcggcaatttcctcgcgagcttcttgagcacgcctgctgctgctgctgctgctgaggctgcgtcaggctcaggatgccctgtcatgggaggaaactgaagcaatgggtaa

SEQ ID NO: 960 - DNA, 729 bp, Oryza sativa
atgtcgacggaggcggagaccaccagcgccgccgccccggccccggccccggcccccgcatcggcgccggcgcggtgccagcggataggctgcgacgccacgttcaccgacgacaacaaccccgacggctcctgccaataccacccctcccctatgtttcatgatggcatgaaacagtggagttgctgtaagcaaaaaagccatgattttagcctatttttggctattcctgggtgcaaaactggaaagcacacaactgagaaaccaatcacaaaagcagttcctactaaaccatcaaaggcagttccagtccagacttcgaagcagagtgtgggagctgacacttgctcaaggtgccgtcaaggtttcttttgctctgaccatgggatcacaacccaaggcacaaataccaaccgctaccagtgatactaacatggtacctgttgagaagcctgcagttccaccaccaaagaaaaaaattgatctgaatgagcctagggtttgtaagaacaaaggatgtggtaaaacctacaaggagaaggataatcatgatgaagcatgcgattaccatccaggacctgcagtttttcgcgacaggattagaggggtggaaatgttgtgatattcatgtcaaggaatttgatgaatttatggagatccctccgtgcacaaagggttggcacaatgctgatgccgcatgaattttcaccatgccccatcttggaataa

SEQ ID NO: 961 - DNA, 684 bp, Oryza sativa
atgggctctaagaagcggtcgcctcagcatccggccgccgcggcgccccctcccgccgtcggcggcggcggcggcggcgaggtctccggcgatggtggcgcctcgacggcgaacgggccggtggtgccgaagccgtcggaggtggcgccgttcctgacgaaggtgtacgacatggtctcggaccccgcgaccgacaacgttatctcgtgggccgagggcggcggcagcttcgtgatctgggactcgcacgccttcgagcgcgacctccacaggcacttcaagcacagcaatttcaccagcttcatacgccagctcaacacctatcctgatagatgggagtgggccaatgaaggttttattatgggccaaaaacatcttctgaagaccattaagaggaggaagaagtcttctcaggaatcacctagcgagatacagaaggcgcctgtcaaaactgcacctggtactgaaaatattgagataggaaaatatggtggccttgaaaaggaggttgaaacccttaagagggataaagctcttctcatgcagcagcttgtagatctcaggcactaccagcaaacatctaaccttgaagtgcagaatttaattgaacggcttcaagtaatggaacagaaccagcagcagatgatggcacttctagcaatcgttgtccagaatccctagttt

SEQ ID NO: 962 - DNA, 680 bp, Oryza sativa
atggcgcgaggcaaggtgcagctccgtcgcatcgagaacccggttcaccgtcaggtcaccttctgcaagcgccgtgccggcctgctgaagaaggccagggagctctccatcctctgcgaggccgacatcggcatcatcatcttctccgcccacggcaagctctacgacctcgccaccaccggagaaccatggaggagctgatcgagaggtacaagagtgctagtggcgaacaggccaacgcctgcggcgaccagagaatgggacccaaaacaggaggcaatggtgctcaaacaagaaatcaatctactgcagaagggcctgagaggtacatctatgggaacagggcaaatgaacacatgactgttgaagagctgaatgccctagagaggtacttagagatatggatgtacaacattcgctccgcaaagagatgcagataatgatccaagagatccaagcactaaagagcaagaggaaggcatgttgaaagctgctaacgaaattctccaagaaaagagatagtagaacagaatggtctgatcgacgtaggcatgatggtagcagatcaacagaatgggcattttagtacagtcccactgttagaagagatcactaacccactgactatactgagtggctattctacttgtaggggctcggagatgggctattccttctaa

SEQ ID NO: 963 - DNA, 645 bp, Oryza sativa
gcagagttgctgcgggagaacaagcggatgctggataaatccatcagggagatcgagagggagaggcagggcctgcaggctcaggagaagaagctcatcgccgagatcaagaaggtggccaagcaaggacagatgggagccgtaaaaattatggcaaaggaccttatccgcacaagacatcagatcacaaaattctatgccctcaagtcccagctacagggtgtatctcttcgaattcagcagacattgaaatcgacacaagctatgggtgaggccatgaagggtgtcacaaaagccatgagacagatgaacaggcagatgaatctaccagctctgcagaagataatgcgggagtttgagatacaaaacgagaagatggagatagtcagtagcacaatgaatgatgccattgacgatgctttggagggcgatgaggaggaggaagaaacagaagaactggtaaaccaggtccttgacgaaattggcatcgacgtcaactcagagcttgtcggggctccttcaaccgctgttgctgcaccggttggagcaggaaaggttgccgctcaagctgaagccgctggaggtggggacggtgggatagatgacgacctacaggcccggcttgataatctgaggaagatgtga

SEQ ID NO: 964 - DNA, 639 bp, Oryza sativa
aggtcggccaaagagattgaaaccaagcatcggcttcacgctcaagaaattgctcattcactggatcttaggaaatatgatggaattgtttgcgtcagtggagatggtgtacttgtagaggtggttaatggtctgctgcaaagagaggactggaacacagcaataaaaataccattaggcatcatcccggcaggacaaggttttttagtgtcttgatgcttacttgggggtctggtagctgatatcgatattgagtcagagaagtacaggtggatgggcagtgctcgtcttgacttctatttgcggcggtacaatgggcgtgttctttttgttccagccccaggatacgaaggacttggtgatcatgagtggagatcactggatggcccatttgtttcggtttgggtcagtggtgttccttttgctagtgaaaatgtcatgacagcaccagaagcaaaggagccgggaatgcgggtgggcagcaccaccaagggcggcatcatcgactccgatggcgaggtgatcgcgagaggggatggatcacacactggcgacgagatagagcacctgatggcctatggccctcccatccaactgacggtggatcagggcttggccaccattttctcccctagatga

SEQ ID NO: 965 - DNA, 632 bp, Oryza sativa
  misc_feature (505)..(505): n = any nucleotide
atggcgatccgaatcacggtgtcctactccggctacgtggcgcagagcctcgcccctttcctgcagacctcgaagtggctcccctgctccgacgacaccaagacggccttcgcagcggtgactgtgcctctgctctacagctcgtcgctggccgagccgaggtccatcccgtccaagtccatgtacccgaccttcgatgttggtgaccggattctcgccgagaaggtctcgtacatattccgggagccggaaatcttggacattgtgatcttccgtgcaccaccagctcttcagggctacagctcgggtgatgttttcatcaagagagttgtggccaaggcaggcgactatgtcgaagttcgtgatggcaagttgattgtcaacggagtagtccaggatgaggaatttgtgttggagccctcacaatttacggagatggaacccatggttccagaaggttatgtgtttgtgctgggagacaaccgtaacaacagcttcgattccnataactggggcctcttcctgtgaggaacattattggaagatctgtgtttcggtactggcctccatcaagaataacagatacaatatacgagcctcgcgctgaatattctgtggctgggttgtcgtga

SEQ ID NO: 966 - DNA, 628 bp, Oryza sativa
ggaactttttggtgctgggagcgagacatcagctaatacacttcaatgggcgatgactgagctcataatgaatccaagagtgatgctgaaggcacaagctgagttaagtaacgtcatcaaaggaaagcaaacgatatctgaagatgacttagttgaattgaagtacttaaaacttattatcaaagagaccttaaggttacatcctgtagtgccactacttctccctagggaatgtcgggagacatgtgaggtcatgggttacgatatccccataggtactactgtgcttgttaacgtatgggcaataggtagagatcctaagtattgggaggatgctgagacattcatacctgaacgatttgaggatggccatatagacttcaaaggaacaaactttgaatttataccgtttggagctggacgaaggatgtgccctggcatggcatttgcagaagtaatcatggagctcgctctagcctcattgctttaccactttgattgggagctccctgatggcatctcgccaaccaaggtggacatgatggaggagttgggtgctacaattcgaagaaagaacgatctttaccttattcctactgtccgtgtgcctttgtcaactgtcttatag

SEQ ID NO: 967 - DNA, 622 bp, Oryza sativa
  misc_feature (423)..(423): n = any nucleotide
  misc_feature (497)..(497): n = any nucleotide
atggattcgcacgtaggcaagttattcgattcggtgggctcgatcttccgcggcagcgacaccctcccctggtgcgaccgcgacatcatcgctggttgtgagaacgaggttgcggaggctgcgaatgaagaacagaagaatgagagccttatgaggctttcgtgggcgcttgttcactccagacagcctgaggatgtgaaccgcggcattggaatgcttcaagctggcagcttctttggacaggtctaccagtccactgcagacaagggagaagctctacttactggctgttggacactacagaactggtgattatacaaggagtcggcagcttttggaaagatgcttagagcaacctgactggaggcaagctctcactttagacggtatgattggcatggctattgtcactggtgccttcgnacttgtgggacttgttgctggtggaatcatcgctgccgcttcttcttcatcctcatcatctaggaagaaattgnggaccccatttcaggtgaataagatgtcaagatgggcaagaaatcgatgtaaatatgcgcatcttgctgtcatacttgttgcaaccgtatactcacgtctccatttttcagtccttttaccatga

SEQ ID NO: 968 - DNA, 573 bp, Oryza sativa
atggccatcaagaggcatctgatggcgcgcaccacggacgtcttcatcgccaccttccccaagtccggcaccacatggctcaaggcgcttatattcatgtcatggaacattgatgtggctgtccggcaattctgcgatggcatctcgcatttcgggccgttttgggagcacgtcctcggctactggcggtggcacgtcgagatgccaagccaggtgttcttcttgacctacgaggagcttgccgctgacacgcttggcctattgagacgtttggccgagttcgttgggcacccgttcacggttgaggagcaagaggctggagtggataggaagattgtggagatctgtgccatggagagcttgtcgaggttagaggtgaatctgtcggggacaactgactttatcgagaaagacgtaccgaacaacatattcttccggcgtggagtagtcggagattggaggaactatctgacaccggagatggcaatgaaaattgatgagatcatcgagatcaagtttgaaggaactggcttgttgtttcatccacagcttttacgacaaaaaggagaatag

SEQ ID NO: 969 - DNA, 557 bp, Oryza sativa
atgcagctggagatttcgccgagacagaggagccagcagcagaaggaggaggaaggcgagcaccagcagcgcgccggcgaggaggcggtgggcgccgtcttcagcattgagccgtgggtggacgccgcggcggtgctggtgccgccgcttaacttcgccgaggtgaacgacggcatcttccgctccgggttccccgccgccgacaacttcgcgttcctcctctccctcaagctacgctcgatcgttacctgtgcccggagccgtacccggaggagaacacgcggtttctggagcagaacggcatcaagcttcaccagttcggtattgacggcagcaaggacgtaaggaatcaaccggtgctcatccactgcaagagaggcaagcaccggactggctgcgtcgttgggtgcctgagaaagttgcagaaatggtgcctaacttcagttttcgacgagtaccagcattttgcagcggcgaaggcgagaagtactgatcagagattcatggagctgtttgacacatccagcttgatgcacctgacggcctcacagtgttaa

SEQ ID NO: 970 - DNA, 543 bp, Oryza sativa
aagcgttgtgagtcgataaacacgatggtgtcatttctgtggtggataattgggttctactgggtggtgtctggcggggatgtgctcgagcaagatgctccaaggctgtattgggtttttctagcatttgatgtcttcttcgctgtgttttgcgttgctatggcctgcttcatcgggatcgcattgtgctgctgcttgccttgtgtcattgcaattctatatgcactggctggccaggtaaataagaagaactctgcatttgagaaattttcctcttctctaccttggtactaccaacattgttgatacatattgcttacttcgttctcttcgaaatatggagggtgcatcagatgcggatattggctttcttcccagatatagtgctgtatctgcctctcatcatatgaggatggagcggagctatctgccctcccttgcaaccatcacttccattggacatgtattaccaaatggctacgcatgcatgcaacctgtccactttgcaagtacaacattcttaaaggcagtgaaagtgcatga

SEQ ID NO: 971 - DNA, 535 bp, Oryza sativa
atgtctaggtctgtggagcctcttgttgtagggcgcgtgattggggaagttcttgatacctttaacccatgcatgaagatgatagtgacctataactccaacaagcttgtatttaatggtcatgagctctacccatcagcagttgtgtctaaaccaagagttgaggtccaagggggtgacctgcgatctttcttcacattggtgggttatgacagacccagatgtgccaggaccaagtgatccttatctaagggagcaccttcattgcatttacgcaggattgttactgatatacctgggacaacggatgcttcttttgcgcgaggtcataagctatgagagtccaaagccgaacattggcatccataggttcatttttgtgctcttcaagcagaagcgcaggcaaactgtaattgtgccatccttcagggaccatttcaacacccgccggttcgccgaggagaatgatcttggccttcctgtggctgctgtctacttcaatgcccagagagagactgcagccaggaggcgctga

SEQ ID NO: 972 - DNA, 513 bp, Oryza sativa
atggcggcggcgggggagtttcttgggttcgcggcggcgaggaggggggcgcacaggagttcgaccggctcgacgacgaacagctcatgtccatgttctccgacggaccccaagagagtcaagaggttttcaggattttggcaaacaggcagtcggcgcagcggtcaagggtgagaaagttgcagtacatctctgagcttgagcgcagcgtcaccactctccagctgcagatggaggtgtcagcactgtcacctcgtgtggccttccttgatcatcagcggtcgctgctcaccgtcggcaacagccatctcaagcaaagaatcgccgccctcgcacaagacaagatcttcaaagatggctcaccaggaggctctgaagaaggagattgagcggctacgccaagtgtaccaccagcagcagatcaaggccaccggaggcgccgacatcgccacggcggcctcaatgcaggccaagcatgagctgctggcgtgcgagggagcggcgatgcgatag

SEQ ID NO: 973 - DNA, 506 bp, Oryza sativa
atgcagagatatgatcttgatcctgctgcaaaagctgctgcagcaactgttttggcatctaaactgggtgctgattctggattgagagtcttcttgggagatgagtcgaatagggatgcaacattgagtaaaagtaatgatgcccaaactactggaccgaggcaaagaaaaccaggacacttgagcaacagcactggaaggacatacggccctgagtcattaggcggttcatatgcctatgatggtaatgaaggtgtcaccactccaaatcagaggactgttgaccacttcagaggtccagctggtaatgatgggggatggctcgcacgagcagctgctctgcttgtaggggaagatccaactcagtgctatgcgttaatatgtggcaactgccatatgcataatggtatggtcttgcaaggaaagaggactttgcattcattacatattactgcccgcactgtaatgccctcaatggaccacggcagcatgatgagcatgaaatg

SEQ ID NO: 974 - DNA, 485 bp, Oryza sativa
  misc_feature (168)..(168): n = any nucleotide
tgcaactcattcgtggagttggagccagccatctttactctaaaatccccagccaccatcctccctattggaccacttcgtaccgggcagcgttttgctcatcaggttgggcacttttggcaaaccaatgatgacacatgcctctctttccttgatgaacaaccctanggttctgttgtatatgtggcatttggcagtcttactatcatgagcccaggacaactaaaggaacttgcactagggctagaggcttctggtcatccatttctatgggtagttaggcctggacttgctgccacaggaacaggtgctagcgcaccctgcagttgggtgctttgtaacgcattgcgggtggaactcaacggtagagagcattcgtaatggagtgcccatgctatgttggccatatttcaccgatcagttcacaaatcaaatatacatttgtgatatttggcggattgggctaaagatggtgcaaacctgtg

SEQ ID NO: 975 - DNA, 477 bp, Oryza sativa
atgacgccgcagcggtctccggcggcggcggcggcgggggaagggggcacgccggcgctgcactacctgagcgggccgtacggggacacgacgtacaccaaggtgttcgtcggggggctcgcgtgggagacgcggagcgaggggctgagggcgcacttcgaggcgtacggggagatcctcgaggccgtcgtcatcaccgaccgcgccacggggaggtccaagggctacggattcgtgaccttccgggacccagactcggcgagaatggcgtgcatggacccgtacccggtgatcgacgggcgccgcgcaaactgtaaccttgccatcctaggccgtcctgggccagacatacctttcgaggccggtcatcccatacaatggaggtgtggcggttccagggggcatgtatgtgcaaagcccaacatatcagcaacccccctacaactatccacaggcatttgtatatccttcttatgg

SEQ ID NO: 976 - DNA, 477 bp, Oryza sativa
tggcaaggagcaccacaaagtccctcttcttacattgtcaagaagatcttgcggttggaaataccgacagatgcttaccctaatccttagttcaattttattggtcgccttcttggaccaaggggaaattcgttgaagaggattgaggcctctacaggttgtcgtgttttcataagaggaaagggctcaattaaagaccctaacaagaaggaggagcaacttaagggaagggctgggtatgaacacttggatgatcccctgcatatcttgattgaagccgagttacctgccaatgtcattgacgctagactcgcaaaagcacaagaaatcctagaagagttgttgaaaccagtggatgaatcgcaagattactacaagagacagcaactccgagaacttgctttgttgaactcaccacttagagagggtagtgcttctccattcagtaatggtggcatgaaacggatgaaacaatga

SEQ ID NO: 977 - DNA, 471 bp, Oryza sativa
atggaagggcagcagttcgcttggggaagggaggagggagggtggaggaaagggccatggacagcgcaggaagacaagctgctggttgagtacgtgaggcagcacggcgaagggaggtggaattctgtcgccaagatcacaggcaggtctgaagagaagtggcaagagctgcaggcttcgttgggtgaactacctgagacctgacctcaagcgaggcaagatcacgccacaggaggagagcgtcatactcgagcttcatgccttgtggggaaacagaggtggtcgacgatcgcgcgtagcctgcctggcaggacggacaacgagatcaagaactactggaggacgcacttcaagaagggcaagccgtccaagaacatcgagcgcgcgagggctcggttcctgaagcagcgccgcgagatgcagcagcagagccagctgatgcaaaccggccagcagcagcagctcggccaa

SEQ ID NO: 978 - DNA, 456 bp, Oryza sativa
ttggacaggattgaacaagatgatgaattgacttatgagttgctggtgctagaaactaacttgtttcttagcggccttggcctgcatgaccagcacagagatatgagaatggatattgacaacatgtcttatgaggaactattagcactagaggagcgaatcggttctgtcagcactgccctatctgatgagcagcttgtgaagtgtctcaagcgaaatgtgtataagttaccaaattcagatcttgaagcgaacagagctgtactagatgacgccaagtgcagcatatgtcagcaggaggaatacattgagggcgaagaagttggtaggatgcagtgtgagcatcaataccatgtgtcctgcattcatgaatggcttagacagaagaactggtgtccaatatgcaaaacttcagcaataccttcagagatggacaaggggggcacatgaatatag

SEQ ID NO: 979 - DNA, 453 bp, Oryza sativa
atgcaggcgtacatggtgggagagcacggggacagctcggtggcgatatggtcgagcatgagcgtggccgggatgccggtgctcaagtcgctgcgggagagccaccagagcttcgacgaggaggccctggagggaatccggcgagcggtggtggacagcgcgtacgaggtgatcagcctcaagggctacacctcctgggccatcggctactccgtcgccagcctcgccgcctccctcctccgcgaccagcaccgcatccaccccgtctccgtcctcgcctccggcttccacggcatcccccaagaccacgaggtcttcctcagcctccccgcccgcctcggccgcgccggcgtcctcggcgtcgccgagatggagctcaccgaggaggaggcccgccgcctccgccgctccgccaagacgctctgggagaactgccagctgctcgacctctaa

SEQ ID NO: 980 - DNA, 432 bp, Oryza sativa
  misc_feature (5)..(5): n = any nucleotide
  misc_feature (9)..(9): n = any nucleotide
ttggncggnggaaagcgggtgcgccccgtgcgggcggtcgccgagctcgggagcgcctcgggcaccggcggggtcgccgccgggcaggtcgccgacaaggagagcgagggcctccccgtcagcctcgccatgctggagtacatccacgtgcacaagacggcgaggctcctcgaggccgccgccgtgtccggcgccatcgtcggcgggggcgcggacgccgaggtggagagggtccggcggtacgcgcgctgcgtcgggctcctcttccaggtggtcgacgacgtgctcgacatgacgagcacatcggagcagctcgggaagacggccgggaaggacgtcgaggccgacaaggccacttacccgaagctgctcggcgtcgacaaggcccgcgagtacgccgccgacctcctcgccatggccgaggcggagctc

SEQ ID NO: 981 - DNA, 419 bp, Oryza sativa
atggcttcgccggagccggccgcgggggcggacggcgcttcggctagccagacggccgtggtggagccgatccggttgccgacgccggaggagatcaaggggcaggacatctggaacaactgcgccgtccgcagcgtcgtcagtggagtcatgggggggtggtttaggcgtgcttatggggctattctttggagctttggaaaacccaattacagcagaggagatgacagcaagacaacaaatagtataccaagctaaacagatgggtaggcgaagtataagcaatgccaaaacctttgcagtcatgggcctgattttctctgccgctgaatgtgtcatagagaaggctcgcgcaaagcatgacactaccaattcagcggtggctggctgtgtcacaggaggggctttagctgcaaaag

SEQ ID NO: 982 - DNA, 301 bp, Oryza sativa
cgcattgcggttctaggtgccagcggttatactggagctgagattgtcaggcttctagcaaaccatcctcaatttcgtatcaaagtgatgactgcagatagaaaagctggcgaacagtttggatctgtatttcctcacttaataacacaggatgcagatttttcaaatgtggatgcagttttttgttgcttgccacatggtacaacccaggattttcgattgcgtgatatcaatgagtacgctgagtggtatggccattctcatagggcaccagaacttcaggttttcctcgactacttaa

SEQ ID NO: 983 - DNA, 1659 bp, Oryza sativa
atggagagcatgaggagcttcctgacgcacctgaccgagacggagcctcccggcggtgagcacgacgagcaggtctggacgtggatgaagcaggtccgggagcttgcgcaggactgcagcaactgcatcgacacctaccggcagcacggtgacctagcggtccgccaccccagctggagccgcggtgccggcatcctccagcgctacatctactgggctccttggatggtcgagaagttgctcgcccagcactacgcggccatctggctgcgcgagctcaaggaccgtgcccacgacgtcggccagcgtcgcttgaggtacggcgtggaggtccccggcaagccatcatccaaggcggcaggaggggcaccgtcgtcggtgcggtctgaagaagcttctccgtcaaccactagtgccaccacaggagcacaggcaccagacgaggaagatgaagacgaggaggaggaggagcagcaagaccaagaatacgactcggctagtaaagtcggttggcattacgggaccatcgtcatcttcatcgccatcattaccatccatcgccattgtaccaccaccaccacccagagtagctcaaggtggtgcaacggaggagccaatgcacgcgatgctttggcttccatggagaccacccatttcgaccgctctgtgtggatcaacctccaggctttgcatctccaccgctcttggcaccaaatcagcaccgaggccatcctctgctacatcctgcgtgaatgtgaatctctcaagaagcgaggcaaagatcatggtcaggtggacgaccgggatgatcaatgggaggcttactattattacagatgggacatattgtatgatatccatagggacttttatcgacaggttaatcctaagatggaagaaatcgagggtaatattactaagaacagtgctgcagaagaagaacaagaagagaaaagtaaaggagaagctgcatatggaaaccagactgaagacgaaatcccctcaacccctgatggtagtatgtcacgccccaaactagccccgaacggcggccagaactttcagaaacaactaagtgagtgcttctcaacgacacggacgagaaagtgcgtctcatccggtcggagcagtgaaattgtaaggattgattcttgtcggtacgagaggctccctgccaatcgttcaccgacaccggctgtaccaacaaccacacgcgagaggctccctgccaatcgctcaccaactccagctgtatcaacagccacacgtcaagcacatcggcacgaaaggctccctgctaatcgttcaccaacaccggctgtaccaacagccacaagccaaacactgaacagaattctcacccaacagcagttcacaaaagggggtacactttacctacaagacgtcactaacccgggtcacccagcccgtgcagaacggccacgtctggtgattttgaggctttcacgacaaagcatttcgaaagctgactcagggtcatcttatgccaacgggaggggtcccacggacaaacaccaggaatcggtccttaaggcgagaacgggaagaccgcacctccagtacgtctcccgcaccatcttgagcttcttcttcgaaatctgcgtactgcgagtctttgggctccgaaactacacgtga

SEQ ID NO: 984 - DNA, 771 bp, Oryza sativa
atgcgccggcgatccccgccggcgtggtcgtatcggcgcatacacatcctgttcctcctgctactggccacttcgtcatcctccgcctcggccgctaacttcacctgcaccaccgtgcaggcggcgtgccagtccgccatcgggtacacgacccgcaacgccaccacctacgccgagctcctctccctcttcaacacctccaccctcgccgagctcctccgcgccaacggcctccctcccaccgctatgccgcctgacacggccatccccgccgcggccaccgtcaccgtccccttccgctgcctctgtaatgttgccaccagagtcggccggtcagactaccggcccatctaccttgttgggtcgcaggacgggctcgacgcgatcgcgcgcaaggtgttcgacggcttcgtgacgtaccaggagatcgcggacgcgagcaacatccccgatcccaataagatattcgtcgggcaggagctgtggattccgctgccctgcagctgcgaccaggtggatggccacaacgtcacgcacttcgcttacaaagtccgcgccgtggacaccacgtcggcgatcgccgccaagtttggggtcctcgagtccacgctaatgaggatcaatgggataaccgatcccaaaaacctagtccaggggcagattcttgatgtcccaatacctggtaatgatacaatggcacgaatggctcggaagcatgaaggtaattgccctctcttatttgattttgctgaatgcgcatgtgggaaataa

SEQ ID NO: 985 - DNA, 765 bp, Oryza sativa
atgtccatatataggctgcgttcgggagcacttgttcccaactccttccctcttgttttccacgcgcacgcttttcaaactgctaaacggacacccaaaaaatacggcctttgttgtgggacacccgaagatcgtgtgtttgctcgtggacactcgaaaaatgtggcccacttgtcaatctctctttctcgggctcgccggctggaacacgccgtcctcgccgagctaccgctccggcttgtactccaagcagtcctcgccccatatggcagcgagccgccccatggcatacgcgttgtacgtcacggaccagccggcatggacgagcgtgccgtcggggagcgtgtcatccgccgcgcacgcctgacgccggcggtgcatctcccggagcgcgtcgaacccgaacagctcgctcgggcacgcgccggtcgccttcctcaccacatggaccacgtcggcgatgcgtgccatgacgtccggctgggacgacaagagccagaagaaccagctcaaccccgacgacctcgtctcgcaaccagcgatgaggaagatgaggacgatgtcgcggaggacctattcgttgtgcttgtcactcgccacgaacctcgacaggacgtcgtctctatcttgcacggacgcgctctggcgccgggcacggatgatgtccatggcgaaggcgtgacgttggcgatggccttcctcagggctcccgcaggagttcgccttttaccttcgcgaggaatgcttaataggaaggtatactga

SEQ ID NO: 986 - DNA, 699 bp, Oryza sativa
atggccggccgtgcgacggcgacggcgacggcggcggggaaggacaggtccagcttcgccgtcacctgtagcctcctcagccagtttctcaaggagaagaagggcggcggcggcgggctgcaggggctcggcctcggcttgcggccggcgccggcggcgccgcccgccgcgggagctggaggtgctttccggccgccgccgaccaccatgaacttgctgtcggggctcgacgcgccggcggtggaggtggagccaaacacggcggaaacagcggccgacgagctgcctctcatcaaggccccggccgatcagcaaagcgacgaaagtgcaagtgaggcagctggagagaaggctcaacagctgaccatcttctacggtggaaaagtagtcgtctttgagaacttcccgtccaccaaggtcaaggatctcttacaaatcgtaagcacaggcgatggcgtcgacaagaacaccggcaccgcggcaacgcagagcctgccccgacccgcacacaacagtcttcccgatctgccgattgcaaggaggaactcgctccataggtttctcgagaagagaaagggcaggatgaatgcaaatgctccataccaagctaactgcaccgctgcaccgtccaagcaagctaacggtgacaaatcttggcttgggtttggccaagagatgacaataaagcaggagatatga

SEQ ID NO: 987 - DNA, 633 bp, Oryza sativa
  misc_feature (210)..(210): n = any nucleotide
  misc_feature (222)..(222): n = any nucleotide
  misc_feature (324)..(324): n = any nucleotide
  misc_feature (328)..(328): n = any nucleotide
atggtgctcactcgcagcaacgggaatggccctaacaacaacaacaacaacaacaacaatggagagaatcccacacttgcccaagtcctggctcaacaggcacagcttatgaacatgatgatgcagcaactccagaaccagcagaaccagggaaataaccatgcacctccccagaacaagttagcagaatttcttcgtgtgaggccgccnactttctctagnaccactaatcctgttgaagctggtgattggctgcatgccatagagaagaagttggatttgcttcagtgcaccgatcaggagaaggtctcatttgcatcacancagntgcatggccctgcctctgaatggtgggatcacttccgccttaacaggactactgctgaacctatcacttggcttgaattcaccgctgctttccggaagacgcatataccatcgggagtggtgtctctcaagaagaaggaattcaggtcgctcactcaggggtctcgctctgttaccgagtatctgcacgagttcaatcgtctggctcgttatgctccggaagatgtgcgcactgatgaagagcgtcaggagaagttcttggaaggacttaatgatgagctttcttacttcttggaacgcacttaa

SEQ ID NO: 988 - DNA, 588 bp, Oryza sativa
atggcgaggacggggcggcgcggggcggcgccgccgttgctgctggcggcgacaacgccgacggggttctgcgagaccaatggagtggacgttgacgcgctgcggggtctgatgcagcaatggaggaactacccgtcgagctggaactccggcgacccctgcggcggcgggtgggacggcgtcatgtgcagcaacgggagggtgacatcgctcagtggcgtggccaaacagagtggcggcaccaatggtcatggcatggcaagagctgccccatggcgatcgttgctgttgaaatcgtcaaccgggcgccaatgtggcagttttgccacgcccgcgatccgggacgccacaagcaccgatgggttctgggagttcatacggctggtgcagcagtgtgtcaatagcagccgggatgtgcgcccaaccatggtcgccgtcgagaggaggatcgaagacatcctgaactcggttgtcaggtcatccaccaccgggttcatgactgccggaggcgacacacccagcaacgagccaaatcgtgaagataacggaaacgagccaaatcccagcaacgagatcgccagggactag

SEQ ID NO: 989 - DNA, 534 bp, Oryza sativa
atgcgtacaatgctgtgccgcgatgcaacggatgcaaaaatcctgcatcgctcaataccaaaagctcaaacctcatacttccacgtcatcatcaattgtaaaccgttggatgaatgcgttagattgcttctcagccgttggatggaacgcagcatagagcccaatccatcaagcatcggtgggcctaatatgagataccggaaaaacccaccaggcccaaatacaagtaagcccacggcccagaagaaattactactgcctactcgtctcactcccaccaccggagaaggctccggcgagaaagggcggaggggagagagagtccgctccggcgccaccggcggcggcggcggcgatgtccgcccccatggattcccccaggacgatgggagaaatccgcggccgctgtttaccctccagaacccagggggtccagccgaggcttccatggaagcatctgcgacatggttttgcaaatcattttgcggcagtttggatttctccaatctgcgtgcagttttctcactcgtctga

SEQ ID NO: 990 - DNA, 522 bp, Oryza sativa
ttgtgcgatcttctcaaatcgagggttgcatcgcctgaatttcttgaaaaactcgataatattcagaagtcggtatatcaaaatggtgcagtagatgaaactatatcatgggatatcataagtgcggcagacatatgggacgacattgacaagggtatgaacattagtgatgattcagaggatggatatgttctcattaaacaagaggacatagttgatggtattgcaagcttcatggctgcatacttgctgtcgctgaaacaaactaaggacttgacacctaatcaacttcaacaagaaaaacttaactcccaccttccatttttgccagctcttagcaagaccttttcagctaagaagaggaaaagcaagcttcagaaagcatgggatggaacaaaagttatttataatatagcatcatggagtgcaactgctattggcatctaccagaatccagcaattctaaaagcagcaactgctgccttctggacttcctgccgtgtagcatccaagtttctgtga

SEQ ID NO: 991 - DNA, 517 bp, Oryza sativa
  misc_feature (444)..(444): n = any nucleotide
  misc_feature (449)..(449): n = any nucleotide
  misc_feature (452)..(452): n = any nucleotide
  misc_feature (459)..(459): n = any nucleotide
  misc_feature (468)..(468): n = any nucleotide
  misc_feature (474)..(474): n = any nucleotide
  misc_feature (480)..(480): n = any nucleotide
  misc_feature (504)..(504): n = any nucleotide
  misc_feature (507)..(507): n = any nucleotide
atggcactgcatcaaacccttctcctcctcctcttcgtctccatcgccatccaccgcgccgtcgcccagaccaccacctccaccgctgtccgcggcgacggcaaccggttcgtgacctactccttccccagcttcgccaacgcgctgctccacctgcaggccaacctcacggtgctcaacaacgccagcatcagccagggcgccctccagatcacccccgatagcagcaacagcgccgacggctacctcgtcaaccagaccggccgcgtcttcttctccacccccttcaccctctggtcgccggcggctggtggtgggggcaatggcaatggcaatggcacctatgtcgcgtcgttcaacatggtgttcagggtgaacatattccggacgaacaccagcgaccccggcgaaggcgtcgcgttcgtcgtggcgtccgggctcganccgcngcntcccggnagctacagnggcttnctcggnctcacgaacgcgtcaccgacggcnacnacgcgaaccg

SEQ ID NO: 992 - DNA, 345 bp, Oryza sativa
atgaatgcagcggtggccctgaacacgatcatgaggagatggggcaaggaggcatcatcggagtggaatgttagcggtgatctctgcagcggtttcgccgctgacaaaaacgactgggattactatcccaacatcaacccattcatcaaatgcgattgcactttcagcaacaacacactatgccgcattacaaaactgagggtaaataagttggacgtggttggtcaaataccttcagagctacagaatctcacccgtctagagaacttggacttgaactataattacttgactggtttcattccatcattcatcggaaaattcacttcgatgaaatacttgtag

SEQ ID NO: 993 - DNA, 318 bp, Oryza sativa
atggctagcgccccgaaatggcaagcgaaatgtgcaaagaaaccaggagctagcggccggcgcggggatctcacactccaaccgatcgaccgagctagcaagcaaacaactgaaaccggcatgcatgcaatgcgacgcaatgtgatgcgatgcgacgcaatcatgaaccatgcaccgccagtcgtgacttgcggcaatggcaccgaattgaatgacttcgaactaacgattcgcgttggaatttgcgtcctgtactggaacactgttggatcgatcgggttcgcgcgcctgaccactctttggtgcagcgagctgtag

SEQ ID NO: 994 - DNA, 303 bp, Oryza sativa
atgggtttgggtttcttggatgtttatgtggatgaggttgttgggttgctgggtgagatcagattaggcaggaaggacctgcctactaagctggaggctgactcatcaacgctggatgaacggattgaggatgaagagaatgaagagatggagcaagaaatgaagcacgatgagaatgatgaagaccccattgatgaacctgacctggacaaagatgatgatcttcctgagcctggcgagcactctgctgataaggatgaaagatctgaggatgtggccaatggcatcgtgccatctgactga

SEQ ID NO: 995 - DNA, 5850 bp, Oryza sativa
  misc_feature (1448)..(1448): n = any nucleotide
  misc_feature (3396)..(3396): n = any nucleotide
  misc_feature (3681)..(3681): n = any nucleotide
atggatagggcgtcgaatttcatacctggtccttatcaagaactcgtggatgccaaaccaattagatcgttagctcctatgttccctgcacccttgggaatcaatgtcaaccagtcaagcaccccgcctttggtatgtgtcactccggttggccaatttcctgtcggttttggttctggaatccttcctacctttggttcaactactgccttcactaccacagcaaatggggtttcttatacaagctacaccaataatggagctattgatgccactcctatctcggcatataagaccagaccaggcattgtatcacttgatggcgatgaaccttactcaggttcagcatctggacggaagtccaagagatcatctggttcagctgctgatggttcaaatggagttaagttcaagcgccctaagccagtttacaagaattttgttgctggcaaggagcttgcctttttaccaccttcatccagtgatcccagggaggttgtggaagcagtccacatgacctttgaagcacttaggcgtagacatctgcaactggatgaaatacaagagactagcaaacgggctgacctgaaggctggcgccatcatgatggcaagcaatatcagggctaatgtgggaaaaagggtaggacttgttcctggagttgaaataggggatattttctatttccggatggagctatgtatcatcgggttgcatgctcctagtatgggtggcattgattatatgagtgctaaatttggaagcgatgaggattctgtggcaatatgtattgttgcagcaggtggctatgagaatgtggatgatgacacagatacactggtgtacagtggttcaggtggcaatagtaggaacagtgaggagaggcatgatcaaaagcttgagagaggtaaccttgctctggagaggagcctgcataggaagaacgagatcagggttgtgcggggcttcagggatccattttgcctgactggaaaaatctacatatatgatggcctctataagattcaggagtcctggaaggagagaacaaagtctggtatcaattgcttcaagtacaaactgctgcgtgagcctggacagcctgatggagctgcattgtggaagatgactcaaggatggatagacaatccagcaagcagaggcagggttatattacctgatctatcatctgcggctgaagctctcccagtttgccttgtcaatgaggtagaccatgagaaaggacctgggcatttcacctatgccagtcaagtcaaatacttgaggcccctcagttctatgaaacccttacagggttgcggatgccagagtgtttgcctgcctggtgatcccaactgtgcttgtggacaacataacggaggtgacttaccttacagctcatcaggacttttggcgtgccgcaagccaataatttatgaatgcggtgntgcttgccattgtactacgaattgccggaacagagtgacccaaaaaggggtcagatttcactttgaggtcttccggactgcaaatcgaggctggggtcttcgctgctgggatcccattcgtgctggtgcatttatctgtgagtatactggtgaggtcattgatgagctcaaagttaatctggatgacagtgaagatgattacatttttcagactgtatgtcctggtgagaagacattaaaattcaactttggtcctgaattgattggtgaggagagtacatatgtatcagctgatgaatttgagccactgcccatcaagattagtgcaaaaaagatgggaaatgtctcacgtttcatgaaccatagttgttccccgaatgttttctggcagccagttcagcatgaccatggagatgacagccacccacatatcatgttctttgcactgaagcacattcctcccatgacagaactgacttttgactatggtgttgctggatctgagtcttcagaacttcctgcctgtacccccagattcgagctctggtattattccctgagaatgacgatgggtttcaacatgaactgtgaagagacagtcacttttctttcaaaatgcacatgtaggtcactaatgatgcacgagagcgacagcgatcctgattctgacaggacacactggtatatgagcaatagcgatgacgagtcatttgttgataaagataaagattgcagaaggagcaccgtagccctgctgttgaagaaaggtccatggacatcttgggaggactccatcttagagaagtacatcaagaagcatggtgaaaggaactggaagcttgtgcagaagaacactggcctcttgaggtgtggcaagagttgccgtcttcggtggatgaaccatctgaggcctaacctaaagaagggggctttcagcaaggaagaagagaataaaattattaatcttcatcgcaaaatggggaataagtggtctcggatggctgctgatttgccagggcgtactgataatgaaataaagaactactggaacactcgaataaagaaatgcaagaacaatcgttcgcctttgtatcctgctaatgtatgcaacgatgctttgaatgaagatcaacatgagtctgctgaccccaacgttagggagaagctgaccaataatcatctagaagatactactagtatgtattctgcaccccagttttcagatgcttccatcagtaatatacttgataggagacttgcatcaaaagattatgactccatagaagatcaaagaaaccaaatagaagttgtagcaaaatatgagattccacttcctgtgttgaaaacaacgaacaatgacatatttccatcagcctctatctttgccaaccatggtatttcaaatggcaatctctctgctttgtccacaactgatgctttgcagatggagctccctttaatccaatttgatccaaacaaccagttcgtttactcaagggcttatgcgatgcacctaacaaactttgctttattaaatgatcaatcagaagaattactaaatgatactgatgtattgaactatgtggtgatgaaagaagagctttctggagggagtttgagtcctactattaatatgccatgtgaagcacataactccatggctgcctctaatgagctggtagtgccacaatatgaaggagatgctccacctcttcaagatgatttcacatcatatttctatttgaatgatactaatctatccatattcgaagacacaaatgaattgtttttggaaaacaagttggatactaaagattcgattcgattccatttcgataccattccatggccgccgccgccgccgccgcgggtggcccgcggccgcgatgagccccgacgcggccggggcgggcccaccgtcgtcggagctcgcccgcgtcggcagccntcggggggaaggctcgtggccgccgacgaggcccgcgcgtgcctcgcccgccgcctccacgccgcgctccaggttagggaggagtcgcggcggcagggcgcggcgctggacgagatgcgggcgcgggtggagctccggcgggcgcgggtgggggagttgctggtcgccaggagggacgcggcccggggcgtcgaccgccgcagggagcagctccaggcgcagatcgaccgcgtgctgcgcctctccggcgccgtcgccgccgcgagccggcggctgcaggatgcnaaagaagcgttgtctggagagaaggcgcggcttggggatttgcagaggctgttaaggatgaggcagcagagtatgattggccaggttgctgcattgtaccctgtgaaggtattccatgatctgccgcatgggcgaaacctcaattccaatactaatggagcacataggtctctttcggaagaaaatggaacacttccagaagagaatggaacacatctactcaatgttatcaaactaccacaaatacatgctttgacatttttgggttggcaaattggtaagcaaagaagaaaacaaaatgatatatgtgagaaggatcttcagcggtccgcagctgttctgggatatgcagcgcatgcaattttgctcatagcctcctatcttcatgttcccctccgataccctttgcactttggaggatcgcgatcttatgtgagtgattgtttgccttcagctgaaacagcatccattgcttcagcagagcgtacatgtatcaacatgaccgacccaaaactgacagtttacccccttttcgtggaatgtcaagaagatgaccccactaaggcatcctatgcaatctacttgttgcacaagatttgtgctgtcaagttgatagaggacaaggccatgggtgtcgaggcagatcatggtacgccatgtataaggacgatcttgaggtgttcaatcaggatgagctacagatatgcttctgaaaactgggttctcctcttcccggtcctgctgctctacctgctattcagatcttcgccgggtttcttcgctttccttctgtcccactctcctgtaatcatatgtgccgctcttatccttggtgtgctgataagccatggcagcacaaacgttgctgagatcaaggaagaacggaaatctgtcgccgaggtttcggatcccaagtatgcagatttgtccaggaatatccatttggaagcaaacaagggattttcggcaaaagagaacacggcgagcttaaatgacggtgaaatcaaagatggcttgaattcttccagagaagatgctatcgaagttgttgagatggtgggcaagataagtcatgatagaggatcaacagattcacagagtgatgagatgaaagtagattcagaagataaaccggctggtacctgtaaatggggccgtgccttttctgttcgtcgcaggaagaagctttctgatattaaggtagagcctatcaatgctgctgtggacagtccattagactcatctttggattcaccatttggtagagttggctgccatgatggttcaccaggttttgatcatgatcagacagagggtaccactcctggtactcctagaacacgcattgcttctgtcctggacgagattgaccctctttccagtgctgattccccccatcctgatcccatccaaaatgatgactcggacaaccacatgtcccttcaggattctagaactgtgagagataataattatgaatctgacaagagcaaggccaacaaaaacgatgacaagaatgtcagcactgatcctgcatttcttggaaccgtagatgatgataagaatgtcatggatcttgggtactctgaggtggaaaggcatcgtaggttagagatcttgatggttaagagaagatcaaggaagaacatagtatttgatcctgacagtaacttagacatcgataatgataaggtttgcaagagaaacccatctgatattctttcttgttctgatgagacagaatttcctggctcagctccatccgttctgcatacatggaggaatccgtttgatcatccttttgagcaatcagatgaaagtgatctacatgaacatgtcgcaataccccaccaggacatgttcttcacaaggcatgaaagcttcagcattggcagccaggggagacgtccctcaagatttaagccaccttttatcatcgaagcaatggacattgatgagccaagtgcaagtgatttccagagacaattcagtgacaaaagtgcgtctacattgagtacagttactgaatctgatatcatttcttcagttgctgatcaagaggacataagtaacaacataaaaaatgactctagtagagagtatgaatcaccagagctacctacaatacctacaatgggaagtgatattatatgtgttggaggcacatga

SEQ ID NO: 996 - DNA, 2833 bp, Oryza sativa
ctggtctctcctcatgcttcaaatccgcaccagtggcggggtggacaagctcgggctcctacttctcaatcgaatgggccacctacaccccaataaggtggtggttgtctcgccgccacttccactctcactcggcgccgacatcgtctcggccgtcatcgtcatcgtgggcgccgcgtccatcccggacacgcctaacagcttcacgctgcgtgggaggctcaacgaggcccgcgacttgctgtggcgcatccgcagggccggggcggccaccgccgacgtcgacgccgagctcaaggatatcgtccgcgttgccgaggaggaccggaggtacgagtcgggcgcgttgtggcggcttcttcgttgcaagtaccggccacacctggtgatggccgtgctaatcatgccggcgacaagggtgctgatcggtgccagcgtcaccgtggccttcttgctcctgctcgccttcttcttcatcatcttgccgcgcggcggcacaccgccggaggtggtatcgtcgtccaaggagggcgggatccgggggcgtcgcgatggcggcggcgtattccaggttgagagctatggggagaggtgcgagcacgtcgccgaggaggatggccatgatcgccggcgattcccgcgtggctacgtcgactacctgtacctgttcgactgcgtgttcggtgtggagcggcgggttcttggctacggcgtgatggcggcttggctcgccgtgctgttctacctgctcgaaattaaaaagctcaagattgcacatcagcgcacacggcatcatcgccgacgaaccaccaagatcccgacgcgagccagcttcctcttctctcgtcgccatcgtcccgctcccgttcccactccctccccgccgccgactgcctccagtcgggactatccaagaagagccgcggctgagcggggacgaggagcctcgccctcctcatcggtgctgaacgggcgcgagtggacggagcggcagccggacatgtcccccgacgccgatgcagttgatggagatgtgccgccgactgcgctgcgccccgatgccgccagccgccgccgctcaccccgtcctcccgccgctgctggcaatgaagaaagagagaacgtaggagaggactcactgacagatgtgcccaggccggactttgagaacatcatgggcgagtacggtcgtaccgatgaacacttgaccctccgtatggccgttgatgttaccgagaaccaccaccctcctctcgacaccgccaaagtcaaaaagcaaagcgtcacgtcacgtagcgcagagcggctgcaactcaatgccagcgctgacgtagccgtaggtcgccgggcgacgcgcccactaagatatcgagcagttccggagcctgctcagggggctgggtgcggccgctccggcgatcgccggagaagaagggtggttggaatctggttcgatccggcccgatttggcggagggattcgaacgcggcgtattgggataggaagccgcgccggtggatttgttcgagcagatttggctgctgggggtttgtgtgatgggagatcaggcggcggcggatgcggcggcgagatggtgaccgggagctttagcaggagcacgtcggcgcggctcacagcgaggggcggcgtcgggagcccgcgggtgtcggcggcggcggccgcgcaccgcaagtggtggtggtgggcgccctcggggccgtcgttcgagtgcgctgccttggccttcttcctttcctccgtcgcgctcgtgctcgcctgcgcgctgtatctgtatctcttccggaggtaccctttgtacaatagctccgattgcccgtttgtggagaggggattcaattgcctggcaaatgggaggaaggacaccggctacctgaaatggcggtggaagccaaggggatgcgacttgccgcggttcagtgccagggatgtgttggaacggctgagggggaagagggttgtgtttgtgggggactccatgagccggacacagtgggaatctttcatctgcatgctcatggcaggggtggagaatcccaagactgtttatgaggttaatggcaatcagatctcaaagactatccggtttttaggagtgagatttgcgtcattcaacctgaatgtagagttcttccggtcggtgtttcttgtacaacagagccctgcacctcgcagtagcccaaaaagggtccgagcaattctcaagcttgataagatggataatatcagccggaaatgggagaatgctgatgtgcttattttcaactcagggcattggtggactcccagcaaattatttgatatgggctgctattttgaggctggaggtttgcttaaactaggtacatccattaattctgctttcaaaatggcacttgaaacatgggcttcatgggtgaaggaaaaggtggatttaaaacgaacacatgtctttttccgcacgtatgagccatctcattggagtggttcaaatcaaaaggtatgtgaagtaacagaatttcctacagctgaggccaaaggagatgacagaagtgaatttggagatatactcgctggggttgtggtgaacatgagcgttcctgcaactatcttgaatgtgactttgatgggggccttcagaagtgatgctcatatcgtgctccttatacacgcctccggggttacagattttgtatcattgtctattttgcgttttagacagaacatcacaatcggcaacctggaaccagtaggctacgtggaagaggatgtgaaaaaaccacccatctctattcgacggccgcgacatcatcctgtggggagcgagctgtggtga

SEQ ID NO: 997 - DNA, 2805 bp, Oryza sativa
atggggatccgtactgtccgggcgattcgagctgaggatctaattgtagcaagtgctggggatgataaaaagatctcattatggcacaaaaaaggtcaaaatgtaggacagctaccaacatcaactgttgatcgtggggatgacatagaggagtgcatatattctatcagttttagcaacaagggttcacgatatctttgctctggtgggagtggccacatcgttaggatatgggatttgcagcggaagaggtgcatcaaatggttaagtggtcacactgacaccattacgggtgtgatgtataattgcaaagatgaacatttggcttcaatcagcatgaagggggatcttattctccataatcttgcttctggagcacgtgctgctgaacttagtgacccaaatgggcaggttttgagagtccttgactattcacgtaatagtaggcatatattggtgacagcaggagatgatggttctgtgcatctctgggatacaactgcaagaactccaaaggtctcatggctgaagcaacattctgcacccataagtggtgtctgtatttcgccctccagtgataagataattgctacagttggcctggacaagaagttgtacacactcgattcagggtcaagacgaccaacacacactattcctcacgaggcccctttctcatcattggcatacaatgatgatggtacaatattggctgcaggcacaaatagtggtcgtgtggtattttatgatgttcgaggaaaacctcagccattgactattcttcgtgcatacaatagctcagaggctgtgacaggtttatgttggcaaaggtcaaagcctgtcattgttaacgagaatagttcttctgaggttgctcttctgggtgggagtagtgaagaatctgttctcatgccagatcccttgccttcagcaacttcagcttttcattctggaggtgtcatcccaaatcttcggtcttctttggctgcaaacccaagtggatttctttctacctctacctcgtccactgtggaggaaactccatacaggacacggccattgtctggtggaccattatcaaagctacaggctcctcgtagtaacttcagtctaaaggatgatatggatgtattctctccacttgtagatgttcaacctttcacaccgtccagtggcagcctgtgggatgaccatgggagtgatgaaacaaaaaaggatgataaacttggagagaagaaattgtcgacaactagaaaattcccgtttattgaagacaataatgagccacatccaatctcagactggaagtcaatttccaattcaagacaggatgatgcctcatcagcaaccactacatccatgccatcatggaagagtgaactatctatcacttcacctgagacagcaactggaaatgcattatccgataggttaactcaccgccaacaagtctcgcgctttggggcttcagcctttcagactggcagctttgcatttgcaggcttacaagattcagctccaacaactggtaactcactgaaaggttctctaacaagtaatattttaatgaacctacaaaacaagggtgtcttgagcaatgcacgcccttccctggacatatcaacttctagcctccagagttcactgtcctcaggcttaatggccaagactatgccaccagtaaactccgaccagcctggagcagcacaatctagttctcaatggagaccctcaacatatactgatagagtgagcacatcgtctgttttcagtgaaggattagcatcagcctttggttcaccaaaatcaaagaagactggggcagaaacaaaagatgaactgctcagcagtcttctatcaagacaagaagcagcagctgcctcttcatctgccaaccttgtagcaaacaatggggtggtgccaccacaattgccaacatcaggtttgtcagctgatcaacagggagcttcatccttctcacttcagtatgtgcagcggatgcttgaagaatccctagggtctgttcagaagtccatccatgaggacgctttagccgattgtacttccctcatgaactgcgactttgcgtttgttagtagaaggcgatgtgtggagtttggatttaatattacaggcgcagccatgttcaacaggctctttggtaagcccaaggagcaggccaatgctagtgcgttggccacgcttgataagttaaatgagacccttgacatgctggagaagaaggagaaagtcttagagaaaaaggcagccgcagaactggagagggctaaggagttctcaaaagcaaagaataaaagagcggctatccaatccttgaagagaaaaaagctttatgaacaacaaattgagcagctagggaacttccagttgagaattcatgatcagatgatcatgttagaagctgcaaaagctacgacagaaaccgttgatgctttgaggactggagctgcagctatgaaagcaatgcaaaaggcgacaaatattgatgacgttgataagactatggatgaaattaatgaacagactgaaaacatgaaacaaatacaagatgctttgtcagcccctcttggagcatctgctgattttgatgaggacgaactagaggcagaactggaagaactggagggagcagaattggaatctcagcttctcgagcctgttgcagctccacctgtgcatccagtgcaggtcccaggcaccaggataccaactcgccctgctccacagaaagcatcagctgaggaggatgagcttgcagccttgcaagctgaaatggcattgtga

SEQ ID NO: 998 - DNA, 2733 bp, Oryza sativa
  misc_feature (1743)..(1743): n = any nucleotide
  misc_feature (1860)..(1860): n = any nucleotide
atggcatgcaatgaatcgatcgagagccgcatcatcctcaccgaccaatccaatttaaggttggttagcctagctttggatgagcagaagggcagcgtgatcctgtgcacaaccaagaaccaaccccaacacatggaagctgcggcaggggcaggaggagccattggaggtagtggtcgcgaggcggcggcggaggaggaggacggcggcgagcagtggctagaggaggaggcggaggcggaggcggtgtactgcgccgtggggaaggaggcggtgaaggaatggaaggcgaacctcatgtgggtgctcgccgccttcccctggaggaggaggaggagccgcatcgtcctcatccacgtccaccgcccgccttcccgggtcaatatgatgggggcatgggtcccagtaagtcagcttgcagaggaggaggtgaatgcatacaggcagctggaggaggagaggatcagcaaagtcttagatgatctcttggacatttgcaaaagtcaaaaggtcaatgcgagcaagatcatcttctcctgcgacgacatcgcgagaggcctcctccagctcgtcgatgatcatgggatcactgatcttgtcatgggagcagcatctgacaaggcctattcaaggaaaatgcgggcgccgagatctaagaaagctcggaaggtgcaactgaaggcgagcccctcttgcaagatctggtttgtctgcaaaggaaaccttatctgcactagggaggtgaacgaaggactcaatagaacaggatcatcgacaactagcacaactccgaggtcgagcacttctgattactcgaggtcgagatcctcgccacgagtgcacagcctaagcagcgagcaattcggtatgcaggatccagccgaaccgacgacatcatcagttgatcagactcctatcagggaggacaatgccatggaccgtggcactgagggttttaatcatgaagcagttgctgttgctagttcatcaacagtcccagtgtctgaaaatgtagaggctgtacagagatcagctgctgctgttgtgcagtctctgcaagaaattgaagaggactcaccaactccttcagggcatggttcggaggatgctggtgatgtgagcgatgcgtacgacaagttcaaggatgctgtgatagaagccgagaacctcaggcatgaggcatacgaggagactcgccggcgtcaaaaggtcgagcgcgacctcgccgacgcgacaagaattgcgaacgaagcggagagctcgcagcagagggaggcgaggcatcggaaggaggtggaggagaggctggcgagggagcgcgcggccatggagcaggacaggcgagagctcgacgacatactcgagcagacacgcgaggtggacgcccgcgccgccgagctcgagctccagatcacgagctccgagcggatgatgagagacctcgaggccaagctgtcggaatcgtacgacctcctccaccagctccggcgagagcgccggcgcgacgatgtgccggcggaagcaatggcgggaagcgaggctggtgaccagagactgaccttcttgcggctcggcttgccggagctggaggaggcgaccaaccatttcgacgaatctgtcaggatcggaggcggcgacggcagccgtggcagcgtgtacaggggcgacctgcgcagcatggcggtcgccgtcaagatgatcggccgtgacgtcgccgtcgacgaggtcggtttctgccgcgangtggaagccgtcggcagggcgaggcacccgaacctcgtcacgctcgtgggcgcgtgcccggaggcccgcgccgtggtgcacgagttcgtgccgggcgggagcttggaggaccgcctngccggcgccgcgccggcgctgccgtggcacgagctgtgcggcgtggcgcaccgggcatgctccgcgctggcgttcctccactcgacgcagccacgggcgacggtgcacggcgacgtccggccggcgaacatcctcctgggcgaggagtgctgctcgagcaagcttgccggcctcggcatgtgcaggctggtgcggagctccggcggcgtggcgctgtcaaggccggcggtgggctacgtggacccgcggcacctggcgacgggggagatgaccccggaacgcgacgtgtacgcgctgggcgtggtcctcctccggctcgtcaccgggaagccgccgttgatggcgaagcaggaggcgcgggaggccgcgggcggcagcaaggcgtggcacgaggtgttcgacgcgagctctggaggctggccgttggaggtcgccagggaggtggcgctcgtcgggctgaaatgctgcgacgtggaggaggagccagcgggagctcgccgtcccggcgaacttctggaggaggcatgcggcgtgctggaggcggcgatgagcgcggcgccggggaggtcgtggtcgtcggtgtcgtcgtcgtcggacggcggtgagggcggggcgccgtcctacttcgtgtgcccgatcttgaaggaggtgatgcgggacccgcagatcgccggagacgggttctcgtacgaggcggaggcgatcagggagtggctgcgcagcgggcgcgacacgtcgccgatgacgaacctgaagctgccccgccgcgagctcgtccccaaccatcccctccgcgacgccatccaccactggcgcctccgccgcgccatgcgaaccaactttactactggattagatagctactactactag

SEQ ID NO: 999 - DNA, 2189 bp, Oryza sativa
  misc_feature (248)..(248): n = any nucleotide
  misc_feature (271)..(271): n = any nucleotide
  misc_feature (279)..(279): n = any nucleotide
  misc_feature (308)..(308): n = any nucleotide
  misc_feature (1478)..(1478): n = any nucleotide
gtcgtccggcgaagggccgcaagaaggcggcggagaatcccggcggccgccgccggaagggcagcgcggccagcacggcggcgaggctcatggagaagatcatgcccagcgcggcggcgatgaagcccagggccaagaagaaggaccagtacctgctcaagcgccgcgacgacgcgcgcgccccgccgccgccgtccatgccggacgccttcccggcggcgcccatggcccccgctctcgacgacgtnccgccggggtttcccttccgatnccccggangccgcggtcggcgacggcggcgcgcccanggacgcggccacggccgccgcggcgccgaagaaggcgaccaagccgaagaaggcaccgcccgcaaacgcgaacccgaggaacccgctgacgccgccgccgctgccgccgcaggcggcgttgccggcgagcctaagaagaagaaaaagaagaagctcgccgagctcaacggcgtggcggtcgccgccgccggcaagccggggttattgcctgctaaggtagaccatgatctgaagcaggtaatatccgagcttcaaagccttcctctcgttgcctcctatgtcgccggccgccgcagcatctctgacgaagctcgctccttcctcctcgccttccgctccaagtctttcaagaagagccatgagaacgatccacccgaggacaacaaggcctctaagcccaatgccgccaccgccgccgacggccagaagccgccggcgaagaagaagccggccgcgaggcccggcgacaccaccgccgcctccgccaaggttgccggcgtcaagcgcgccccgtctgatcgccaggaggagcttgccaccaagaagaaagccaagctcaacaagatcaagacgctcgccactgacaagaaggccgccggtctggagctcgccgccgcggcgcctgcggcggcgaggaagaatgatgcgatcgctgccaggaagaaggagaaggagccggctctggctccggcgatcaagacgccatcgccgacggcgctgatgatgaagttcccgccgaagaccacgctgccatcggtggcctccctcaaggcgaggttcgcgcggttcgggccgctcgacgtcgacggcatccgcgtctactggaagtcccacatgtgccgcgtcatctacaggttcaagtccgacgccgacgtcgcgctcaagtacgcgcgcgccaacaccaccatgttcggccaggtcgcgcccaactactacctccgcggcgtcgagtcggacggcgacctcgccgccgacgctgcacctccgcctccgcagcagcgctccgagcttcgcctcatggagacggccccgttcaggcccgggacctccggcggcaactgcgcgccgctgccgctgtccagggccgtgccggcgcgcgcggtggttgggcagcagcccaagtcgatcctcaagaagacggtcaccgacgacggcgcgccgtcggcggcngcgctccgtgatgccccgcgggtgaagttcatgctcgacgccggggacagcaagctcgagccgccgccacctgcagcgccggcgaacggcggcggagacgccgccgcgccgctcgccaagagcgccaccaagtcggtcgggttcgcgcaacggcttttccagccgccggcgcgcccggcacagcacccccacctgcagccgccggcgcgtccagcgcagcagcctcctcgcccgccggtgacccagccactccctccgccgccgcctctccatcagcaccagccataccaacctcgccacaccgacgcgctgccgctgccgctgccgctgccgccgccaccgccgccgccattctccgtgcagcagcagcagctccctccaccgccaccataccacctccgccacagcatcgacggaatgcaccaccagctccccggaccaccgctgccgccgtcgtaccagcatcgcgccgccggcggcgtcgtcttccccggacagcatcagcagcagccataccgccccaacaacgacacccagctcggcctccccggcgccggcgccgccgccggtgacgtcacgccggcgtggaagagaggagggagagagttcgacgaggagttgatgagggtgatgcggggaatcgccaagatggtggagccattgacggacaagaacggcaacttcccctaccacctcttcacctcagcttga

SEQ ID NO: 1000 - DNA, 1893 bp, Oryza sativa
  misc_feature (1854)..(1854): n = any nucleotide
atgggcaccggcggcggcagggtcgccctcgacggcggcggccggcgccggaggaagctggacgaagaggatgatgaggagtatgtggcggacgacgacgaggaggaagacgaagacgaagacgaggaggagtaccaacaggccgccgccccctccgacgacggcgaggaggggggcgacgacgaagcggagccggaggacgaatctgatgcggatttcgtcggggacgaggaggaggaggaggaggacctcgaagacgaagatgatttggaggaggtcaaggcgccgcgccccaagcgcccgcccaaggggaagccgccgccgagatctcgccgtcggaggcaaaaggacgacgacgatgactacgaagaggaggaggaggaggacgccgacttcgatccggacgtggacgaagacgacgaggaagaggtagatgaagatgaagaggaatttgagcaagatgacgacgattccgatgattttgccccgattcgcgtcagaaagaccagcaccaagaaccacgtggccaagcggaagccaccacccggccgtaagaagaagaagaggaaaccttctagggtttctaaggcaaagcctaagaagcccacctcagggcgccgccggaggaagcgatgggccaccgatgacgacgaggaagaagaggacgatgcggatttcatcgtggaggacgatcaggaagaagaggaggacgaccaccgcccaaagaagaaggccaaggctgctaggaagaccagggatgtcacgccggagccggatgtcgaggcaagcgcatggccggccgtcgaatcagacacttcagaattcgaattcgtgacatctgatgaagaagctgctgacaaggaagcaccagccgctgaaccagcaaaaaccaaggggaagaagggcaggaagaggtggggatctgggtcagagtcatcatctgattctgattatgtcatatcagagcaggaactgaaggatctggaagtctccatgcctccagatgcagctctgcaatcacctgcaaccctgccgcgccggacctttctttcaaggagggtgggggagaaggggaaagagcctgaagaggcttggaaacagacatgtgggatatgcctctcggaagaacagagagccacgatacagggtgtgcttaattgctgcgcacattacttctgcttcgcttgcatcatggagtggtcaaaggtggagtccaggtgcccattgtgcaaacgccgattcacaacaattaccaagtcatcaatggcagatctagggcttggatcaaggaaagctgtcattagggtagaaaaacgtgatcaggtgtatcagcccacagaagaggaaatgagacgttggttggatccgtatgaaaatgttgtatgcatagagtgcaatcgtggatggaagaccaagtaccagaaggaaactgggtactgcggaggatgtagatccggtggggagggcccctctgcacaggatacggtggttcactgcagagaaagtaataccaaccctgccaacagtagttctggatcatttggctcagccacaccaagtggagtgttccagagaccaccaccaatcaacacccaaccttctctacaaggattcgatctaaatctctcaccaagagaaacccctgatgaagataagcgagaagagtcacatgtttcagctgatgctgtttcgactcctactggaaggcatgccactctcgataggaggcgggcctttaaccgacgaattcgcatccttctatttagaccaagggtcacacctaatgggtggcagaatccgattcagtctgacaggacaataccagagaatgaacaaaatccacagagcacgtcnactccaactgaagtgaaccccatcatgttccagggatag

SEQ ID NO: 1001 - DNA, 1872 bp, Oryza sativa
atggaggactggatgccaccacccacacccagcccgagaacactcatgtcaagcttcttgaatgaagattttgtctctggttcattttccaatattttcagtgatcatgagagcaacaaaccccaggatcagtttgagagaaacagagagcttgtggatttgagtaaggaagtgccttcccaattcgcaagacccgcattccagagggatgcttccctggatcatagcttggtcagtcctacacagagatcaaactcgcatggtggtttggcagagcgcagggctgcgagggctggtttcagtgtcccgaaaatcgatacatcccgtggtggttcatccacagtaattcgatcgcccgtggcaattccaccaggtcttagtccaacaacacttctcgagtcaccggttttcctttacaacgcaatggcacagccttctccaaccactggcacactgccatttttgatggcttcaaatgctaagtcaacaataccgtcagctaccaagatggacgaagattgcacatttggcaatgacactttctccttccaaccgcatgtagggtcgagacggccaaatttctccgctgcagaaaagggtcccaatgcttgtcaccaaaaccaatcgctgtcgaatatccatcagcgggaatccagtcttcagtcaagctttactgcagtcaaagatatcactgatgaaaaaaacattaaaacaaagacatctgactccatgtttggtgataaccactcttctgatgaacaagatgatgagactaaccaaaatggagaaaactctatgccacctccgaaccaccgttcaggtgtccctctgtcacataccaatgatccagaagtgaatgtcctagagaaccgcggttcacagacatgccataactctgcatccttgtgggacaatgccaaaaatgattgccttcaagatgttcaaagtgaagttattgaaacaagaacagctgcttgtcttccagtatcaaccaattgtgatacatctatcatggagtcccaagatgcagttgatgtgtcgtcaacactatctaatgaggaggatgatagggcaacgcatggcacggcttctatagagtgcaacggggatggagatgagactgattccaagagaaggaagctggatgctttgacagctgcaactgctgctattaccaccaccagtaacattgacatgggagctgcggcatcgagaggtgtccgggagcctcgtgttgttgttcagacaacaagtgaggttgacatccttgatgacggttaccgctggcgcaagtatggacagaaggttgttaaaggaaatccaaacccaaggagctattacaaatgtacgcaccaagggtgttcggtgcgcaagcacgtggagagagcatcgcatgatctaaaatccgtcatcacgacgtacgaggggaagcacaaccatgaagttccagctgccagaaatagtggacatgggagctctggatctggaaacgctccatctgcaccgcaatctaacggctctcagcgcaggcaagaacaagggcaagccagcttcagccagtttggtggcgcggctcccttcagctccttcgttctcccaccaagaaaccaatttggaccatcggcgagcaatttcccctttgggatggtcccgccaggcatggcgattcccatgccatctctagggtctcttgctccagcaaagatggctggtcatccatccaccatgcagggctaccaggggctcatgattccggaaggagagatgaagacagagcccatgtcgcagctcggcttccccgcggtaaaccaatcttcatcatccttccaacagatgatgaacaggcctccatcatttggacctcagatgtaa

SEQ ID NO: 1002 - DNA, 1689 bp, Oryza sativa
atggccgcggacgatgccgcgcggagcagcagaaggatggatctgaacctctacctcggcctcccccgcgccccgcgcctgcgccgccccgatctcggctccgacctcgcgctcggcaccccgatgctctcctcctcgccttcctcctcggcggcctcggccgacgcgccgccgctggagacggagccgctccacccgccgtactcaccgccccccgccgagcttgtgcgccccccgacacctctgcccgagccgtacgacccgtcggctcccgaggcgcacccgccctacgtgccgcctcccgtgccgcccccggaggcgatacctgagctcgctgacgaccttgagttcggcttctcccacccgccgcttctgctgcggcccagcgagctgcttgggtgggtagaccggccatcgtcgtcgacggcctcctcttccttccgcccggagcgtgtcgaccgctaccgtccccccgtgatctgcctgaatagccgccagagtcgctgcctccgtccaagacggttcaggtcggaccttccgcctctcggctcggaggcccctgccctggagaacgacgctgcagcacaaccgccaccgcaagagcctatgcaagatacggttgaagagaacaaggtggtcgccgatggcgctatcgtgggtgcctcagaggaggagccagccgaacgtggcaagagcgttgcgatgtttgagtgcaacatctgcttcgagatggcttccgagcctgtggtaacttcgtgtggacatctcttctgctggccttgtttgtaccaatggctgcatgtccactcaactcacaaggagtgccctgtctgcaaaggcgaggtcactgaagggaacatcactccaatttacgggagagggaattcgacttcggacgcggaaaagaaggttgcggaggagggaaatgtatcaggccctacaatcccaccaaggccacatggcaatcggctcgagagcttccggcagaaattccaccatttgcgcccgatttctagaaggcttggcgaggcacatgggatattgtcttcttggaggcgcatacttgatcagcagattatgaatagtgtgagtaggtttgaggggcctcctgaatcaactgtccaggaaatgattgatcatgctcatcatgctagccgtttaggtcgaattactactagaatgagggcaaggaggttgcagagggaagccgaaaactctacatttgttgcttcttctgctgcggagagtgggctgccagcaaacagcacatcggatctgcctaggcgtagctcaagtccattttcctcggaaagaattgatttattgcaacactttgttgaccttgcaagcacggaaagattggcaagcgctgtgagtgaccttagaagaatggttaggccgagcccttatggagcatcaacttcatcaaatccaccaaatccaccaaataccgagctgctgccagttgatgggaatcatgttgccgttgcactagctgcagatcaagcttccaattcaagcaccatggctgtaattcaggaggatgctgcttttactgaaagcacaggggaaccaagtaatgcagggtcttcgagatccctgaggaggagaggaagaaatgatgccttaggttctttggatgtggatggtgtgggactacaccggaacaagagaaggcggctgaactga

SEQ ID NO: 1003 - DNA, 1461 bp, Oryza sativa
  misc_feature (468)..(468): n = any nucleotide
  misc_feature (474)..(474): n = any nucleotide
  misc_feature (660)..(660): n = any nucleotide
  misc_feature (686)..(686): n = any nucleotide
  misc_feature (691)..(691): n = any nucleotide
  misc_feature (696)..(696): n = any nucleotide
  misc_feature (1252)..(1252): n = any nucleotide
  misc_feature (1254)..(1254): n = any nucleotide
  misc_feature (1291)..(1291): n = any nucleotide
  misc_feature (1358)..(1358): n = any nucleotide
atggcgccctccttccggctctcttctgcacccgagtcggccgacgaagcaacagctcataataaggagatatacgaccaactccgacgagtcgcagagacctttccgtcggctcccagcctcatcggcctcccgtgcagtcgccacccggacgggtggtacacgttcacgaatggggttgtgagctccatggtgatcaaggagcacctgacggcgcgcgccaccgacatcttcctcaccaccttccccaagtccagcaccacttggctcaaggcgcttctgtactcgactctccaccgcggaactgacgagctggtggcgcacagcccgcaccagctcgtccctttcctcgagtcccaggtgttcgccaatgaccggatccctgacctgagctccttaccttcgccgcggttgtttatgacgcacatcccatcccagtcactgccagactccgtcgctgcatccggntgtaangtggtgtacctttgtcgggaccccaaggactgcttcgtctcgctctggcacttttggaacaggttcatgccgtgggacatcgacgaggcgcaccggcaattctgcgatggcgtctcgcagtttgggccgttctgggagcatatcctcggctactggaggtggcacgtcgagaagccgaaccaggtnctcttcttgacctacgaggagctcgncgccnacacnctcggccagttgagacgccttgccgagtttgtcggatgtccattcacgacggaggagcagaagcacggggtggataggaatatcgtggaggcctgcgcattggagaacatgtccggattagaggtgaatcggtcgggaacgatcaccatagtcgatagcactgtcccaaacaacacgttcttccggcgtggcgtggtcggagattggagaaaccacctgacgccagagatggcaaggaggattgatgagattacaaagagcaagtttaaagggactacacacacttcatggcttcctcctcaactgccgaagcggccgacggaacgtctcacatggaaatctatgaccaactccggcaagtcgtggagaccttcccggcggcagtcagcggtcatcggccaaccatactgtcgccaccctgacggatggtacatgtccaggcggggggttgtgagcgccatggccatcaagaggcatctgatggcgcgcaccacggacgtcttcatcgccaccttccccaagtccggcaccacatggctcaaggcgcttatattcntntcatggaacattgatgtggctgtccggcaattctgcnatggcatctcgcatttcgggccgttttgggagcacgtcctcggctactggcggtggcacgtcgagangccaagccaggtgttcttcttgacctacgaggagcttgcagctgacacgcttggcctattgagacgtttggccgagtttgttgggcacccgtttcacggttga

SEQ ID NO: 1004 - DNA, 1146 bp, Oryza sativa
atggcgtaccgccggaagccgcagcctccgcagacgccgccgtccttggaccaccaccaccaccaccacaccccctccggttcttcgggttatgaatacacatccatgaagaacttgaatgaggctaagtacggattttggggggcccttgctcggaaagccaagtcttttctggacgaggatggttcaccagggcagtatgattccccggcgaggcagcagccgtcaagagatgcgccgccggttggtgtccagagattagcagcacagtctaaacttttgacttttgctaatgatgttaacacttattctgtcatcatgtatacacgctcacaacaaccaccgtctgaaacatggaaatccgagacacctccatctcataagaggtccgaggccatagcttcctccctcaactatattggtggcacaataaaaagtgcacttgaagaaggccggacgattgtagaaaataaaacagccgacattattcatgaaacacgcaaattgaacataagaagaaaaggagctggctcaactacacaaggagaagctccacaaagatttactcaaaggaatcttccacaaaatccacttgactacgaaactcaattgaaggcatctcgcgacgttgcaaatgccatggcagcaaaagcaaagctgctattacgtgagctgaagactgtgaaggccgatttagcttttgcaaaggaacgttgcgctcagcttgaagatgaaaataagattttgcgggaaagtcacgataagggtgataaccctgaagatgatgatctgatccgcctccaactagagacactattagctgagaaggcacggctcgcacatgagaattcggtgtacgctcgagagaatagattcctacgagaaattgttgagtaccaccaacttactatgcaggatgttatatatgtggatgaaggcattgaagaggtcactgaggtctaccctacacaagtattaccacctgcaccttctcgggctggttcaggccttggtcgctctgtaaccccagctactcccaagactgccagctcatcaccttcatcaacatccattgttgtaccagaaacttgtccggtcgttccagcctccccaaagtcgctttctcggacttcatctaagcaatag

SEQ ID NO: 1005 - DNA, 1146 bp, Oryza sativa
atggatgacaacgtggaaaactatatcaatttcctatcagatgattgcttgatttgtatatttaacaagcttgaaagtgaatcggacaggaatgcttttggcttaacttgtaagaattggtttaaggttcgaaacattgcccggaaatcaataattttccattgttcttttaaccctaaagtatataaggagcacgccaattgcctttcaaagttattggcccgctcaccttatcttaacttggtctccctcgctgggcttacagaactacctgacacggctttaaatcagctgagaatttccggagcatcattgcagcccctttctttctactgctgctctggtattacggatgatggtttagaggtggtctcaatcggatgccctaatttggtgagtcttgaactctaccgctgctttaatattacagatcatggtttggaaaatctttgcaagggctgccatgctttgaagagtcttaacctgggttactgtgtagccatttcagatcaagggattgctgcaatctttaggaattgcccgaatatttccacaattatcatagcatattgcagaggtttatccggtgttggattcagaggttgtccaggtacactttctcatctagaagctgagtcgtgcatgctttctccagatggtttgttggatgtagtgagtggtggtggactggagtatctaaatttgtacaatttgaaaagcccaactggacttgatggcctggacagagttggttatgcgagaagtcttcggtttttaaacctcaggatgtgccgttaccttaccgatgattctgtgacggcaatagctagcgggtgtccattgattgaggaatggagcctcgctgtctgccatggagttcgcttgcctggatggtctgcgattggattgctctgcaacaagctgagaatcttgcatgttaaccgttgccgaaacatttgtgaccaaggtttgcaggctctaggggatggctgtgtatgccttcaagttctgcatatccatggatgtggcaagatcactaataatggtctggcatcatttagcattgctaggcccaatgtgaaacaaagggctgatgaagtcatgtgcattggcccctccattgaggatttattccgattgcaatga

SEQ ID NO: 1006 - DNA, 1125 bp, Oryza sativa
  misc_feature (678)..(678): n = any nucleotide
atgtctaagagctacattactgctttatcaaatgatgatgataataatgacactcctatcataaatgaaaatcctactgtttgtctaaactttttaccaggaaacagatgcttctttgatgcttcttggaaggacaatctaacaggttttggcctctttcttcataatccaattaatcatcaagctatctttgtgcaggggaaatcaagtctctacaaatcaccaatgcaagcagaacttgcagccttcaaacttgctctcttcatctgtgatttccttaaaattgcaaatcctctttttctttcagacaatcaagagctaacactgttacttcaaaatactgattacatcaatcagaattgccactggagccttttacctcttcttgcacttttaaaaatttttgcagaagtcattcttcatttcgccgttaaacttgtgaaggagaagaacctaggcgaaattgtgaacgtgatttcccacgatattttgggggattggccattaatttatgggccttccactgtatttggttcgcggaccgaccgacagctcgctaatgattccggcgtgatgttgctgcgccgcctggccgcgtccgccctccgccgtggcggcgccaacggcggcgtcctggccgccgtccgcgccgagatcgcgcatgagctctcctcctcnaccccctcctctcccccgtcgctccaatcccaggacattcccgacttcgccaccgtgtcggacccgccgcgcgggcaggaagtgctcctgcgccgccgggatgcttccgaggaggtcctcgtgtcggcggtgctcgagccgctgcggttcgaaggggaggagcccctgcccagggacgcgctcatgaaggtgttcgtcagtaagcctgatgtgaagccggtgatgcggttcgactgccgcgcgtttgcagatgaaggtgatggcggctctgctgactatgatgttactaatgcttgttatcacccgtttgctggcgacgctggggaagacaagtatgaagggcctgagttcagtgggctcataaacttggagttcctccaagaaatctggaaaaacaagcactttcatggcattttggtggagctctgtaattctagtgaccggtag

SEQ ID NO: 1007 - DNA, 1113 bp, Oryza sativa
atggcgtcgaggagcatatcaagctgcacaactgagacggcaaaaggcatccacaggttcgagatcttcagttacagcatgatgaacaccgaagccgaagacgactccatccggtccggcgtcttcaacgtaggaggattcgattgggcgttgctttactaccctgacggcatcgacgacgacagcaagggctacatcggcgtctacctcgagctgatcagcaagaacggcgagccatgggcactcgtcgacgtgaatctgatcaaccagctgcaacccgggcaacctcgtcagctgttcaccaagaccgatgtgcctaccccgttcagatcttcaagctttcaggagtctaccttggggtctctcaagtgcatgaagaggagcgatattgagagcactccagggttcatcgtcaatgactgcatcgtgatcgaatgcaatgttactgtcatctatgagccaaaagtgtctaaaaccagggcattgtgtgacgctgaaactagttcggcattgcgcgagatcgaggtgcctcctatggagatatcgtcggatttcgccaagatgttgaaggacggtgtaggagcagatgtgacattcagagttggagaagacacattccgtgcccacagggcggtgctagctgcgaggtctccagtatttcatgctcagctctgtggaccgatgaaggagaagaaggagacacaaatgcaggagataaccatccaagacatgcagccatctgtcttcgaggctttcctctatttcatctacaccgattgtgttccaagaatggatgatcttggcaatggtgagaagatgcatttgatgatgcatttgcttaaggccggtgaccggtatggattggagaggctcaggatcatgtgcgagagatttctagctacgaacctcgacacggagcatgtatctgcgatactgggtctagctgacttgctagatctcaagaagctcaaggaagcttgcatggagttcatggtcccatctgagagaatggatgccgtggctgcaagtcaagggtaccagcagctgaagagagcatttccctctctggcgtttgaagtgtgggagaggaggagccgtgttcgcaggaattaa

SEQ ID NO: 1008 - DNA, 1062 bp, Oryza sativa
atggctcaccgccggatcgcgctcgccgtcctcgtgacgctgctcttgtcggcgttccgcccttgcctggcgcaacagagcaacgacgacacgagcaaacaccaccggagcgccacggccggcgggttcacgccgaccaccgtcgtcgtgctcgtggctctcatcaccgccttcgtcctcctcaccgtgttctccgtcctcatcaaccgctgcgcccaggcgcgcgctcccccgcgccgggcgttccgcagcacggcgtcccatcagcccgtcggcggcgccgccgccgcgtcccgcgcctcgcgtggcctcgacaaggaggtcgtggaggcgttccccacggcggtctacggcgacgtgaaggcgcgcatggcggcgaagtcggggccgctcgagtgcgccgtgtgcctcgccgagttcgcggacagcgacgagctacgggtgctcccggcgtgctgtcacgtgttccacccggactgcatcgacccctggctcgccgccgccgtcacgtgcccgctctgccgcgccaacctcacggcgccaccggtgtcgctcgccgccgccgagagctccgacctgacggcgccggaggaggcggtgcaggaggaagagtcggaggagctcgacgaggcgtccctgatggccaccttcacgccggaatccgtcatcgacttcggcgcgacgcacgaccatgaattcgacagagcagggtaccctcactaccggaggacgcagtcggccatggacgccgcgccggaccggcacacgctgaggctaccggagcacgtcatgaaggagctcgccgccgaccgcaggcaccggcgcgccgcgagcctcgccgggtacccggacagcgtggagaggacgccgaggtggctgacgtcgctctggcgatcggtgtcgtggcagaggcagagccgggcggactgggacgccggagaggagcacggcggcagcaaaagggttcacccggtcgccggagctcaggacgagacacccagcgggtccggctccgatgggagcaaggagaactccgattctgacgcgttaaaccgagtttga

SEQ ID NO: 1009 - DNA, 1047 bp, Oryza sativa
atgtacgaccacaacacgcagaggcctaggggctttggattcatcacctatgactcagaagatgcggtggacaaggcactgcacaagaacttccatgagctgaatggtaagatggttgaggtcaagagagctgttccaaaggagcaatcacctggacctgctgcacgttcacctgcgggagggcagaactatgctatgagcagggtccatagcttcttgaatggtttcaaccagggttataacccaaaccctattggaggttatggcatgagggttgatggaaggtatggtctgcttacaggcgcacggaatggattctcttcatttggccctggttatggaatgggcatgaattctgaatctgggatgaatgcgaattttggcgccaattctagttttgtcaataactccaatgggcggcagataggttcattctacaatggtagttcaaacagattaggtagtcctattggttatgttggtcttaatgatgattcaggatcactattgagttcaatgtcaaggaatgtttggggtaatgaaaatctgaactacccaaacaaccccacaaacatgagttcttttgcaccatctggaactggaggtcaaatgggtattaccagtgacggtattaattggggagggcctactcctggccatggaatgggcaacatttcaagccttgggctggctaaccttggccgtggagctggagacagttttggcttgccttctggcagctatggaaggagcaatgcaactggtaccattggtgaacccttctctgcaccacccaatgcatatgaagtgaacaatgcagatacatatggcagcagctccatttatggagactcaacttggaggttcacgtcatctgagattgatatgcctccttttggtaatgaccttggaaatgttgatccagatatcaaatcaaacataccagcaagttacatgggcaactatactgttaataataatcagacaagcagagcctcctcgaccgccatcgtgcccccaatctccttgactaccgccgcgacatga

SEQ ID NO: 1010 - DNA, 1023 bp, Oryza sativa
  misc_feature (497)..(497): n = any nucleotide
atggcgtctgagctgaacagcagaatagtcaagctaactgttggggactttggaacaggagcaacatgcgagagaactgcaataccttctcgtcggcgatgggcgaggagggacaaggcagccgggacgagggacggcggggtgaggctgatgctgccggagagccgcgagcccgcgacggacgaagctgatgcggggcgaggagcacgccggcggacggagatgaacgccggggacgatggccgccggcggttcatcaagagaattgaagaccttgttgttgtgtcgtttccaaatattccacatgacggcaaggaggatagagcgccagactcgtggagtggcgggttgtctgggtggagggatgtcccagacaccttcaagctgcggcagggaggcgatctgttgttcgtccaggccaaagttgaggtgggggtcggaatgccacacgcgcgcgcgcgcgccgggccgggccgtgggcgaggcgaggcgaggcntggctggctggcggcgtgcgcgggtgatcaggtttttggggagtgcctcctgcacgactgctcatcgccatgtctggagttgctgccgccgctattggcggaggtggtgcgccgccgccgacaggagctgcgccgccgccgacgccgacaggagctggatccggagctggtgcgccaggaggaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttttgacgccggcagtgagctgtatgtcatggagcagttctatgactacaagatggtcgatgaccgttctgtagtagaacaagctcatgagattcagatgctggctaaggaacttgagaacaacaactgtgagttgctggacaagtttgtggcgggtggcattattgccaaactaccaccttcttggtcggactttgtgtaa

SEQ ID NO: 1011 - DNA, 1020 bp, Oryza sativa
atgaagttcggtgcaatatatgaagagtatcttcgggaacagcaagacaaatacctaacaaagtgctcacatgtggagtacaaacgtctcaaaaaggtactgaagaaatgtcgagttggtcgctcattgcaagaagactgccccaatggtgaccagcaggaggggaacaacgaatctccagatatttgcaaatgcaattcatgcacattgtgtgatcaaatgttctttacagaacttactaaggaggcttcagaaatagctggctgtttcagctctagagtacaacgtctcctaaatcttcatgtcccttcaggatttctacgctatatttggcgtgtaaggcaatgtttcatagatgatcaacaaatcatggttcaagaaggcagaatgttacttaattatgtaaccatgaatgctatcgctatccgtaaaattctgaagaagtatgacaaaatacatggttctgtcagtggtagagatttcaagagcaagatgcaaactgatcatattgaactgttgcagtccccttggctgatagaactgggtgctttccatctaaactgcaatagttcagatattgatgaaactgtggggttccttaagaatgagttcttcaagaatttttcctgtgatttgaccgaagcacgaccactaatgactatggctatttctgaaactatgaagtatgagtacagcctaacttgtccaatttgcttggatactttgttcaacccatatgcacttagctgtggccatctcttttgcaaaggctgtgcttgtggagctgcttctgtgtacatctttcaaggtgttaagtctgcacctcctgaggcgaagtgtcctgtatgccgatcggatggtgtctttgctcatgctgtgcatatgactgaacttgacttgctcatcaaaacaaggagcaaggattactggagacagagactgcgagaagagcggaatgagatggttaagcaatccaaagaatactgggactctcaggctatgctgtcaatgggaatttga

SEQ ID NO: 1012 - DNA, 948 bp, Oryza sativa
  misc_feature (444)..(444): n = any nucleotide
  misc_feature (691)..(691): n = any nucleotide
atggccaagctgatcctcgccaccttcgccgtcgtgttcctggcgctcgccgccacctccctcgcaggcgaccccgacatgctccaggacgtctgcgtcgccgattacaagtccctccgaggcccgctgcggctgaacgggatcccgtgcaagaggctggagaacgtgacggcgaacgacttcttcttcgacgggctgacgaacgccgggaacacgacgaacgcggtggggtcgctggtgacggcggcgagcgtggagaggctgccggggctgaacacgatgggggtgtccatggcgcggatcgactacgcgccgtgggggctcagcccgccgcacacccacccgcgcgccaccgagatcatgttcgtcgccgagggcaccctcgacgtcggcttcgtcaccaccgccaacaagctcttcacccgcaccgtcagcaagggggangtgttcgtcttcccgcgcggcctcgtccacttccagaggaacagcggcaacacgtcggcgctcgccatcgccgccttcaacagccagctccccgggacgcagtccatcgccgacacgctcttcggcgccgcgccgccgctgccgtcggacacgctggccagggcgttccagaaaaatgcttgtacgttgcaacaggccagtgcaagaacagggaatgccaagagtgaggtcttgatggctttcggangggttaatgactgcaaggatgacccaaaagcaaccgacaattatggatactatgacagaggaggcaagaggaacaaagttggcgaaaggcttgtaggcaggattctgtcgggaagaggcctggacacaaggaagattgtgaaggcaatgaaagcaaggaggtgtaagataaacaccacttttgtgacactggatgtgaaaccactgcagcaaccacgactatcagggacaacaatattgccaaatgctggggagtaa

SEQ ID NO: 1013 - DNA, 873 bp, Oryza sativa
atggagagcgactgccagttcttggtggcgccgccgcagccgcacatgtactacgacacggcggcggcggcggtggacgaggcgcagttcttgcggcagatggtggccgcggcggatcaccacgcggccgccgctgggagaggaggcggcgacggcgacggcggcggcggcggcggcggtggcggggagaggaagcggcggttcacggaggagcaggtgcggtcgctggagacgacgttccacgcgcggcgggccaagctggagccgcgggagaaggcggagctggcgcgggagctcgggctgcagccgcgccaggtggccatctggttccagaacaagcgcgcccggtggcgctccaagcagatcgagcacgactacgccgcgctccgcgcccagtacgacgccctccaagcccgcgtcgagtcgctcaggcaggagaagctcgccctcgcagaccaggttcgtgcgccattgccgaccaatcatcagctatacctgctgcatacgtgcacgcatggtgacaatgcgcgctttgccttcttgcaggtggatgagctgagggggaagctgaacgagcggcaagaccagagcggcagctgcgacggcggcggcgccgaaggggacgacgacgacaagaggaatagcgtgatgaacgcgagcagcagcggcctcgtggaggaggactacgtgagctgcctcgcggtgccggtggtggacgtctcggaggacggctcggcggcgtgcggcgggtcgtcgtacgagtacgaccatcacctagactacttgggcggcggccagctgcccgatccgttctgcggcatgccggatctgtgggagatatggccaatggtggaatggaacgcagtagcatga

SEQ ID NO: 1014 - DNA, 843 bp, Oryza sativa
atggcgctgaccaacttcatcctgacggtggtgggcgtgggcacggcggtgctgctgctgcggagcgacgtgaagcagtcggcgtccatcttccgccgcaacgtccgccacatccgcaagtggctcgaggaggagtccgccgccgccgccaagatgcaactccggaggcgaggcgtccaattaatccgttcatctcccgcgacgcgatgcttctcgtcggcaaaacttcctctctccggcgccgctcgccgcctccgactcaccggcacgaccgcgcggctccacatggacgccggcgaccagtcgccgaaggaggtgtactccgtgtgggcgctcccgcccgagcccgtccgcgcgcggctccgcggcgtcatggccggcctccgcgccgcgcacggcgggccggcgttcgagccgcacgccaccgtcgtcggggccatccgcctccgccgatccgccgccgtagaggcgctccgcgccgccgccgccggcgtccggccctacaccgcccgtgtggtcggcgtcgcccgcggtgacttcttctaccagtgcatctacctcctcctcgagcccacccccgaggtggtggaagcgagcgatcattgctgtggccactttgggtacgagagatcaaccccatatatgccacacgtcagcctcttatatggagacctgacagatgaggagaaggaggtagcaaggaagaaggtagaggagatagacaaggagatttgtggattgcagtttgagatctccgagcttgcgctgtataggacggataccgaggacaaaagcttggagtcatgggaattggtggagatctgccaccttgagaggaagtga

SEQ ID NO: 1015 - DNA, 756 bp, Oryza sativa
atggcgggcgacggcgaggcgatcccggaggcgtggaaggagcttgttcgctccctgggaaccgagcagctcgtcggcgccatctacgtcgccctcgacgacttcaacgcgcgggagcgcgacacgatcccgcccgagctatggcggcggctcggcgaccgcagcgccgcctacaggaaccctttcgtgagcgatggaggatcgagctccggctccggctccggcgaggttgagaggatcaaggtcaagctcgtggccgtgggcggggaagacggcagcggcggcggcggcggcggcacgagcgccgactcgtcggaggatgccgtggtcgacttgctacgcgacctgcaggccgtgccgatgacgttcgagacgctggaggcgagcaagatcagcaagaccatcagcggcctgaggaagcactcgtcgtcggagaagaaggcaaacacggcggcggctggccacgtcaagacgccagcggcggcgccgaagacggcggcgtgcagcaagcgcaaggaggcgcccgcgccgccggagatggacgaggcgaagctggaggcggcgaggaagaagctgagggagcgttacacagaggaagagacggcgaagaggcagaggaagatacagatcatcaacaacgcgccggggaaggcgaagcagcgccccgccgtcgtcgagcagcggcggcgcgtggtccgggacacggtggtcgccgtggcgagccgtgctcctgtgcgttcctctctccggatgtag

SEQ ID NO: 1016 - DNA, 753 bp, Oryza sativa
atggagccatcatcacaacctcagccggcaattggtgttgttgctggtggatcacaagtgtaccctgcataccggcctgcagcaacagtgcctacagctcctgctgtcattcctgccggttcacagccagcaccgtcgttccctgccaaccctgatcaactgagtgctcagcaccagctcgtctatcagcaagcccagcaatttcaccagcagcttcagcagcagcaacagcgtcaactccagcagttttgggctgaacgtctggtcgatattgaacaaactactgacttcaagaaccacagcttgccacttgctaggataaagaagatcatgaaggcagatgaggacgttcgcatgatctccgcagaggctcctgtgatctttgcgaaagcatgtgagatattcatactggagctgaccctgagatcatggatgcacacggaggagaacaagcgccgtaccttgcagaagaatgacatagcagctgccatcaccaggacggatatgtacgatttcttggtagatatagttcccagggatgacttgaaggaggagggagttgggctccctagggctggattgccgcccttgggtgtccctgctgactcatatccgtatggctactatgtgccacagcagcaggtcccaggtgcaggaatagcgtatggtggtcagcaaggtcatccggggtatctgtggcaggatcctcaggaacagcaggaagagcctcctgcagagcagcaaagtgattaa

SEQ ID NO: 1017 - DNA, 630 bp, Oryza sativa
atgttgctcaagctcttgctcgccgtcgtcccgctcgccgtcatcgccggcgtgctcgtgtacgtcgccggcgtcccgtgggccatctccatcgtcgtcctcgtcgtcgtcttcgtcgtcgtgcacagggcgcgccgtggcaggtcaccggcggcgggaggaggaggaggaatggtccgggatgatcaagaaccgacggtggcgcggccggcggcgccgagcgccgtcgtcgttgtggtggcgccgccgctgccaccgccgctcccgatccaccgtgtgccggcagcagcggtgcagccctccgcgccgccggtcgtcgccgacgacgtggcgctcttggcgtacgcgtacgagaagaagaagaagaagaggagagggagcgacggcgacagcggcggcggcgacgacggcgacggcggcggcgaggagtgctcggtgtgcctcggcgagatgaggcaaggggaggcggcgaagcggctgccggtgtgcctgcacgtgttccacgaggagtgcatcgacatgtggctcggatcgcacgccacgtgcccgatatgccgctctccggtggacgccggcgccgtggcggcgcgggtgcaggtgcaagtgcaagtgcaagtgctatcatgttag

SEQ ID NO: 1018 - DNA, 615 bp, Oryza sativa
atgtctgggatggacggcagcggtgtgccagaaaccgccggagtggaggcagcctccagctcagatgcccgcggggacaaccgacacatgccgtctgaggactgtgtcgccggcatcaactcggctctccaacatccgacggtgcggttcctgagggagcaaatggagaaggccggttgcccagtgctaccgcggatgatcagggcgatgaactgcatgtctaccaatcacaatggttcctacggtagcgggctggggataactgtgtgctgtgatcacatgcggtctcaagatgagataaatcagctattaattcatgaattaatacatgcctatgatgactgtgttgtcaagaacatggattggaagaactgtgctcaccatgcttgctctgagattcgagctaatcaccttagtggtgactgccattataaacgtgaattgttgcgtggcttcatgaagataagggggcacgagcaagaatgtgttaaaaggcgggctctcatgtctgtcaagaacaacccgtactgctcagggacagctgcaaaagatgcagttgagtctgtgtgggatatatgctacaatgatacacgcccatttgatagggttccatga

SEQ ID NO: 1019 - DNA, 493 bp, Oryza sativa
ctctcgtcgtgtgaagtggaatgaagacaacctgtatgagattgaatcaaataaacctgttaggcagaagataactgagcctaagacaccatatcaccctatggtagatgatgatgggtcattgtcaccaacgcgtccttttgacaagtgtctggatgagactgttaatgctgaagctattttaactgctttaaatggtgtggcttcttcaagcaaaactgatccaaaggatgatggttgggcatcctcagatgatgatgcagatgccatggaacaagatgatgatccagaagctgaaaagtcaagactgagtttcaaggaacatcgtcgtgctcactatgatgaattcctcaaggtgaaggagctgatgcgctccggatcgctgattgacgatgaggctgatgaggatgatagaggtgcaaaaggcagccaagccaaagctgtaggaaagaagccagcaggctgtgacagcacacccccaccgcaaacatga

SEQ ID NO: 1020 - DNA, 1636 bp, Oryza sativa
atgtggacattaacaaactctatcttaacatctagtcgatcactactttacttcactataaaaggaccaacatatatcaccatttctcacaaaagcattgagttcagtcccacaaaaacatggcaaccatcaaattccctatagttttctccgtcgtttgcttgttcctcttgtgtaatggttcgttagcccaacttcttagccaaagtactagtcaatggcaaagttctcgccgtggaagtccaagagagtgcagatttgatcggttgcaagcatttgagccgattcgcactgtaaggtcccaagctggtacaactgagttttttgatgtctctaatgagttgtttcaatgtactggagtatttgttgtccgtcgagttatcgaacctagaggtcttctgttacctcactactccaatggagcaactttggtatatgtcatccaagaggcagaggtataacaggaccaactttcccaggatgtcctgagacctatcaacaacagtttcagcaatccgagcaagaccaacaattggaaggccaaagccaaagccataaatttagagatgaacatcaaaagatccaccgttttcaacagggggatgtagttgcattgcctgctggtgttgctcattggtgctacaatgatggtgatgcaccaattgttgccatatatgtcactgatatatacaatagtgctaaccaacttgatcctagacacaggggatttctttttagctggcaacaataagataggtcaacaattgtatagatatgaggcaagggacaattcgaagaacgtctttggtggatttagtgttgaactacttagcgaggctcttggcataagcagtggagtagcaagacaactccagtgccaaaatgaccaaagaggagaaatagttcgtgttgagcatgggctttccttgctccaaccatatgcatcgttgcaagagcaacaacaagaacaggtgcaatcgagagactatggccaaacacaatatcaacaaaaacaacttcaaggtagttgctctaatggtttggatgagaccttttgtaccatgagggtaaggcaaaatatcgacaacccaaacctcgcagatacatacaaccccagagcaggaaggatcacatatctaaatggccaaaagttccccattcttaatcttgtacagatgagtgccgttaaagtaaatttatatcagcagaacgcactcctttcacctttttggaacatcaacgctcatagtgtcgtgtatattactcaaggtcgtgcccgagttcaagtcgtcaacaacaatggaaagacagtgttcgatggagagctccgtcgtgggcagcttctaattataccacaacaccatgtagtcattaaaaaggcacaaagggaaggatgctcatatattgcattgaaaaccaaccctgactccatggttagccacatggcaggaaagaattccatcttccgcgcacttcctgacgatgttgtagcaaatgcatatcgtatctcaagagaagaagctaggaggctcaagcacaacaggggagatgagttaggtgtgttcactcctagtcatgcctacaagagctaccaagacatatctgtgagtgcataaccaagaaatgtcaatcatag

SEQ ID NO: 1021 - DNA, 1042 bp, Oryza sativa
atgaagatcattttcttctttgctctccttgctattgctgcatgcagcgcctctacgcagtttgatgctgttactcatgtttacaggcaatatcagctgcagccgcatctcatgctgcagcaacagatgcttagcccatgcggtgagttcgtaaggcagcagtgcagcacagtggaaatccccttcttccaatcacccgtgtttcagctgagaaactgccaagtcatgcagcagcagtgctgccaacagctcaggatgatcgcgcaacagtctcactgccaggccgttagcagtgttcaggtgattgtgcagcagctacagctacaacagtttactggcatcaacttcgatcagactcaagctctagcccaagctatgttggccctaaacttgccgttaatatgcagtatctacccaagctacaacactgctccctgtagcattcgcacggtcggtgaatgaagatcattttcttctttgctctccttgctattgctgcatgcagtgcctctgcgcagtttgatgctgttactcaagtttacaggcaatatcagctgcagccgcatctcatgctgcagcaacagatgcttagcccatgcggtgagttcgtaaggcagcagtgcagcacagtggcaacccccttcttccaatcacccgtgtttcaactgagaaactgccaagtcatgcagcagcagtgctgccaacagctcaggatgatcgcacaacagtctcactgccaggccattagcagtgttcaggctattgtgcagcagctacggctacaacagtttgctagcgtctacttcgatcagagtcaagctcaagcccaagctatgttggccctaaacatgccgtcaatatgcggtatctacccaagctacaacactgctccctgtagcattcccaccgtcggtggtatctggtattgaattgtagcagtatagtagtacaggagagaaaaataaagtcatgcatcatcgtgtgtgacaagttgaaacatcggggtgatacaaatctgaataaaaatgtcatgcaagtttaa

SEQ ID NO: 1022 - DNA, 1489 bp, Oryza sativa
atggcaactattgcattctctcgattttctatatgcttttgtgtccttctcctttgccatggttctatggctcagatatttagtctaggcataaatccatggcaaaatcctcgacaagggggttctagggagtgtaggtttgataggctccaagcgtttgagccgcttaggaaagtgaggcatgaagctggggttacagagtactttgatgagaagaatgagcagttccagtgcaccggtacattagtaattcgtcgcattattgagcctcagggccttcttttacctcgatactccaacactcctggcctagtatatatcatccaagggattgacctttcctggttgcccagcaacttaccaaaagcaatttaggcattttggtcttgaaggaggaagccaaaggcaaggaaaaaaattaagagatgaaaaccaaaagatccaccaatttaggcaaggagatgttgttgcacttccttctggtataccacactggttctataatgagggtgacacccctgttgttgctttgtttgtttttgatgtaaacaacaatgctaatcaactcgaaccaagacaaaaggagttcttgttagctggtaacaatatagagcaacaagtgtccaacccctcaatcaacaaacattctgggcaaaacatattcaatggattcaacactaagctattaagtgaggccttaggcgttaacatagaggtgaccagaaggctacaaagtcaaaatgaccgaagaggagatatcattcgagtaaagaatggccttcgattgataaaaccaactatcacacaacaacaggaacaaacacaagatcaataccaacaaattcaatatcatagagagcaacgatcaacaagcaaatacaatggcttggatgagaacttctgtgcaattagggcaaggttaaacatagaaaaccctaatcatgctgatacttacaaccctcgtgctggaaggattacaaatctcaatagccagaagttctccattcttaaccttgtccaaatgagtgctacaagagtaaatctataccagcagaatgctattctctcaccattctggaatattaatgctcacagtttggtgtatacaattcaagggcgtgctcgagttcaggttgttagcaaccatggaaaggctgtatttaatggtgttcttcgtccagggcaattactaattataccacaaaattatgtggttatgaagaaagcagagcttgaaggatttcaatttatcgcgtttaagacaaacccaaatgccatggtaaaccacatcgcggggaagaactcagttctccgtgcaatgcctgtggatgtgatagctaatgcatatcgcatctcaaggcaggaagctcgtagcttgaagaataataggggagaagagattggtgctttcactcctagatatcaacaacaaaaaatccaccaagagtactcaaatccaaacgaaagtgagactcaagaggtgatttaa

SEQ ID NO: 1023 - DNA, 1213 bp, Oryza sativa
atggcggcgatgatggcggtgacgacgatggtgacgaggaacaacgccgtcggcggcggcgcggtggcggtggtggacaggaaggggtgttggagttccctcgccggacggctgcgccgccgctgttcgccagcgtcgggctcagcttgccgtctgcggcgaagggccgggacaactgcgacgtcgcgcggcagctcgccgccgcggaggccgaggaggcggcggggaagaagaggcagggcaggaagatgaagggcggcggcgggctgctgtcgctgaggaaggtgagggtgaagatcgggaacccgcaccttcgccggctggtgagcggcgccatcgccggcgccgtgtcgcgcaccttcgtggcgccgctggagaccatccgcacccacctcatggtcggcagctgcggcgccggctccatggccgaggtcttccgctggatcatgcgcaccgagggctggaccggcctcttccgcggcaacgccgtcaacgtcctccgcgtcgcccccagcaaggccatcgagagcatttcacctacgacacggccaagaagtacctcaccccggaggacggcgagcctgccaagatccccatccccgtccccctcgtcgccggcgccctcgccggtgtcgcctccaccctctgcacctaccccatggagctcgtcaagacccgcctcaccatcgagagaaggacgtgtacgacaacgtgctgcacgcgttcgtgaagatcgtgcgggaaggcgggccgggggagctgtaccgcggcctggcgccgaacctgatcggcgtggtgccctaagcggccacaaacttctacgcctacgagaagctgccgccgtctgtaccgccgcgccacggggcgcgccgacgtcggcccggccgcgacgctgctcatcgggtcggcggcgggcgccatcgccagcacggccaccttcccgctcgaggtcgcccgcaagcagatgcaggtcggcgccgtcggcggccggcaggtgtaccgccacgtgctccacgccatgtactgcatcctccgcggcgagggcgccgcgggcctctaccgcggcctcggccccagctgcatcaagctcatgcccgccgccggcatctccttcatgtgctacgaggcgctcaagaaggtactcgtcgaggaggaggcggcgccggagctggaggcggagtgcgcggaggagatcaaggagaaggttgcgtga

SEQ ID NO: 1024 - DNA, 1187 bp, Oryza sativa
  misc_feature (242)..(243): n = any nucleotide
  misc_feature (266)..(266): n = any nucleotide
  misc_feature (420)..(420): n = any nucleotide
  misc_feature (423)..(423): n = any nucleotide
atgggtgtgaagtggaaaggtggtggcgcgctcctcctgctcgccgccgggctgctctggtggccgtggcggcggcggcggcggaggaggagggtcggcgggaccgaaggaggagctccggtggtgcaagaagcagtgccggtgggaggccgggcaggaccagcggcagctgagggagtgcgaggagcagtgtctccagcggcagcaggaggacgacgacgacgacgagaacacgcacggcnncggcggcaaggagtgccgccgcnagtgccgtggctaccgcgacgagccgtggcggaagcaggagtgcatgaggcagtgcgagtggcgccgccacgagcagcaccaccagggcggcggccatggcggatccaggccggactgccgtgagcagtgcgagcaccagcaggactggtgganaancagcgctgcctcatggactgccgccaccggcgacaggaggtcgacgccgacgacgacaaccaccatggcagagacccctgctacaagcagtgccgccaccaccacgaccagtggaagaagcaacaatgcatggaggagtgcagataccaccagcgccaacaagacgccgccgtcgacgtcgacgaggaagacgacaaccacggcggcgatcgctgccgcaagcagtgccagcaccaccatgaccagtggaagaagcagcagtgcatccaagattgcaggtaccatcaccgccaagaagacgacgtcgtcgaggaagaagacggccatggcgatcagcaatgccgcaagcagtgccaacaccaccatgaccaatggaagaagcaacaatgcatgcaagactgcaggcagtggcggcgccaggaggaggaagaggccgccgtcgacgaggaagaagaccacaactacggcggcgagagagagcaacactgccgcaagcgatgccagcaccaccacgaccaatggaagaggcagcaatgcatgcaggactgcaggtacaggcgccaggaggaagacgacgtcgtcgacgatgacaaccaccacggcggcggcggcggccatggcggcgaccactgccggaggcaatgccagcaccaccgcgagtggcacgagaggcagcggtgcatgcgagactgccacgagcgccgccatggatgggccacggtggccgccgaagccatcctccaggcagtgtaattaaaggtaac

SEQ ID NO: 1025 - DNA, 518 bp, Oryza sativa
  misc_feature (272)..(272): n = any nucleotide
aagatttttcacaaactaagcaaaatatggcttccaacaaggtagtgttctcggtattgctcctcgtcgttctctccgtgctcgcggcggcgatggcgaccatggcggaccaccaccaagtctacagccccggtgagcaatgtcggccaggaataagctatccgacatactcactcccgcaatgtcgaacattggtgaggcgccaatgcgttggccctggcgcggccagcgccgcggacgagcaagtctggcaagactgctgccggcagctngccgccgtcgacgacggctggtgcaggtgcggggcgctcgatcacatgctgtcaggcatctacagggagctcggcgcaaccgaggccgggcaccccatggccgaggtgttccccggctgccggagaggggacttggagcgcgcggcggcgagcctcccggcgttctgcaacgtggacatccccaatgggcctggtggtgtctgctactggcttgggtatcctaggaccccaagaaccggtcactag

SEQ ID NO: 1026 - DNA, 1992 bp, Oryza sativa
ttttgtgggaatggggaattcttgccaaaatggaacctatgggaacaattaccagaacagcaaccggtttcagaatgaccgttttgcttctcggtacgttgatgggaatgatactgaggattgctactcgggctcgtcaagggccagcttagcgggtgctctgcggcaagggctgaacctaaagtcccctgtccttggatacaagactccaaatgtaagggagctctatactcttggccgggagcttggacagggacagttcgggaaaacatacctctgcactgagattagcacagggtgtcaatatgcatgcaagactatcttaaagagtaatctccgatgtgtgtcagatatcgaggacgtgcgccgtgaaatccagataatgcaccatctttcgggccagaagaatatagtgacaatcaaggacacatatgaggatgagcaggccgtgcacatcgtcatggagctctgtgcaggtggtgagctcttcagcaagattcagaagcgaggtcattacagtgaacggaaggctgcagagcttataaaaattatagttggcatcatagaaacatgccattcacatggagtgatgcaccgggatctcaagccagaaaatttcctcttactggacgcagacgatgaattctcggttaaagcaattgactttggtctatctgtgttcttcagaccaggtattatcaggtcaggttttcagagaggtagtgggaagtccatattatattgctccagaggtattggagaagcgttatggaccagaggctgatatatggactgctggagtgattctctatgtattgctgactggtgttcctccattttgggcagagatacacaaagcgggatatatgaaaaagtactggatggacgtattgattttaaatcaaaccggtggcccaggatatctgacagtgcaaaggatcttataaaaaagatgctctgcccttatccatcagagcgtttgaaagcccatgaagtgctaaagcatccatggatatgtgataatggagtggctactaatcgagctctggatccaagtgtacttcctcgtctcaagcaattttctgcaatgaataggttaaagaaattgtctctccagtccagattattgctgagcgtctttcagaagaggagattgttgggttaagagaaatgttcaaggctatggacaccaaaaacagaagtgtggttacatttggtgagcttaagggactgaaaagatacagctcagtgttcaaggatactgaaattaacgacttaatggaagcagctgatgacaccacctccaccatcaactgggaagagtttattgctgcagcagtgtctcttaataaaatagaacgtgagaaacacttgatggcagcctttacatactttgacaaagatggaagtggttttatcacagttgacaagcttcaaaaggcttgcatggaacgtaacatggaagatactttccttgaagagatgattctggaggttgatcaaaacaatgatggtcaaatcgattatgctgaatttgtcacaatgatgcaaagcaacaactttggacttgggtggcaaacggtggaaagcagcctgaatgtagccctgagggaggcaccccaagtatactgaactcctgtcgcctggcacccccaagaattcagtttgttctcctgagcctttcatctgtttatcacaacacatagttgtggatttgagagaagagagccaagactagatggtttatcagtaatcaccctatagcagtggtggaagaagactctcttagtacctaatagcatataaatgtgtggtctaaagacatcgtatatgtatgaacctcataagttcgttcgttcgttcgtttggttggttggtttgctaccctgctatctaataataatatcaataatacccgaagaacccctcttggttctgcatatatctctgtgctggtgttgttaattgtgtttattttcctgcagtttttaa

SEQ ID NO: 1027 - DNA, 1642 bp, Oryza sativa
ggagaagtacatattcaagcatcctcaacctaaaagaccaaagtcattgcggatatacgaaactcatgttggaatgagtagcacgggagccaaagatcaacacgtatgcaaactttagggatgaggtgcttccaagaatcaaaaagcttggatacaatgcagtgcaaataatggcaattcaagagcatgcatattatggaagctttgggtggtaccatgtcaccaatttctttgcaccaagtagtcgtttcgggaccccagaagatttaaagtcattgattgataaagctcatgagcttggtttagttgtgctcatggatgttgttcacagcagccatgcgtcaaataataccctagatgggttgaacggttttgatggtacagatacgcattactttcatagtggttcacgcggccatcattggatgtgggattctcgccttttcaactatgggaattgggaagttctaagatttctactatccaatgcaagatggtggctcgaggagtataagtttgatggtttcagatttgacggtgtaacctcaatgatgtacactcatcatggattacaagtagcatttacggggaactacagtgaatactttggatttgccactgatgctgatgcagtagtttacttgatgctggtaaatgatttaattcatggactttatcctgaggccataaccatcggtgaagatgtcagtggaatgcctacatttgcccttcctgttcaagatggtggggttggttttgattatcgccttcatatggctgttcctgacaaatggattgaactcctcaagcaaagtgatgaatcttggaagatgggtgatattgtgcacacactgactaacagaaggtggtcagagaagtgtgttacttatgctgaaagtcatgatcaagcactagttggtgacaaaactattgcattctggttgatggacaagaggatatgtatgattttatggctctggacagaccggcaacacctagcattgatcgtggaatagcattgcataaaatgattagacttatcacaatggggttaggaggagaaggctatcttaactttatgggaaatgagttcggacatcctggaatggattgattttccaagagctccacaagtacttccaaatggtaaattcatcccagggaataacaacagttatgataaatgccgtcgaagatttgacctggggtgatgcggactatcttaggtatcgtggcatgctagagtttgaccgcgcgatgcagtctctcgaggaaaaatatggggttcatgacatcagaccaccagtacatatctcgaaagcatgaagaggataagatgattatatttgagaagggagatctggtatttgtgttcaacttccattggagtaacagctattttgactaccgtgttggttgtttaaagccagggaaatataagaggtggtcttggactcagatgctggactctttggtggatttggcaggatccatcacactgcagagcacttcactgccgattgttcacatgacaacaggccctactcgttctcagtttattctcctagcagaacctgcgttgtctatgctccagcggaatgagaacaccaagaggcagcatgcaagtgtgtgcggctgctag

SEQ ID NO: 1028 - DNA, 1590 bp, Oryza sativa
atgcaattcatgatgccattggatacgaatgcttgtgcacaaccaatgagaagggctggtgagggtgctgggactgagaggttgatggaaagattgaatattgggggcatgactcaggagaaagcactgaggaagaggtgctttggtgatggagttactggaactgcacgatgtgtgttcacatcagatgctgatagagacactcctcatcttcggacacaatcctcccgaaagaattatgctgatgcaagccacgtttctgctgtcattttgggtggaggcactggagttcaactctttcctctgacaagcacaagggctacccccgctgtaagttcctgttggaggatgttacaggcttattgacatccctatgagcaattgcttcaatagcggaataaataaaatatttgtgatgactcagttcaattctgcttctcttaatcgccatatccatcatacataccttggtggggggatcaactttactgatgggtctgtgcagaggtattggctgctacacaaatgcctgacgaaccggctggatggttccagggtacagcagatgctatcagaaaatttatgtggatacttgagaggatcattacaatcaaaacaacattgagcacgttgtaatcttgtgtggagatcagctttacaggatgaattacatggagcttgtgcagtgcagaaacatgtcgatgacaatgctgacattaccatatcatgtgctcccatcgacgggagggaagccgagcttctgactatggactggtgaagtttgatgattcaggccgtgtgatccaatttcttgagaaaccagagggtgctgatttggaatcgatggaaagttgataccagcttcctcagctatgcaatagatgacaaacaaaagtatccctacattgcatcaatgggaatttatgtcttgaaaaaggatgttcttttagacattctgaagtcaaaatatgcacacctgcaagactttggatcagaaattctcccgagagctgttttagagcataatgtgaagaggcatgtgtcttcacagaatattgggaggatattggaacaatcaaatcattttttgatgctaacttggccctcaccgagcagcagcctccaaagttcgaattttatgatccaaaaactcctttcttcacctcacctcgatacttacctccagcaagattggagaagtgcaagagatcaaagatgcaataatctccgatggctgttcctttagtgaatgcaccattgagcattctggtcattggaatctcttcacgcgttagcatcgggtgtgaactcaagaggataccatgatgatgggtgcagatcaatatgaaactgaagaagaaacttcaaagctattgtttgaaggcaaggtcccaattggtataggcgagaacacaaagataagaggaactgtatcatcgacatgaatgctagaattggcaggaacgtgatcattgcaaacactcagagggggtccaagagtctgatcaccctgaagagggatactacataaggtctggaattgtggtgatcctgaagaatgcaaccatcaaggacgggaccgtcatataa

SEQ ID NO: 1029 - DNA, 810 bp, Oryza sativa
  misc_feature (547)..(547): n = any nucleotide
atggctgatcagcacagaggagtgatcggcggcggcggctacggtgaccgtggtggccaggagcagcaggagaagcagcccttcatgatgacggctctgaagacggtgaccgcggcgacggccgggggctcgatgctggtgctgtccgggctgatcctggccggcaccgtcatcgcgctcacggtggccaccccggtgctggtcatcttcagccccgtgctggtgccggcggccatcgcgctggcgctcatggcggccgggttcgtcacctcgggcgggctcggcgttggccgcgctctccgtgttctcgtggatgtacaagtacctcaccgggaagcacccgccgggcgccgaccagctggaccacgccaaggcgaggctcgcgtccaaggcccgcgacatcaaggaggcggcgcagcacgcgcatcgaccaggcgcaggcgtcttagggcggcctgccgcggcgaggcgccgcttctgctagctagctcgatcgggcggcgcacgggacggcgccggccggcgcgcgtgcgttcgccgtggccangcccacgctggctactcctcttatctgctgagctctgtaaatgcatgcgtacatgtttaattaagcttggtcgcgtagtactctcctatgtaatatgtcccctagattatctaagaggcgatcgtgcatgtcgggcgcctggtacgtgtggtctggtggatgtcgtgtttatggtcatgatgaataaaatgcagtgttccttcgataaatctagtggttgtactgtttttttttttaacgataagggcatgagttccgcatag

SEQ ID NO: 1030 - DNA, 363 bp, Oryza sativa
atgtcgaacaaggctacggattcttcccagctcatcgagcagaagttcgccatggccaagcagagctcccatggaggcggccattgccgggctgaaagcagcggccgtcactgctgtctgcaccgcgatccccacctttgccagtgttcgtatgtccaagtgggcaaaggccaatctgggcaacccagtcgccaagacagtcatcatcacctacggctgctggcatggcctacttcatcgccggggagaagaaggtggtggagctgtccaggaagcactccctcgaggctgcaaaggccagggctaaatctgaatatactctcacaaaatcgaactagatttgcagcaatatggcatcaatga

SEQ ID NO: 1031 - DNA, 6255 bp, Oryza sativa
  misc_feature (3110)..(3110): n = any nucleotide
ggcttggtgcacctgacttctatccccagacattgagttgtgcagaagagaccttaaccaaagaatatgtgcaatctgggtacaaggataccgttgaaggaattgagcaggaagccagagagattgtactcagtcagattccatacttgagcaaaccagatattgctacaaaatgcaaggagaggcactaaagaagcggttcagagcgatcaatgaatctcgtgctcagaagaggaagcaggctggccaagtttatggggtccctctttctggctcgttgctgacaaaacctgggatgtatccagagcaaatgcatagcaatgaagacacacgcagaaaatggatcgagaggcccttgtgcaaccaaacaggcgtctatggtcattagcagagcaagttcctcgtggttttcggaggaagttactctttaattatcttatccgatataatgtcccactgttaagagcatcatggcttgtgaaggttacttaccttaatcagcaggttcaaacatcatccaataatgtttcatctgctgctcctgatagtttgcgatctcagcactggacaaaggatgttattgaatacttgcagctgcttttggacgaattgtgttctaaaaatggcttttttggacttccatcttctcaagaacagtcattgccatgccttgttgctggagacagcccaattaagttaaaaaccggggcatcacctgctagtgcagatgttgaggagccttcgctacactttaaatggtcgtatatgattcgtattgttcaatgtcatctcatggaacaattacttgttccgtcgttacttatcgaatgggtatttaatcagctccagcaggagagagactcaactgaggttttagaattactcttgcctattgtactttctttggttgataccataaccctctcacagacatatatccacatgctggtggaaatactgattcaacgtctcagtgatgcttctcctggcagcttaagtgttaagaataacccaaaaaggtcatccattacctctgctttagttgagttactgcagtacttgatacttgctgttcccgatacatttgtttctttggattgctttccacttccatcagttgtggctcctgatgtatacggtaaaggtgctcttctgaaaatagcaggtggtggtaaaattgctagctctaggagacagaatgcatctcgacacctctcttgtggttatgccatttgttcagttcaaagacgtgcatctgatctttctttagttgctaatcctaatcttcaagttcgtggggcagccaacgtagtgcaagctttggacaaagcacttgtaactggaaacttgacagcagcatatacatcagtattcaattatctatcagataccctgatggaagaaacatggattaaagaagtcagcccttgcttgcgatcttctctgatgtggatgggagctgttgagttatcccttgtctgctctgtgtttttcatttgtgagtgggcaacatgtactttccgtgattgccgtacatcacaatgccaaaatgtaaaattttcaggaagcaaagatttctctcaggtctatatggcagtttccctgttgaaggataaaatgaatgagataaataatttatcttcttccaagagcagcagtcagcttgcaatgaaggatcaccttaaaagtgctactctgaatcattcttctatcaaggtgacagcaatggagactgcttctggatttagagacagtacaggtagcattgatgagaataacaaaaaggatatcttcagcagcccaggtccactgcatgacattattgtatgctggttggatcaacatgagattagtgatgcttcgggatttaaaagtgtggatgttttcatgactgaacttattcgcagtggtatattttatcctcagacatatgtgagacaactaattgttagtggaatcaccatttggaatgatagcttgtttgatctggaaaagaaaacgaggcattacaaaattctgaagcacctgccagggttttgcttatttaatatccttgaggaagctaagattgctgaagatcaagtcctttatgaaattgtgtcaacatattctagtgagcgtcgacttgtgctttctgagctttcaagtggtctggctactgatgcaaatgttgaaggcagggtccctttgagttcctgccttcagaaacagcctgatcttctaatggattcaacagatgataatcatggcagagtggcagttcaagtagaagaggtaaaacttatgatatcaggtctgttgaatttgggatactctacactcttggctgaatcaggaagagaagaaacaaaaaaaaccaagaaaggacaaacagatttggtagactcagaagaagatgttgggcatgcaaaaactggctgtaaggatagtagtaggaccaagagacagaagttggataagaacgtgtttcctttccaagggtccccattggttcaatcagatgaggaagatttttggtgggtaaggaaagagcagaagcaggaattgtttactgttgaaacaatacatcagtcaattgaacaaacaagtggaggtaaggcaacagtagtgcaaaagacacaaaatatagcacaacttgcagctgctagaatcgatggtagccagggggcatctactagtcacgtgtgtgataacaatctgagttgtccccaccataaacctggcactaactctgacattcttaaagacgctgatcatatgagtatgttgactctggctgaagttggcaaatcacttaagagacttagattgcttgaaagaagatccatttcaatctggctgctgaagtccataaaacaactaattgaaggagatgaagtgaaacattctaaggctaataactccataagtgcctccactgtgcagcatagtggtaaaattgcatctggatggaggtttggagaagatgaacttctgtcagtgctgtacataatggatacatgttgtgatttactctcctctgtaaggttgcttatatggcttctatcaaagatttatattggaaggaccacatctggtcaagttggaagaggtgttatgcacccaaaacntaaagaaaaccaagttttccaagtagccgaagcttttctgttctcatccttgctcagcaggtatgagaacatccttattgcaatggatcttttgcccgaggttttgagtgtttcaatgaatagaactgttcataagtcaggtgaaaggcagtctacttcagtagcttttgcttatgctcgatatttcttaaggaaatacagagatgtgactagtgttgctaggtgggaaagaaattttaggtccacatctgataaaaggctgcttgctgaactggatagtggaaagtcaatcactggtgattcaattatttctggaatttcatcagcagactgtatcagacaaaatggaggagcaaatccagatggagatcattctttagttgcttctgctgtttctgcaattgttgacaatgctgggcatgcaatagctaaacacttggatatttcaggtggtaacaatccaggtgttacctcaattaattcattaaacttgattcaacacattttggatatccacataaactctctggccttgctaagagaaactttaggtgatcgatttagtagaatatttgaaatatctcttgctgttgaagcttcttcagctgttgcagcatcttttgctcctcctaaggctcaccgcagtcaacagtcttctgagacccatgatgaaagtggaaatcatgcaaatgaagttccaagtaatccgtcaaaatgttttaatgttaaggctgtaaaagtttctgctgctgtttctgcactagttgttggagctattatttatggggttgtcagtctagagcggatgatggtggtcctaagattaaaagaaggtttggacattctgcagttcttaagaatttccaaagctagcacaaatggtgtgacccactccattggaaatttcaaaattgacagttccactgaagttttggtacattggtttaagattctaatagggaactgtaagacagtttataatggagtgatcgcagagattctaggtgattcttatgtccttgccttttcaaggttgcaacggacgcttccattgggtatagttcttcctccagcttattcaatatttgctatggtcctttggcgaccatatttatatgacaccagtacatcgaatcatgaagacattcagctttatcagtctctactgggtgcaattagtgatatcacaagacatcagccttttcgagatgtctgcttccgtaacatgcatcttttctatgatcttctggctgcggatgttggtgattcagagtttgctgcaatcgttgaacttcgaagccctgatgaatgtttgaaagctctttcacctcttcgtgcccgggttttcctgaatgctcttcttgattgtgaaataccagtaacaatgagagacgatggtacatatgctttagagcctggttgtgcagaagctagtaccaagaatgatgtaaagtttccagagaggcttatagaaattctgaatgtcctacagcctgcaaagttccattggcaatgggttgagttgaggctgcttttggatgagcaatctcttattgagaaaccaaagaatgtgccatatgtaaaagcacttcgatccctatcccctaatgctgagaattttaccctctctgaaagggaaaaggggcttactgaagttattttgtctaggctacttgtcagacctgatgctgctcctctatactcagaacttattcaccttcttggaaagctacaagagtcattcgtgatgggtatcaaatggttcttacaagggcaagatgttcttttgggaaacaactctgtaagacaacagcttgttaacttgactcagcgcaaaggatttccaatgaagacacagttttggaagccatggggatggtcaaaattagtcggatatgctaatgctaataaaagctccaaaaggaagttagaagttacttcaattgaggaaagagaagttgatggcttgattgattctagaaaatccagtaataggaagtcgctaaatgtgggtacaagcccagaagggcatggatctacccaaaaatattttactcaggaagcccttgctgagttagttttgccatgcatagacagaagttctagcgagtttcgctttgtatttgctggtgatttgatcaaacatatgggtgtgatcagtgagcatattaaagcagcagtgtggaacggtattaataaactgaatagttcaaatccttcaggaaatgaaggtttgagtaaacccaatggccgcaaaggaatcttcagtggtagtccgaatatcaggaagcatagccctgtacctaatgattcaactactccttccgcatcagctttacgatcatcaatatggttgcgcctgcaattcatcattaggctacttccagtaattattgcagacagagtaacatgaggcaaacgctagcttcctccattattaagcttggttggaacacgtgtggtctatgatagatgcagatatcacttgaactcttacatgcgatgatgtcctgcttgattgtccaagtgaaagcctattcgataggcttttatgtgtcctgcaagctttgcttggcaatagctcaactctaagtctggctgaagactaagctcaagctccaagccagctgttaaatttttgcgtgatctttctgcaattgataaagaggtcactaagagcttgcagttgcagtgtgcacttagatctgcatggagtgtgcacagcaacaatcaggcggcggattcaagtggctatgccgattctacctacttcccgcctctcctccataacatgtggtcctcctcgtactgtctcatctgctgcatcatatcaccgattccagtgcagtacatctgctgcagggcctcactcaacaatttcccctcaattggattcctaccaatactctcaagaagatgcaaggcagcgttgccttcatacaggagtcctaacatggaaatagatccttggactttgctggaagacggtacaagctgtccaaataccaacagtggacagcgaagcttctgcaaatggtgttaccggtgaccactgccaatctgaaagcttgcagcttatctcaagtagatattcgtgtcaagggtgaggaggactgacctgacttacattggctctctggtatga

SEQ ID NO: 1032 - DNA, 3079 bp, Oryza sativa
  misc_feature (62)..(62): n = any nucleotide
  misc_feature (183)..(183): n = any nucleotide
  misc_feature (215)..(215): n = any nucleotide
  misc_feature (217)..(217): n = any nucleotide
  misc_feature (837)..(837): n = any nucleotide
  misc_feature (958)..(958): n = any nucleotide
  misc_feature (972)..(973): n = any nucleotide
  misc_feature (1003)..(1003): n = any nucleotide
  misc_feature (1501)..(1501): n = any nucleotide
  misc_feature (2523)..(2523): n = any nucleotide
atgcagatgctgctccacgccaattccctcctcctcctcgcgccgacgacctcgcggctctncgcctccgcctcgccggggagatcggggacggcccggccgctgcctccgccgcaggggcacgcgcattccgcccgcgccgccgctcgcgggacacggaggccgcccgccgtcgccgcagcntgccgcggacgccgatggcggtgggggaggantncgccgccgccgtggcttcccagcaggggttcgtgacggatgcgagggcatactgggtgacaaggtctctgattgcctggaatgtaaacgatcaagacacctccctcttcctgtatgcaagcagagatgccacgatgcacgtatctgatggggccattcatgggttatgattcaaaaattgaactcgaaccagaacatgccagccttccagacaatgtggctgagaagttcccgtttatcagaagttacagaaccttcagagtccctagctctgttgatgtcgcgagccttgtgaaatgccaactagctgtcgcttcttatgatggctcatgggaggcatcaagatgttactggattgcaactacctggtgtattggatgacatgtttgcttatactggaccacttggtgcagttttcagtgataaagatgtcgacctctacctttgggctcctacagctcaggtctgcttgcaaaacaggatgttagagtatgcttctatgatggtccagcaggacctttactgcaaactgtgcaactcaaggagttaaatggtgtttggagtgttactgtaccaagataccgggagaaccagtactatttgtatgagtaggtactggcntctagtatcatcacagttgagaaatgtttagctgatgatccctatgccagaggggctttctgcatggcacacggacttggttggttgacatatagtgactttagccagcttcctgggatgnattgtcagatgagnngcaaaccttgagtccttctctgacatagcntctatgagttgcatattcgtgatttcagcagtgctcatgatagcacagtggactgtaactctcgtggaggatttcgtgcatttacatttcaggttgttcagacttaatttactgaacgatttctgtttcaccacctataacaaaacatcctggtcgcattatggaaactgtgatgcaggattcagcaggaatacgtcacctgagaaaattgtctgctgctggcttgactcatgttcatttgttaccaagctttcattttgctagtgttgatgacaacaaaagcaattggaaatttgttggtaaggatgaggctcagctggcaaaactccctccaggttcagatgagcaacaagctgcaatagtatctattcagcaagaggatccttacaattgggggtatggtatgaccctgtactctggggggttccaaaaggaagctatgcaagtaacccagatggtcctagtcgtattattgaataccgacagatggttcagcanggcctgaatcgcataggtcttcgtgttgtcatggatgttgtatacaatcatttagactcaagtggcccctttggtgtctcctcagtgcttgacaagagattgttcctggatattaccttaggcggaacgttaatggtcagatcgaaaatagtgcggctatgaacaatacagcaagtgagcatttcatggttgataggttaatcgtggatgaccttttaaattgggcaataaattacaaagttgatgggttcagatttgatcttatggggcatatcatgaaaagtaccatggtaagataagagcaaaatctgctattcgaagccttacgagggatgtacatggagtggatggttcaaagatatacttgtatggtgaaggatgggactttggtgaggttgcacaaaataagcgtggaataaatgcatcccagattaatatgagtggcacaggaattggtagagtttcaacgataggatccgcgattctgttaatgggggtaatccatttggtaatcctctacagcaaggcttttctaccggtctgttcttggagagcctaatggatattatcagggtaatgaagcagataccaggcgtgaacttgctacatatgctgatcacatacagcagatcggactagctggtaacctgaaggattatgtactaagaactcatactggagaagctaagaagggatcagacatttacacttttgatggatcaccagttggctatacttcatcccctgtagaaactataaactatgtttctgctcatgataatgagactctgtttgatattgtcagtataaagagaccccaattggcctatcgattgatgagaaatgcaggataaatcatttggcttctagcatgatcgcattatcccagctctttcagggaatacctttcttccatgctggtgatgagatactgagatctaagtcacttgatcgagattcatataactctggtgattggtttaacaagcttgattttacatatgaaacaaacaattggggtntaggacttcctccaagagataagaatgaagaaaattggcatttgataaaaccaagattggaaaacccatctttcagacctttgaaaaatcacattctttctgtcttcgacaattttgttgacatcttgaagatcagatactcctcaccgctctttcgtttaagtacagcaagtgacattgagagcaaagggttcgctttcacacacaggtccctcgatggtaccaggagttattgtcatgagcattaaagatgctcaaaatgaaaaatgtaaaatggctcagttagataaaaacttctcttatgtcgtgacgatcttcaatgtctgtccacacgaagtgtctattgaaatccatgatctcgcttcgttggggcttgaattgcatcctattcagttcaggtgaattcatcggatgctctagtcaggcagtcagcatacgaggcgtccaaaggtcgattcaccgtgccaagaagaacaactgcagtgttcgttcaacctagatgttgatgcctttgggaaaacgttcatattatgtcgaaaaatatgaatgaagataa

SEQ ID NO: 1033 - DNA, 2720 bp, Oryza sativa
  misc_feature (21)..(21): n = any nucleotide
  misc_feature (555)..(555): n = any nucleotide
  misc_feature (2162)..(2162): n = any nucleotide
  misc_feature (2216)..(2216): n = any nucleotide
  misc_feature (2244)..(2244): n = any nucleotide
  misc_feature (2628)..(2628): n = any nucleotide
atggacggggagcaagaggcncggtggctggcggcgcagggggtcgccgtaggtgccgacatggtcgcggcggcgctccggcagctggagttcctcgcggcggtggaccgccgccggtggctctacgaggggccgctgctcgagagggccatccacagaggtacaaatcatgctggcttcctctcctttccaagcacactcaggctgctgttgtagatgggcctttagttgttcctcttgattgcgaatggatatggcactgccatcggcttaacccggtactgatcttctccaggaactggatgataaaagtacaatacttaaaggactgcaagagattgtatggcagaatactcgacaatagcaatgttcagtcttcgattagagcagaatccaagcaccagtctgagaaggtttgggctgagcaatatcctaaggagccctttgagctggagtacacaagctcttctgacaactcaatttatgcaaatgctggagctgcagaggacatttcttatgatttggtcgcagctgttaagagacagtcttctttcntctaccagtatcaggttgacacaccaactatgcatgatcagcgatttctggaagaagctttagctcggtacaaaggattcttgtacctgatcaagacgaatcaggagaacaaaatgaagctctttcgcgtgccaacctatgatgtggatgtcatctggcacactcaccaactgcatcctgctacctactgccatgatatgctgaagctcattggacgagttctggagcatgatgacaccgatgacgatcgatcagaaggaaagaagctcgatactggattttcagggactaccaaacagtttgagaatgcctttggtgcaagatactggaaggctggtgctatgtaccgtggcaacttgccgtctcctgtgacatccaatcctcagatgtttattagtgaggtggatggtgaatttagtgttggcaaagctgagtcgcaaattaccattcttgaaacaacagttatagagttattcttgcaaattgtggacatcaagaacttgccacctgcaattccaaaggaaaatgtgtacatatggttcacaaagaatcaaccagacatgttcatcagtgatggtggcaggctggatatctctacaaaaacagggaagtcgattggagccagtatccaatgtgagcctactggtgaactcattctaacagtactggttgatcgggaatcatcatcgaagaaacccaaaaagattgggaagatttctatccctcttcaagagtttacatggtctgattccaagctctcctttgagaggtggtttgaattgaaacctcatgatgggcatgccagttcacctatcgtcagccttcgagttgctgcctcttccactgtcccagtgaaggctcagcaggttcttagcatgatcaggacagaacctttctctcttaagagttttctgtcaccgaattccatcaaggatcaaaagatgagctgctggactcactttgtgtatgattgcaatactgaacttatccgtcttcaaattagcgccttcatctcagggatcagaaggcaaagaacggcatggttgtcgctcgggagttggtcggagtaacaaagtcatcaaagaaaccatttaagctagcagagttcgtggacaacaagtggtcactgagcaactctaacttatgcatcactaatgacatgaaaccaagcaaggatggctctatacttgagctcaaatgtgacaacaaaacgatcaaactctaccagggaaagaggctagaatttcaacggaagtgctgcaacaatcacgcagaggagaatgcttcagctattactgctgtgaagttctctgctgaacatccatatggcaaagcagttgcattgcttgacaccaaatctgagctgataatggtagtaaatgaggattggtttctgcttccttggatcgtgatgtcgttcctgttccaagacatcaatgtcgaagacggctcgaagctcatcggtggcgccattgctcagaaaggcgcgatctctgagcccgacactgctgccatggcgatgtcagccgagacggtggctgctcctgctaactgcggcacttgcggcacggcgtgcgacagtaacatggcaggcgacaaggtggtgnccgccgcgagatgcaaggccgcgcgatgcaaggctgtcgcggcaagcggcggcngcggcggccaggcagagtcggctgggtncggctcgggatgcggcggcggctgtggcggcggtgttgccaaggtcgttgaggccaccaaggctggcgtcggcggccatggcaagtccggtggatgtggctcgggctgcggtggtggctgtggcggcggcgggtgcggcgccatggccgtcgagagctccaaggatgatgtccatgcgaagtgtgcaggttgtggctcaggctgcggcggcggctgtggcggcggctgtggcggtggcatggtcatggaagcctccaaggctggccatgtcaagtccggcgggtgcggctcaggctgcggcggcggctgtggtggaggctgcggtggcggcgtggccatggaaagctccaaggctggccatgtcaagtccggcggatgcggctnaggctgccggttgtggcggcggcatggtcatggaaagctccaaggctgtccatgtcaagtccggcggctgcggcggaggctgtggtggcggc

SEQ ID NO: 1034 - DNA, 2412 bp, Oryza sativa
atgtcgtcggccgtcgtcgcgtcatccaccacgttcctcgtcgcgctcgcctcttcggcgtcacggggagggcccaggagggggagggtggtgggcgtggccgcgccgccggccctgctttacgacggccgcgccggaaggctagccctacgggcgccgcctccgccccggcctcggcctcggcgtcgggatgcgggcgtggtgcgccgcgcggatgatggggagaacgaggcggcggtggagcgggcgggtgaggacgacgacgaggaggaggagttctcttcgggcgcctggcagccgccccgctcgcgtcgcggcggcttcggcaaggtcttgaagcggaggggcaccgtcccgcccgtcggccggtacggctccggcggtgatgcggcgagagtgcgcggggcggccgcgccggcgccggcgccgacacaggacgccgcctcaagtaagaacggagcgcttctcagcggccgcgacgacgacacacctgcctcacggaacggatcggtcgttaccggcgccgacaagcctgccgccgccacgccgccggtgaccataacgaagctcccagcgccggactcccccgtgatccttccatccgtagacaagccgcagccggagttcgtcatcccagacgcgacggcgccggcgccgccaccgcccggttcaaatcccaggtcgtccgctcctctccccaagcctgacaattcggaatttgcagaggataagagcgcaaaagttgttgagagtgctccgaagccaaaggcgactagatcttcccctattcctgcggtagaagaggagacgtgggatttcaagaaatattttgatctgaacgaaccggacgccgcggaggatggcgatgacgatgatgactgggctgattcagatgcgtcagattctgagatcgaccaggatgacgattcgggccctttggctggggagaatgtcatgaacgtgatcgtggtggctgctgaatgtgggcttggagatgttgcaggtgctttacccaaagctttggcgaggagaggacatcgtgttatggttgtggtaccaaggtacggtgattacgcggaagcccaggatgtaggaatcaggaaatactacaaggctgctggacaggatctggaagtgaaatatttccatgcatttatcgatggagttgattttgtgttcattgacgctcctctcttccgtcaccgtcaggatgacatctatggggggaacagacaggaaatcatgaagcgcatgattctgttttgtaaggctgctgttgaggttccttggcacgttccatgcggtggtgtgccctatggggatggcaacttggtgttccttgcaaacgattggcacactgcactcctgcctgtttatctgaaggcatattacagagacaatggcatgatgcagtacactcgctctgtccttgtgatacataatatcgcttaccagggccgtggcccagtagatgaattcccctacatggaattgccggagcactacctggatcacttcaagctgtacgaccccgtcggcggcgagcacgccaacatcttcggcgcgggcctgaagatggcggaccgggtggtgaccgtgagccccggctacctctgggagctgaagacgacggagggcggctggggcctccacgacatcatacgggagaacgactggaagatgaacggcatcgtgaacggcatcgactaccgggagtggaacccggaggtggacgtgcacctgcagtccgacggctacgccaactacaccgtggcctcgctggactccagcaagccgcggtgcaaggcggcgctgcagcgcgagctggggctggaggtgcgcgacgacgtgccgctgatcgggttcatcgggcggctcgacgggcagaaaggtgtggacatcatcggcgacgcgatgccgtggatcgccgggcaggacgtgcagctggtgctgctgggctccggccgccgcgacctggaggtgatgctgcagcggttcgaggcgcagcacaacagcaaggtgcgcgggtgggtggggttctcggtgaagatggcgcaccggatcacggcgggcgccgacgtgctggtcatgccgtcgcggttcgagccgtgcggcctcaaccagctctacgccatggcgtacggcaccgtccccgtcgtgcacgccgtcggcgggctgagggacaccgtgtcggcgttcgacccgttcgaggacaccggcctcgggtggacgttcgaccgcgccgagccgcacaagctcatcgaggcgctcggccactgcctcgagacgtaccgcaagtacaaggagagctggaggggtttccaggtgcgcggcatgtcgcaggacctcagctgggaccacgccgccgagctctacgaggaggtccttgtcaaggccaagtaccaatggtga

SEQ ID NO: 1035 - DNA, 1884 bp, Oryza sativa
  misc_feature (384)..(384): n = any nucleotide
atgtacttgatttctggagatggcttccaagatattgtaattaaaaacacatccctcacagcttccatagacgctactaaagtttgtggtgcatatcaaagaaactattgttgacaagagcatggcatcaacaggcattgcagtgagcccaagcaacaacgatgctttggacctagctgttgcacaattagatggtgatcaatcttcatatcatcatacaccagaggtcttcttactctaccttgcagttcccggtgttcctctagccaaaatgcaagtacttgagtctgattcggttgccgcagtgaagcttcggatccaaaacagcaaaggatttgtggcgagaaaccaaaggttggtttttcgaagggcagagagctctcnacgcaatgatagcccatatcccgtgactatggggttgaaggtatgggaagtgtgcttccatctcgtggatccgactatcagatccacgacgaaccgctgtgaggactgtttatggaaggaagtttaaattccaagtggaccaacgtcgaaatgctagatatatgaagcaagagatttcaagaaatgttgaaagtcccaatggtattggagagagcatgactttggtcaatggtgaaaagcttgatgaaagcacattaatctccaccatttgtgagaccaacacttctgataccgattttcttgcaaacaagtcagaaaattttaatggaaatgaaatagaagaatcttttgagcaattatccatttcttctgacattggaaacaatttacaatttgatgatgccaaggagaaatatcccctgattgaaccagttcttgtcaacccaagtgttacccttactccaaaaattacgggtatgatcgaagctacacttgctgggctagaaatggagcacacacctgtgatgtcctcagagggcactgggggagtctacttcatgctagattcatcaggccaagagtatgttgctgttttcaagccaataaatgaagagccaatggcaaaggacaatcctaatggctaccctttgtccagtgatggggaaggattaaagagaggaacaagagtcggtgaaggtgcattcagggaggttgcagcatacattcttgaccatcctattagtggttatcgcgtgagcgatgaactagggtttgctggtgttcctccgacagttcttgttcgatgtttgaatggttatgttgatcagactaagtatgattgcgcggagaaagaaccgaaaattgggtccttgcaaatgtttgtgaagaattctgggagttgtgaggagtttggtcctagggctttccctgtgcaagaggtgcacaagattgctgttttggatatgaggctagctaacacggatcgccatggcggcaacatactgattcgtaaggatgagaatgggcagattgagctgataccaattgatcatgggtattgtctgcctgaaagctttgaagactgcacatttgattggctttactggccccaagcacgccagcctttcaatgttgaaaccctggactacataaagtcacttgacgaggaagaggatatcaagttgctcaagctcaatggttgtgaaccatcatctaagtgtgttcgtgtttttcgtctaagcaccatgatgttgaagaagggtgctgtgagaggtctaactccatatgagatcggtaacatgttgtgtagggagaacattacaaccaaatcaaagattgaagagattgttgaagaggcagagcatgttgttcttcctgggataggtgaaaaggcattcatggaagccatctcaggtatcatggatcgctatctcaatgaactcttcaaatgaaatgctcctcaagatgactgtgaattatggtttcgagtgtgtgtgataa

SEQ ID NO: 1036 - DNA, 1704 bp, Oryza sativa
  misc_feature (338)..(338): n = any nucleotide
tttgtaattctttaatttgttgcaaccatgaatgtattggcatctaagatcttcccttcccgctccaatgttgccagcgagcaacaacaatcgaagcgcgagaaagcaactattgatgacgctaagaactcgtccaagaacaaaaatcttgaccgcagtgtcgatgagagagtgtgcttggaatcattcttggaggtggtgcagggactagattgtatcccctcaccaagaagcgtgccaagcctgccgtgcctctgggtgccaactacaggcttattgatatccctgtcagcaactgtttgaacagcaacatatccaagatctatgtgctgacacanttcaactctgcctctctgaaccgtcacctgtcaagagcctatgggaacaacattggcgggtacaagaatgaagggttcgttgaagtcctcgctgcacagcagagcccagataatcctaactggtttcagtcagggtactgcagatgctgtaagacagtacttatggctatttgaggagcataatgttatggagtttctaattctggctggagatcacctttaccgcatggactatgaaaagttcattcaggcacacagagaaacagattctgatattactgttgctgccctgccaatggatgagaaacgtgcaactgcattcggcctcatgaaaattgacgaggaagggagaatagttgaatttgcagagaaaccaaaaggagaacaattgaaagcaatgatgggttgacactaccatacttggccttgacgacgtgagggcaaaagaaatgccttatattgctagcatgggtatctatgtgattagtaaaaatgtaatgcttcagctcctccgtgaacaatttcctggagctaatgactttggaagtgaagtcattccaggtgcaacaaacatcggaatgaggggtacaagcttacttgtatgatggttactgggaagacattggtaccattgaggcattctataatgcaaatctgggaataacgaaaaagcctgtaccagatttcagcagtttctatgaccggtctgctccaatttatacacaacctcgacacttgcctccttcgaaggttcttgatgctgatgtgacagacagtgtcattggtgaaggttgtgttattaaaaactgtaagatacaccattcagtagttggactccggtcctgcatttctgaaggcgcaataatagaggactcattactcatgggagctgactactacgagagactgaagcagacaagaaactccttggtgaaaaaggtggcattcccattggtattgggaagaattgccacattagaagggcaatcatcgacaagaatgctcgtattggagataatgtgaagagataatcaatgttgacaatgtccaagaagctgcaagagagactgatggatactttatcaaaagtggcattgttaccgtgatcaaggatgctttgctccctagcggaacagttatatgaagtagctgcgtaatatgtgatggggcatcggcgacgagcaccaggcgggcattataagaagaataaaagcagttcaaggcactttattccctttttttttcttctgttcttcctctattgtgttaggataaatgtaatggtagaagcaactgtttttcagatgttttgggagtgaatgataccgtgcttgaattttccatgttttgctttgcctctgcttga

SEQ ID NO: 1037 - DNA, 1273 bp, Oryza sativa
  misc_feature (520)..(520): n = any nucleotide
  misc_feature (523)..(523): n = any nucleotide
  misc_feature (527)..(527): n = any nucleotide
atgtcgtcgtccctgctcactgacctcgttaacctcgacctgtcggagagcacggacaaggtcatcgccgagtacatatggggttggtggtactgggatggatacgttgtctggacctgttgatgacccaagcaagcttccaaagtggaactttgatggctccagcaccggtcaggctaccggtgacgacagtgaagtcatcctccagtatgcttcttgtttgtactctttgatttgattacaccttgccctcaagccatcttcagagacccattcaggaaggggaagaacatcctggtaggtcatgtgtgactgttatgcgccgaatggcgagccgattccgacgaacaaccggtacaatgcagcaaggatcttcagtcatcctgatgtcaaggctgaagagccatgggtatgggattgagcaggagtacacccttcttcagaagcacatcaactggcctcttggctggccactaggtggctatccaggccctcagagggtccgtactactgtgcggcnggngccnataaatcgtacgggcgcgacatcgttgatgcccactacaaggcctgcctgtttgccggcatcaacatcagcgggatcaacgcagaagtcatgccggggcaggcagtgggagttccagattggccctgtcgttggcgtctccgcagggatcatgtctgggtggcacgctacattcttgagttacagaggatcactgagattgctggcgtcgtcgtgtccttcgaccccaagcccattccggagggagactggaatggcgccggtgctcacaccaactacagcagcaccaagtcgatgaggagcaatggcggctacgaggtgatcaagaaagcgatcaagaagcttggcatgcgccaccgtgagcacatcgccgcctacggcgacggcaacgagcgccgcctcaccggccgccacgagaccgccgacatcaacaacttcgtctgggggcgtagcgaaccgcggcgcgtcggtgcgtgtcggccgggacaccgagaaggacggcaaagcaggttacttcgaggacaggaggccggcgtccaacatggacccgtacctggtgaccgccatgatcgccgagaccaccatcctctgggagcccagccacggccacggccacggccaatccaacggcaagtgaggaggagtcgcctcgcccgggttgatgaactgctttctcgcgttctgggtttcatggaaatctgtgtgtgtgtgttctctgacgctggtgctgttagaaacttccaataa

SEQ ID NO: 1038 - DNA, 1234 bp, Oryza sativa
atgaggaggatcacgtggctcgcgacggcggctgcggcgctgtgctgcctcgtcgcggcggcgagtgcgacggcgcagtgcaggttcccggccgtcttcaacttcggcgactccaactccgacaccggcggcttctgggccgccttcccggcgcagcaggcgccgttcggtatgacctatttccgccgccccgccggccgcgcctccgacggccgcctcgtcgtcgacttcctagcagtgcaagcgatggggcttccgctgctgagcccttacctgcagtccgtcggctccggctaccgccacggcgccaacttcgcgacgctggcgtccacggcgctgcagccccaacacctcgctgttcgtcaccggcatcagccccttcttcctcgctgtccagctcaaccagatgaaggagctgaggaccaaggtgctcacctccaatggcaacaacggaccaacttcctgcacctgatgttctgcacaatgctctgtacacaattgacattggtcaaaatgatctcacctccaacctgggatcacagagcattgagacggtcaagcaaagtctccccttcagttgttagcaagatctcctctactgtgcaggcaggaattgtacaacattggcgctcgcaacattatggtgtttaacatggcgcctatcggatgctacccggcattcctcacgaaactcccgcataccagcaatgacatggatggatatggttgcatgaaaacctacaacagtgcagtgacctactacaatgaactgctgaacaatagcttggccgaggttaggaagaagctgcaggatgcatctattgtgtatcttgacaaacacgctgtgacgctcgagctgtttcgccatcctaaagctcatggggctgaagtatgggactaaggcttgctgcggatatggtgatggggcttacaatttcaacccagatgtgtactgtggaagcagcaaattgctgaatggccaaacggtaaccgcaaaagcttgtgctgatccacagaactacgtgagctgggatggaatccatgcgacagaagctgcaaacaagatcatagcatcttccttgatgagcggctcatattcatatccaccttttgatctttccaaactttgccacctacagcccatagcataatcacagcaccaatctagtcatacttagttgctgaaaccagaatatgacaggaaagcacatcttctggaaaagagatgttgtaa

SEQ ID NO: 1039 - DNA, 981 bp, Oryza sativa
  misc_feature (594)..(594): n = any nucleotide
atggcgcacttccagggacagcagcacggccacccggcggcgcgcgtcgacgagtacggcaacccggtggcggccggccacggcatcaccgggacgcaagaggcaggcgccggagggtacggcgccgccggcaacgttgcgcagcctcagcatgcgttcggcggcgcaaccgacgccgggggttatggccggcaggccggatacggcgcaaccggcaccggcacccacgacgccgcgggctatggtggttccggtcagccggcgtacggcgctaccggcactggcgtccatgacgccggtggtttaatgcctgggcacactgccgggcatggtaccaccggcaccggagtccaccacggcgccggcgccggtttacccgcggggcagaccgccgggtacggaacaaccggcgtcaccggagctcagcacggagctggtggactaggaaccgggcacacagccgggtacggaaccaccggagcccaccacggcgccggtggcttgggcaccaggcacatggctggacacggagccaccacaacacccgacaccatggcatacggaaccaccggcacaggggcgccacacggcgcnaccgccggcaccggcgcgtatccgcacgcaggcggccagttccagccggcgagagaggagcacaagaccggtggcatcctccgccgctccggcagttcaagctcaagctcgtcgtctgaggacgacgggatgggagggaggaggaagaagggaatcaaggagaagatcaaggagaagctccccggcggcaacaagggcggccagcagcagccgacggccactgcggcgaccggcggatatggtgccggcacgggacacaccgccgccgctggtacaaccaccgacgccggcgggacggcgtatacaccgacgacgcagccgacgcacgagaagaagggtatgatggagaagatcaaggagaagctccccggtggtggccatcactga

SEQ ID NO: 1040 - DNA, 924 bp, Oryza sativa
  misc_feature (64)..(64): n = any nucleotide
  misc_feature (143)..(143): n = any nucleotide
  misc_feature (865)..(865): n = any nucleotide
  misc_feature (870)..(870): n = any nucleotide
  misc_feature (897)..(897): n = any nucleotide
  misc_feature (913)..(913): n = any nucleotide
agccgcggtaattctgccgcgaatgccgccggtaatgggacccagggcggttccctccggaaangtccccgtcggcggcggtgccgcaagagcaagcgctcgtcggcctcgtcggcgtcggcgtcggcggcgtctcctcctgntcctgcggtgggcgccgcgccaccggtggtgccggcgctgtcgtcggcgatcagcaagctgctgcagtcggagcccatggcggcgccgtgcgcggacttccccaacgtgctcccgaccttcgtgtccaccgggttcgagctccccgccgccgccggcgaccgcctctcgctggggtcgttcggggcgttcggcaacctgtcggcggcggtggcggctcccggcggtggtggtgggtcgtcgacgaccacgtcgttcatggacatgctgaggggagttggagggcttttcgacggcgtcggcaacagccatcagatgggcggcaatggcggcggcggaggcagctactacgcgcctctcatcaccggcgccggcaatggcatgctgatgccgccgccgccgctgccgccattttctggttctctgatgcagcatgggatgcaggggctgttcgccaatcatgcgatgggaggaggtggtggtggagtgatgaacgccggcgaggacggcagcgtgatggcggggctgggaggaggccagtggccgccggcgcttggtggtgcagacgagcagcagggcggcggcgacggtggcgaagctgtgatgacgaaggacaccggcggcggcgcatcgtcgtcggcgtcgaggccggactacttctacggctggaacagcgccgccggcggcttcttcgctggaggctccatcggcggcaaggccgccntttcnaccggagcaacgccatggcagggcctnattgaaaacaactcgnccattatttaa

SEQ ID NO: 1041 - DNA, 918 bp, Oryza sativa
  misc_feature (553)..(553): n = any nucleotide
atggcgtcgcagcagttcccgccgcagaatcaggagacgcagccggggaaggagcacgccatggatccccgccccgaggccatcatccagagctacaagccagccaacaagctgaagtcttctccgttcatgtcacgttcatgtcgtcgttcgtcggtgcaggacaaggtggcgatcgtgaccggcggcgactccggcatcgggcgggcggtgtgcctgtgcttcgcgctggagggcgcgacggtggcgttcacgtacgtgaaggggcaggaggagaaggacgcggaggagacgctccgcgcgctgcgcgacatcagggcgcgcaccggcgccaaggaccccatggcgatccccgccgacctcgggtacgacgacaactgccgcaaggtggtcgacgaggtcgccggcgcgtacggcggcgccatcgacatcctcgtcaacaacgccgccgagcagtacgagcgcccctccatcaccgacatcaccgaggacgacctggaacgcgtgttccgcaccaacatcttctcctacttcttcatgtcgaagcacgccntgaagcggatggggtgcagcatcatcaacacgtcgtcgatcaacgcgtacaaggggaacaagacgctgctggactacacggcgaccaagggcgccatcgtggcgttcacgagggcgctggcgctgcagctggcggaggaggggatccgggtgaacggcgtcgcgccggggccgatctggacgccgctgatcccggcgtcgttcgcggaggagaaggtgaggcagttcggctcccaggtgcccatgggccgcgccggccagccgtcggaggtggcgcccagcttcgtcttcctcgccagcgacgacgcctcctacatgtccggccagatgctgcacgtcaacggcggcgtcatcgtcaacggctag

SEQ ID NO: 1042 - DNA, 705 bp, Oryza sativa
  misc_feature (162)..(162): n = any nucleotide
  misc_feature (345)..(345): n = any nucleotide
  misc_feature (359)..(359): n = any nucleotide
  misc_feature (387)..(387): n = any nucleotide
  misc_feature (391)..(391): n = any nucleotide
  misc_feature (415)..(415): n = any nucleotide
  misc_feature (419)..(419): n = any nucleotide
ccgtccagcctcaccggcaagagtccgtacttctccaacaaccacggcaagctgttcgagctcaccggcgacaattgccgccactcaagaagctcgactgcagatcggcctcgcaacatcacccgcggctcgatgattgcgccgaactacaacacccgcgcnacaagctcgccgtcgtcctgcagggcagcggctactttgagatggcgtgccacacgtgtccggcggcggctcgtcggagcgccgggagcgcgagcgcgagcacgggaggaggagggaggaggaacagggagaggaggagcacggcgagcccggggagaaggcgaggaggtaccacaaggtganggcgcaggttcggnaggagtcggtgatcgtgatccccgcgtngcanccggcgacgatcgtcgccagcganggcnagagcctcgccgtcgtctgcttcttcgtcggcgccaaccacgacgagaaggtgttcctcgccggcaggaacagcccgctgaggcagctcgacgacccggccaagaagctcgtgttcggcggctccgcggcgagggaagcggaccgcgtgctcgccgcgcagccggagcagatcttgctgcgcggcccgcacggccgcggcagcgtctccgacatgtaacgcgacgcgacgacgtcccctgcacccggcgcgcgtacgccgagcagctgtgtgatcgagaggaataa

SEQ ID NO: 1043 - DNA, 646 bp, Oryza sativa
gccggggaagcgaacaacctcgcgccgtggaagtccctgcccgaggagtgcgccgcctacgtgcgggagtatctcaccggcgtggcctaccgctccgacctcgaggtcgtcgcgcgggaggcctccgcgtacgcgcggaccgcccgcgtcggggacgacggccgcgacgcgtgggtgttcgacgtcgacgagacgctcctctccaacctcccctactacgccgaccacggatacggagcttgaagctgtacaatgaggttcgcgaccttggattcaagaccttcttgctcacgggccgcagcgaggggcaccacggcgtcaccgtcgacaatctcaagaagcagggcttccatgattgggacaagctcatactaagaagacggcgacgatatacaaatcggagaagaggaaggaaatggaagaggaggggtacaggatcctaggcaactccggcgatcaatggagcgacctgctgggtttctccacgagcgctcgctccttcaagcttcccaatccaatgtactatattccatgacggaacagaagagggaaagagagggcgggtgagaaatgcggcgtttatttgatgcattttctcacccagcccattcaaactgactggtggagaaaaagaaattcacaataa

SEQ ID NO: 1044 - DNA, 422 bp, Oryza sativa
atggcctccgaaggcgccgtgagcccggcgttcgcctacaccgtcgtctacgtcaaggacgtcgccaagtcggccgccttctactccgccgcgttcggctacaccgtccgccgcctcgaccaatcccacaaaggtgggcggagctggagagcgggacgacgacgatcgcgttcacgccgctgcaccagagggagacggacgcgctgacgggcgcggtgcagctgccggactcggccggcgagcgggggcccgtggagatctgcttcgactacgcggacgtcgacgcggcgtaccggcgggccgtggacagcggcgccgtgccggtgagcccgccggagcagaagagctggggccagaaggtcgggtacgtcagggacatcgacgggatcatcgtgcgcatgggcagccacgtccgcgcgtag

SEQ ID NO: 1045 - DNA, 321 bp, Oryza sativa
atgggaaagctttatggtttgttctgggttatggccttggtattggctacggtggctggtacaaaatccgatgagggttgcagtcgtgatcttcaggacttaattatggagtgtcaaaaatatgttatgaatcctgcaaacccaaagatagaaccctcaaacgcatgctgtagcgtaatccaaaaggcaaacgtcccatgtttatgctccaaggtcactaaagagattgagaagatagtgtgcatggagaaggtcgtgtatgttgctgactattgcaagaagccactacagcctggctccaagtgtggaagtaagctttaa

SEQ ID NO: 1046 - DNA, 366 bp, Oryza sativa
atggcgagatcaagcggaggacttgcaatggaggcaaccaaggagacccagcagcagcagcagcagaggaagccggacgccggcgacacggtgcagctgccgatggacaccagcccgtacgtgcagtacaagaaggacgacggcctggaggactacaagctgcgcgcctacggcgcccgcggccacctccccgtctccgacgtcccccacggcggctgcggcaccgacgcccccaccatccccggcaccgccgtccccgtcgccacacagcgccgccaccaacaaggcgacaccgccgctgccgccgccggcaccggccgcgttgacaccgccaccgacgccatcaatcaccatggcgtgccatag

SEQ ID NO: 1047 - DNA, 2145 bp, Oryza sativa
atgccgcgtcgccgcccacgcgtcgttatcgtcgttgcccactcgttgtcgtcaccgcccactcgtcgttgccgtcgggggtcggtgatgagaacatcaacaccaacgatatatccacgcctccacaagtacaacttcaacgtcctattactcgcgctcgtgcacgtcaactcaactatcaggaacaatggagagaatcaaatgggtgaggattcgcgcggggtggattcggactgcagcacagtcccaacttttgacggtcgccatgacttcatgcgaactctgatttgggcgtgcaagtactatcaagtctaccttcaaatggatctagcctcttgtccatatcagttctggagcagccgcaatcttcatttttctaccgagttcttttctgtccacgttgcttgttcatcttgttcttgctggttctcgattgcttacaccgcctctggagttggtgtaacgattgctaaggcgcaacatccctggatagttgtagtcggatcgccaacgtcactccatccaatctacttatccctctcatcgaaatatcgggacaccctcaagcacatcagtcggcgccgccgcgaagggggcagcccgagcgacggggacgacgcggcagccgctagccaccagcacgcgcacgccgcccactcgtgctcggtaccgagagaggaagagaaagagagggagaggagagaaagactttcgcgagccgtatcgtatccattggatggagccctagagcaacaagaagaagccaagaatatttgcgccatggagggtggtaattccagcaagggcgccatggagggtggtcaccgctgccgccgcccaaacgtcgacgacgatgaccagatcgaggagggagagatctgctacgactgccacgtctcgggctccgagaccgacgacgacgagcaccacagacgcgccgtgctccctccccgcgacaatggcgatggctgcgcggagcacaaacggtgccgcctcgacaatgctgctacggcgcccgcaccctctgccgggccggtgctgaccaccagcaacggaagcgccatcgtcgccatcgcctccgctgccgccgccgcagcagctgcggcgtcgacaatggcgcgggaggtgttcgcgtgccgcatctgccggaaggagttcgacacccggaaggccgtggacgggcacatgagagttcaccgtcagcaatccattgccacccccaagtataatgccgcagacaactctcgtgtcactgtggtcgctgagcccagaaccgatcttgatctttccggtccacacgggagcagcagcgcgccgccgtcgccaccagcgccggccaatcctcccaatcataatcaggccgtcggtcaccaaccagcggctgccgcgccgaacgccggcgtcgtcgtcgtcgtcgaaggggcgccgcaaaaaagtctaccatacatgtgcaagatgcagggctgcggcagggcgttccccacgcaccaggggctaggtggccacgctgccggccaccagaacaggagcaaggcagcggcggcggcggcctccgagcagggcagcagcggagcgggggccgacgggtgccacggcggcgccgacagcagcaagcatcggtgcagagaatgcggcatggagtggaagacaggtttcgcgctcggcggccacatgaggaagcaccaaactaaggagacggtgaccgtgaacgagaaggagccgaatgtcgctggcaagcacatctctcttggaccaccacctttgccggaccttactccggccgccgctgaggtaacttcgtcggaaccacttgatcagccaccactactgtcaatggtggtgggtgcagaagttgcagcaccggcgctgcttgcgctggccaacgaggcagcggcattgccgccacaggatgatcaggcagaggaagaggcggctgcagaagccgctgcaccggccgaggcagcggcattgcgaccggttgaggcagggcagaggcggccgatgttggagcagcaccagaggagccgctgctggcgcctattgccggcatgggaaccgtgcgtattttcggttttttggttgagaagccggcacctggagacggcagtggaggagagggttcagcgcctgcatagatcgtcctag

SEQ ID NO: 1048 - DNA, 768 bp, Oryza sativa
atggagcaaactttggacgtacctagatcgttgaggctaccgacaccaaaggctcaacaacaaatggatgaattttggagggatcgacaaaaagagattgagacaacaaaggactttagcgagcatgcgatccctatggcccgcttgaagaagatcgcatcttctcaaaagggtaacatgatgatgtcctttgacatgccagcattcttatcgaagatgtgtgagctcttcgtacaagaacttgctgtgcgtgcatgggcatctgctcaatcccataaccgttgcatcatactagacacggatattgctgaagccattgcctccacagagtcttatgactttcttgttgatatcctccataatcaccccatccctattactcctagtttaatgccaccaatttctcactatataccgttccaatatccatccttatcacaagaagtgtccacgatgatggcttccgcacccatagtgaatagatcaatgttgctcattcacaacatagcaaggggtctaggcttacaaggaaacaatatcagcacattcgccaacaataatatcccagacaatattattggttgtagtagccccgcggttcttgcaagtatgatgagtcctgctttactagacgttgcaggggcatcactaaatccgccaaactcttactccatctgcacgatgaacatgatcaactcgagtgatcccagtggatctagcattggtgacattaaatgtggcaaatcaggcaagtctggctccctctga

SEQ ID NO: 1049 - DNA, 3315 bp, Oryza sativa
  misc_feature (2606)..(2606): n = any nucleotide
  misc_feature (3036)..(3036): n = any nucleotide
  misc_feature (3042)..(3042): n = any nucleotide
atgccgccgcgctggcgcgccacggcgacgaggcttctcgtgctcctcgcgtgcgcgtgcgcggtgttcgtcccgcggtgccattgcgtcggcgaccagggcgaggcgctgctgcgatggaaggcgtcgctgctgaacgggacgggcggcggcggcggcgggctggactcgtggagggcgtcggacgcgagcccgtgccggtggctcggcgtgtcgtgcgacgcgcgcggcgacgtcgtggcggtgaccatcaagacggtcgaccttggcggggcgctgccggcggcgagcgtgctgccgctggcgaggtcgctgaagacgctggtgctctccggcaccaacctcaccggcgcgatcccgaaggagctcggcgacctcgccgagctgagcacgcttgacctcaccaagaaccagctcaccggcgctatcccggccgagctgtgccggctgaggaagctccagtcgctggcgctcaacagcaactcgctgcgcggcgccatccccgacgccattggcaacctcaccggcttgacgtcgctcacgctctacgacaacgagctgagcggcgccatcccggcgagcatcggcaacctcaagaagctccaggtgctccgcgccggcgggaaccaggcgctcaagggcccgctgccgccggagatcggcggttgcaccgacctcacaatgctcggactcgccgagaccggcatctccggcagcctcccggcgacgatcggcaacctcaagaagatccagaccatcgccatctacaccgccatgctcaccggctccatcccggagagcatcggcaactgcaccgagctcaccagcctctacctctaccagaacaccctctccggcgggatcccgccgcagctcggccagctcaagaagcttcagacggtgctcctatggcagaaccagctcgtcggcacgatcccgccggagatcggcaactgcaaggagctcgtgctcatcgacctgtccctgaacgagctcaccggcccgatcccgagaagcttcggcggcttgccgaacctgcagcagctgcagctcagcaccaacaagctcaccggcgtcatcccgccggagctctccaactgcacgtcgctgaccgacatcgaggtggacaacaaccagctcaccggcgcgatcggcgtcgacttcccgaggctgcgcaacctgacgctgttctacgcgtggcagaaccggctcaccggcggaattccggcgagcctcgcgcagtgcgagggcttgcagtcgctggacctctcgtacaacaacctcaccggcgccatcccgagggagctcttcgcgctgcagaatctcaccaagcttctcctgctcagcaacgacctcgccggtttcatcccgccggagatcggcaactgcacgaacctctaccggctccggctgaacggcaaccggctttccggcacgatcccggcggagatcggcaacctgaagaacctcaacttcctcgacctcggcggcaaccgcctcaccggcccgttgccggcggcgatgtcggggtgcgacaacctcgagttcatggacctgcactccaatgctctcaccggcacgttgcccggcgacctcccgcgaagtctccagttcgtcgacgtctccgacaaccggctcaccggagttcttggcgccggcattgggtcattgccggagctgacgaagctgaacctcgggaagaaccggatctccggtggcataccgccggagctcggctcttgcgagaagctccagctgctcgacctcggcgacaacgcgctctccggtggcatcccgccggagctcgggaagctccctttcttggagatttcgcttaacctcagctgcaaccgcctctccggcgagatcccgtcgcagttcgccgggctcgacaagctcggctgcctcgacgtctcgtacaaccagctctccggtagcctcgagccattggcaaggctggagaacctcgtcacgctcaacatctcctacaacgccttctccggcgagcttcccgacacggccttcttccagaagctacccatcaacgacatcgccggcaaccacctgctcgtcgtcggctccggcggcgacgaggccacccggcgggcggccatctcgtcgctgaagctagccatgacggtcctcgccgtggtcagcgcgcttctcctcctgtcggcgacgtacgtgctcgcccgctcgcgccgcagcgacagcagcggcgccatccacggcgccggcgaggcgtgggaggtgacgctgtaccagaagctggacttctccgtggacgaggtggtccggtcgctgacgtcggcgaacgtgatcggcacggggagctccggggtggtgtaccgcgtggggctccccagcggcgactccgtcgccgtgaagaagatgtggtcctccgacgaggccggcgcgttccggaacgagatcgcggcgctgggctcgatccgccaccggaacatcgtccggctgctcgggtggggcgcgaaccggagcaccaagctgctgttctacacctacctccccaacggcagcctcagcgggttcctccaccgcggcggcgtcaagggcgccgccgagtgggcgccgcgctacgacatcgngctcggcgtcgcccacgccgtcgcctacctccaccacgactgcctcccggccatcctgcacggcgacatcaaggccatgaacgtcctgctcggcccgcgcaacgagccctacctcgccgacttcggcctcgcccgcgtcctctccggcgccgtcgactccggctccgccaaggttgactcgtccaagcctcgcatcgccggctcctacggctatatcgcaccagagtacgcgtcaatgcaaaggattagtgagaagagcgacgtgtacagcttcggcgtggttgtgctggagatcctgacggggagacacccgctggacccgacgctgccaggtgggacccacctggtgcagtgggtgcgggaccacctgcaggcgaagcgggccgtggcggagctcctcgacccgcggctgcgcgggaagccggaggcncaggtncaggagatgctgcaggtgttctccgtcgccgtgctctgcatcgcgcaccgcgccgacgaccggccggcgatgaaggacgtggtggcgctgctgaaggagatccggcggccggtcgagggcggcgccaccggcggcggcgaggggaaggagcagaatgccgccgccgccgccgccgcgcctccggcggccgagcgacggtcgccggcgaggagcacgctgccgaagggcggctcttctagctgctcgtttgccatgtcagattactcgagttga

SEQ ID NO: 1050 - DNA, 3190 bp, Oryza sativa
  misc_feature (161)..(161): n = any nucleotide
  misc_feature (264)..(264): n = any nucleotide
  misc_feature (606)..(606): n = any nucleotide
  misc_feature (1818)..(1818): n = any nucleotide
  misc_feature (2130)..(2130): n = any nucleotide
  misc_feature (2132)..(2132): n = any nucleotide
  misc_feature (2141)..(2141): n = any nucleotide
  misc_feature (2145)..(2146): n = any nucleotide
  misc_feature (2164)..(2165): n = any nucleotide
  misc_feature (2216)..(2216): n = any nucleotide
  misc_feature (2327)..(2327): n = any nucleotide
  misc_feature (2336)..(2336): n = any nucleotide
  misc_feature (2343)..(2343): n = any nucleotide
  misc_feature (2555)..(2555): n = any nucleotide
  misc_feature (2641)..(2642): n = any nucleotide
  misc_feature (2648)..(2648): n = any nucleotide
  misc_feature (2735)..(2735): n = any nucleotide
  misc_feature (2759)..(2759): n = any nucleotide
  misc_feature (2777)..(2777): n = any nucleotide
  misc_feature (2798)..(2799): n = any nucleotide
  misc_feature (2814)..(2814): n = any nucleotide
  misc_feature (2816)..(2816): n = any nucleotide
  misc_feature (2844)..(2845): n = any nucleotide
  misc_feature (2853)..(2853): n = any nucleotide
  misc_feature (2856)..(2857): n = any nucleotide
  misc_feature (2859)..(2859): n = any nucleotide
  misc_feature (2863)..(2863): n = any nucleotide
  misc_feature (2873)..(2873): n = any nucleotide
  misc_feature (2909)..(2909): n = any nucleotide
  misc_feature (2915)..(2915): n = any nucleotide
  misc_feature (2921)..(2921): n = any nucleotide
  misc_feature (2939)..(2939): n = any nucleotide
  misc_feature (2951)..(2951): n = any nucleotide
  misc_feature (3077)..(3077): n = any nucleotide
atggcacggggctctgctctgctcgacggcagtgtactgccgccttcccgcatcgtgaacgagaggcatgccggactgccgcgccgcttcatgccggagtccgccaccggtcgggagatagtgatgctgggcgaggggcgcccggcaccagactacccggngcggtccatcttcttcctccccttcgcaatggctgggctggtcccgccattttctcatttcttcatggatgtcctggagttctacgatctccagatggcgcanctcacccccaatgcggtgatgacattggccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacaccccccttgccgacgaagcgcgcctccgacttccaagccagcccccggcgcaggtctccagctggcgggcgccggtagatctgggggaggactacgacgccgtcctcgancgcctggcgggcctgcgatcccaggggctcaccggggccatggtgtacggcgattatctccgtcgccggattgcgccgctccaacggcgcgcccggagcgcctgggagtacactgggcctgaagactacatgcggacccaccagggaaccaagatgggattgggctcctgaggacttcaagatcgtagtccaaagggtgctgaaccttagctccgcggaggcgtctcgccttcctcaggagatcctccccctctgcagcgatcccgaccgcgtctccattctaaccattatgatgggggtcggggcctcagaggagagagcccctaagggccacgacggcgcgggcgagcgccgccggggggaacaacctgccccaggagggggtcgtgcttctgggccccgcgtcgggggctcggggagcagccgccctgccgacacccaggggaagaggaagctgggaggtacacctcccccatctcctccccgagggggcggggcggcgcgtgccagcagtcggcgcccggagggggccgcgccgacgtcgcagcccgagggggtgcgcaagaagaagcggctccgcaagacgggggagacggaaccatgccggggaaacctgatttcccctccaaggtggtcattcaaccgaccccctcgcaggttcgtctcactctcattgcaaccatctttctccaaaaagaagttttttcttgctcactttgttcgtcttctggctttttcttctgcttcagcgatgtcccgtcgcattcctcccgccaccccaagtccggccagtccgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcacttgggcccactccctcgggcggtcctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgcattttctccaaggcgncttttctcctcatcttccgtcgccccggtgagcgccgagcccattatgcaggccttggccgccgcaaacaccgcggtgctagatggatttagcgcccaggtggaggccttgcgagcggaacgagcggagctcgaggccgcatgggcgcgcgtcgaggaggggcggcgctcggtggacgccatggtggaggtgggccgtaaggctcacgccgccacatctcggagcttgaagcccgcaaggcggcgctggcggagatcgcccgagaggtggaggaggagcgagaggccgccctcgtcgccaccaccgcgatgntngaggcgcangacnncctccgccttcaacacgnnagctgggaggcggagctgaagaacaagctcgacgccgcccaaggggttctngactccgccgctgcccgagagcggcgggcaacggaggccgaagcggcgtcccggcggcgcgaggaggcccttgaggcccgtgccatggcgctggaagaacacgccggcacngtggagaanggcttcncggaccgcgaggccgccactgctctccgggagacgacgctggcggcgcacgaggccgcctgcgccgaggaggagtccgcgctccgccttcgcgaggatgcactcgctgagcgggagcgagctctcgaggaggccgaggccacgacgcaacggctggcgaacagcctctccctccgcgaggcggcgcaagaggagcaggcgcgccgcaacctngaatgcgtccgtgccgagagagccgcgctggagcagcgggctgccaacctcgaggcacgggagaaagagctggccgcgagggcgcnnatcggnggggcggctgcgggcgaaagcgacttagccgctcgcctcgcggctgccgaacacaccgtcgctgacatgcagcgcgcgctggattcntccatcggggaggccgaggccctncgcttggcgggcgagatngggcccgacatgctttggganncggtctcccgcatgnancgcgccggtcggcaagcgggcctctggnnaggccagncgnngntgcnccccaccaanctggaaggcctcgctccgcacctcaacaggatggcntgggtnctcgancaactccccgaggagctngagaagaccatnaagtcatcctcgagggacctcgcgcggggagcggtcgaactcgtgctggcgagttaccaggcccgggaccccaacttctctccatggatggcgctggaggagttccctcccgggaccgaggacgangcgcgcgcgcgcgtccgggatgccgccgaccacatcgtcaacggcttcgagggctcggcccctcggctcgcgttcgcccccagctccgacgaggagggcgatgccagcggtga

SEQ ID NO: 1051 - DNA, 2987 bp, Oryza sativa
atgtcgggcaagacagctctggcgggcacagaaccaacggtcaataaacctgacgggcaggacagctccgtcgggcacagaaccgatgtcactaacaatccccaacacgaaaaagatgtcgggaaggtaccggagtcgagcgaggaatcgtggcgcacactgagcgacccatttgagctagaactagcgcaattgcagtatgaaagacctgaggatgacccggattatattcctatcgagcaggcgaaaaaacgtggcgagaagggcaggaacctcatgtcgaaggagacgtactacattcttgctctcgacgatgacggcaaacccgtcgagccgcaacatgtaagggcgaagtttagcacctcatgcggtgcgctggcaaagcttcatgggcctctcaacgtggacaaatggaagcacgttagcattcacatcaagaacttaatgtgggaaggtctgcaggagcaccttatttatccgcctgggtcggaggcacttggccggaaatttgcactgcaaacaattgcccatcggtggtgacagtgaaagtcggacatgaacaccaattatgttcagaagaataagactccatttgaagaattgggcaccattttagcagctgagtgggacaagttcgtggccaagatgacaactcctcaagctctagaaaggaggaagaagatgtcggacctggcgaagaagaacatatatccacacgggttagggtcaagtggatacgccggtcacgagaagaaatggcaaactacggaagaaaagtttgcggccgaagacaaacctttgattgtgcagcccctaaataagcaaactagaaattgggtgtgggcaagaacttcggggcaagtgacagaagagggtgagatgctgttggactgtccggacatccagaacgtgaccacgtctctccaacaaatcgtccagaaggaagaccgggtgagttcgtccctcgacagcagcatgatgagctgactgaagctttgggaactgcagaacactccggtagggtcagaggaaagtcgtgcaggatgaattggaacgtagggtttccacaggaagcccaaagttacaagaagcgcgacgcctacaaggccaagatgcgccaggaaatcacagatcaagtcatacaacaagtcacccaacaattctacagtcttgccgcacaacatcctcaagccttccctgacctggttcctcatggttcgcagtcgacacagatcccaagctctgtcgggtcggtagaaaatacaacctacccgatagatagtataactggtccgacaccatgcagccttgtcgttccgatagggagagcgggaaaaacaaaggaggttgcgtctggattggcgataccggggagacagttccataacagcccaattccggcggactatgcaagggttcaggtcgcacgtgttaatggcgaccagatgtcattggagcttgacatcccaacaccagaggggattgaacttctcggggatgcggttagccagttaatactctagcatcgtcgtgacatcatcctcactggatagttcacgttgacgacaccagctccatcggtgccaattacggctgcacctcctgcaccgccgtcccctccgatctgcactaccccacccggatctccactcccacagatatcaccacttagaggtccttctccacctccacaacaagtagcacctaactccccaactcccctacctcggcagccgtctcctgctcctcagtcgtatcttgctctaccccttgacgaacatgtgccacctccacagccagatacatcaaaggagcagccaaaaacctgtgaagcccgcaagctcatacccattatggtatccgcatacaacaaggaaaaaatggtagagtataagacacggatggttttgcaatctttcaagggtcgagggggtccgctaaagccaattggaccttatcagtattcggacgcacagatgagcgttgtaggtcttactgacaaaatgcaatcttggacctccgatgaagtgcctaaggagtatgaatatggcaagccgtttttgccgttcaacttgatgtgtgaactcccatggccaatgaggttgatgcatgagtggtacttgagggcaagtgagttaggtctcgggatgattactgtgcatgtcccggaaggcgctttcaaggatggacctaacgcaaacttcgccttcagtttcaaggacctccacgcattctttaagatggataaaatgaatatcaatctcgtcggcgcatggtgcctgttagcattccatgctgaaagaaccggggcctcaatcggttacgtaaatccaacgatggtttgcgagacggcccacactgtgcggatatcggaggatagtgcggtactaaagaataagacacctcaggagaaaaatgattacatcaagcgtctgcataagagaaagatggccgaggtgggaaattacttggccacctcatttctcgcacattccgacaaacgagtcatcatggtcccctaccactttggcactacatactattcctcgtctatccaatggaccaaaccgtcgtagttcttgatccggcggactatgacaaggacgcgtacatgaagttcctatgcttgttgaacttctatgcttgttgatctttgttataagcaacctagcttgacgaacctatacggttattacgtgtgcgagatgctcagggttaatgggagatacagaactgagtttacagatatagcacaagccgggttcgatcagaaaacgcttatcaacttgtgcgcggacttgtgccggttcattcgtcgcgacatctgcaatcatctaggagagttccatgatcctcatagcgaacttgctacggaccccaaattcaagaatctaagagagtgggagaggcaacatgctgtggactaaatggatgtatttgtcgcgggggatacttgtaataaacactatactttctatgtaatatga

SEQ ID NO: 1052 - DNA, 2981 bp, Oryza sativa
  misc_feature (381)..(381): n = any nucleotide
  misc_feature (699)..(699): n = any nucleotide
  misc_feature (969)..(969): n = any nucleotide
  misc_feature (1119)..(1119): n = any nucleotide
  misc_feature (1200)..(1200): n = any nucleotide
  misc_feature (1339)..(1339): n = any nucleotide
  misc_feature (1380)..(1380): n = any nucleotide
  misc_feature (1571)..(1571): n = any nucleotide
atggcacggggctctgctctgctcgacggcagtgtgctgccgccttcccgcatcgtgaacgagaggcacgccggactgccgcgccgcttcatgccggagtccgccaccggtcgggagatagtgatgctgggagaggggcgcccggcaccagactacccggggcggtccatcttcttcctccccttcgcgatggctgggctggtcccgccattttctcattttttcatggatgttctggagttctacgatctccagatggcgcacctcacccccaatgcggtgatgacactggccatcttcgcgcacctgtgcgagatgttcattggggtgcgcccctctcttcagctgttccggtggttcttcaccgtgcagtcggtgtcnccgccgtcggtggttggcggctgctacttccagccgcgggggccggtgctgaaccgctatatcccctgcgtcctccgcaagaagtgggacgactggaagagcgactggttctacacccccctcgccgacgaagcgcgcctccgccttccaagccagcccccggcgcaggtctccaactggcgggcgccggtagatctgggggaggagtacgacgccgtcctcgaccgcctggcgggcctgcgatcccaggggctcaccggggccatggtgttcggcgattacctccgtcgccggattgcgccgctccaacggcgcgcncggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatcgatcccgaccgcgtctccattctatccattatgctgggggtcggggcctcagaggagagagcccctaagggccacgacggcgcgggcgagagccgccgggggggncggcgcccggagggggccgcgccgacgtctcagcccgagggggagcgcaagaagaagcggctccgcaagatgggggagacggaaccagcccggggaaacctaatttcccccccaaggtggtcattcaaccgaccccctcgcagcagagangtcccgtcgcattcctcccgccaccccaagtccggccagttcgaggccgaagatccagcggccgcagaggagcggaggcgngagtctgaccggcgtgaagccgcagcccgccttcgggaagctgaagaggccgcccgggaggccgcccgggttcgccaagcggaggaagctgctcgggaggaggccgcccgggcaggaggaggccgcccgggctcgccangctgaggcggcagctgctgctggcgcgtcactcgggcccantccctcgggcggccctcaggcgacatcctccgaggcggctcgcgacgaggccgcgggcgcgtcgcctgggcctacctccgggcgacgcccaggaccaaacgggcccgggggacatccccgagctcagcgtatcctccggggggccaagccgcgtcgctttttctccaaggcggcttttctcctcctcttcngtcgccccggtgagcgccgagcccattatgcaggccttggccgccgcaaacaccgcggtactagacggatttagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagctcgaagcccgcaaggcggcgctggcggagatcgcccgagaggtggaggaggagcgagaggccgccctcgtcgccaccaccgcgatggtcgaggcgcaagacaccctccgtcttcagcacgcaagctgggaggcggagctgaagagcaagctcgacgccgcccaaggggttctcgactccgctgccgcccgagagcggcgggcaacggaagccgaagcggcgtcccggcggcgcgaggaggcccttgaggcccgtgccatggcgctggaagaacatgccggcgccgtggagaggggcttgatggaccgcgaggccgccactgctctccgggaggcgacgctggcggcgcacgaggccgcctgcgccgaggaggagtccgcgctccgccttcgcgaggatgcactcgccgagcgggagcgggctctcgaggaggccgaggccacgacgcgacggctggcggacagcctctccctccgcgaggcggcgcaagaggagcaggcgcgccgcaaccttgaaagcgtccgcgccgagagaaccgcgctggagcagcgggctgccaacctcgaggcacgggagaaagagctggccgcgggggcgcgcatcggtggggcggctgcgggcgaaagcgacttagccgctcgcctcgcggctgccgaacacaccgtcgctgacatgcagcgcgcgctggactcctccaccggggaggccgaggcccttcgcttggcgggcgagattgggcccggcatgctttgggacgcggtctcccgcatgaagcgcgccggtcggcaagcaggcctctggggaggccagacgacggtgccccccaccaatctggaaggcctcgctccgcacctcaacaggatggcttgggttctcgagcgactccccgaggagctcgagaagaccattaaggcatcctcgagggacctcgcccggggggcggtcgaactcgtgctggcgagttaccaggcccgggatcccaacttctccccatggatggcgctggaggagttccctcccgggaccgaggacgaggcgcgcgcgcgggtcggggatgctgctgaccacatcgtcaacggcttcgagggctcggcccctcggctcgcgttcgcccccagctccgacgaggaaggcgacaccagcagcgaggacggcggtggcgacgaggccggcgaccctttgccagtccggccgggggcttag

SEQ ID NO: 1053 - DNA, 2959 bp, Oryza sativa
ggaggtggcacaataagtgcttgcggaggggatggtttggctgggggaggtggtgggcgtgtttctgttgatgttttcagtaggcatgatgactcccaattttttgttcatgggtgggaggagctcaggttgtctggacaatgcaggtgcagctgggactctttatgaagaagtgcctaagagtattactgttagcaacaataacttgagcacacaaactgatacagtttttctagaacccccatatgatccactctggacaaatgtttttatcaagaatcatgccaaagtttctcttcccttgcgttggagtcgtattcagcaggctcaaggacaaattagccttctatctcgcgctacattaacttttggcttgacacactatccatattcagagtttgaattgttggctgaggaacttcttatgagtgattctacaattaagattcaggtgtttggtgctttacgaatgtctgtaaagatgcttcttatgtggaactctagaatgttgattgatggtggcagagagtcaggagttgcgacttctttactagagggtagcaatttgatagtgttgaagtcatcagttatacattctattggcaatcttggaattcatggtcaaggcatcctgaatttatctggagatggagatacgattcaggcgcaacgtcttattttatcacttttctacaacatagtggtaaaccaaagctgaactgtgaagatgagagttgtcctatggaaatctttcatcctcctgaggattgcaacctgaacacttcattgtcttttaccctacaggacattgttgtttctggccttgtgcaaggaactgttattaatttcaacagagcaagaaatgtcactgtgagatcatctgggaccattagtgcaacaggattaggtaatgggttctttggagcaatctcttccactactctcccttgctggttcaatagaggcgaatggtggcagttttgctggtgcggtgactcatgctgcaaatgaaggacctggtggtggttccgggggcacaattcttctatttgtgagggcattgtccttggaggagggctctgtactttctagcgctggtggggttggaagtaatggtagtggcggaggtggaggtggccggattcacttccactggtctgacattcccactggagatgattatattccctttgcaacagttaatggatcaatacttgcaagggttttccgggtgaaaatggaacagtgacaggaaaagattgcccaaaaggtctttatggcacattttgcaagtgtcctttaggaacatataagaacattactgggtctttgaagtccttgtgttctccatgccctacaaatgagctccctcatcgtgctgtctacataagcatccgagggaggtgttactgaaaccccgtgcccatacaaatgtgtgtccgatagataccgcatgcctcactgttttactgctcttgaagagttaatatacacttttggtggaccttggttgtttggtctgtttctctcaggccttctttttttattagcccttgttttgagtatcgctcggatgaagtttgttggcactgatgagttgcctggaccagcaccaactcaacatagctcccaaaattgatcactcttttcccttcctcgaatcactcaatgagctggaaaccaatagggccgaagaatctcactgtcatgtgcacaggatgtatttcatgggtcccaacaccttcagtgaaccttggcatctaccacacaccccacctgagcagatttctgagattgtgtacgtcgatgagataaatgctctcgcagcatatcagtggtgggaaggatcaatttatagtatcctgtgtatactttcataccccttggcatggtcttggcaacagtggcgcagaagaagaaaattacaaagattacgtgaatttgttcgatctgaatatgatcattcatgtttacggtcttgccgtcacgtgctctttatgaagggctgaaggttgctgctacaccagatttaatgctgggttatttagatttctttcttggtggggatgaaaaaaggcctgacctcccccctcgtcttcatcaaaggttgccaatgtcattaatctttggaggcgatggaagttacatggctccattttcacttcacagtgacagtgtggtcacaagtcttattagtcagtggcaccgccttgttgctggattgaacgcccagttgcgtttggctcgtcgtggaaatctaaaagccacatttcttcctgtactcaaatggcttgaaactcatgcaaatcctgctttgaacacataccgcgtgcgtgttgaccttgcatggttccaagctacagcactaggttactatcaatttggtctagttattcattctgtgggaccattcagtagtggccttcaagctcaaggacaagagagatttattttaccctctttctcttatattgcacaataccaaaccagttgggcatcagcaggatcttgttggtttggtgatctctatattgcttcttgcagatttcagcttagtattgcttacttttctccagctatattcatattctatgatcgatgtgttgttagtgctgtttgttcttcctcttgggatactggcaccctttcctgctgggataaatgctctatttagtcatggaccacggcggtcagcaggtcttgctcgtgtgtatgcgctgtggaatattacatcattggttaatgttgtggcctttgcgtgtggacttgtgcattacaagtcttcagccaaaaggcatccaagcatgcaaccttggaatttgggcggtggtggctgttcccaacaggacttgtgttatgtaaatgcatccaagcaagacttgtcgattggcatgtctctatcttagagatccaggatcgtgcagtttatagcaatgacccaaccatattttggcagtga

SEQ ID NO: 1054 - DNA, 2748 bp, Oryza sativa
atggcggcgtgcgggccgtggggccgcaaccggagggtcggcgccggcgacgcgttcgaggccagcgaggtgaggcgggacgggcgcagcaggatgatgcccgcgtgcgggccgtggggggcgggccatggcggcggggacccggcgctcgagagggagctgtcgcgggacggcagccactacagcatctccagcgccatcctcccgtcgctcggcgcgcggagcaaccgccgcatcaagctccgccgcttcatcatctccccctacgaccgccgatacagagaatctgggagactttcctcatagttcttgtagtctactctgcgtgggtctcaccatttgaatttggcttcattccgaagcctacgggggctctagctacagccgacaatgtggtgaatgcattcttcgcggttgacatcattctgaccttctttgtggcttatttggataaaatgagctatatgcttgaagatgatccaaagaagatcgcatggcgttatagtaccacatggcttgttcttgacgtggcctccaccatcccatcagaatttgctcgcaggatactaccttcaaagcttaggtcatatggatttttcaacatgcttcgtctgtggcgtctccgcagagtcagctctctgttttctagttttctaggttggagaaggatagacacttcaattacttctgggttcgatgtgcaaagctcatttgtgtcacactttttgctgtgcactgtgcggcatgcttctactatcttcttgctgataggtaccccgtcccaacttctacgtggattggcaattacatggcagatttccatgaacggagcttatggattcgctacgtaacatcagtctattggtcaatcaccactcttaccaccgtgggctatggggatctacatgcagaaaatacaagggagatgatcttcaacattttctacatgctctttaaccttggtttgaccgcttatttgatcggtaacatgaccaatttggttgtccatggcactagtcgtactcgaaactatagggatacaatccaagcagcaacaagctttggagtaagaaatcagctaccacctcggctgcaagatcagatgatttcacatattagcttaaaatacaggacagattcagaaggtcttcaacaacaagagatccttgattcactgcctaaagctattaaatctagcatttctcaatatctgttcttccatctggttcaaaatgtttacctgtttcaaggagtctcaaatgatctgatttttcaactggtaaggatagagttctttctgtagctgtgtttttgtagttgcgtactgttacagaatggtttcggagatgaaagctgaatattttccacctagggaggatgtgattttgcagaatgaagcacccactgacttctacatcttagtttctggtagtgtgcaggtgatacaagtggctacgtcaggagaggttgttggagaaattggggttctttgctacagacctcagctattcacagttcgaacaagatccttgtgccagttgttgcgtttgaatcgtacagcttttctcagcattgttcaatccaatgttggggatggaactatcataatgaacaaccttattcagctgatgcagttccttaaagagcagaaggagaacagtgtaatggctggtgtcgtaaaggagatagagagtatgctagctcggggaaatctggatttgccaattacactctgttttgcagtaactagaggagatgattttttgttgcatcaacttcttaagcgtggtatggatccaaatgagtcagataatgacgggcataccgcactgcatatagctgcttccaaaggaaacgagcaatgcgtcaggcttctattagaatatggagctgatccaaatgccagaggactcagaaggaaaagttccactgtgggaagcgctgtgtgagaagcacgccgccgtcgtgcaactattagtcgaaggcggcgcggatctgtcgtcgggtgacacgggcttatacgcttgcatcgccgtggaggagagcgacaccgagctgctcaacgacatcattcactacggaggcgacgtgaacagggctcgccgggacgggaccaccgccctgcaccgcgccgtctgcgacggcaacgtccagatggccgagctcttgctggaacacggagccgacatcgacaagcaggacggcaacggctggaccccgagagccctcgccgagcagcagggccacgacgacatccagctcctgttccggtcgctgatcgggaggttcaacagcgagcccatgatgaagaacatgatccacgaagacgccgacctgcccagccgggttctccccgagaagctccggaggaagcgggtcaccttccagaactccctcttcggggtcatctcgtcgtcgcaggcgcagcgggagaccgaccacccgctctcgaggggtggcctcgcggcgacgggctccccgaacccgagcagcggcagccgcaacgccgtcatcagggtgacgatcagctgccccgagaaagggaacaccgccgggaagctcgtgctcctgcctcagacgctggacatgctcctcgagctcggcgccaagaagttcgacttcgcgccaaccaaggttctcaccgtggagggcgccgaggttgacgaggtggagctcatcagagacggcgatcatcttgtgctcgtcagtaatgaatgggatgcagagaagatgaaaggcaagagctag

SEQ ID NO: 1055 - DNA, 2730 bp, Oryza sativa
  misc_feature (121)..(121): n = any nucleotide
  misc_feature (211)..(211): n = any nucleotide
  misc_feature (2179)..(2179): n = any nucleotide
  misc_feature (2332)..(2332): n = any nucleotide
atggcgagtgcccctctcctctcgtggacccggcaagcgctcccagtcgctgacacgggttcggtgctcgccggcggtggcgctggcgctcgtcgtggcggcggcggccgcggccgcggcnacggcgaagctgtacagcccggcggacaggatcctggtgaactgcgggtcgacgacggacgggctggacgcggaggggcgcaggtgggtngcggacgcgacgaacgacacgtggctgacggactccggcaagtcttcgatcatggcggccgccgacgagctggagacgatgctgccgtcgtccatcccctacatgacggcgcgggtgtttaccatggacacggtgtacaacttcacggtgaacccgcgcgaccgccactggatccggctccacttctacccgtcgtcgtacaacgggctggagccccaggacttccggttctccgtcttcaccaccacgggatacacgctgctccacaacttcagcgtctacttcaccaccaaggcgctcacccaggcgtacctcatcagggagtactcgctgccgcgtgtcccggagggccacttcggcgtcaccttctcgccgtcgcccatgatgaacgtcacctacgccttcgtcaacggcatcgaggtgatctccatgccggacatgttcaacaacccggccaccatggtcggcttcgccgaccagaccgccgacgtctccgccgccgcgttccagaccatgtaccgcctcaacgtcggcggcgcctacatcccgccgtccaacgactccggcctcacgcggccgtggtacgacgacacgccgttcgtccagggccccctgcgcggcctcgtctacaacgccggcccgcacttccacatcaagtaccccagcgacgccgccgagtacgccgcgccgccggaggtgtacctcggcggccgctccatgggcagggaccagcgcctcaaccagaactccaacctcacctggagcctccacgtggagtgcaacttcacctacgtcgtgcgcctccatttctgcgagctccagctcatccacggcaaccagcgggtgttcgacatctacatcaacaaccggacggcgcagacggacgtggacgtgctggagatggcgacggagcgcggcgtgccggtgtacaaggactacgcggtgaggctgagcaacgacaccgccgacgagcatctgtgggtggcggtgcacccctcggtgatgctccgcccgcagttctacgacgccatcctcaacggcctcgaggtgttcaaggtgaacaacaccggcggcagcctggcgtcgccggaccccgtcccgtacaagctgctcgcggagaaggagctcggctggggcgggccgccggagttctccaccgacaacccggccaacatggcgtcggtgatgggcggcacggcgggcggcgcggcggcggccgggatcgtggcggccatctgcgtggtggtgtacagcaacaagaggagcaagaagctgggcggcggcggcgccgactcgcacacctccgcgtggctgccgctgtaccactcccacaccagcggcaagtcgtcggggcacatcacggcgaacatcgccggcatgtgccgccacttctcgttcgcggagatcaaggcggcgaccaagaacttctccaacgacctggccatcggcgtgggcgggttcggcgtggtgtaccgcggcgtggtggacggcgacgtgaaggtggcggtgaagcggtccaacccgtcgtcggagcaaggcataaccgagttccagacggaggtggagatgctctccaagctccgccaccgccacctcgtctccctcatcggcttctgcgaggaggacggcgagatggtgctcgtctacgactacatggagcacggcaccctgcgcgagcacctctaccacaacggcggcaagcccacgctgtcgtggcgccaccgcctcgacatctgcatcggcgccgcccgcggcctccactacctccacaccggcgccaagtacaccatcatccaccgcgacgtcaagaccaccaacatcctcgtcgacgacaactgggtcgccaaggtctccgacttcggcctctccaagtccggccccaccacgctcaaccagtcgcacgtcagcaccgtcgtcaagggcagcttcggctacctcgacccggagtactaccgccggcagcagctnaccgacaagtccgacgtctactccttcggcgtcgtgctgttcgaggtgctcatggcgcgcccggcgctcgacccggcgctgccgcgcgaccaggtcagcctcgccgactacgcgctcgcctgcaagcgcggcggcgcgctgccggacgtcgtngacccggcgatcagggaccagatcgcgcccgagtgcctcgccaagttcgccgacacggcggagaagtgcctctccgagaacggcaccgagcgccccaccatgggcgacgtgctctggaacctcgagagcgcgatgcacttccaggacgcgttcgacgccgccgccggccgccccgtccccgcgctcgacgccgccgccggcagcagcagccacctcgacgacgggagcacggccagcatcaacacgctggccacgtcgtccacgtcgcacccgcacgagccgtgcgtcgacgttgtcttggagcccgacgacgtcgtcgcggagcgcgccaccttctcgcagctcgtccagcccaccggccggtgacagtgacaccactacggcactaccacaagtga

SEQ ID NO: 1056 - DNA, 2626 bp, Oryza sativa
atggggagcgatctgaaggagatgaagtacaggcggaggattgggctcgacgagcgggcgcaatgcagcgagcagagggcgctcgactggcacgcgctgaagcaggacccagtggagttgctccgcaagctggacgagctgagggagcagatcacgaggacctgccagatcgtcgagccgccgcgggagcaccgtcgggcgggccgacgagcgctctcgctgctccctgagaaccctgagccgccaccaatgccagggtatcaccgctcacgctatggtggtgggcggtatgggcacggcttgccgccgagcccctacgagccgctgcgccctgagattggggagaggtactccagacagtcaagtgggcggtatcggcagtatcaagggaggcaatgggatggctgtggagttggacatgggaattacaatccttcttatacatgttcctgtccgcattgtctacatggacagagaactgcaccacaagaagagcacattccaatggcgagatactttgctgggcagcatgagtgctaccggtttgaaaggtcgccatctgtctcatcggactatgaccggaggtccgtagcatcatcattgtactcgcatcggtcggtttcaaagaagagagcagagtatttccggaagaaggcagagcatctttgccgtcctgtttatggcgccgccccttttgttgtgtgcagttcttgttatcagctgttgcaggttccaatggaaaagtgtatgggaggaatcggctgcagtgtgggtcttgctctcagattgtcagtttgaagcgtgaggagaaagttatccccttctcaccatcagcatccttttgtgtgcccaaaattgagcaaggttcaaatgatcaaactaggcgagattttgagcaccagctcaatgagtttgccaattctgccttttataatttgaatgagcatagcagcatgcaaatcaacatagactttggtgatgatcattcagtttcttcttccattagtcatgacaggactgagaaaggatgtggatcaagcaggagcattcagttaaaaacagatgggctcttgttgtctccaagcagatctggagatattgagagcccgaaggatatattatgcgaaagagatgctgaatgtcaggtagaaccttcagatgctcgagtcagcccatgttccccagttttagaggacaaacttgttgatccattgtgcagccaggaaaaggataataatagtgaggacctaggcatggctaatatatctgatgtaaattgcaaaggagaacacaaagttaatgatgatgatgatgggagtcttagtatgggaagtgaacagaagagaaaggaatgcgatgaagattcccttgtagatgaaagcatgtgcaaaacccatgaacagaagagcaaggacgatcactctagccctgaagatgttagcaaaactcatgaatttgatagtacaaaagataatattagcagtgctgtagatggaaatgaaaagcatgagtttgaaagcaaaaaagatgataccaatagtcttgaaggtgaaagtttgaacaaggaacatgagcaaaagagcaaagaagacgaaaatagtggccttgaaggtgagaatgttaagaaggggtttgacaaaaacaacaaagaaagtgaaaatagtgcccttgaagaatgccaatgccccccttgaagatactagaaatgcctctgatgcggcaagcttaagcgagatatctgaagaaaagaaaacagaggaagaaaatggaagtttggaccagccttttgttgaagatggcaatgcctttgcagagagtgggggatcatcatttaatgagcgtacaaattctggttttttcccgtggttcttctgagactgcattagaagaagatcagccctcaactggaaagagtggggattcgtcattttttgctggtttcctgaagaagggtttcaaggacctttctttatttaatcagtccatggacagcgttaaggtttcaattaatggccatcctatctctgaaagagctcttaagaaggcagagaaaaaagctggtcctgttgagcctggctcgtattgaggtacgactaccgtgctgggttttggggtgtcatggggcgagaatgtatcggcattatccctccattcataagagaattcaattacccgatggccagtaactgtgctagtggggatagtggtgttttcgtgaatggcagagaacttcatcagagagatctagatttgcttgtaggaagagggcttccacgcatctctggcaaatcatattctgtagagatttctggaaatattactgatgaagaaactggcaagaagctacgcagtcttggcaaacttgctcccacaactcgagctaccttaagtggtctgtgttgccgcgcggcaattggctcgccgcgcctcacaagtcatccactaacactgatttctactacaccagacaagacagagtgcggttcgactcggaggtccgaatcctcgattttgcctccgctacagatgttacactgcgatcgtacattgcgagtgaaataaagaactgcaataatcaagaacggagaaagtacgccggtatggcatatcctatttactggtataa

SEQ ID NO: 1057 - DNA, 2569 bp, Oryza sativa
  misc_feature (726)..(726): n = any nucleotide
  misc_feature (785)..(785): n = any nucleotide
tggaatatcgccttcaatttctccactgatcccaccttcctctccaactgcatgcaggccaccgatggtacgcgtgtgtgcaccgccgctgagatgaagttctactttgaaagcttcctcgacagcaatggaagaaagaactacgtgaggcccaacaagaactgcaacctcacatcatggatggatggctgtgaggctggctgggcatgcagtgcaggcccggaccagaatatcaacttgcaggatgccgtcaacttcccttccagaacacttgattgccgaggctgctgtgctggattcttctgccctcacggcctcacttgcatgatacctgttgatcatttacaacttctcagggcaacttctgaccaaccgagagaaaaagcaagcaaaatctagggaggctgcagcaagacacgcaaaagagactgccatggctcgtgaaaggtggaaatcagctaaagatgttgccaagaagcacgccgttgggctgcagtcatcgctgtcccgcacattctcgcgcaagaaaactcttaggacacacgagccatccaaaggagcggttgaaactgatgtggagccatcgaaaggatcaggagaaaagaagagtaatcttactgacatgatgcgctcgcttgaagagaacccggaaaaaggagaaggcttcaatgtggaaataggagaaaaaaagaaaactaaagggaggcatgcacacactcagagccnaattttcaagtatgcatatggacagattgagaaggaaaaggcaatggaacagcagaatnaaaatctgaccttttcaggtgtgatatctatgggcaccgatgaagatatcaggacaagacctagaattgagattgctttcaaagaccttactctaaccttaaaggggagtaagaaaaaactgttaaggtctgtgaccggaaagcttatgcctggtcgggtagctgctgtgatgggcccatcaggtgcagggaagaccacattcttgagtgcaattgcaggtaaggcaactggatgcgagacaacaggtatggtacttatcaatgggaaaatggaacccatccgtgcgtacaagaaaatcattggctttgtcccacaagatgacattgtccatgggaacttgactgttcaggagaatctttggtttaatgcacgatgcagaggctttctgctgacatgtcaaaagctgacaaggttcttgttgtggaaagagttatcgaggctttgggactgcaagcagttcgtgattctttggttggaactgtcgaacagcgtggcatctctggtggccagcgtaaacgagtaaatgttgggctagaaatggtcatggaaccctctgtgttgattttagatgagccaacgtctggtttggacagctcttcgtctctgcttttacttcgtgcactacggcgggaagctcttgaaggtgtgaacatctctatggtggttcatcaacccagagctatacattgtataagatgtttgatgatttgatacttctcgcgaaaggtggcttgacggtttaccatggacctgtgaagaaagtggaggaatacttttcaggattggggattgttgtcccagatcgtgtgaacccgccagactactacatagacatcttggagggaattgtgaagccaaacgcaaatgttgcagttaatgccaaagatctccctctgcgatggatgctgcacaatgggtatgaagttccacgggatatgctgcagagtggttctgatgcagaatcgtcgtttaggggaggaggggatcttacccctggcggtgacactgggcagtctattgctggtgaagtgtggggcaatgtcaaggacatagttgggcagaagaaggatgagtatgattacaacaaatcttctcaaaacttatctaatcgatgcactcctggcattctcaggcagtacaagtactacctggggagaagcaaaggctccgtgaagctagaatacaaggcgttgactatctgatcctgggccttgctggtatatgtctagggacattagctaaaagatcattctctctggagaagatacactactggagggagagagcatctggaatgagctcgttggcgtacttcatgtcgaaagacacaatagatcacttcaacacgatcatcaagccgatcgtttacctgtccatgttctacttcttcaacaacccaaggtcgtcgatatgggagaactacgtagttcttgtggcgctggtgtactgcgtgacagggatcggctacacatttgcgatattcttccagccaggatcggcacagctgtcagcgctgcttccggtagtgctgactctgatagcaacgcagcagaaggacaccttcttcgcgaacctgtgctacaccaagtgggcgctggaagggttcgtgatcgcgaatgcgcagaggtactcgggcgtgtggctcataacgcgatgcggctccctcctcaagagcggctacgacatcaacgacaggttcctctgcattctcgtcctcgccgccaacggtgtcctcttccgctgcgtcgccttcttctgcatggtcatcttccagaagcactga

SEQ ID NO: 1058 - DNA, 2538 bp, Oryza sativa
  misc_feature (324)..(324): n = any nucleotide
atggctcttccaggccgcctcctcctcctctttctcactgccgcacatgcagccctgcaaacatgcggtggtgaccaaacccctggccccgttgcaaatgtatccagggtctggagcagcaatacctctagagacgtgctcctctgctctgtcccaggcaatggcaacgagaaactgtccttcgctgccggcttctactgctcctccccttgcgacgccatcctcttcgccgtctacatcacctcaggctccggcgatatccctgtggtcgtgtggtctgccaaccgtgaccttgcggcacaccagaacgccaccctgagcttnaccgccagtggtgatttggttcttgcaaatgcagatggcagcgttgtctggtccaccggcacctcagggcagtttgtcattggaatgaccatcaccaactctggcaacctggtgctatttaatgatgcctacatgccggtgtggcagtcgttcgaaaatccaacagattctttgctccctgggcagatgctagcggagggaatgatgttaaggcccaacagctctgccaccaactggactacaagcagacagttatatttcactgttcggtctgatgggctctatgcgtttgccggatctgaccaacctcaaccatactatcggtttgagttttattcgtcatatctggttaaaaatgaaagcatcacacagtatcagtacaaaccaacctttgtgactctggtgaatgggagcctatcaatccctggatctgatccactggagaccaaattgccacctgcacactcacttcagtacttgaggtttgagtcagatgggcatctcaggctatatgaatgggaagagttcaaacaacgctgggtgatagcaaaggacatctttgagttaaactactgtcaatacccaactgtttgtggggagtacggcatctgcttaagtgagggctgctccactgagggcatggactgctcgactacggagtgctcctgtcccaataccacatacttcaagccaattgacaacatgagacctactcttggttgtgcggtggaaactgagatttcctgccaagctatgcaagatcaccaactcgtagcaattcctaatgttacatacttccatctctggggcgatagccgtggtgcaccaatgaccgatgaagagagttgcaagaaagactgcttgagcaactgctcctgtaaagctgccttgtttagtttgtatctcaaccaaactcaggctttgctctatccggatctatctctttctatgtcatatctgaatacgtgttacttgctaccagaagtcctttcactgcaagcatatcttgatccaggctactactcaaaagatccggtaaacgctaggtcaacattgtacgtcaaggtgcagagtacacacctgcttcctccatcaaagaaaaaaaacacttttggttatgcaattggagcaaccgccgctgcactagtgacactcaccattatctcaatggtcatcaggaagaggtgtaatcgacaaagagctgatgaaagcgattttgcagacctgcctggaacaataacgaggttcaccttcaagatgctgaaagcagcaaccaatgatttcagtagcaagcttggggaaggaggatttggttcagtttttctaggaaaattaggcaatgagatggttgcagtaaaactgctggatcgagcaggtcaaggaaagaaggacttcttagcagaagttcagacaattggcaacattcatcacatcaatctggtaaagctgataggtttttgtgtggagagatcacacaggctcctggtttatgagtatatgcctagaggatcactagacaagtggatttattacttgcatagcaatgctccactagattggggcacgcggaagaggataatcaccaatgtcgccaggggtctgtcttatcttcatgacgagtgtaggcagagaattgttcatttggacattaaaccacataacattctcttagatgacagcttcaatgcgaaagttgctgactttggtctatcaaagctgatcgagagggagataagcaaagttgtgacaagaatgaaagggacacctggatacatggcacctgaatggctgacttcacaaatcacagagaaggttgatgtatatagctttggtgttgtggtcatggaaatcatcagtggaagaaagaacattgactactctcagtcagaggagaatgttcagctcattactttactgcaagagaaggcaaagaaaggccagcttgaagatctggttgacaagaatagtgatgaaatgcacttacacaaggaggaagtgattgaggtgatgaagcttgccatgtggtgtttgcagagcgatagcagtagaagaccatccatgtccgtggtggtgaagaccatggaaggagaaagggcggtagatgacaatttgggttataacttctttgatttgagccctgcaatatctgttccagttgagcagctcaacagttcattgcaccctgaagcatcaattttatctgcccctaggtga

SEQ ID NO: 1059 - DNA, 2496 bp, Oryza sativa
atgtcggctagcaaacaagctcattgggacgagattggaatcagccaagccttagccctcaccatagcaaatttggccaaggacgaacccctgatagctgctgccacctatttctggtccaacacccttaatgcctttctcttcaaccaagggccaatgaccccaactctgctggatatcatcatgctcaccggtttagatgtgacctcgtcggccaaccccatgaacttgaacaccaagagtactttcgagttcaagactaagagcattggaggctggtcaggatacattgcagcatacatgggcaaaggaccagttaccccaagagagcatgtagccttcctgttgatgtggctagaaaaattccttttctgcgggtcaagttgtggtcctacaaccaactggcagttcatagccgaggctctagaatcgaagaagcaatttcccttgggcaagatccttctcggctatctatatcaaatgttgaacaatgcatcagccaagatgattattagctcagtagtcggggcaggtggaccatggtggttattgcaatcctggctaaacctggtagtcatgaaagttgtcaatcggccatctgtgacggaagccgaatttccaaggttggagccgattgtggaagatgatggagaagaacgcactcattgtagatgcatgtcatacggagaatatgcctctatgccagccgatgcgggagcaaagctatcggctgaacttctaaaggactggttcttcagtttttatgatgggtttcagaaggatgcccgagtttggttcttctatgccgattcaatggactttgaactaccagctgatttcagatttgaagacatcaatcacgaaaaatttcagcaatctcgagaagtcttcactactgctatcagcccgtgcatcctccctgttggcatccatcaagggagaaatattcaagtctcctatgagttctatcatccaatgtcatcggctagacaactcggaatgggacagctgccgatcagcctgtactttgccgacaagatccagtgcagaggtgacatctcttcaaccttaatgatggatcggctactgaacatccccagacctccattaggcagcattgagaacataaagttggcaaggttcaggagccgggcacttgacagatggtggagtgaatggaagctgcacttgttccatcaattggcgtccatgtatatgatagacctgttccctgatgccattcctcagacaacagaatcttctcctcctcgtcggagtaatagtggcaaggacattgaatataccccaagtctaattccaaatggaggtggaccatctccctccgccatcggctataatgcccccaagacctcagcacttctccaagggctcatcagagaaccagccgatgctggcaagaagcgaaaaaccagatcatcggctgttgatattttagccccagctttaaagaagaaaactaaaccaaagaagaccacgccagctgatgatctgcctgttctagatccatccatcgaaaaggttccggatgaagaagtgattggagatgatgtcgatcaagccgcagccgaaataagtgacacagaaagaacaccatcggcttcacccaagcataccccttcaactccttctgctccagttcacttcctaagtaaaaagaaaaccgctgtaaggaagaaatcggctacatcaactcctaaaccggctgcaccagtggaatcaggtggccgcactccatcggctgcagacagtcatcatgttgaaggagaagaacaactagctgctcctgttattccagttttagccgatctgttctctttcgacataaaagattaccttgatgaaacagaacaagacatcaccagtaaagcaacagctcttctgcccgatgatgtaaagagaacgctcaaagacatctctcatcggctagaagcatcattggataacctggtaaccaactgtggaccgatccgggaaaggttcacagacatccaagctcttctcccagatgaactagctgacgctcttactccagccgtctaccttgagcaacaccagttcaagctggaaaaggccaggcagaggttagccgatcgccgggagcgcaaagctattgaagctacaattcagcacaatcggcagcttgtacacgtagagaaatccaagcttgatcaattgtccgagggcccgatcaaatcaaatatcaatcggcttgaagctcgcaagattgatctcatggcacaactccaagaatgcaatgctgagctggatctggagcacaagaagctagccgatctcccacaagccgtcgaagaacagaaggcaaagctaaaatcggctatcaagaacattgctgacatgaccaaatccttgaaagtcatccctggaaccgacgctcaagacgcccaagccatagaagaagtagatcagattaggcaaagggctatatcggctatccagggatatttgtctcagtga

SEQ ID NO: 1060 - DNA, 2403 bp, Oryza sativa
atgggcgtgcacctcatgaccgcccgccccaccacgccggcgcgcgccgccgccgccgtcgaggctccggtggtgcacggcaattgggaattatctgcttcttttctgttgttgtccgtttcgttttacacgtcatgggctcgtcatctcatgggtgtggtggttcaggcaggggaagacatggcttcacgctcgacgccttcgaagaggccgtttcaaaagaattcttcagagcaaaatggtcggggcaagtggcagaaaacaaagcacaattctttgcagcagcctcaactgatagtgcaacctggtgttcctattttccgcattctctgccctacttcaaaatctgggatgtcattggcaagggtggaggcatcattgcaaagataaggcaagagactggagtaaaaatcagggttgatgaagttgtccctggttgtgacgagagggttattgtgataactgccattgataaggacagagaagttagtcatgtgcaaactaaggaaaacgacggaggtgtggcttgttctgttgatggcaaccatggaatggagaaggaccacactaaggaagaaaaggatgaaagtaacaaagaaatggatgattcagagaaaggccttggtaaggaagaaaaggatgatttagaaaaagatcatgataaggaggacagggatgagtcagggaaagacaatgataagaaagcagatgattcctctgttgcaaaagatacaaattctgagccagaggcgcagctggagctggagaagggaatgccattagccgtgaaggccattttgcttgtatttgaccggatttttgtaaatgaaatggaaaatggaacaggagatgcatctggtgagagaaatcatgtttcattgagattattggtgctagacagccaagtaggttggcttttgggaaagaatggtagtgtgattaagcaaatgtctactgacagctgttgtgaaattcgagtttcaaaggacaagcttccattatgtgctttaccccgagatgaactttgccagagattttgcatcagaaaatcattacatactcccttcatatatcatttcttcagatcactggagagctcgactcagtcaggaaaggtctgaatacagttgctcagttgctatttactcatcctcctaaggagagtgatgttcttggtgctcataattctggttcatctcgttcattcttcaatcaaccagatgttcttcctccaggaatgcaacctaatctccatctcccttttcaagggccaaatgttgctcatcttcccaattttcctgaagctctaatgcatggccatggctcagtcccacctgaaccccttacttttaggttgttatgctcaagtgacaaggttggaggtataatagggaagggtggaaacaatatcaagtctattcagaatgatacaggctgtgaaataaaggttcttgatactgttccaaaatctgaagatcgcatcgtatttatctcaggacctgcggcatccgggtgatggaatttcccctgcacagaatgcaattctgcatgtgcagcgtaaaattgtaccgacctccaacaccaaggagggtcctgcgatatgtaggctgattgtttcaccgaaccaagttggttgccttcttggcaaaggtggtagtatcatagctgaaatgaggaagctatcaggagcacatattatagtgctgagcaaagacaagatcccaaagggtgtcccagaaaatgatgaagttgttcagttcagattagtggggcctctgaagctattcaggaagctctaatgcagataactgcaagactgcggaaccatcttttccgggacagaatggcttcaacagtccctaatgtgcagccaccttttggtttggtggatcctcagtttggttcatatgcggaaaccatgattctatatctcctaggatttttcctaatgtgcctcagtttcataaagattttataggacgaccattggatgagatgtctgctccttggaccatgaaggtatcaatctatagggcatgcaggttgttggtgatccaatttcattgcctgatatcccaggaatggcgcatagaggaatgggtggatttcctggggcctggtcagccatctatcgtatcaaccataactgcagatgtcatggtcccaaaattagttttaccttctctatgtggggaagatggaggctgtttaaacagaattcgtgaggtagtgaccatggactggttgagttgctggtgatgatgattgtgtgggcaatgaagctagtgaccttatgtgttcatatttatgaatatgcgtgccctgtttgcagacttgcatatggtcgaagaggctaattatgctgaatagtgactaaatttcaacatgatggatctttgctag

SEQ ID NO: 1061 - DNA, 2305 bp, Oryza sativa
  misc_feature (102)..(102): n = any nucleotide
  misc_feature (104)..(104): n = any nucleotide
  misc_feature (111)..(111): n = any nucleotide
ccgccggagggggtgaagctgaacgagatcgtcggcggcggcatctccgggatcctctacaagtgggtcaactacgggcgcgggtggaggccgcggtggttngngctccangacggcgtgctctcctactataagatccatggtcccgaccgcatcgtcctctcgcgcgagaccgagcgcggcgccaaggtcatcggcgaggactccctccgccgcctctcccgaccctccacctcctcgtcttcctccgcgcactccaacggtcaccacctaccccgcaagcctatcggcgaaattcacctcaaggtgtcgtccgtgcgggagagcagatcggatgacaggaggttctcgatcttctcggggacgaagaggctgcacctccgggcggagacaagggaggacagggcggcgtgggtcgaggcgctgcaggcgaccaaggagatgttcccgcggatgtccacgagcgagatggtggggccaggggacaccgcagcggccgtggctgtctccaccgagcgcctaaggcagcggctgcagcaggaaggagtcagcgaggcggccattgctgacagcgaaaggatcgtgcgcaccgagtttgaggtcttgcacaagcagctcatgctccttaagcagaagcagacgctcctcctggataccctccgtcagctagagacagaaaaggtcgatttggagaatacccttgtagatgagagccaaagacagtcaaaagagtacggatccacttctagatcaaagaatgagaagtatagtgttttcagaaggaagtgctagtgaatctgatgattataatgaaccacaagatccagctgaagacgaaactgacgatgatgagaatatatattttgatacacgagatttcctgtcatcaagttcttttaaaagcagtggatctgatttccaaagatcagaagctggttcggatgatgaggatgattatccaatggatggtattgatacctctatgaaatccgttggaattagttacccatatgtcagaaggcgtaagaagctgccagatccagtcgagaaagagaagggtgtaagcttgtggtcaatgatcaaggacaatataggaaaggatctaaccaaagtttgtctgcctgtttatttcaatgaaccactctcatctttacagaaatgctttgaagatcttgagtattcctaccttattgatcgcgcttatgaatgggggaaaaggggcaatagtctgatgaggatccttagtgtagcagcatttgctgtttctggctatgcatctacggatggaagaagctgtaagcccttcaatccacttcttggggagacctatgaagcagattatccagacaaaggcctccgttttttctcagaaaaggttgttagtcaccatcctatggtggttgcatgccattgtgagggaactgggtggcggttttgggcagatagcaacctaaaaagcaagttctggggtcgctccattcaacttgatcctgttggtgtgctaaccttggagttcgatgatggtgaagttttccagtggagcaagtctcaggtgacaacttccatttacaatctcatattgggtaaactgtattgtgatcattatggtactatgcgaatacaaggcaataatgaatattcgtgcaagttgaagtttaaggagcagtcaattattgatcgtaacccacatcagcaggtacaaggtgttgttcaggaccgaagtggtcgaactgttgctacactctttgggaaatgggatgaaagcatgcactatgtgatgggtgattgctttggaaaaggcaagggatctgaaaatttctcagaggcccatttgttgtggaaaagaagcaaaccacctaagtttcccaccagatacaattttactcgctttgcaatcacattaaatgaacttaccgctggattgaaggaaaaactgccaccaacagactctagattgcgaccagatcagcgatgcctagagaatggtgagtatgaaagagcaaatgctgagaagttgaggcttgaacagagacaacgacagcaggcacggaagatgcaggagagcgggtggaaacctcggtggtttgcaaaagataaagctaccgacacataccgctaccttggtggttactgggaatccagagaaaagggcagctgggaaggctgtccagatatcttcggacaagttcctaacgatttgatgataactgactaggctttgagtaggttacaggtcttctggttctctgcttttattctttctgtgggatcacttgattccagattttttagcggtttatattag

SEQ ID NO: 1062 - DNA, 2141 bp, Oryza sativa
atggcgtcggccgccgccaacaacagtagctcggccgcctacgatgcggcggagacaggcggcctcctccgccgccgcaacaccaccgccgccgcccgcggcaatgcgggggaggaggaggaggaggcggaggcggtggcgccgtccgtggagcaggcgttcgcggacaagcccgtgccgtcgtggagggagcagctgacggtgcgcgccttcgtggtcgggttcctcctctccatcatgttcaacatcatcgtcatgaagctgtccctcaccaccggcgtcatcccctcgctcaacgtctccgccagcctcctcggcttcttcctcgtccgcctctggacggcggccatcgagagggtgggcttcctcaagcagcccttaacccgccaggagaacaccgtcatccagacctgcgtcgtctccgcctacggcgtcgccttcagcgtcaggtgggtttggcagttacttgtttggtatgagcgagaccatagctaagcaagcaacagaggctaatgatccgatgaatatcaagaatcctcaccttggatggatcatcgggttcatgttcctcgtcagttttgttgggctatttgcactggtgcccatgcgaaaggtgatgattgtggactataaactgacctacccaagtggcactgcaactgcttaccttattaacggattccacacacctgagggtgctgatcttgcaaaaaacaagtccggacattaggcaagtacttttcgattagcttcctctgggctttcttccagtggttctacactgctggggacaactgcgggtttagctccttcccgacatttggccttgaggcttttaagaacagttctattttgatttctcacctacctatgttggtgttggaatgatctgcccctatatcgtgaatgtgtctcttctcattggtggcatcatctcatggggcataatgtggccactcataagcaagaagaaaggaagttggtaccccgagacacttccagaaagtagtctacttggactgcaggcttacaaggtgttcataaccatagcagtaattcttggggatggcctttacaactttgtgaaggtcttcggctacacaatcaaaggcttcatagttatgtataagaacaaaaactcaaacacgcttcctatctccgacaatggcactcctgccaacgccactgaagaggagtcatttgatgacaagcgtcgcaatgaactattcctgaaggatcaaattcccaagacagttgcgattgggggctatgttgttcttgcagttataacgagtggttgcctccctctcattatcccacagctcaagtggtactatatattgattgcatatatatttgcacctataatggccttctgcaatgcctatggaagtggcctgacagattggtccctcgccaccacctacggtaagcttgcaatatttgtgtttggtgcgtgggcaggcgcttcgcatggtggtgtgcttgtaggactggctgcctgtggtgtcatgatgaacattgtgggaacagcttctgatcttatgcaagacttcaagactggatatatgactttagcctcgccaagatccatgtttgtcagccaggtgataggtactgccatggggtgtgttattgcaccctgcgtcttctggctgttctacaaatcctttaatatcggtgcaagtgatggtgcttacccagcaccttacaccattatgtaccgtaacatggcgattctgggtgtcaatggattatcctcattgccaaagtactgccttacactatgctacatagcctttgttgctgccttcatcatcaatctgataaaagacctggtaccagagagagtggcaaagtacatcccgatccccatggcagcagcaattcctttctatcttggaccatacttcgccattgatatgttcatgggcagcgtaattctctatttctgggaatggaggaacaaagatgaagcgcagtcgttcggtccagcagttgcgtcgggcttgatgtgcggtgatgggctatgggccctacctcaggctgttctttctcttgtcaacgtgaatcctccgctttgcatgaagttcttatcaagggctgccaatgccaaagtggatacattcctcggtaactaa

SEQ ID NO: 1063 - DNA, 2097 bp, Oryza sativa
  misc_feature (90)..(90): n = any nucleotide
  misc_feature (105)..(105): n = any nucleotide
  misc_feature (229)..(229): n = any nucleotide
  misc_feature (237)..(237): n = any nucleotide
  misc_feature (253)..(253): n = any nucleotide
  misc_feature (258)..(258): n = any nucleotide
  misc_feature (261)..(261): n = any nucleotide
  misc_feature (284)..(284): n = any nucleotide
  misc_feature (291)..(291): n = any nucleotide
  misc_feature (352)..(352): n = any nucleotide
atggcgaagtattggggccagcggctatggcggccgccggcgccggacgccgccacgaccgttcacctggcctccctcctccagtcgtgnggccgcgccggcganctccgccggggccgcctcctccacgcgcggctcgtgctctccggcgcggccgccggttcaactttcctcgccaaccacctcatcaccatgtactcccactgcgccgacctcgcctccgcgctcngcctcttngccgccatgccccgcngcaangcngtctcctggaccaccctcgtctngggcctntcccagaacctcatgcacgccgacgcgctcgccgccttcgccgccatgcgccgcgcgggcntcgcgcccacgcggttcgcgctctccagcgccgcgcgcgccggggccgcgctcggggccccgctcccgggcgcgcagctgcactgcgtcggcgtcaggctcggcttcgacaccgagctcttcgtcgcgagcaacctcgcggatatgtactccaagtgcgggctcttgtctgaagcatgcagggtgttcgaccaaatgcctcagaaggatgccgttgcctggacagccatgatcgatgggtatgccaagaatgggagccttgaggcggctgttttgtctttccgggacatgaaacgcgagggactggttggtgctgatcagcatgtgttctgcagtgtgttgagtgcgtcgggagggctcaaggatgggtggctcagcaaaagcatccattgttgtgtgacaaaggcagggtttgaactggaggttgctgtgaggaatgcactcattgacatgtacgctaagtccatggatgtggagagtgcctctcgcgtgctgaagattgaccctggaggttggaatgttgtatcaggcacctctatgattgatggttacattgagaccgattgtgttgaggaggcccttgtaatatatgttgaactgcggagacaaggagtcgagcctaacgaattcactttctcgagcatgatcaagggctgtgccatgcaggctctgcttgagcaaggtgctcaattgcatgctcaagtgatcaaaacggatttgatcagggactccttcgttggttccaccctagtggatatgtatgggaagtgtggccttataagtttgtccatgcagttatttaatgagattgaatacagaacagatattgcttggaatgcggtaatcaatgtattcgcacaacatggtcatggaagggaagcaatccaagctttcgataggatgatctatagtggtatcaggccaaatcacattgcatttgtcagcctgctcacagcatgcagtcatgctggattagtggatgaaggactcaagtatttttactctatgaaggaagcccatggtattgagcctaaagaggagcactattcctgtatcattgatacgtatggtcgagctgggagattagatgaagcatataagttcatatctgagatgcccatcaagcccaatgcctatggctggtgctctttgcttggagcttgccgtatgcgagggagcaaggagctgggggaggttgcggcacaaaatcttatgaagcttgaaccaggtaacactggtattcatgtgtccctttctgggatctatgcatccctgggccaatgggaggatgtgaaggcagtcaggaagttgatgagagatagcaggattaagaaacttcctggttttagctgggtcgattctaacaaaaaaacccatgtgtttggatccgaggattggtcacatccacagcagaaggacatatatgaaaaacttgaggaactcactacgaggataaaggaggaaggttatatcccggatacaagcttcttgccatgtaatttagaagacatcgcaaaagagaggattcttcgttatcacagtgagagaatagctgtagcttttgctttgataagcatgccagctacaaaaccaatcattgtgaagaagaatttgcggatatgtatagactgccacactgcattcaagttcatttgtaaggtagaaagaagggatattattgtgagagataattccaggtttcaccattttgtgaatggtaggtgttcctgtggagattactggtga

SEQ ID NO: 1064 - DNA, 2028 bp, Oryza sativa
gtacacgagacaagatcacgcacactagcggcttcccaagaagaagggaaggctgctccgaagaagcagaagacagaaagcaaagagcagtgaattctgcaaggccataagggaacacctcacgatcgaggacatgcgcaagatcctccaaggcaatgaacaggatgcatctggatcattttatgggcctcttgacaagtgccccgtatgcggtggtcagctcgagtgtaagggattgaaatacaattgcactgggactcacagtgagtgggcatgttgtagcttcagtactaacaatccttcgaggagaggtggtcctataaaggtccctgatgatgtcaagaatgatttcgtgcgcaagttctcgggcatgatgattgcattgtctggaaggatgtcacgctcacatattatgaagcatggagggaaagtcaacaactccgtgattgggtgtcacttgtgtagtggcttccccagctgagagacatcaaggagcgtggaactcctgttgtgagtgagaattggataattgatagcgtccagaagaaggaaaagcaacctttggctgcttatgatattgcatctgatgttgttccagaaggccgagggctgccgctgggcaaccttgatccaactgaggaggctatcgagaccttggctgcagagcttaaacttgcaggcaaaagagcagtgcacaaagattctaaactggagaaagacggaggacatatctatgagaaggatggcatcatctacaattgtgccttttctgtgtgcgatttaggaggcgatattaaccatgcattatgcagctgatcatggtgcctgagaaccatttgcacctatactacaagaagggtcctattggacatgaccagatggcagaggaacgggttgaagattttggtagtcgtttcaatgatgctatcaaggaatttgtccgtctttttgaggaggttactggaaatgagtttgaaccatgggagagagagaagaaatttaagaagaagtgtatgaagatgtatcccttggacatggatgatggtgttgacgtgcgccatggtggtgtggctcttcgtcagttgggagctgctgcagcacactgcaagcttgacccttctgttacttttatcatgaaacaactatgcagccaagaaatatactatgctttgacagagatgggccatgatgtgccagaccttcctatcgggatgcttacagatctccatctgaaaagagagagtctgggcctgctgctgacgcattctggatggagatcagcaataagtggttcaccctttggagactgttcgtgatataaatgtcgcttctcgtcttattggtgatgtgtttggttcaactttagatgacccactgtctcaatgctacaagaaactaggctgttctatcaatcgtgttgttgaagactcggaggactataagatgatcctgaaacctacgagcctgtcaaggttggcgatgtggtcgagcggatatatgctgttgaatcgagtgctcttccttcttatgatgaaataaagaaacttccgaacaaagttctcctctggtgtgggaacaagaagttcaaatttgctcaggcacctgcgcgatggtttcgtgcctgctgtctgccatataccagtgccgggatacatgtttggcaaagccatagtttgctcagacgcagcagccgaagccgcgctctacggcttcacggcggtggatcgtccggagggttacctggtcctggcggtggcatctctggggaaagagatccaggagataacaggcacgccaggctcagaggaggagaagaagatgggcgtgaagggagtcgggaggaagacgaccgacccgtcggagcacttcacctggagggacggcgtcacggtgccgtgcggcaagctggtgccgtccacgaacaaggacggcccgctcgagtacaacgagtacgccgtgtacgaccccaagcagctcgtgggcgtgaagtacgaggagcagaacatggaggtggtgccggacgagtga

SEQ ID NO: 1065 - DNA, 2007 bp, Oryza sativa
atggagcatcctcccttctttctgctccttgtgtcgcttggcttcaaccttatagccctttgtgccggtcaaaaccaattcatctaccatggtttcaccggcaaaaacctcactatcgatggcaccaccaaaatcacaccggaaggactccttgagctgactagtgacaagaatgatctcaatggccatgcattcttcccaacacctatgcatttccgcagttcacccaacagcaccgttcagtcattctcggtgaacttcatgttcgccatccagtccttctactccgatagaagctacgatggcatggcgttcttgatagccccaagcaacaatctctcgactgcgtggccagatgggtacctgggtctctttaacatcagcaacagagggaattcaagtaaccgcatcctcgcagtcgagctcgacacctttcagaacaatgagtttggggatatcagtaacagccatgttggcattgatatcaatgacgtccgctccgtgaattcctcctttgctggcttctatgatgacaagaacgggattttcacaaacttgactctgtacaatggtcgggctatgcaagtttggatggaatacagcgaagaggccacgcagatcaccgtgaccatggctcccattgatacaccaaagccgaagaggccactgctctatgccacctatgatctctcgactgtgctcacagaccctgtgtacataggtttttcagctgcaactggcgtaattagcacacgacatatcgtgcttggctggagctttggcatgggtgttccagctccggacattgatatcaccaaactaccaaagctacctcgtgttggaaccaagcctcgttccaatgtcttggaaatcgtcctcccaatagccagtgccatgttcatcatcattgtcggcaccatggtcattttgattgtgcggaggaagctactgtatgctgagctacgagaagattgggagattgattttgggcctcagcggttttcatacaaggacctgttccatgccactcaaggatttaagaataaaaacatgattggagtaggtggatttgggaaagtctataaaggagtccttgcgacatccaaattggagattgccgtgaagaagatctcccatgagtcgagacaaggaatgaaggagtttataacagagattgttagcattggtcgtcttcgacatcgcaaccttgtgccactacttggctactgtcgacggaagagtgaactacttttggtctataactacatgccaaaaggtagtcttgataagtatctacatgatgtagacaatagggctatacttaattgggctcaaagatttcagataattaaagatgttgcatgtggattgttctatttgcacgagagatgggagaaagttgttatacatcgagacataaaggcaagcaatatactccttgatgctgaaatgaatgggagattaggcgactttgggcttgcacgactatatgatcatggtactgacctacagactacacatgtggttaggaccatgggctacctagcacctgagatggtacagacaggtaaggcatcccctctcacagatgtgtttgcttttggcgcattccttcttgagaccacttgtggacaaaggccagtgaaacaaaactctcaaggcaaccaacttatgctggttgattgggttcttaagcattggcatgatggatctctcactgaggcagtggacatgagactccaaggtgattataacattgaagaggcatgcctagtcctaaaattagctcttgtgtgtttgcatccatttcctgcttcaaggccaaatatgcggcaggtaatgcaatacctcgacaaggacttgccacagccagagttagcaccaacacgtctaggtttcagcaagctacctttgatgcaaagcaaaggatttaacccatcagccatgtcatatccggagtttaggacaagcatcggcacattctctggcctctcaggtggacgatga

SEQ ID NO: 1066 - DNA, 1980 bp, Oryza sativa
  misc_feature (7)..(7): n = any nucleotide
  misc_feature (10)..(10): n = any nucleotide
  misc_feature (12)..(12): n = any nucleotide
  misc_feature (183)..(183): n = any nucleotide
  misc_feature (1193)..(1193): n = any nucleotide
  misc_feature (1239)..(1239): n = any nucleotide
  misc_feature (1272)..(1272): n = any nucleotide
  misc_feature (1274)..(1274): n = any nucleotide
  misc_feature (1281)..(1281): n = any nucleotide
  misc_feature (1284)..(1284): n = any nucleotide
  misc_feature (1290)..(1290): n = any nucleotide
  misc_feature (1374)..(1374): n = any nucleotide
  misc_feature (1383)..(1383): n = any nucleotide
  misc_feature (1675)..(1675): n = any nucleotide
atggcgncgntnacgccggacgagcacgagcggcagcaggacggccactgcagggccagggtgaacctgcggccggcggcggcgcggccgttcggcgcggcggcgcgggcggcgctgaaggacacgcttttccccgacgacccgttccgcgggctcggcgggatgccgccggcgcggcgcgcntggcggttggcgaggtacttcgtgccggcgctggactggggcgcggggtactccgcggcgagcttctggtacgacctcctcgccggcgtcaccatcgccagcctctccatcccgcagggcatcagctacgccaccctcgccggcatcccgccggtcatcggcctctattcgtgcttcgtgccgccgctggtgtacgcggtgatggggagctcgaggaacctcggggtggggccggtggcgacgtcgtcgctgctggtggcgtccatcgtcggcggcaaggtgagggcgtccgacgaccagcggctgtacacgcagctcgtcttcacgtcggccttcttcaccggcgtcctgcaggcggcgctcgggctcctcaggctggggatcctggtggatttcatgtcgcggccggcgatcaccgggttcatgggcggcacggcgatcgtaatcatgctgcagcagctcaagggcttcctcggcatgacgcacttcaccaccaagaccgacatcgtctccgtcctccgctacatcttccacaacacgcaccagtggcagtggcagagcacggttcttggcgtctgcttcctcatcttcctcgtcttcaccgagcaagtgaggcgacggcggccgaagctgttctgggtgtcagcgatgtctcctctgttagtggtcgtcgtaggatgcgtcttctcgtttctgatcaaaggccacaagcatggcatccctatagttggtactctgaagcgtggcatcaacccgagctcgatatcacagctcaagttccagccggagtacgtcggcgtcgccatgaaggccgggttcgtgtcagggatgctcgccttagcggaaggcgtcgccgtcggcaggagcttcgcggcgatgaagaaagagcgcatcgacggcaacaaggagatggtcgccttcggcctcatgaacctcatcggctccttcacctcctgctacatcaccaccggtgcgttctcgaagacggcggtgaactaccacgccgggtnccggacggcgatgtcgaacgcggtgatgtcggtgtgcatggcgctngtgctggtcgcgctggcgccgctgttccggcanangccgctngtngccctngcggccatcatcaccagctccatgctcgggctggtcaagcaccgcgagatccggcgcctgtacgaggtggacaaggccgaattngccgtctgngccgccgggctcctcggcgtcgtcttctccaccatgatcaccggcctcggcgtcgccgtggccatctccgtgctcagggcgctcctgcacgtggcgcgcccgtcgacgagcaagctcggccgcgtgtcctgcggctccggtgccggcgccgccgacgacgaccacgccttctgcgacgtcgcgcagtaccccggcgcggcgaccgcgcccagcattctcgtcctccaggtcgccggctcgccggtctgcttcgccaacgccgagtacctccgggagaggatcgcgcggtggntggaggacgaggagaaggccgtcgccggcgaggacctgctctacgtcgtcctcgacatcggcggcgtgacggcgatcgacagccccgggatcgagatgctgcgggaggtgcacggcgagctggagaggaaggggatgaagatggcggtgacgaacccgaggatggcggtggcggagaagctggtgctgtccgggctcgcggagctcgtcggcgagagctggatgttcctctccaatggcgacgccttggccgcgtgccggtacacgctccagggctccaagcacggcggcgtccctccggtgtag

SEQ ID NO: 1067 - DNA, 1917 bp, Oryza sativa
  misc_feature (1503)..(1503): n = any nucleotide
atgaagtatatgaagcttggatcaaagccagatgtgtttcagacagagggaaacaatatcaggtttgtcgcaactgagttggcaacggacatcgtaatcattgtaggggaagtgaagttttatcttcacaagttccctcttttgtcgaagagttcgcgattgcaaacattggtggcatcgacaaacgaagagagcaacgacgaaatagacatctccgacatcccggggggacctgcagcattcgagatctgtgccaagttctgctatggcatgatcgtcaccctcaacgcgtacaacgtcctcgcagcccgctgcgcagccgagtatcttgagatgttcgagacgatcgacaaggggaacctcatctacaagatcgatgtgttcctgtcctcaagcatattcagaacctggaaggactccatcatcgttcttcagacaaccaagtcactgctgccatggtcggagaacctcaaggtgatcaaccactgcgtcgattcgatcgcgacgaaggcctccatcgatccgtcagaggttgagtggtcatacacctacaacaggaggaagctaccgtcggagaacggcctcgactcgcactggaacggcgtaaggaagcagcagatggtgcccagagactggtgggtagaggatctctgtgaccttgagatgtgcctgtacaagaaggtcatcatggccatcaaggccaaggggagaatcagcagtgaggtgattggtgaggcactgagggcttatgctcacaggaggctgttcagctcactggaaagtgctgtcagcaatgggcttgactgcacaaggcactctgcagctcttgagaccatcatctccctgcttccatctgaggaaggttcagtcccatgctctttcctccttaagcttctcagagcctcatgcttgttgggatcagatgaggcgtgccgcgacaatcttacgaagaggatcggcgcgaagctggatgaggcttcggtctcggacctccttatccccgctaactccgacgaggccgccatgtacaatgtggacatgatctcggcgatgctggaggagttcatggcgcagcaccgcgaggacgatgatggcgccaagctacaagaggatgatgatcaggaagccatggatggtgatgatgacaacctgaatggtgtctcccgcagctcgaagctcgcgatcgcgaagctggttgatgggtatctggctgagattgcgaaggaccccaacctcccactctcgaagttcatcgccctcactgagatggttcccctcgcaactcggcccgtgcacgacgggctataccgcgccatcgacatgtatctcaaggagcatccgggtttaacgaagggggagaagaagaggctgtgcgggctgatggactgcaagaagctgtcgccggaggcgagcatgcacgccgtgcagaacgagcgcctcccgctccgcgtcgtcgtgcaggtcctcttcttcgagcaggtccgggcggcgtcgtcggcgtcngcggcggcggccgccgacatgccgccggcagcgcgctccctcctccccagggagcaggacggcaactcgtacggcagctcgaggtcgacggcgaccgaggacgaccagtgggcgccgccgccgacgacgacgtccgtcgacgtcacctccttccggtcgatgagcctcgccaacaacaagaacggcggcgtctccggcggcggcggcgatcaggccgcctgcaagaagccgccgccgtcgtcggcgtcagcgaaggggagcggcggcggcgggctgatgccgaagaagatactgagcaagctgtggtctggcaaggcgagcagcggcgagaacagcagctccgacacgtcggagagccccggcgaggagacgaggtcgacgccgtcgcggaacacgaggcattcggtgtcctag

SEQ ID NO: 1068 - DNA, 1885 bp, Oryza sativa
  misc_feature (663)..(663): n = any nucleotide
gatttctttatcaccagtttgggagaaatcgataaaaggccaagctaccataattcctaccagatatggccagttggttttacgtcttactggcatgacagaattactggttcactgttcgagtgtgaggtgtgtgacggagggaattttgggcctttgtttaagcctctgggacgtcctattagcaataagcttccgccagagttggcaggagaggttctccagcgtttctctgaaataattggcctgaaagaaattccttcatatgagcagctagaagatgaacttattgacccagttctttttggtgagctattatctaaggttgcaatttttgtagatccagaatcaaaaactaggcgtggaagaaagaaagacactgagaatctcatttcagcaaaagaatttaaatttgacatgctaacagctaacaagttgacttggccggaattggcaagaaggtatattttagccatttcgtccataagtgggttcatggatttatctgatatttcaagtcgagaaggagtgaaattattccgctgtctacaaggtgatggtggtattctgtgtggtgcactacctggggttgctggcatggaaaaggatgcgttgtgggcaaaatcactggagcctgtgagaaaattaccaacaaatgtgggnacacgaattagaaaatgcgtttatgaatctttggagagaaaacctccggaatgggcaaggaaaattttggagcattcaatcagtaaagaggtctacaagggtaatgcatctggaccaactaagcgcacaattgatataaggttggctatgggagcttactatggatcatgggaggcttttcttgaggatgtccaggaatttgagtcattgtacaagacagagaacagcttacctaaagctccatgggaagatggcgtttgcaaagtatgtggtattgatagggacgatgatagtgttctgctatgtgacaaatgtgactcagaataccacacttactgcttgaatcccccactagcccgtataccagaagggaactggtactgtccatcatgtatgttaggtcaaacgaaagcacatcatgatcagggtgttcaagatgtgaaacggcagcaaaagaaatttgttggggaggaagcccatgcctttcaagaggaacttaataaattagctacagcaatggaagagaaggaatattgggaccttaacatgcaagagaggatatatttactgaaatttctatgcgacgaaatgctcaacactgctctaattagagaacatctagatcaatgttcagtggttaagagactatgacccaagggagaaggaactgaaagactctatcttgcagtggcaaagaaaaaagcgaggaaagaagataaagttaagttctgaagatagaacatatcgctgcgactgtttggaacctgtatggccttctcgataccattgtttaacatgtcatgagacttatctcatatctacagagtttgaggggcatcccatatgactttgaagaaatttgcagaaaaagataaacttgcttgacatcgaagcagccttgcctgaggaggcactgagagcctcaaagtgtcagcaaataagaaggcgttcatggcgtgcatttgtcaaagatgcagaatcaatatcccaggagggcatgataaaagctgagttcttgaagaacgattggtggtactggtcttccttcacagcagctatgaagacatcaactgtatcctcactcgcgctcagggtctacactctagatgattgtatcatctacagtaaggatcaagttccaagcgttgagccagctgacaatacaaggtctggaaacagaggtgggaggaggaggagagagcttgaatccttagcatcataa

SEQ ID NO: 1069 - DNA, 1755 bp, Oryza sativa
  misc_feature (976)..(976): n = any nucleotide
atggatcccgcgccggcgacccctcgctggaacctggagcggccgtacctcaccggccgcttccatcagcaggagcttttggtcattgatgatttgttatcagctcttgtgggtattgagggacgatacatttcgattaagagagtacggggaaaggaggggtatgttgtcttccagattgattcttcaatggaccttgcactccagttgcaggaattaactcgtcggatttttcccttatgtgaggattttgtcttggtataccattttgtggagtccagatcacatttcaagagtggcctggtcaaccatgctctagctgcagcattgagggcattcctcttggattatcaggcaatggttgctcaactggagcaccagttccgtcttgggagactgtcagttcaaggattgtggttcttttgtcaggcaaaggcaatggctggcgatagtgctgttcgatcattactggagaagatgacagagtgtgcaagtgcagcgtatcttaggatgttagaaagaggtgggtctatgagggcgttatagatgatccttatggtgaattcttcattgctgaaaacaaatccttgcagaaggagagccttactcaagattatgatgctaaatattggcagcaaagatacagtctaaaagatggcatccctagtttccttaccaatgttgccgccacaatactgacaactggaaaatatcttaatgttatgagagaatgtgagtacactgtccaggttcccttgtcagagagttctaagctgatgggctttggttcaaaccaccaatatcttgaatgcatcaaatctgcgtatgactttgcaagtggtgaactcttgactctaatgaaagataagtatgatctcattgggaaactgcgatccctcaagcgatatctacttcttgaccaacagggtgattttctggttcactttatggatattgcccgagaggagcttacaangaaaccagaagaaatatctgttgaaaaacttcagttgcagtctcttgttgacatcgcgttgcgaagtacggcagctgcttcagatccaagtcatgaagacttgacttgctgtgtgccgttaagtgtgactggcttggaaactttctgcctgagctacaaggttgttcaatggccactatctctagtaatttcaagaaaatctttgacaaaataccagttgatttttcggctgttgttccactgcaagcatgttagtcgacaattgtgtacagcatggcaaattcaacaacagggtttccgttctgtcaaaatcctaggaacaccagtcctacggtcatcaattctttgccgcagcatgctcaagtttgtaaacagccttttacattatctaacctttgaggttcttgaaccaaattggcatttgatgcatgatcggcttcaaactgcaaggagcatagatgaggttttaacaacgttcttatgatgaagaaagatgtattgcgaaaggggtcatacagattcatgatttcttcctgcagaagtgtctaaaagaatgcttattgttgttgcctgaactccttgtgaaaatcgagaagctgaaagctctgtgtctccagtatgcgacttccatccagctattgataccatccattgatttcgaggcagaattcaattcagagcttcaaagtcttattcctacgctgagtaacagttcacaggcagaaccatacttgactcatcttgggcagtgcattcttggtgtgggagttgatcaatga

SEQ ID NO: 1070 - DNA, 1734 bp, Oryza sativa
  misc_feature (1109)..(1109): n = any nucleotide
atggtactcactcacctcctctgctccctcctccttgccaccgcattgctgctgctctccatctcccgtacagatgcgggcgagatcggggtgtgctacgggagggacgcaaaggacctgatcgacccaccggcggcggtgagccttctgaaggcgaacggcatctccgcggtgaggatcttcgacgcggacccgacggtgctggccgcgatggcgaacaccggcatcaaggtgatggtggcgatacccaacgccgacctggctgccgccggccaggacctgcgcagcgcgaccgactgggtggcgagcaacgtggcgccgtaccgcagccggggcacgctgatcagcggcgtcgccgtcgggaacgaggtgttcaggcagaggcccgagctgaccggggcgctcgtctcggccatgcgaaacgtgcacagggcgctggagaacctgaacctggcgaacgacgtgaaggtgtccacgccgattgccttcgatgcgctcaagcagtcgtcccctccatctgcgggggagtttaaggatgagatcgcgcaatcggtgatgaagcccatgatcgacttcttgaaacagaccggctcgttcttcatggtcaatctctacccgtacttcgcgtacgtggctcagccggacaagatctctctcgagttcgcgacgttccgccctaatgctggtgtgctcgatggcaataccgacatcaggtacttcagcctctttgatgctcagctcgacgctgtttacgccgcgataaacagggtttctggtggtagcttaacggtctcaatggctcgacgagatggaatccttagtgtgcaagcttcggaatcagggcacccctctggaggtagatttcccctatcttccatgctagctgcagccgatacggactcggtggccacgatagccaacgcccaagcgtacaacaatgggcttatcagacgtgttgtatccggagcctccggtatgcgtgacgtctccgcctacattttctctcttttcaatgaaaacgagaagcctggaccaaccatagagagaaactttggcttgttctacccaaatggtcagaaggtgtatgaggttgactttcggggcggtgncggtggcggagcttgtcctacaaagacgagttggtgtgtggcgagagcagatgttgggagtgcagcattgcagtcagcgttggactttgcgtgcggtaacggcgcggactgcagcgctatccaacagggcagtgtgtgttttgagccaaacaccttggtcgcacatgcatcgtacgcattcaatgactactaccaacgcaagggccaggctagcggcacttgcgacttctctggcgccgcttccatcgtattcaagccatcaccaagcatatgtgatccgaacccaagttggtgtgttgcgaaatcggaggtcggggacgcacggctgcaaaatgcactagactatgcatgtggtagctgtgcggactgcagcgccattcaaccaggtgcacagtgctttgatcctgacactaaggtggcacacgcgacctatgcattcaacaatttttaccagaccaccggtcgggctagcggatcgtgtgactttgcgggtgctgcttctattgtcaaccagcaaccaaaaataggaaactgcgtgctcccaccaaacaatgcttggacgacagaacaaactgcaattgaagatcaatcgactgcaaacttaccagcaacagcttggcagtga

SEQ ID NO: 1071 - DNA, 1718 bp, Oryza sativa
atggcgagctcttcctcagcagcggcgatctccaatcctctgttcgggattcaaatctcggataaactcaccaagaaaaatcaccccctctggtctgcgcaaatccttaccaccctatggggtgcgcagctggaagggcatgtcaccggcacagttgaagctccggcggccgagtgcgagaaggaagatggcgacaagaaagtcaagaccaccatctccaacccggaatacatcaagtgattcagtcaggatcaacaagtcctggggttcctcttctcctccctatcacgggagatcctgcagcaggtggctggcgcgcagacgacagcccaagcatggaacatgatcaacgacatattctcctgcaaatccaaggcgggcgccatcaacgtcctcctcgccttgacgactactcagaagggacccatgtccataagtgagtacattgccaagatgcgatcccttggcgatgagatggcggcggcaggcggttgaaggattgatggcaacgacaagaattgctcctctcttaatctctcatgtgtattcccaacttttgagctatgaaaacaggatcagtattcgccaaacctacctccctacttcggcaaacactgcaaatcgtggcggtcgcggcggtcgcagtggcggccgtggtggcgcaggcggggccaacactgggcgagggcgcggtaacgacacccacccggtgtgtcaagcctgccataaacgaggtcacattgcaagtgactgctggcaccgctatgatgagaactacgtccccgacgagaagctaggcgacgcggccacatatgcctatggtgttgacaccaattggtatgtggacaccggggcaacagatcacatcacagggcagctagataagctgactacaagggagaagtacaagggaacagatcagatccacactgctagtggcgaaggtatgaatattaaacatattggtcataccattgttcctacccctagtcgtcccttacatcttaaaaatatacttcatgttccacaagcatcaaagaatttagtctctgttcatagactcattgcagataattatgcctttcttgagattcatggaaaatattttttgattaaggacaaggccacgaggaggacaattcttgaaggaccatgtcggcgggggggtgtgcagcagtcacatccgtcaggatcatctacacaaatggagccagcacagcacggtgtgtctactgaggtaatgagaccaaaaactaggctacaaagtggcattagaaaggaaaaagtttacactgatgaacctgttagatacagctgttgtttcacatattctggagagccacaaactttggatgaggccttaggagataaaaattggaagaattggacagaggcaatgaatagtgaatataatgcactcatgaaaaataaaacttggcatctagtacctcctagcagaggattaaatgtgatagactataaatgggtttacaaaattaagaggaaaactgatggtagtctagacagatataaagtcaggcttgtagcaaaggggtttaaacaaagcctgtagtcaaggttgctactatcagaactgtactgtctatagcagcttctagagggtggatgcttcgtcagctagatgtatagaatgcttttcttcatggaatcctagaggaagaagtatacatgaggcaaccacccaggatatgaacaag

SEQ ID NO: 1072 - DNA, 1668 bp, Oryza sativa
  misc_feature (399)..(399): n = any nucleotide
  misc_feature (842)..(842): n = any nucleotide
  misc_feature (1014)..(1014): n = any nucleotide
  misc_feature (1016)..(1016): n = any nucleotide
  misc_feature (1023)..(1023): n = any nucleotide
atggggccagccgcgccgccgtccgaagccgccgcggcggccgacgatgtggtgctcccgtacatctcgcgtattctcatggaggaggacatcgacgacgacatgttcttctgcctgtaccccgaccaccccgctctcctcgaggcgcagcagccgttcgcccagatcctctcctcctcctccggcatcgccggtgaggtgaacagtgcacccatggaggattctgctgccttgatgatgcaggggagcggcaatggtaggggacggaagggtagtaagcatggcggggacgagctggaggccgaggtgggcagggcgagcaaactgatggccacgccggaggaggaggacgacgacgacgatggcgtcggcgagatgttggagaagatgatgctcaanggggacgaggacgaggattcgacggagatgaacgcgccacgcgtccccgcggagaaaaacggcgggaaggcggcgcggcggaagaggaggcagggcaagggggaggtggtggacctgcgcgagctgctcatgtcgtgcgcgcaggcggtggcatcgggcaaccgccggagcgccggcgaactcctggagcagatcaagcggcactcgtcgccgacaggggacgccaccgagcggctggcgcattacttcgccgacggcctggaggcgcggctggccggcgcggcgagcctggagcaccggctgctcgcgtccgcggaggagcgcgcgtcggccatggagttgctggaagcgtaccaggtgttcatggcggcgtgctgcttcaagtgggtggcgttcacgttcgccaacatggccatcctccgcgcggcggaagggaggagcanggtgcacatcgtggactacggcggtcagtaccacggcctccagtggccatccttgctgcagcggctggcggagagggaaggcgggccaccggagttcaagttccgcgccgtggcggcggcgaggtgggagacggtcaccgccgaggacgtcgtcggcgtcgaccacgacgangnggcggcngtcgtcgtgaacgacgtgctcagcctgggcaccctgatggacgagagcggcgtgttcgacgacccgagccctcgggacacggtcctcggcagcatccgcgacatgcgcccggcggtgttcgtccaggccgtggtgaacggcgcccacggcgcgcccttcttcccgacgaggttccgggaggcgctcttcttcttctcggcgctgttcgacatgctggacgcgacgacgccggaggaggggagccacctgcgggcggtgctggagagggacgtgctgaggcgggcggcggtgggggtgatcgccggggaaggggcggagcgggtggagcggccggagacgtacaggcggtggcaggcgaggaatcggcgcgcggggctgagacaggtggcggtggaggccgacgtggtggaggcggtgaggcgcagggtgaggaggcggcatcacgaggaattcgtgatcgaggaggatgcagggtggttgctgcaggggtggaaggggcgcatcctgtatgctcactcggcgtgggtcgtggcagaggatgcaactagcgttggagagctcacagtagtaacaacaagcttagtggcaataatcctttcagctgcttcagcacaagacgagcttccattgtccaccaatgaatga

SEQ ID NO: 1073 - DNA, 1622 bp, Oryza sativa
  misc_feature (292)..(292): n = any nucleotide
  misc_feature (746)..(746): n = any nucleotide
atggcggtcggcgtcgtcgccggcgtcgagagccaggagcgccgcggcggcggcgccggaaccggaagggtcaccgcgttcgtcgtgctgtcgtgcgtcaccgccggcatgggcggcgtcatcttcggctacgacatcgggatcgcagggcggtgcaggtggcgtgtcgtcgatggagccgttcttgaggaagttcttcccggaggtgcaccggcggatggagggcgacgtgcgggtcagcaactactgcaagttcgacagccagctgctcacggcgttcacctcctcgctntacgtcgccgggctcctcaccacgttcgccgcgtcgcgggtcacggcggggagggggcgccgcccgtccatgctcctcggcggcgccgcattcctcgccggcgcggccgtcggcggcgcgtcggtggacatctacatggtcatcctcggccgcgtcctcctcggcgtcggcctcggcttcgccaaccaggccgtgccgctctacctgtcggagatggcgccgtcgcggtggcgcggcgcgttcagcaacggcttccagctcagcgtcggcgtcggcgcgctcgccgccaacgtgatcaactacggcacggagaagatcaggggcgggtggggatggcgcgtctcgctggcgctcgccgccgtccccgccgggctcctcaccctcggcgcgctcttcctcccggagacgcccaacagccatcatccagcaggcaagtcgaacgctgcgacgtcgnagcagctgctacagagatccgcggcgccgacgacgtcgccgacgagctcgacaccatcgtcgcggcgaacagcgccacggccggagtcggcggcggcggcctgctgatgcttctcacccagcgacggtacaggccgcagctcgccatggccgtgatgatacccttcttccagcaggtgaccgggatcaacgcgatcgcgttctacgcgccggtgctcctccgcaccatcggcatgggcgagagcgcgtcgctgctgtctgcggtggtgacgggggtcgtcggcgtgggcgcgacgctcctctccatgttcgccgtcgaccgcttcggccgccgcacgctgttcctcgccggcggcgcccagatgctcgcatcgcaggtgctgatcggcggcatcatggcggcgaagctgggcgacgacggcggcgtgagcagggcgtgggcggcggcgctgatcctcctgatcgcggcgtacgtcgccggattcgggtggtcgtgggggccgctgggctggctcgtccccagcgaggtgttcccgctggaggtgaggtcggcggggcagagcgtgacggtggcgacgagcttcgtgttcaccgtgttcgtggcgcaggcgttcctcgccatgctctgccgcatgagggccgggatcttcttcttcttcgccgcgtggctcgccgccatgaccgcgttcgtgtacctcctcctgccggagaccaagggggtgcccatcgaggaggtcgccggcgtgtggcggggccactggttctggtccagggtcgtcggcggcgacggcgaggaggaggagcgcaataatggcgggaagctttgactgaaacaacgcgcgcgcgcaatatccaaagtgcgttgcacgaatcttga

SEQ ID NO: 1074 - DNA, 1607 bp, Oryza sativa
  misc_feature (30)..(30): n = any nucleotide
atggcctcgccggcgaagcgcgcgaagaanccggccttgtccccggtggacccccccgggttgccgccggcgccggaggacccctgcgtcctcctccgccgcagctgggagctcgcgtcggtgctccactttctccggggtgtttgagccggtgatcgaggggaacctggggctatcagcggaggagatcgagaccgcgctcatcgccaataaccacgaccttgcccgcatccatattgcgcttataaaggagggaataccaccaactatcaaaaatctgaaggtcgatgatggatggataacggcaactgccaagaaattatcagattggtggacatggggttgctgaaggtgcaaacccgttcaaaattaatccaggacccaggaaggaaattgacacgtataaacagcaagatccgattaaacgcttgttgatacttaaagcactctgtgaagttcgttcagagagcaaaatgacgcggtatggtatgttaatgacgagatgaaaagaggagttgatatttccaatttccgaaaagaaaagttaggaagtagtagtaacggaactatatactgggtatgatggtgactcaactattggccatagattgtatagtgagtatgtaacacttgatttcaagcgcaacttgaagggaaagaatggtcgtttgacaaagccagttatcaatattcagtgggaaacagttgcgactaaccttgatgagttcgttgagatatcgggagaaactatgcagtaaaggtcgaccggaatctgccatcggcgagcatcttaagacagaaattattccagatgtggagaagcttcaaaagagaagaaggagcgggatttaaaacgtcagcagaagaaggatgaacttttagcttatgctacaagtttccaaacccgttcattgcgtgaacgtaggcctgtcagctacaattactctgattacgatcgttctataaaggaggcaataaaagctgcagcaattcacgtgcttgaatgcaggaaatcaaaagaatctgatccacaggaggcaggcaaaaaagagaagcgtgcctcacatcagggcaataaaggagccaatggagggtctgacattggtccagagcagaaggaagatggacaggaggatgctggagggtctgacgtcaatccggagcaggacaaagatggcggacaggaggatgtcgagtcccttgatgacctgagttctgatgaggatgaagacagagactacaatggtaaggatgatgactcgtcaggcagcgatggagaaaatgatgttggcagtgatggagaaaatgatgcttatgatcccaacaagggtgatactgaagaggaggaagtatttgtcccacgtaagaggactcgtcttgcctcccgtcggtttgacaagcctccgcaagggctccgccggagtcggagaaatatgaaaaacgacgaagacgtcatgcgcccaggacagcttactcctcgatccatgacaaagaaaacaatgaggcagaggccaacatctatctcaaagcagttttctctatcaggctcggaagatgatcgtgaaatgatagttgcagactctgaggaggagtccggctcaccttag

SEQ ID NO: 1075 - DNA, 1536 bp, Oryza sativa
  misc_feature (702)..(702): n = any nucleotide
atggaggacaacaagctgatactggctctaggcctatcagtgctgttcgtcctcctctccaagctggtatcatctgccatgaaaccaaggctcaaccttcccccggggccatggacgctgccgctgatcggcagcctccaccacctcgtgatgaagagcccccagatccaccgctcgctgcgcgcgctgtcggagaagcacggccccatcatgcagctgtggatgggcgaggtccccgcggtgatcgtgtcgtcgccggcggtggcggaggaggtcctgaagcaccaggacctcaggttcgccgaccgccacctcaccgccaccatcgaggaggtctccttcggcggccgcgacgtcaccttcgcgccctacagcgagcggtggcgccacctccgcaagatctgcatgcaggagctgctcaccgccgcccgggtgaggtcgttccagggcgtccgagagcgcgaggtggcgcggctcgtgcgtgagctggccgccgacgcgggcgcgggcggcgacgctggcgtgaacctcaacgagaggatcagcaagctcgccaacgacatcgtgatggtgagctccgtcggcggccggtgcagccaccgcgacgagttcctggacgcgctcgaggtcgccaagaagcagatcacgtggctcagcgtcgccgacctgttcccgtcgtccaagctcgcgcggatggtggcngtggcgccacgcaagggcctcgccagccgcaagaggatggagctcgtcataagacggatcatccaagaacggaaggaccagctgatggacgacagcgccgccggcgccggcgaggctgcggcggggaaagactgcttcctcgacgtcctgcttcggctgcagaaggaaggtggcacgccggtcccagttaccgacgaaatcatagtcgtgcttctgtttgacatgtttacaggggctagcgagacatccccaacagtattgatttggatcttggctgaactcatgcggtgtccaagagtaatggcgaaggcacaagctgaggtacgacaagctgctgttgggaagactaggatcacagagaatgatattgttgggctgagctacctcaagatggtgatcaaggaggccttgcgactccattccccggctcccttgctgaaccctcgtaaatgtcgtgagacaacccaagtcatgggctatgatataccaaaaggcacatctgtgtttgtgaatatgtgggcgatatgtagggaccctaattactgggaggatcccgaagagtttaagccagagagatttaagggtaataactttgaattccttccatttggctccggacgtagaatttgtccgggtataaaccttgggctagccaacttggagctagcattagctagtcttctctaccattttgactggaagctacccaatggaatgttgcccaaggaccttgatatgcaggagacccccggaatagttgcagctaaactaactactctaaatatgtgccctgttactcagattgctccaagcagcgcagaagatgcatcataa

SEQ ID NO: 1076 - DNA, 1469 bp, Oryza sativa
cgttacaatcggattcctctcagcaacgaagttgttctgcgggggcacaccaaggtctcagccctcgctgttgaccatacaggatcccgagtgctctctggaagctatgactacactgtatgtatgtatgacttccaaggtatgaactcaaagctgcaatcattcaggcagttagaaccctttgaggggcaccaagttcgcagcttaagttggagcccaacatcggatcggttcttatgtgttactggttcagctcaggccaagatatatgatcgggacgggctcacactaggtgagtttattaagggtgacatgtatatccgagatctgaagaatacaaaagggcacatttctgggcttaccggtggtgaatggaatcccaagtcaaaagaaaccatactgacgtcatcagaagatggatctattcgtctgtgggatgtatcagactttaaaagtcaaaagcaggtacagaaaattttgggtcataaaacctaagcttgcaagaccaatgcgaattccagttacctcatgtgcctgggatcatgaaggcaagcgaattgttggtgggataggcgatggttcaattcagaagactggatggggaagcaggccagatatacatgttgagaaaacacatacggaggatattacaggggtcaagttctccacagatggacaaatactcctgtcaagaagtatggatagtactctgaagtgggatttgaggaaaatgaaaactcctttgaaagtttttgaagatttaccaaatcactatgctgagacaaatgtggctttcagccccgatgagcaacttattttcacaggaacttctattgagaaagacggtgaaaatggaggcctactttgcttctttgatagaaggaaacttgagcttgtatcaagggtggggatttcaccacattatagtgtgataaggtgtctatggcatccaaggattaatcaacaggtattcgcaacagttggggataagaaggaaggtggtactcatatcttatatgatccttctattagtcagagaggagcacttgtatgtgttggacgagcacctaggaaaaaatctgttgacgattttgaggtgcaacctgtaatacataatccacatgcactgccactatttagagatcaaccaagtcggaaacgccaaagagagaagatactgaaagacccgctcaaatcacataaacctgaagctccagtcaatggtcctggctttggtggaagagtcggtactacaaaaggcagcttgttgacacagtacctcttgaagttattacaggagggtggtttgattaaggagacatggatggacgaggatccaagagaggcaattttgaagtatgcagatgctgcagagaaagatccaaagttcattgcaccagcatattcccaaactcagccgaaacctgtatttgcagagtcggattctgaaggcgaagagaaaaaataat

SEQ ID NO: 1077 - DNA, 1407 bp, Oryza sativa
  misc_feature (348)..(348): n = any nucleotide
  misc_feature (351)..(351): n = any nucleotide
atggggtcttcggccgagccgccgccgccgtgccacgtcgtggcggtgccgtacccggggcgcggccacgtcaacgcgatgctgaacctgtgccgcatcctcgccgcgcgcgacggcgtcaccgccaccgtcgtcgtcaccgaggagtggctcggcctgctcggcggcgcggcggccgcggcggcgaagggcggcgtccgcctcgaggccatccccaacgtcgtgccctccgagcacggccgcgccggcgacatgctcgggttcgtgcgggccgtgtacaccaggatggaggcgccgttcgagcgcctcctcgaccgcttggctctcggcgcggcgccgccgccgccngcngccatcgtggccgacacgttcgtgctgccgtgggcggtcggcgtcggcaaccggaggggcctgccggtgtgcgtcctctcgccgctcagcgccaccatgttctccgtgcactatcacttcgaccgcctgcccacggccaccgacatcgccgatggcgatgaggtcggaaactacattcctgggctgaaatcgatcaggtttagcgatcttgagcccacacacacgaacaagaacatggtagacctcatcctcgaagcctactcccatgccagaaaagcacagtgcgtcatcttcacctccttctacgagctcgagagcaacgccatggacgctctccggcgagacctcccttacccggcgttctcggctggcccttgcatcccatacatggcgctccaagctgacgaacaccacgccggcgacgaggaagaagagccatacatggcgtggctggacgcgcagccggtgggctcggtgctgtacgtctccctcgggagcttcctctcggtgtcacggccgcagctcgacgagatcgccgccggcctcgccgacagcaaggtcacgttcttgtgggtgctccgcggcgactccggcgcgcgagacatcctccgcggcggcggcggcatggtggtgccgtggacggaccagctgaaggtgctgtgccacccttccgtcggcggcttcttcacccactccggcatgaactcgacgctggaggcggtgcacgccggcgtgccgatgctgacgctccccatagcgttcgaccagccgatcgtcgcccggctcgtcgccgacgagtggaggatcgggtacggcctcagggagaacggggacggcggcggctgcagcggcgtcgtcgggagggaggagatcgccgcggcggtgaggaggctgatggtgatggattccgatgcggcggcggcggaagaggcgaaggagatgaggaggagagcttcgctgatgcgagaggcctctcgcgccgcggttcaagagggtggttcttcctacagagacgtgacgtctctgatcaactacatttcagagttcaagaactga

SEQ ID NO: 1078 - DNA, 1362 bp, Oryza sativa
atggaaggcggcgtccacatcgtgtcgcggcgcatggtccggccggcggcggagcacgccggcgagctgccggagcacgagacggtgcaccacctcacgccgttggatctccggatgatcaccggcgactacgtccagaagggcgtcgtcctgcccaagcctcccggcggaggtgagcacgtcgtcgaacaccttgtctcgtcgttcgcccgcgcgctggcccgcttctacccgctggccggccgcctcgccgtcgccgagacgccgccgtcgcctggtggtgctcgtccgaccatctccctctcgctccgctgcaatggcgagggggcggagttcgtccacgccgtggcgcccggcgtcaccgtggccgacatcgccgactcgctcttcgtcccaagggtggtgtggtccttcttcccgctcaacggcatgcttggcacggacgccgccgtggagccccgccgccctgtcctggccgcgcaggccaccgagctcgccgacggcatgttcatcgccatgtcgctcaaccacggcgtcgccgacgggttcaccttctggcacctgttccgcacctggtcggagatcaaccgccgccgcagcggcgctgataacgccgacctcgagctctccaagccgccgccagtgttcgacagatggttcgtggacggcatcccggcgccgatccctctacccttcgccaagctggaggacatggtccggcggcctgcgtacacgccggtggaggagtgcttcctccatttctcggcggagagcgtgaggacgctgaaggagaaggcgaacgccgagatggccggcggcggcggcggcgccgccatatcgtcgctccagtcggtgctggagacgaggcacggcctctccgtgggactgcgagcgcgggtcaaggaggtgccacaagaatacatgggcaacacggtggtgggcgccgtcgcgagggccaccgccggcgagctcctcgagagagggctcggctgggcggcgtggctgctgaaccgcgccgtggcgtccgcgggcgacgaggcgagcgtgaggcgcacgctgccggcgtggccggagacgccgaggttcgtgacggtggcgagcctgcagaacgccggcgtggtggtgatctcgggctcgccgcggttcgacgtgttcggcaacgacttcgggtgggggaggccggtgggcgtccggagcggcgccgggaataagatggacgggaagattacggtgtacgagaggcgaggcggcggcggcggcatggcggtggagatttgcctggcaccggaggcgctcgcgaggctggtcgccgacgaggagttcatgagcgcggtgactgcgccgccgccgacacatcactaa

SEQ ID NO: 1079 - DNA, 1317 bp, Oryza sativa
atgggcaagcaccatgtcaccctgtgttgtgtcgtttttgctgtgctctgcctggcgtccagcttagcacaagcccaagttctcttccagcaggggtttaactgggagtcgtggaggaagcaaggcgggtggtacaactttctgcacgagaaggtggaggagatcgccagcacgggcgccacccacgtctggctcccgccgccgtcgcactctgtctcgccgcagggttacatgccggggcggctctacgacctggacgcgtccaagtacggcacggaggcggagctcaagtcgctgatcgaggcattccacgacaagaacgtcgagtgcctcgccgacatcgtcatcaaccaccgctgcgccgactacaaggacagccgcggcgtgtactgcgtgttcgagggcggcacgcccgacggccgcctcgactggggccccgacatgatctgcagcgacgacacgcagtactccaacggccgcggccaccgcgacaccggcgccgggttcggcgccgcgcccgacatcgaccacctcaacccgcgtgtccagcgggagctcaccgactggctcaactggctcaggaccgacctcggcttcgacggctggcgcctcgacttcgccaagggctactccgcgccgctggcgaggatctacgtcgacaacaccaacccgacgttcgtcgtcggcgagatctggagctcgctcatctacaacggcgacggcaagccgtcgaccaaccaggacgcggacaggcaggagctggtgaactgggtggagggcgtcggcaagccggcgacggcgttcgacttcaccaccaagggcatcctccaggccgccgtgcagggcgagctgtggaggctccacgacggcaacggcaaggcgcccggcctcatggggtggatgcccgatcaggccgtaaccttcgtcgacaaccacgacaccggctcgacccagtcgctctggccgttcccttccgacaaggtcatgcagggctacgcctacatcctcactcaccctggcatcccatgcatcttctacgaccatgtgttcgactggaacctgcagcacgagatcgcgacgctggctgaaatccggtcaaggaacgggatccatgcggagagcacgctggacatcctcaaggccgagggggacatctacgtcgccatgatcgacggcaaggtgatcaccaagctcgggccgaggtacgacgccggcgggatcatcccctccgacttccatgtcgtggcgcacggcaacgactactgcgtctgggagaaggaaggcctcagggttcctgccggtagaaagcactattag

SEQ ID NO: 1080 - DNA, 1204 bp, Oryza sativa
  misc_feature (127)..(127): n = any nucleotide
  misc_feature (669)..(669): n = any nucleotide
atggcgcgggggttccgcggcgtccgggacgacctcaccgagctaggccgccacatcctcgacatcgcctgcttcctccacccgctcctcggccccgcccacctcaccgtcgacttaccgcccgccnacccccacccaccgccaccaccaccaccgccgctccccttccccgcgccccgccagccggccttcccctccatcctcgccggcatcctcgccgacctcgccgagatcggcggctcctttcaccggtggcttcgcccgccgcgccgccctccccgaacctgccttctcctccgcctccgcctccgcttccgccaccaccgcggagtccccgcgcgccgcttcctccacggcctcctctccttccccttcccctgctgccgctgccgctgctgatgtcgctgatgacgtcgtcggggcggcgcaggcccttgcggcgcggcccgaggcgtggattgacttccccgtgctcgcgctcgatgagattctataatctccgatatccaaagggatcatatggaagccattgaaaaacttgtacctgacttagcatctctgagagctaggctctgcccttcttacatggatattgatgtattctggaagatctactttacgctgcttgagtcgaaccttactgaacatacttcagagaggtagatgagnatgtaaccaggttctgttcatcacggtcaatgagatagagtctgattctgcgcctaatgtttgtgaaattgaaagtgtgaaaagcactcaagagggttatcaatcgccagatgatcgtgtgttgataaaaacaagatccaatcaaagcattgaccaatgggtgtttgcaaagtcaaaatctgagcaaagcatggatcagtggtccgaaataccttcggatgtggaatcttctagagatggtagaagatacattagcggtgaggagcttagcgacgctgacagtgcccatattgttgtcatggacaaatacatggattcacttctgtcagatcggaggagcctccactatgctagctcctcagtccggcgggattcagctagattggacgcggttagaatgccctgcggcagctgcctcgccgttgctggcttcttgttcttcgtcgtccggcagctgcatttgggcgtgaaacgctgtgttcttcgctgtctggattcagtggtggagctagaaaaatttttgagcccgaactaa

SEQ ID NO: 1081 - DNA, 1167 bp, Oryza sativa
atggcatcggagatgagcaagaacgtgaaggtcaccgatgatcaagaggttacatcacaggagcgtgaccaaagtggtggtacaaaagtaggtggggaggaggaaattgctccactggcgcggcagtcgtcaatcctctccctcaccttggaagagctacaaaactccttgtgtgagccaggacgcaactttggttccatgaacatggacgagtttgtggctaacatatggaatgctgaagaattccaggctaccaccggaggttgcaagggtgccatggaggaagccaaggtggtagacagtggaagcggaagcggtgatgcaggaggaagcggtttatgtcggcagggatcattttccttgccgctaccgctgtgccagaagacggtggaggaggtgtggactgagatcaaccaagcccctgcacacacctccgctccggcctccgcgctccagccacatgccgggagcggtggtgttgcagctaacgaccgacaggtaacactaggtgagatgacacttgaggatttcttggtaaaggccggggtggtccgagggtcctttaccgggcaagcggccatgggatctggcatggtcaacgggccggtgaaccccatgcagcagggccaaggcggtcctatgatgttcccagtaggaccggtaaacgccatgtatccggtgatgggtgatggcatggggtaccccggtgggtacaacgggatggcgattgtgccaccgccacctcccgcccaaggtgccatggttgtcgtgagtcctggatcatcagatgggatgagtgccatgacacatgctgatatgatgaattgtattgggaatgggatgatgattgagaatggaacaagaaagcgtccccacagagaggatggctgcgccgagaagacggtggagcgccgccaacggcgcatgatcaagaaccgtgagtcagctgcacggtcccgtgctagaaagcaggcttatacggtggagctcgaagctgaactgaactatctcaagcaggagaacgctcgtctcaaagaggcagagaagacggttctactgacaaagaagcaaatgctggttgagaaaatgatggagcagtccaaggagaagatgaatgcaaataggggtggcagccagctgcgccgcagcggcagctgcatgtggtga

SEQ ID NO: 1082 - DNA, 1162 bp, Oryza sativa
ggggtcgactactacaaggtcctcggcgtcgaccgcggcgccggggacgacgacctcaagaaggcctaccacaagctcgccatgcggtggcaccccgacaagaaccccaccaacaacaagaaggaggccgaggccaagttcaagcagatctccgaggcctacgaggttgccctcacaccccccgcatctccccctcctcatattcctgcgaagaggtccttagtgatccccagaaacgcacaatctatgatcaggtaggggaagaagggctcaaggggcagccgccccctggtgcgggaggtcctggagcatctcccttctaccctggtggtgcccattccaactcttttcacttcaacccaaggagtgcagacgacatttttgccgagttctttggattccgtggtcctttctctagcatgggtggcatgccaagtgtaagtggaggcatgagaggggacccaaggttcccagggtttggcaatgaatatttctcttcacgctttggtggtgagggttccaccagtatgcatcagccgtcacaccaactagcgaaacctccgcccattgagaaccggcttccagtcagccttgcagatctgtacaagggtgtaacaaaaaagatgaagatctcaagagagattatagacttcaacggaacaggagagtttcacagcaggaggaaattttgcagatagaagtaaagccaggttggaagagggggacaaagatcacttttgaagagaaggggaatcaagctccaaacatgaaacctgctgatattgttttcataattgaggagaagccccatgacattttcaccagggagggaaatgatcttgttataacggagaaaatatctttggtggaagcgcttactgggtatactgcacgtatcattacacttgatgcgcgaagtctgtcagtgcccattaattcagtcatccatcctgactatgtggaggtggtccctggagaaggcatgcctaatccaaaagggcccaataagaagggagatctgaagattaaattcaacatcaggttcccttccaggttgacatctgatcaaaaagcagggttcaaaaggctcttgggttcttgagcctgtttgaacgaatttcgtaaaagtgactgtgaatattggcggtacctagcgaggtag

SEQ ID NO: 1083 - DNA, 1142 bp, Oryza sativa
  misc_feature (29)..(29): n = any nucleotide
  misc_feature (148)..(148): n = any nucleotide
  misc_feature (153)..(153): n = any nucleotide
atgcagagctcagcgcggaggacaaggcnaacctcgtggagtcgattaaggtcggggtttctgcggtggtgtttttgtttttgctgcttgctgcttctatcggggtttgggcgggcttgggaggggttttctgatgaaacttgtggtnaattncgatgtttgcttgcgcagaacacgctgcagggattggcggcgcggcacacggacgtgctcgagagcctcgagcccaaggaggcgaagttctttgaggagagagctgcacttgaagctaaatatcagaagatgtatgaaccactttactccaagcgttatgaaatcgtgaatggtgtggttgaggtagatggtgtcaccaaagaagctgcagatgaaacccctgcagagcagaaaggttctcatattcttcctttactaacatgcagaggagaagggtgtaccagagttctggcttaatgccatgaagaaccatgaaattctgtctgaggagatccaggagagggatgaggaagctcttaagtacctcaaggacatcaaatggtacagaattagtgagccaaagggtttcaagcttgaattttacttcgatactaatccattcttcaagaactcggtgcttaccaaaacataccacatgattgatgaagatgaaccaattctggagaaagccattggactgaaattgaatggttccctgggaagtgtttgacacaaaaggttctcaagaagaaaccaaagaagggctcaaagaacactaaacctatcacaaaaactgaaaactgtgagagcttctttaacttcttcagcccacctcaagttcctgatgatgatgaggaaattgatgaggatacagaataggctgaacagttgcagaaccaaatggagcaagattatgacattggtctaccatcagagacaagatcattccacatgctgtttcatggtttactggagaggctgctcaagatgaggacttcgaaggcattatggatgatgaagatgatgacgatgaagatgacgacgatgatgaagatgaggatgacgagggtgatgatgaagacgacgaggatgaaaagcagaagggcggacgagttcctgcaggggaagggcagcagggagagcgacctgcagaatgcaagcaacagtaa

SEQ ID NO: 1084 - DNA, 1113 bp, Oryza sativa
atggctcttgaggggaaaccaggtttcattaccatgtacgccatcacatgctgcaaatgcgagaaatggcgtacgattccaacaaaagaagagttcgaggtaatccgtgagaactaccccgcgaagccatggttctgcagcaaaaagcgcgactgctcatgtgagcaccctgaagatatccagtatgacaccagccgtatttgggccattgataggcccaacatccctaagcctccgccgaagacagagaggctactgatcatgaggaatgatctatctaaaatggatgcctattatgtcttgccaaatgggaagcgtgcaaagggcaaacctgatatagataggtttctgaaggaaaacccagagtatgctgctactttaccactttcgagcttcaacttctcaacacctaagatagttaaggagactgtttccgatagtgcaaagtgggtgatggcgaagtctgagagggaagagcagtgtatgcaactagacgcaaaagaagttccaagttccagcagcaagaagcgtgtgtgtaaaatgagagtaaagttgggaaagtgtcccgaacacaacctccaaggtaggtgcacactgcacatcaccagaaaacgaggctcctccacagactccattggcatgtatgcagttcaatgttgtgagtgtcacaaatggcgcaaggttccgacgaaggatgaatttgagacaattcgtgagaatttcactgaggagccatggcactgcagtagaagacctgactgctcgtgtgaagaccctgctgacatcgaatatgatagcagccgtatatgggtccttgacaagcctaacataccaaagcctccagcaggaactgagagactagtgattatgagaggtgatttgtctaaaatggatacctactatgtcatgccaaatgggaagcgtgtaagatgcactgcagaggtggataagttccttgaggccaacccgcagtacaaagatcgcttttcagttgaaagcttcagctttacaacaccaaagattgtcgaggaaactgtttctcacaactccgtgtggaagtctggaaaggctaagaagcaggacaagataaatgctttgagcaataacaattaa

SEQ ID NO: 1085 - DNA, 1093 bp, Oryza sativa
atggttctaaacaaggtgctcgagctgttttgtgtgaagaagaaggattccaagaagaaaggtaggcaaagccattaatcctctttgtaaagagttgccgctccacaccccactgcaaatgtcagtacaaacaacagccttttggatcccttttcaagtgggaatggtactgtgctattagtgcaaaaacatgagcctgaatgttcaagtgttgtatcatcaatgacaaggacagaatatggatctgaaagtgatggctaccaatttgtttaaccaatttgatgttgtgcaagatttttctgatcattactatgcaaagaattcaccagggaagcagcatggtttcaatcatgcagaatctatctatgttagagcttatgaggataggattgatctgctgagggctgctattgttgggccagctggaactccatatcatgatggtctgttcttctttgatgttcgctttccttctgaatacccacaatctccaccggaaagttcattaccattcgggtgggcttcggctaaatccaaacttgtatgagagtgggaaagtttgccttagcctgctgaacacctggtggggtactggatgcgagaagtggggcaagtcaaaatcaaccatactgcaggtgctggtttccatccagggtcttgtgttgaatgataaaccatactttaatgagccaggcaacaaaaattcggctaatacagctcctggagaaaagtactcgttggcttataatcagactgccttcctactatcctgcaggacaatgatgtattcacttcggaagcctccaaagagcattttgagtcccttgttgcacgccacttccatgagcgtgagcgcgtcatcctggatgcgtgcgacgcatacatatctggcgcagtcgttggatcatcctctgcgaagggcaccaagcatccccgcgacaacaacagatcgtttgcagatttcaagaagtcactggagaagtactctgaactgctcaggaaggacttggccgcgaaccgcacacacttcctgaaactgacaagagactcgccggctgccgcagatgagatcgttgagtgtaccagcagctag

SEQ ID NO: 1086 - DNA, 1053 bp, Oryza sativa
gaaggtgcatatctagaaggcaacaaaagtttaagcaattgggatgtgttcactcatctaccagggaaatatcaaggatggaagcaacggagatatcgcggatgatcattatcaccgctacgaggacgtcgagctgatgaactccctcggcgtaaatgcctatagattctcgatatcatggtccagaatccttccaagaagggagatttggtggagtcaacccagcgggcattgatttctacaacaaacttatcgattcaattttactgaaagggaatacagccatttgtcaccctgacacactacgacatcccacaggagctcgaagacagatacggagcttggctctgcttcggcgcgttcggcgaccgcgtcaagtactggaccaccttcaacgagcccaacgtcgcggtgcggcatggctacatgctcggcacctacccgccgtcccgctgctcgccgccgttcggccactgcgcccgcggcggcgactcacacgccgagccctacgtcgccgcccacaacgtgatactctcccacgccaccgccatcgagatatacaagagaaagtaccagcagagaggaatgattggcatggtgttgtacagcacctggtacgagccgctgagagatgtccccgaggaccggcttgcctttcttgatccactggtctacggcgattacccaccggagatgcgccagattctcggcgggaggctgccgagtttctcgccggaggacaggaggaagctgcggtacaagctggacttcatcggggtgaaccactacacgaccctgtacgccagggactgcatgttctcagactgcccacaggggcaggagacgcagcacgcgctggcggctgtcactggagagagcaacgggcttcccattggaactccagggagctgatgttcgtggctacttcgcctgtttgggtacacccttcgatttggactgtactacatagactacagaacacaggaaagatctccaaagctatctgcgctgtggtacaaggaattcctccaaaatctgcatgaaaatcaatag

SEQ ID NO: 1087 - DNA, 1036 bp, Oryza sativa
gagattctgtccaagcaggccgtcaagatcgccaccaaggccgaggagcacgagcgcttcatcttcaaggtcacacacttgctgggtgttcttggatttgggacattttgctacctcctgggtgccaccacaggatgtgccgtatgtgtactgcctgttctatgtcatctttgttccgctccggtggatctactaccgctataagaaatggcattactatctcctgctgcaggacttctgttactatgccaacacttttctccttgttatgattctcttctatccaaaggatgaaaagcttttcatggtttgcttctcatttgcagaggggccgcttgcttgggcattaattgtgtggcgctgcagcttggtttttagctcatttgataaacttgttagtgtcctgattcaccttttgcctgggcatagttatattcactatccggtggtggaatccacaaacttttgctgcgatgcatccagaaggaagagcagccagagtcacatggccttatgtggaggacaaatcatacctgtggacatggctgtttgctgttcctctagctgcttacaccctgtggcaacttatgtattttctcatagttaatgtgctgcgtcggcaaaggctgttaaaggatcctgaagtcatgacatcatacagtcttgtagggagctctcaaagaaagcacagaaagcaaacaacatctggtggagactcagcgggcttcttggcgacaggaaccggccactcatgtacatactactccaagcgctgttcacggtggcgacaatggcgcttaccgttcccatattcctgtccttccagatgcatgtggtcttccagatactcaaggtgtgcgcgtcgacatggaacggtggaagcttcatcctggaggtgatgcctaggcaagtcgtccagaaggagaagaagaagctagagatgaagcccatggaagaggctaattcgagccagaatgctgaagaatcacaaggggacctgtcagcaaacggccagcactcatccgagcatagctaa

SEQ ID NO: 1088 - DNA, 1024 bp, Oryza sativa
  misc_feature (18)..(18): n = any nucleotide
atgcgtgttcagtgtgtncgttgcgctctcagcagtttaggtggggatcatcctggagaaatcaagaaggagctattgaatctggctttaccggccatagttggacaagcaatcgatcctgtggcgcagctgttagagactgcatatattggtcgtttagggtcctgtagagcttgcctcagctgccgtgggtgtgtcagtcttcaatattatatcaaaactgtttaacatcccactcttaagcatcacaacctcatttgtggctgaagatgttgcaagacatgattccgatcagtttacttcagaggaagagactcccctccatttcttcagctatacttttggctgctgcaattggtgtcattgaggcctcagctttgattctggggtctgaaatactcctcagcattatggcctgcaaagttgtttctttctttaagggcacttggtgctcctgccgtagtggtttcattggctattcaaggtatctttcgtggattgaaagacacaaagacacctctactttacagtgaaaagagcagttctactgcctccaaaaattgaagaccttgatttcgttgggtacataaaatctggtgagtgggtggcatgctattagggagaactctttcagttcttataacaatgacccttggaactgcaatggctgctaggcaaggcacaatagccatggctgctcatcaaatatgtctacaggtttggctggcggtatcattactttcggatgcattggctgtttctgcccaggtgcaactctcttttgtaatcaggcattgattgcaagttcttttgccaagcttgactatgaaaaggtcaaggagggtgcagctttagcccttcttctgtttgcctcttttggtagaattgcagttggggcaatatcttctttatttttgctatatgctcccaaagtttttggcctccctggggtttgggctgggctggctcttttcatgggtttgcgcatgactgcaggatttttgaggcaagtttttctttctga

SEQ ID NO: 1089 - DNA, 1011 bp, Oryza sativa
  misc_feature (962)..(962): n = any nucleotide
  misc_feature (965)..(965): n = any nucleotide
atggaggatgtcaagtcaggaggagcagtcccatttcttgaccctgacaactgccccaatggctgggctactcccccaggggacacattcatggtcagaggccctgattatcttgcaaccaaggtgaagataccaggtggggagtatcttctaaagcctctcgggtttgattggatgaaaagccccgcgaagatatgcgagattctgaataacaagagtcatcgtgtgaggaaagccatcgacggcgaggttttgcgtggtaatcagcctttcgtctgggctttcaacctgcaactgcccagcaaggataattacagtgctatattctactttgtgtcgctggagccggtaccggaaggctcacttatggatcagttcttgaaaggagatgaggctttccggaaatctaggcttaagctaatcgcgaacatagttagagggccttggattgttcgaacagctgtgggagaacaagctatttgcatattgggtagggctcttacgtgcaagtatactcagggatcaaacttcattgaaatcgatgtggatgttggatcttctattgtcgcaaacgcaattgttcatttggcgtttggttacgtgcagacgctaacagtagatctagcattccttattgagggtcagaccgaatcagagctccccgagagacttcttggagctgtgaggttctctgagttgaatccgggttcggctggtgtgtatgaagtgccatctgaggagcaacaagaaagtgcgccttttctgccggcaagattgtggcagggtttttcaaacatgttacataaccctggaaattccagggagccatcctctacttcacaaagcactaatgggagtttacacaaagaagatgcggatgagaatactagagaaagtttgcacaaagaagatgtggatgacaatactgctgggagcttgctcaaagaagatgggtacgagangtngctaccgggagttttgaccacaagaagatacagaagaggactctaa

SEQ ID NO: 1090 - DNA, 860 bp, Oryza sativa
ggcgcggcggtagagggggagagaggcgaccggtggcggagcggggacggtggtgataggagagggagagaggtggccggcggcggagcaagggtggcgagaaaggggaagagaggtcggcgcaacggcgagctcggccagctcgcggctgcggcgggagaggagacagttggtgcgacgttgagctcggcgtggtgcggtgacgagggagaggagaggagaggagaggcgcatggcacggcgcggcggcgtgggagaggagcggcgtggcgcccacctcttccctcttcgagcgcacgctcaccaacctcctcgccggcatccccgccctgcttgccggcctcctcgccctgcttgccggcctccccatctccttcccctccactcctcgcgcctcttcccctaagcggcggtcgtcgacgttggagccccctctttgccggtcgccggtagcagccactgctgaccacaacgactgccttgcgcggacaagaaagagggaggggacatacaccaccggccgcatctggcgctcatctgagcccgctgccgcccccatcgacacgctgcgctccactcctctccctcgccggtgcgccgtgcgctgcttctctcctcgtctccctcgcgcgcaggttggacgagctcgaacgggcttgccggccgcgtccccctccccttccaaaccgctttgccccactacccgccaaccgttaccgcgctcgcttgccgcccaccgtctgcatccgcgcatcgccactccgcccgccgctggcctctctcactgaagaagagaagagagaagagagaaaagagaagagaaggagaagaaaagggaagaaaaaaagatgtgcagctga

SEQ ID NO: 1091 - DNA, 832 bp, Oryza sativa
  misc_feature (481)..(481): n = any nucleotide
  misc_feature (508)..(508): n = any nucleotide
atgccggaagacgccgttgtgaggggaggggaaacgcggccgcggccgcggtacggccgcggtacccagagcggtccgtgcaccttctgtcctttgcccattgcggggttgatcccgcccttctctatgttcttcttcgacgtcttggatttctacgagatccatgtcttgcatctcgctcccaatgccgtgatgaccctggccatcttcgcacacctgtgcaagatgttcgtcgggtctacgggctggctggcggtctcggagctgggggaggagtacgacgcggagcgggaccgcctcaggggcctacgaagccggggcctaatggcggcaatggtgttcaaagattatttctgccgtcacatcgcgcctctccaggagcggtcccgcggcgcatgggagtacaccgggtacaatgaccccatgcgcacccatgtgggcgagcgctgggactggagcgaggaggacgcgaagacggttnttcggcgggtgctgggcctggacaccntcgagcatacgctaattccggatgggattctccctctctgcagcgaccgcgaccgggagaatatcctggctgtgatgatggctgtcggtgctggaggaggtcggccccgccagggcgccgttggtggcggtggcggcgacggcgcaggtagcagtagtgcgaccgcgggcggcggccggaccggcggctccggcgggggcagcggctccaggatgcctggtccgggctgtgggcctaggggagactcggtcgtcgacccgaaggggaagcggaagatgtccgagtctcggctgccctcaaaccccccaccccccgcgcgcgcgg

SEQ ID NO: 1092 - DNA, 815 bp, Oryza sativa
actgagcagcagcagaggacacgagtacgtgtcagagatccatgcgagcgaggagaggagagggaggggaggagaagggggtgcatgcttacgtcgctgtcgagggcggcggcggcggtgccccggtcggacggctcgatggcgagcagcgtgtcgagaaggtcgagcgccggcggcgagaagtccctgaacgtctcggcgatcttccgccggtacggccgctgcggcttgaacagcgtcacgtccggcagcttcgccttcgcccagtactcctccgacggcgacccgcacagcttgaagatcttgtgcaatatatttacctcggtttggccgggcaagatgggcttgccggcgagaagctcggcgaggatgcagccggtgctccagaggtcgacggcgacgccgtactcggtggcgccgaggaggagctccggcggccggtaccagagcgtgacgacgcggctggtgagcggctgcggcctggcggcgtcgaagaaggtggcgaggccaaagtcggcgatcttgagcgcgccgtcgccgccgatcagcaggttggcgcccttgatgtcgcggtggagcacgccccggtcgtggcagtggcgcagcccggcgaggatctgcgccatgaggcacttcacctgcggctccgtgaagcgcagccccggcgtggcggcgaggccggcgaggtcgtggtccatgtactcgaagacgaggtagaggctgtgggagaggcgcgacgtgacgatgccctcgaggcggacgacgttggggtggcccgtcgaggcggcggaggacgtggatctcccgcgccatga

SEQ ID NO: 1093 - DNA, 763 bp, Oryza sativa
  misc_feature (397)..(397): n = any nucleotide
atgccgatccgcaacatcgccgtggggagccaccaggaggtgtaccacccgggtgcactcaaggcggcgttggccgagttcatctccaccctcatcttcgtcttcgccggccagggctccggcatggccttcagcgtacgcaggcaagctgaccggcggcggagcgacgacccccgccgggctgatcgcggcggcggtggcccacgccttcgccctgttcgtggcggtgtccgtcggcgccaacatctccggcggccacgtgaacccggccgtgaccttcggcgccttcgtcggcggcaacatcaccctgttccgcggcctcctctactggatcgcccagctcctgggctccaccgtggcgtgcttcctcctccgcttctccaccggcgggctcgcnaccggcaccttcggcctgaccggcgtctccgtgtgggaggccctggtgctggagatcgtcatgaccttcggcctcgtctacaccgtgtacgccaccgccgttgaccccaagaagggcagcctcggcaccatcgcccccatcgccatcggcttcatcgtcggcgcgaacatcctcgtcggcggcgcgttcgacggcgcctccatgaacccggccgtctccttcggcccggccctcgtcagctggtcctgggagtcccagtgggtgtactgggttggcccactcatcggcggtggcctcgccggcgtcatctacgaggtcctcttcatctcccacacccacgagcagctccccaccaccgactactaa

SEQ ID NO: 1094 - DNA, 708 bp, Oryza sativa
ctgctcgagtactccggctaccagcggtatgacgtgcaccatgtcgcgaggtggatcgagcagatactgccattctcgctgctgctgctcgtcgtcttcatacggcagcatctccaaggtggtttctttgtcacaatttggattgctgctgtaatgttcaagtcaaatgatatattgcggaagcaaactgctttgaagttgcagggcgagagaaaaattgctgtgcttgtcgggattacagtaatcttcatgattcatgtgtttggtgtctattggtggtacaggaatgatgatcttctcagacctctgttcatgcttccgccaaaagaaataccgccattttggcatgcgatttttatcatcatgggtcaaatgctaacccttgtggaataccttctgctcctatatcgtgccttgttgccaactcctgtttggtaccgtttctttctgaacaaggaatatgggagtcttttctcatctttaaccactggactgtacctgaccttcaagttaacttcagtagttgaaaagcaggttcagtcattcttggctgcagtgaaagcattgtcacgtaaagatgtgcattatgggtcttatgcgacagcagaacagtgctggtgatatgtgtgccatctgccaggaaaagatgcatgttcctgtcctcctccgctgtaaacatattttctgtgaggactgtgtctctgaatg

SEQ ID NO: 1095 - DNA, 676 bp, Oryza sativa
atggctgctgttggcgcctgcttcctccagcagcttgctgtcgttgccctcttggctctgtggtgctctcatggcgccatcgcctccgatcctggccttcttcaggacttctgcgtcgtcgacaagatgtctcaaggcagtgcgtgtaaatgggttcccttgcaaggacgccaaggacgttgtcgccggcgacttcttcttctccggcctccacatggccggcaacaccaccaacaagcagggatccaacgttaccaccgtcaacgttgcacagatcccgggtctgaacaccatgggcgtctccctcgtccgcatcgactatgcgcccaacggcctcaacccgcctcacactcatccacgtgccaccgagatcccgaccgttctcgaaggatctctctatgtcggcttcgtgatatcgaaccccgagaataagttgttcaccaaggttcttaacaagggtgatgtgtttgtgtttccacaaggattagtccattttcagtttaacaatggaacaaacaatgctgtggctcttgctgctctgagcagccagaacccaggggtgataaccgtgggaaatgctgtttttggatcaaagccatctatctcggatgatatccttgccaaagccttccaagtggacaagaacatcatagaccgaatccaagctcaattctag

SEQ ID NO: 1096 - DNA, 675 bp, Oryza sativa
atggcaggacgtggtggaggaggagagctgcggctgctggggacgtggtcgagcccgtgggtgatccgggtgagagtggcgctggggatgaaggggctgagctacgagtacaccgaggaggacctctccagcaagagcgaccacctgctcaggtccaacccggtgcacgagaaggtccccgtcctcatccacggcggccggccggtgtgcgagtcgctcgtcgtcctggagtacatcgacgagacctggggagccaccgggacgccgcagctcctccctgccgatccctacgaccgcgccaccgcgcgtttctggaccaactacgtcaacgacacggtagagcagagagctgaggcgttcaagaacgtcgtccctcgcgtggaggcgctggagcgagcgttcggggagtgctccaaggggaaggccttcttcggcggggacgacgcggggctcgtcgacgtcgcgctcgggagccatctggtgtggatcaaggtggtggacgaggtggccggcgccaacctgctcgacgaggccaagttcccgggcttggcggcgtgggcggagcggttcttggccgtcgacgctgtcaggcaggtgatgcccgacgccggcgatgttctgaagcagtacaaggggttcctggccaaatggactgcaggcgctggttcgagctga

SEQ ID NO: 1097 - DNA, 643 bp, Oryza sativa
atgcatgctcataatctgcttgatcatacacaagtgcaagctccttaccaacaatgccacaataatcctgtcttacatggtgtaaatcattctggcaaccggttccatttgggtccaaggattccagttcttttctctaattctgaacgtacttttgggcctccacatcatccactcttggcaaatccagtgaaccacagaaatatacgaatcctgccacctgagagcatgctacaataatggatttttcaagattgtatgaagtgtcaaatgttgtagatgagcatagagatatgcggctagatatagacagcatgacatatgagaggagcttttagcattagaagagcagattggagatgtaaatactggtctggcaaaaagctacattgtagagaaattgaagactagcttatttgtgccaggatcatcctgcatgtctaataagtcttctgaatcttccatggagaatgatgcttgcataatatgccagcaggaagagtatcaggttaaagaatgcattggaacccttgactgtggccacaggtaccacgaagattgcataaaacaatggttgatggtaaagaatttatgccccatctgcaagacgacagctttgtcaaccggaagaagaagtggataa

SEQ ID NO: 1098 - DNA, 612 bp, Oryza sativa
tgcagggagcttctgtacaaaccagttgttattgtgtggacatatgtcatgtttctggtgcgtccacaatgctatgcatatcatcagggagtctcattgtgctgtctgtaggcagccttataaacattttcctagtatctgtcaactcctccatcacttgcttataaagcttgaacctgtggaatacaaaagaagggaaaaagaggtactagtgtaaggagctgttgtatcaacctgctgttcttaattgtggtcatgtcagatgttcatattggggttggatgcgattcatgcgggtatccaatacgagggaagaggtacaaatgtaaggactgcactgaattaattggatttgacctctgcgaagaatgctacaatacaaaatcgaaacttccaggccggtttaatcagcatcatacccctgaccacaggatggaacttgatcattcagcactcttcaataggttgatgaggctacaagggatacacgaggagggcccaggagagataatcatagaaggtgcatttgttgctcctgacgctgtggtgcatataatagcagatgatcatgaggaaatcgaggataacggtgaggatgatcacttgctctag

SEQ ID NO: 1099 - DNA, 597 bp, Oryza sativa
  misc_feature (193)..(193): n = any nucleotide
atggtgctctgggtcttcggctatggctccctgatctggaaccccggattcgacttcgatgagaagatcctgggcttcgtcaagggctacaaacgcaccttcaatcttggcttgcattgaccatcggggcacgccggagcatcctgcgaggacctgcacacttgagtccgacgaggaagccatatgctggggnattgcatactgtgtcaaaggggggcttaaaaaggagcaagaagcaatgaaggaaggagattctttgaagccagctgtgacaggtgtactagttttgtatccactcctgatccagtaggcaacaaatactatcttgggcctgctcctttggaggacatggcaagaggcaaattgctacagccaatggccccaatgggaataacagggattacctgttctcaatggagaaggcattgtccaacatatggccatgaagatgattcaatcatcgagctagctaacgaggtcaggaaggtgttgagccggccgaaggagaagatcactggctccgatagcccacaaaaatctcacgctctcgtacacctgtctgcgcttcctgagggcactgttgtggactcaagatag

SEQ ID NO: 1100 - DNA, 587 bp, Oryza sativa
  misc_feature (482)..(482): n = any nucleotide
ccacacgacattactaacccggatcacccagccatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccgagattttaagtttgaaggcgaccgtcgatactggcacagggtgcacgaatatcgaggcgcaactggatggttacaaggggacatggtatagcaattaacaatggaaggatcaaatgcaacaagttagggtggcttgccttgctcgagatctggagcttgatcctcgaaatcntcgcactgcgggtcttcgggctccgaaactatacgcaaaacgggacaactcaacaaacggcgaaaataaagccctattaatgacctctaagcgtgccattagata

SEQ ID NO: 1101 - DNA, 552 bp, Oryza sativa
gcaggtgacctcgggcagacgttcgactcgaacagcacgctggcgcactacgaggccaacggcggcgacgccgtcctcttcgtcggcgacctctcctacgccgacatcgtgaacggcaaggcgacgccggcggcgaacgtggacgcgccggtgtacatcacgatcggcgacggggggaacatcgaggggatcgccaacaacttcacggtgccgcagccggcctactcggcgttccgggaggccagcttcggccacgccacgctggagatcaagaaccggacgcacgcgcactacgcgtggcaccgcaaccacgacccggtgtacatcaacatcggcgacggggggaacatcgaggggctcgccgacgacttccggtggccgcagccggactactcggtgttccgggaggccagcttcggccacgccacgctgcagatcgtcaaccggacgcacgccttctacgagtggcaccgcaacagcgacggcgtcaaggtcgtcgccgaccatgcctggttcaccaaccgatactggtttcccaccgacaccaactag

SEQ ID NO: 1102 - DNA, 509 bp, Oryza sativa
cgccgggccaaatctgaggtccccttccgcctgcccgacgacctcgacctcggcggcggcggcccgggggctttcgacgaaatcggctccgaggacgacctcttctccaccttcatggacatcgagaagcgccccaagcaccgccacagcagctccgtcgacgaggctaagaaggccatgacccccgagcagctctccgagctcgccgccatcgaccccaagcgcgccaaaaggagaattctggcgaacagacaatctgcagctcggtcaaaagagagaaaagctcgttacataacagaacttgagcggaaggttcaaactcttcagactgaagccactactctctcagcacaactcacactatttcagcagagagacacaactgggctttctgcagaaaatgcagagctcaagatacggttgcaggccatggaacaacaggctcaactgcgagatggctctgaatgatgcactaaagcaggaactggagaggcttaagctcgctactg

SEQ ID NO: 1103 - DNA, 481 bp, Oryza sativa
aaggagcagctcgagatggacaaggaggatgagagccttcggagatggaaggagcagcttcttggcagcgtcgatttgaactcagtcggagctgtgcatcctgtcaccggggcggccggacgtccttctgccgctgcccgtggagccgagcaactccaaggaaccatggttcaccctcaaggaaggcagcacgtacaggctcaagttcaccttctctgtcagcagcaacatcgtctctggcctccgctacaccaacaccgtatggaaggccggcgtggacaaaaccaaggagatgcttggcacgttcagccctcagctggagccgtacacttacgtgacgcctgaggagacgaccccctcgggagtatttgctcggggatcatactctgcaaaaacaaagttcgtcgatgatgaccggaagtgctacctggagatcaactacaccttcgacatccgccgggactggccctgcaagtcctga

SEQ ID NO: 1104 - DNA, 402 bp, Oryza sativa
gaggtacttgcttgggtgaaagaaaagagaccgagcgtaagtaatgcatggatgattgaagaagttgattggggaccaaaccaagaccttctccaagtatacttctagctcaccatatcacttttggcccatagaagacaagagatcaagttgtacacgttttggattcagattcgggcctcctgacagcatcaaaatcaaacgtacctagccgctgatttagaaggaatttcggggcccatgagtacttgttggaaagcttatggagtctactttcagatggttttggtcccatgtcaaaattcctaccgagctgtcgggaatctgcaaaacaagccacgtacctcatccagtccgaatctaatttgggttttgggccttgtaattgtgtcatgggcttag

SEQ ID NO: 1105 - DNA, 395 bp, Oryza sativa
taaataaaactgtaattatcagggtgaagttttatacacaagaaattgtatttttccggcaagacctcctttataggatgcggcggtcttgtctgattcccccaacaacagaagaaacaagtgaccctttcgagcatctggtagcaaccatcacccatcagagtcatctttgcccattgcctcttacagttcagccaatcatatggagctacgatcattgccttcgactctatcctactcctcatacgatagtactgggcgacaagagcgaccagaaggccttcaaatacacaggaataacttgcttcaaccctggttcttttgctaacgatagcacctttgcagcttaccgtccttgcactaaggaggttgagctttctgcattagaaagctaa

SEQ ID NO: 1106 - DNA, 324 bp, Oryza sativa
ggtatagtgtttgcttatgcaattactctatgtcatgacgatgatattagagtagtatctggtagtttagacgtggtgtctagattacgggatatcattatttggggttatatattgcggatgagaggtgggccgctgatggtgacagctcagtacggatattcctccgcgcctatatataatcctaagttaatttcctggggagggtattcctctgtatttagccccggttggatggtcatgacgagctgtcgtatggaactcggcagtcaggggtggcttctcgaagtaccaggagggcatcggatagagggtattagctag

SEQ ID NO: 1107 - DNA, 312 bp, Oryza sativa
atgcaggcggtgaaggagaaggtgaaggacaaggtgagcgcggtgaaggcgaaggggaaggtgagcaaggccaaggccgacgagaagaaggaggtggcgacggcgaggtcccacgccgagagggagctggcgcacgagcgcgctaaggccagggtcgccgccgccaagatggagctgcaccaggacaaggccctccaccgcgaggaggccatccagcacaggctccataagcatggcgccggaaccaccgccggcgttcgtccgaccgccgcggcgccggcgccgcacctcccacctgctagctactactag

SEQ ID NO: 1108 - DNA, 2025 bp, Oryza sativa
  misc_feature (43)..(43): n = any nucleotide
  misc_feature (45)..(45): n = any nucleotide
atgaagagactcggcgtcatcgaggatgagaacaaggcggacnancgggatatcctccggtaccttgagctgttcaaggctcccctggcgccatctcatgtacaggcgctggcggcgctctgcagtgtggcggaattgctggtggttgggcagctagtggttggggcctggtgcgtggttggagatttcaacctcttggccgcggacggtgataaaaacaatgggaatgtaaatcgacggttgatcaacaagtttaggcacaccattgacgcccttgagctgcgcgaggcgctcagctcctctgcctctgaccactatcccctgttgctggcctgcgatcagatgatgcataggccgaggaagttcaagttcgaatcctattgggccaaattggagggtttcgaggttgtggtccgtcaggcgtgggcggcagtgccggccggctccaacgcgctcagcagccttcacttcaagctgcatgcaactgctgctgccttacggtcctggggagccaagcgtatcagtgagctccgtcagcaactcgcgatcgcccatgaagtagttttccaattggacaaggcccaggatgatcgtcttctgtcggctggtgaaagatcattgcgggcatctctgaaaggtcgctgcctcgcgctcacctccctggagcgcattcggctcagacagcgtgcccgcttgcttttcctgaaacatagcggcaccacggctcaattcttccgcctcaaaatcaatgctcgtcgaaggaagaaggcaattccctctatttgtcaggacgacatcattgcaataactaaagaggacaagcttcaggctgcgtatgattattttctcaaaattcttggcacgccttgccccccgtcggcatcccttgccttcgatgcgatcggcttggcagtgcatgatttctctgatttggagcgcgacattactgaagacgaggcgatgaaggcgatcatggaaatgccgagcgacaaggcaccggggccggatggctttagtgccaccttctacaagaaatcctcaattgtcctgctgccaaagaaggaggaaccgaatcaactgtcagattttcggccaattagtttgattcacagcttcgccaagattctcaccaagattttggctttgcgacttgcgccgaggatggatgagctaattgggccgacacagtctgctttcatcaagcgccgaaggatacaggagaattttctatatgtgcaggagggggtggtcaaaaacctccatcgttcgaaaacgccagccatgctcttgaagattgatattgcgaaggtgtttgatactgtttcctgggaattccttcttggtctgctccggcacctgggttttggggtccgatggagggattgcatcgcgaccttgctcttcattgcctccacttctgtcatcatcaacggcagagattcgcaacggatcaggcttgctcgtgggttgcgtcatggggatcccctctctccactgttgttcgtcatcgtcatggaagctctggtggccctatgtgcaacggctgtgcagcgaggagagctttctcctcttgccaatgtacatctaccgctgcgtgcctcgctctatgccgacgacgcggtgatcttcttccacccctccagacgcgatgcgctgacaatcaattttgtgctcaagctgatgggtgaagcattgggcaggatgaagtgccctattggcaagattatttggaaatcccgtgcaccggcgagatgcaagttctttatgtttctcgccatgcgcaacgcttgcctcaccgccgacaatctacaacgccgcggatggagccttcccaggtgtgccatctgtgctccaacgacggggaaacctgtcagcacatcttcatggactgcgcttacacccagcagatttggggtcgggtgcgcacgcgtctgggcctttcgtgctcttcgccgtcggcggatagcacggaaatctgttgctaaggttgaccgcaaaacattcgatgcggggttatacttgtaa

SEQ ID NO: 1109 - DNA, 1317 bp, Oryza sativa
atgctactaccgccgatgcgcaggcggcagcgctgcatcgtcttactgaacttgatggtgtccaaagccgacttgacggcgagattccgagcgaccatcttgctcctattccagtgtcgtcccttcatctttgagcttggctcagagtttgcgagggaagactcaccagacaccccagagcgaggctcttggtgcgtgcagccacgacatctcggtagccatgaggaagaagatgagcaagttcaattccctggtgctagcacgaccacgcacgccgttcctttcctggataccggtggaggcgttgctgcgttgcggcacggatcggcttgggaacatgaggaggagatgctcgtgcgaggaggagacaatcaggttgctgcagtcaactacttccgctacaccgacatgttctacattgaaccaatctgttccgactcttcttccactagtcgtcacgtcgagtggttacgatccatgatctctttcttcgcatggttcctggtttacgcgctgatcaaaaccacgattaatcaactgatcaacaatcaacaagctcgtcgtacacatatacctgaatttcgttccaaaatggctcgacccacccaccccatggcgatgcggctgctgaagaacatcggccggcgagctccagcatccatggcttgtgtcttgccggcgacgacggcggcgggcgtggcgttctccgagaccaataagggttactctgaactgaagcagatgtaccaagctttttgtttcaatcatcctgggctctatgacagtgatactggttgtgatgaatatgtgaagagaatgcgagcaatcgtcgagttagtttgtcgtcttgaaaaagaaggccaggactggacatcttgcaccattgaatgggacagcgagagggacttgccgattgtcccgcaatggacaccgtcatcccgaacccgaaccatgacagtcggtgatcgccatgccctgctcgccgccgccattgtcgtcgccggcgccgccaccctcgtcgccggcgccgctgttgtttcccgactaaatgcggaaatgggccataggctgtcaggactcaggaatgaggagagacagagagtgagacctgcaggcttacagagtttcagaccgccacgttcatcacatgttaggaccagcaggagcaaccctgaagaggtacagtatgcgggagatgacggcaacacggtggatggggaacaggacggaggcggtcgtcaagatggcgtcttcgtcaaggaaaagcgtaatcgtcgagtgaacatgaagtataaggggtccgagtgggccgtctaa

SEQ ID NO: 1110 - DNA, 996 bp, Oryza sativa
atgtccacaccgaagaagcacgttctcttccccttcacgagcaaaggccacatcgctggcttcctctccctcgctagccgcctccaccgcatcctcccgcacgccaccatcacgctcgtctccaccccgcgcaacgtcgccgctctccgcgccgccgccgccgcgccgttcctcgacttccacgcgctcgacgagatcttcccgccgctgctcatccccctctacgaggcgttcgagacgctccagccagccttcgacgacttcgtcgcgtcgaccgccgccgccgcagcgcgcgtcgtggtcatctccgacgtgttcgtcgcgtggacggtggaggttgcgcggcggcacgggtgcggccacgcgttctttgcctcgtgcggcgcgttcggcagcgccgtcacgcactccctcttcacccacctccctctgcgcccggaggagccgagcggacgtgtgcccaagtacatgctctaccagtacggcctgcccgctgccggtgcagcaaatgacggcagcggcggccgagcagacagacggttcttggaccggcagctagctcacggcaacaacaccgacgcggtgctggtcaatgccgtggcggagccggagccggccgggctcgccatgctgcggcgcacgctcagagtcctccccgtctggccaatcgggccgctctcgcgcgaccgccgcgacgcagccaccgagcccaccgacgacaccgtgctgcgctggatggacacgcagccgccgggatccgtgctgtacatctcgttcggcaccaacagcatgatacgacccgagcacatgctggagctcgccgcggcgctggagtcaagcgggcggtgcttcctctggaagatcaagccaccagagggcgatgtggccggcctcaacggcggcgcgacgacgccgtcgtcctacaatagatggttggcggaagggtttgaagagagggtgacggcgagcaagagaggcctgctggtcaggcggtga

SEQ ID NO: 1111 - DNA, 921 bp, Oryza sativa
atgccgtgtaaacctgattatcgtaaggatgagagtggtcttacaactgaggatggacagtatgatggatgggatgatcaacaatctgcaggtgggagcagtaactggaattctcgtgcaaatcgctcttttggtctggcagatattccagaatggactgggaagccttcattaccttatgaagatccagatatgctgagatttcttggagagcctattttaactccaaaaaacaatgaggtctttgatgatactattggtaagggcaggccagacaagtgcaactgtgaagtcccaggttccacttcttgtgtcagatttcatgtggcagagaaaaagaccgagctgaagcgtgaaatgggctcatcatactatgcaatgaagtttgatgaaattggacaggatgcagcattaacatggcaaaaggatgaagaaaagaagtttgagaccattgtccagcagaatctgccttcatctaagtacaatttctgggacaagctgcgtgccgccttccgttacaaaggtgaacgtgcccttgtgagttactacaacaatgttttccagccgcgcagaagagccttccagaatcgagtagctcaacatgctaatggtgtagatagtgatgatgactcaattgaacctgccttcctacgccttcgtcaagacggtgttcagcttcacctggagctcaagactcaaaaggttcatttatttttatcttcaccaattggttactggactggagacgactatcttaaaaggttgttttaccattacctcggtgtcctgggtggaatgagcggttgtttcatgttgatattgtcacagcgatccggacaattgaagaacaaagggcttgactttccaatattagattcagcatcgcatcacatcctgaaaaatgtaaacaggttgaaatga

SEQ ID NO: 1112 - DNA, 846 bp, Oryza sativa
atgatgagtcctggcgtttcggccaagaagcgccacgccggcgcggggttcacgctcggctgcggctgcaaggacgcgaagagcgtgtccgtctcggcatcggcggcggggacgccgtcgacaacggcgacgcggcgcaggagcgccgggacgaacccgtcggggtcgacgacgacggacactcttaccatgacgtccgcgtcgtcgtccttcctctgggagcactccgtggtggagttcgaccacgacggcggcggcggctgcgggccggagagcttctccggccttctgcgcgagctcagcgagctggagcagagcgtcgcgtcgtggggccggaagagccaccaccagcaccacgacaagaaacactcgccggcgccgtcgtcgccgctgccgccacaggaggacaggaaggagaagaacggcggcaacggcgatgccacggacaaaccaggagactgccgcgacggcggcggcggcggcgacggcgtcggtgtggctctcgacggcagcgtggcggtggtgaagcagtccgacgacccgctgggcgacttccggcagtcgatgctgcagatgatcgtggagaacgggatcgtcgccggcgaggacctccgcgagatgctccgccgcttcctcaccctcaacgcgccgcaccaccacgacgtcatcctccgcgccttcgccgagatctgggacggcgtgttcgcggctactgcctccctcgtccaccaccaccacccgcccccctcctcacgccgcgagccggtggctccggcggcaaggccgcccgcgccgaggacgcctccgcgccaccgccacccttcaccacgggcatggcgcgtgtaa

SEQ ID NO: 1113 - DNA, 807 bp, Oryza sativa
atggatcttcgtccaaggcgggatctttgggctctttcaaatgttcaaagtgtcttgctaccggagagggatcccattccaggtagtgttatgctcagagctgtgtttgatgacattgacgcagtaccgagagtatttttgctcaaggagttgcccctgagaggtggcctaggacagtcatggacctttggggtctttgttctcaacactgaatttgctgacattcatcttggtgatgaagacctccctcctttgatggttcaccttcaagaacctacgcaacagcataacgatcacatggatatgcagccagatgctccaccacaacatgatcagccctgggggaattgggatcagcaaggggagaataaccctgaaaatactggaaactcaggaataagtgctggccccaaccaaaatttggccatgtctattttggagaatgaagcttcccctttgcccctggtggtcgttcaacctttgggccatgatgaggatatggaccatgacatgggctctcccctgggccatgatgagatctttgatgttcaacccttggcaatttcagagccactagaccaggcccagcccaagagcccaccaagaatcggaccagtgcctctcctgttagaacccccaagagcatcagttaagaagagagatggcaagactgtcatgtttgatcctgacaggaggcagagttctcggttgagatcttcaagtcaagagctcactcaacctgaccctagaatgggcatagggaagccgaggggaaagtctgccaaaaaactgaaagagctggcatag

SEQ ID NO: 1114 - DNA, 642 bp, Oryza sativa
atggcagccaccaccggctattgccgatctccctcaccggagcattgccggccaaaccctcgcgccaccgggcttgcctcgatgagccgtcctataagccactatagccacttcttttaccggccggagcaagctcttgccgccgccgttccggcttcatctctcacttccactgctgacctctgctgtacccggatgcgcgtcgacggggaacacgttatgccaccggcgtcgccgtgttttggccaccggagggccggcgccccgctcgtcctctcttctccctctctcgctgccaacagaagaggagaagaaagaagacgggaggaagaagaaggagaagaaaaagaaaaagaaagactgacaggccccgacatcaaaccgttggttgtaaagtccggcaaaacccaaacccaaggtcgaagtgttgttcctggcaccccacgccttcatacgtataacggtcggagcttcactattccctcgaccttcatagcacgccgcacagttagctctctggctctgtgtgatcctagccgctccgtcgccactcatggttgtcggagtaacacttccaccccactaaacctacacaaatctcctattcctctagtccttatcctttctgttgacaccggctag

SEQ ID NO: 1115 - DNA, 630 bp, Oryza sativa
  misc_feature (23)..(23): n = any nucleotide
  misc_feature (53)..(53): n = any nucleotide
atgctggatccgctgcgagggangagcgcccttggcgctggatccgctcggancggcaccgcccgaggctgccgaaccgcccccaccgcagcggcggtgaggagaggagagggttgcctcgtcgtcgtcatcgtcggtggtggcggtgagaagggcatggcggtggcgccgctgcccactcgccggatccgccgcccgtcgacgccatcgccgcccctgctcacccctgctcacggccgccggcacatgctcttggagaggagagaaagagagagagacaggggaggagagaaagagagagaggggagaggagagtggctcgatggcaagggatatgaggagcacatcacggataggggtctcctggtgcgtggtgggcgccataggtcgggtgtcaccacgccactcatgttcctccccaatgaggccgaggaagtgcaggttgctagcaccagcgtggagaagtctgtggccaagctgatggatggcgacacggacaacacggctaggagggcacctggtagagagctcgctgtgagggccagggcggcaccgctcatgtacctccccgtcgaggccgagggcatgcaggtcgccagctccgacgtggagatggcatggccaagctga

SEQ ID NO: 1116 - DNA, 603 bp, Oryza sativa
  misc_feature (541)..(541): n = any nucleotide
atggctcttggattgtcacggagtcgtcctagagctcgggtgacctcggacgataaaactccagcagaggacctaggttttatagttttagggttagaagttggtgccatggtggagcagggtaggggttttggaggccgtgaggatggaagggaggagttgaattgcatgcttggaaggggcatgccagagccattggcggcttccggtgccgacaaggctgagcggtggcgcactgggatgggtagtcagcagcgcagggaaggcgcaggagtagtcgcacttgcacttgttgccgacgcactggccaatgccgcccctgtactgccgctggcagttcgccacgcacaagccgctgtcgcacgtcgggtattcccggctgatcacaagctagcctcgatcaccaaaaaaaaccagagatggatacaagctagcgccaagtattgcgtacctggtggtgatgatgatgaagcgacgaggacgatggccaggatgagcagtgctgcgtggatggccttcatctctgacgctgttgattttnttttttcacttgtgctgatcgatgctactgctaacggtgctagctttgtttggtggttatag

SEQ ID NO: 1117 - DNA, 585 bp, Oryza sativa
atggatggacatcgcacggaggaggccctagctgctcaagagcgtgaagacaagaacaatggcatgatcaacaagcttcttgacaaggttgatcgtctggagaaggaactagctgaactcaagggagaagcaccgccgcatagggccagagcttgtctgaccacctggaagagagccctcgttgctccccgcttccagctggctcctaagctgcatggctctgcctctgagtggtgggatcacttccgtctcaacagggctactgctgagctaatcatttggctcgagttcactgctgctttcaagaagactcataaaccatcgggagtagtagctctcaagaagaaggagttcagggcactcactcaaggttctcgttctgtcaccgagtaccttcatgagttcaatcgactggctcgttacgctctagaggatgttcacactgacaaggaacgtcaggagaagttgacggaagggttgaatgatgaactgtcttacccactgatgactggggattatgctgatttccagaagttggtggacaagatcatttgtcaggaggacaagtataaccgcatggaatag

SEQ ID NO: 1118 - DNA, 573 bp, Oryza sativa
atgcctcctgctttgcaagaatcttgcctccctgatttggcagtcatcaaagcagaggctgatgtgcaaagcatcaggactgctgctgctgaagcatggaaaaaacagatggttggtttctttctgttgaatcctattcctatttttcttctttggaggagggagagtacaaaaggtgcattggcatcccccggacgtacactcgccaacagccccagcacctatttgcgacttgcagttatcatcgcacgttgtgggagaacaggggccgggtacgttgacgctctgacaatcggccgacaccttcatcgacatatctgcaaattcagatcaaatcaaaacttattaagttttcacatgtgcgtattctatataatcaaaaagaaaagacgatcttcgtcatataaatcgatatataaacagtactacctccatcgatcgtacaagtacttcattttatttctagatatgaacttggataagagaaaagaaatggagttattttgggacgacgagaaatttacccgaatagtgggccgtgagagaaagggccagcagcagcgtgcagagtag

SEQ ID NO: 1119 - DNA, 570 bp, Oryza sativa
atgggtggtggtggtgtggggagtgtgaagccacgccaacaacggaggaggcccgcgcgcgcctccgccgcggcggcttcggcgggggcggaggggagagaggcggcggagggagtgacggactcggggatgggagggggctccacgcttccacctctcctcgtcgggacggaagctgtggacgacggcggcgcagcggagtggagcggcggtggtgggacgccgagcggatttctccctgagccgccagcgaccacggcttctacttctcctttcacagcctgtgcctccggcttctctcttttcctccccttagccggcagcactgctcatctcctccctcgactgccagatctagtgcctggccggcggccacccggcggcaggcgcggcggcggaggccccccgaggcaagaaggaaacgatgacaaggaggactcctgcgggccagatctgggttctccgtccacctcggtggcgccggtccacacctctcctcttctctgtggcggcggggtcggtggcggtggatggcacaccgccggcagtaatttgctcagccaaccatga

SEQ ID NO: 1120 - DNA, 489 bp, Oryza sativa
  misc_feature (51)..(51): n = any nucleotide
atggggcgaaaccagacgctgtggtggggacgacggggatggcaggagccnaggaggagctgtgctcgccggcggagaccaaggaggagctgcgtgccggcggatgcggatgaggaacaacgcgtgccggcggaatcgaggaggactcgtcgcggtagaccactcccacttcttccaatgccttcctcggcgccgctcgttgcccgccgcgcaatcctgcgtcctcctcggcaccacccaccgcccaccgcctccactatcctcctcgacgcggcctaccggccactgctccttccccgttacgcgacaagcttcagcggcggcgtacgggacgtggagcgaggcggcggcggcggcgggatcctccttccctcggtcgcccgagcgacctccgcctccgccgctagcaactgcccccgccctcgcctgctgccattcttggtgtcgtcgtgtgctggtgagctggtgaggagaggagggagaagatag

SEQ ID NO: 1121 - DNA, 480 bp, Oryza sativa
atgttcaccacaagagcttcctattgtcgtttctttctctatcgggaccatgttgttgtcagccgtgttcccattgttctggtttgcttcattgccaaccaccaccatctatggacgagtcacatcatgggacacgtccgaccaccttactcatccctgtttggtcgctggagcactgttgccgatcttccctcctcttctgttggttgtgttgggaagacgatggacaatattattgttttttattcatcttttgttcttcccgcgcgttcaaggaaaacggaatcttccgggaccgtgttttcacacactcatctagtcgtgttcaccaccaaaacttggtgttatcgtttctctctctatctggactacgtcgttgccagctccactcacatagatcggatgcaaagtatggttatgcgaaagattgcagcatcaagagctaaaccagaaacccagtttgaaactacatccatctag

SEQ ID NO: 1122 - DNA, 468 bp, Oryza sativa
atggcggcggctagaggaggggtcagaggtgcagccggtggctggaggccggcttggcgcggttggtggcggaggaggcgggcaaggcgcgacgaggcgttgccggcggtggaggaggcgagcacggtgcgacgaggaggagcttccggtgggttcggtttggtctacggcgcaagaaggctggctggtgagggcgccggtgcagtggtcccacgtgccggcagaagtttgacagtggtggggcatcgtgccagccgtggactcgcaggtggtgagtggcgggtgaaaacccagcctggtctcgccctggtcggcaacgatgacgttcgaagcgtcattcccctcctaagggcgttgtcatgccgtctcatccctcaagtgtggatgtcaggcgaaagcccagtctcggttctctttgaaaccttgacggacggcggcggtggtattttccgtcgcttctcttcttga

SEQ ID NO: 1123 - DNA, 429 bp, Oryza sativa
atggtgatgtccatcagcgccgccaccgccgccatgtcggctgccctccacataccaatgtgccggttctcggtgcaccacgcgctccccgaacatttcctcttcatcttctccaactccgacgacagggacctcgccctcgcgcgctccccgatcccggcggcctcctcccagcagctcctcctctggccatggacgcggcaggcgacggcgacggctttctccttgccgttcaaagtctcgctggatctcgtgggtgttccggcgcacgcttggaacccgtccacggctgtagtgctcatcgctccatgtaggctcttcgacatggacatggaggcttgcagactggccgactttaggatgttgcgggtctccgcccttgcgcacgaccccgttcatcccgcgggagcacctcctcctcatccctga

SEQ ID NO: 1124 - DNA, 327 bp, Oryza sativa
atggcggacctcgagcaatcttcctccgatgccgccacactgaagaagctgtacaccgaaggagccatccctccaaagcaaaccatggcgagggaggcaggaggtactgttcattctcccattttaggtcgcatggtagcggtagaggatttcatccgatgtggctttctacctcctccttctgaattcctcttgctgatcttaaacttctacgggatttctcttttacacctaaaccccaactccatcgcttttctgagcatatttgttcatctttgcgaggcctacattggggatgttgtggattccgccttcgtgatggcatga

SEQ ID NO: 1125 - DNA, 312 bp, Oryza sativa
atgctggagcctgaggtggagacggtgctggcggagcatgaggaggagacggtgcaggatcctgaggaggagatggctgagccggaggagatgatgcgtctcaccgtctcctccagggtaatccagctcgaggtcctcgtacgcgcctcgaccaactcaacttcgaccttcgagtatcctgctggaatcggcctgcagtggaggaatggtcggctggggatcatgggaccgatgtgcggccatgcgttcatcaaccttccttgccacctcctcttgcatgttgagttcgtagctcgatacccggaactctag

SEQ ID NO: 1126 - DNA, 3666 bp, Oryza sativa
  misc_feature (3450)..(3450): n = any nucleotide
  misc_feature (3550)..(3550): n = any nucleotide
  misc_feature (3559)..(3559): n = any nucleotide
  misc_feature (3561)..(3561): n = any nucleotide
gtttcttggccgaaaccctggctgtggaagatggatggtgttgacaaggataaagggaatgggaaggtgcatttcagggattcctctccccaggaagctttccgaacctacaagaggcgccggcagccacggccggagccgcaacagcaaccgcagccgcagccgcagtcagagccggaaccacagcaacagccacagccacagccacagccacagccacagccagaggcagaggcagaggcagaggcagaggccaaggctgcagatgttctggcacggcaggtgactgaaacattttggaaaagtagggacattggatggaagcatggcataatgatcgacgagaacagacaacactggaagtgcatgtattgtcacctgactagatatggtggtggtgtctctagacttaagcggcatcttgctggtgatctggatgtcaaaatgtgcccaaaagttccagctgacgtctctgaaaaaataagggagcatttgcggaagaaaagagaaaggcgaaagaagcgagctgcacaaaatcgtgataactgtgtgacggctaagagcacctctgatgatatcaagtctggcaaagatcctttacccgttgattcagaggtgctgactggagtagacactgttcttgaagaagttactaaccaaacgaaccatgataatcaggatcttacttatcccaaggctaccatgttgttacgagggataagagatattgggtgggagcatgcagtggatcttgatggaaataaaagacgatggaagtgcaagtggtgttctttatgtcgaagtggtggtgtaactacattgaaggctcatcttactgatagtagttgcccaaatattcctaaggaaatatcaaaaaaagtgttgaactttattgaagagaaaagggcagcacgccatctttttaatagcgctgcaaaatctcctttcaatgtcaaatttgacgaggatgcagttaatctctcagaaatacaggtggaaggtactccaccattgacagatgatcgacaacctttaggaaattccttgcatatacaaacatcagagtgcaccattaatgagtttgaaaaggtggcagctggaagcaaccaacagggtgcagaacatagcaaccaactacttaaccatggtgaacagctgatgaaaagcagcgatcaacctgaggagcactgcaccttggaacatggaaggtgccaagtacttgacaataataagcagcagactatggacaataaaactgataatccggaacacaaagaggtcttgaaacaccctaaaaaaactaggtttaacataaggaagcatatagttatcgttgatgaatctgcaaggcattggaggtgtagatattgtggtttggatgggtatggcaaaacgtctaggctccattttcatcttgctgctgtgtttcgacatcctaagtgcccaagtgttccaaaagaagtttttgcaaaggcacggcatcatattcacttaaagagaaggctcaatgtgaaaaaggctgggcaacaagctcgttcaaggccacatattcttgggcaatcgagtcagcaacagcagaacaacaatccggtactttccaattacccaacaagattgagggacaatgcatgggaacattcgcttattcatgacaaagagaagggccattggaagtgcaagtggtgcagtttagagggttatcatggcataactagattgaagtggcatcttgttgggtggcagaatcgtcctcaatgcctaaatgttccagaagatgttgctaaaactattcgggataaaatgatatcaagagagaagcagaaagaaggaagattgaatcttgatgttattgacagttgcaacatgccatgctcttctgagagtttacagtttgatcaagagaattttgctgaggtaatgcagggaaaaggttcttctgaagattttaatcaagctgaaagacaatcaaacacattgaacacagtatgcaataccactcatcctccacagaacagcaacaattatcagggacttcaagaaaatggattatatagtagcaaaaacaaatctgagaagcaaactgaaagatatgactgttggagtcactggcgatatgttttagatggactgatgcatttgccaggtgcactagagggtcctggcattcagagttgcatccgtgatgtacttctttacggttctgctgaatttggaactgttggggacaaagtggaaatggattccaacagaaaagtgtcaagtgatgggaatattgctaagtgtcagagtgttcttgtggatgttttaaagtcagagaattttgccttattgtgcaatgtgcttggcagaactgtccatcaagatgagcaaaggactaagtattttgattttaccatgattgactcaaggatgaaaaatggagattatggccgtgcaccattattattcaaacatgatttgaaaatggttgaaagagagaggggatcagatgatagtgaagagaatctgaagggagctgcggcgaccaatttggaacccatgaacatggtcaagtcaaatgcattggtactttcaacctcacaaggcttcaaccagttggatcaaccagatccaatggatgtttgcgatgaacaaaacggtactaactgcaatgaatgtggcaaggtagcgaaaattgatagcatcctcacatgcaagagatgcatgctagcattccacgtctcatgcattgaacctcctgtgccatccacttcaactggaagctggtgttgtaaaacctgcagcaccatctgtaacgaatcagctgaagttggcatggccttggtccattatgaaccaaatcgtttgcacggacattgcgtcgcatgcaaggaccttgagttttgcaggcctccaaggtgtgaggaaactgccagtgaaagggcacctgctgataactccagagcaattgtgattcccagtgcagagcctgttgaggatgtggaattgtcagatattgatgtcaggggcttatgcaagatgtgtggaaatcccgaggagaaggacaagagattcttggctacacagatcgctagtgacaagcagctggacaagccctgctggtactgcccatcgtgcctttgccgagtttgccattctgacagagatgatgacctgaccattctgtgtgacggctgtgatgaagcttatcatctctactgcataacaccccgtcgaacttcaatacccaaggggaaatggtttgttttcaagtttcaaccaacatgcattgagcatttgagtgtggacatgactcagtttacaggaaccagtttattttctgtcggaatcgagaaagtttctctcgttccaaacagagctcccaacatgtgtcgaaaagattatgagatattacgagcttatttgtctccaatggctgcagtcactttgctttctttagaaccagacggnccatttggtggaaacctcattatagcaaataatagaatttatttatcggaaaagactatagagatggagaagctatctcgatcacctcgaacccatgacntggtcactnancattatggagataagactcaggggatcttaaattcaaaaattttagttgatgtagtctctgaagcccgtgccatatctcatgggtcattacatgacaaaatatga

SEQ ID NO: 1127 - DNA, 3513 bp, Oryza sativa
atggatcatgtagtcgggggcaagttcaagcttggaaagaagatcgggagtggatccttcggggagctcttccttgctgttaatgtgcagactggagaggaagtcgccgtcaaattggaaaatgttaagacgaagcacccacagcttcattatgagtcgaagctgtacatgcttctgcagggaggaactggtattccgcacttgaagtggtttggcgtggagggagagtacaatgtgatggtgatcgatcttcttgggccaagccttgaggacctattcaactattgcagtaggaaattctcgttaaagactgtcctcatgcttgctgatcagatgatcaatcgagttgagtacatgcatcagaagggatttcttcaccgtgatatcaagcctgataatttccttatggggcttggtaggaaagccaatcaggtatatataatagattatgggcttgcgaagaaatatagggaccttcagactcacaagcacatcccatacagagagaacaagaacctcactggaacagctcggtatgcaagtgtcaatacccatcttggtgttgagcaaagcagaagagatgatctagaatctcttggttatgtccttatgtacttccttagaggcagcctaccatggcaggggctgaaagcaggcactaagaagcagaagtacgacaaaataagtgagaaaaagatgcttactcctgtggaggttctttgcaaatcttacccatcagaattcatttcttacttccactactgccgttcattgaggtttgaagacaagccagattattcttacttaaagaggctattccgtgatctctttatccgggagggatatcaatttgattatgtatttgactggaccattttgaaatatccccagataggctccaaaccactgatgaggccaagtgaaagaaccagtggagctgcgggaccttctatggagaagatggaaaaggccccaggtgaagcatctggcagaaggaatcctactggttctttgaatcagagtgacaattatgcacaacggccgtcaatgtcactaaaggaaatcatgcatagcaccgaccggtccggcgaaaggaccgtggaaagaccccgtacatcctcccgtacaggcagtgcatcaaggagagcggttgcgtcaagcagcaggccaggttcatcggtggaaccaatggagcagcaatacagccggacaagcaggttgttctcaagcagtggaagccgtccttccagcacgcagagggttaatccatcggttggagagacaagggccacttctctctcacgagcagccgttgcaagagggtcccgcgacgagcctctccaccgcagcctggagctgctgtcccttggtggcgttaatgaggaaatatttttggcctgggctccaagaacgcacttacgtgggccgattgttgcgctggccaacctcatccccgaagatgacgccgtcgacgagctcgacagctacatgtatcaaactatgaaatttgatgcaatttcattgattggacttgcttgtagggagcagggtcttaaatataatgttaccacaggcgatgaagtggaggatatgtttgcgctcttgagcgaggttaaaaggcaaatcccatccatcactgcagtgtcttcaggcgccattgcgtctgattatcagaggcttcgtgttgagagtgtctgctcaaggttgggcctggtatcgctggcgtatttgtggaagcaggatcagactttgcttcttgatgaaatgataagaaggggcatagtagctataatcgtcaaggttgccgcaatggggctcaaaccttctgctcacttagggaaagaactggctgaacttaagtgtcatctgctccaactgaatgagagttatggaatcaatgtctgtggtgaaggtggcgaatatgaaacactaactcttgactgccctctattccgtaatgcaagaattgttcttgatgattttgaagttatactccactcgcctgattccatcgctccagtaggaattcttcacccgttaaaatttcatcttgaacacaagccaaattcttttggcaccgttggtgatagtgctattgcccaagagaattctagttatttgtatgaagtagatggagctattgcacacagtgatgtcgaaaagaaacaagagaccttgagtccagttacaactgttgatgcttgcacaaatatagacctatgcatctcaaagactggcaaaaagttgttctccattggttgttggattcaggatccctgtggtacttcagaaggcctgaagacagatctagtagcagttttgagcagaatcgagaatcagctcaaggaagaagggttaggttggatgaatgttctgtatgttcacctcttcatttcaagcatgaaggaatttggattggccaatgaagtttatgtgagctttattactgaacaaaaatgccctctgggtgttccttcacgtagtacagttgaattgccactagttcaggttggtttaggccatgcatatgtggaagttctagttacaaaggagcaagtcaagagagttctacatgtacaaagcatttcatgctgggctcctagttgcatcggaccttatagccaggcaacacttcatggagagattctctatatggctggtcagctggggcttgatccccctacgatgaagctctgtcctgggggcccaacggctgaactagaattcgcattacgaaacagtgaagctgttgctaatgcctttggttgctccattttttcttcggcaatacactttctggtgtactgttctgcacacttgacgtccagtgaaaaagaacaagttgaacatacacttcgtagttcgtacatcaccagtttggattgctcaaataccggatcatatcccaccattctctatgtatttgcatcagatcttccaaaaggagcatacgtggagataaaaccaatattgtatgtccccagtcccactaatgatgatggagtcccaaccagagaacaggaggctggagggtcattgccagcatcaagcgaagcttttagtgcctggagcgcacaatactctgacctggatgattcatgctgccaggtgcacacaatcggtgggaaaatttgctctgctgttgtttcagtcacaaatgatattgcattgaaaatctgttctacaactgaacaactataccactcggaggagcatttgaaagctttggctagattttgtgcattccagcttgctaagattctgatagataatggcttttcctgggacaacctaacgatgttaagattctactattcagtagagcacccagtgactgcggatgtgatgtcccgtgtattttctgaggcattcgccgagcttgaagaaggtggtgttggttcctgcacacctgatggggttcctattttcaacatcgtgccagtgtcggcatctggttgcttcacatcgttaagcgacattatatcatgcgagctattagcttcgaaagtttaa

SEQ ID NO: 1128 - DNA, 3492 bp, Oryza sativa
  misc_feature (145)..(145): n = any nucleotide
atgggggctcttgcgccgcggcggcgcgggtcggggatcgaaagcagcagcagaagcagtagatctggaggggtcagcgaaggcgttcatcagatgttatccagtgaggagccttcaggcccctcttgctcttctatccagggtntgagcgctgttccggcgacgtcccccggcgagtcgccggcgagccaggatcccacagatctggtgcaaccgtgcgccaaattctctataagagattatgtttttgcttcaaggagcaaaggcatcaagagaagctggcctttccatccacggtcgctgcagctttgcctgaagcgtggtgtgaaggatctgctacctccatttgaaccacctgatttgattcgatcccggtctttgagtactaccataaacgttgagcaatctgctgcaagttcagaagccaatgctccggttggtctggtgaagactagagatgatggttcgtctattgtgaatgcaagcaatatcaacttccagtcatgccaaccagtagctgagtcacttggtccttcacagtacacctcaccagaggatgggaaatctgctgttgaccaaggggagaatacaaatggattggaccatactgatgaggttatgccagtagatctgcaagtcaatagttgcaccaaagcaattcggcaaactgaggttgctgtaccctcttggcgatcgaaaaatcttgactcatcacgagagccatcagaaaagaagtgtaaattggtagtcaaagtaggatccttgacgcggacagaagaggtggcatctaattctagcacggtttcagacccgatggcctcaaaaacctgtcctgtttgcaaagtgtttgcttctacttcaaacacaaccttgaatgcccatatggaccagtgcctttctgttgaatctaatactgagccagtggaaaaagttatcttgaaaccgaaagttaagccaaggaagaagcgactgatggtggacatttacaagactgcccgtctgttcactcttgaggatcttgatcagaggaatggcactaactgggctatcgaattggctacacccaccacgaacaaggaggtttgcactgagaaccgtagcccagaagtggtgccgtttgacccaagagacgacgaaagagaaggcgatgtctatgttgattctaatgggataaaaattcggattttgtccaagtctagtgatgcgtctttggtgttgagggatgaacataattcaaggaaagttgccaagaacgagactggaaaaagtatgttgatgagcaagacgtgcttgaaatccaaaatatgcaagaataagaggctcaagtttccagggaagaagcacagcaaaactaaccgattgaatacccaggttcgaacacatacagatggagatatgcatgagcacacctctgaggacgaagaggagtccactatgcatgtgcagaaacctactgaaagcacaagttatggtggctccgaaactataaggcaatgggtgggctccaaacgctcaggtctctctaagaattgtgcccgagaggttactgataaagcatccaagagtataacgcctggaaccaagaagttggctaggagcagcattcgtggttttgatgattctcaaatatcagatagtcctcctgaggcattttcttcgcaaccgccggaagagatgacgatcacttcagaagctaatgatgatgacgagaggaatggtacttcgagattgctcagatcgattcctagatggtctttaaaaactactccatccagcaatgtcataccaaaagtacctaggtctgctgctgctctagccaaaaggaaaataaaggagatcggaaggagagagtcctataggtctgataactatgatacagtgaggaattccacctcgatcagaaactctgtacgtcggggtccttcctcctctgttgctgggctgagtgatggctcaaatagggttgcatctaccaagaagttccggaagaaccgatctctgttgaggactggtaggcgtgaattctcaccttctaacagtgggctagttcatggttttggtcaagaccatggatctaatcccaatcatacaaacaagaggttcagggttagtaacaaggaaacctccaagaagcttaagcacactcaagaagatactgcagataatgacttctcttatgaaagtgatgtaccagcattaggacaaggggatgatcaatacgatgcggctcaacaagcaggaatttcacagatgtattatgaaggtgaagagcctgaaactgaaatgcaatgtgcatcaccctccagaagtgatcctgtagactgcagcaatgatatgagcagcgattctttgagtccggaaaataatgagacggcagatgatgttttggtggaaggctatagtgtagcaattgtggatccatgctctaatgagaaatctgcatatcatgctcatatacccaacgacgttgccaataatgaggtggaagaatggcaaattgatccgtcttcaactaaggaatctagtgcctgcttgaccaataatagggacatgggtcttggagctcctcaggataactcatcgattacatcaaacagagaagattctaaccttgatcacggtttggtttttgatcgtggctcatccggctctcctgtttcaactgcctccacactgtctccttcaacttctttgagggactctaggactaacaggtctgagccaggtccatccactgttagtcttccaactgttgaggaacgggtttctgggagctcgaatcaagaaaccaagtcgacacctcttgccagagaaggtgaacagttgcctgaaaagtcctgttgttgcaattgtcgggagagcatttccagggattctcaggtgcacgatcaaagtgcgatggctagaccagtgccagcttttactggaaggccggttccacagttgaacataggtttgcgtgcgtcttcatcgttcagcacatatcaaagaaccagcacaaaggcaaatccttgcttagattcacatgatcagacattagctggtaaggtttcagctgagcctaccatgacccacccatcttatacgacagattgtatgagcccatcaatacaaactcagcttccttcaccatcaaatcctattttgagattgatgggcaagaacttgatggtgatgaacagtgaggagagtggacatcctcaggcacccagttcagattacatcatgagaggaaattacatggcacctggttgttttatgcctcaaaactaccaacatattggtgatcctgcatttatgaacacaacaccgtcaacagccaatcatcaaattcctctgtcaagtgtacaagctggcaacttttctgctcctacgttgcataatggttccatggtgcaatctgattatcattctccacaaaagccatacaggaacctccttccagtcatgcatcatccatcctacatgatgaaagaagtaatcatgaattga

SEQ ID NO: 1129 - DNA, 3162 bp, Oryza sativa
  misc_feature (108)..(108): n = any nucleotide
  misc_feature (110)..(110): n = any nucleotide
  misc_feature (128)..(128): n = any nucleotide
  misc_feature (146)..(146): n = any nucleotide
  misc_feature (156)..(156): n = any nucleotide
  misc_feature (161)..(161): n = any nucleotide
  misc_feature (300)..(300): n = any nucleotide
  misc_feature (305)..(305): n = any nucleotide
  misc_feature (352)..(352): n = any nucleotide
  misc_feature (409)..(409): n = any nucleotide
  misc_feature (422)..(422): n = any nucleotide
  misc_feature (453)..(453): n = any nucleotide
  misc_feature (456)..(456): n = any nucleotide
  misc_feature (474)..(474): n = any nucleotide
  misc_feature (476)..(476): n = any nucleotide
  misc_feature (510)..(510): n = any nucleotide
  misc_feature (513)..(513): n = any nucleotide
  misc_feature (517)..(517): n = any nucleotide
  misc_feature (555)..(555): n = any nucleotide
  misc_feature (1341)..(1341): n = any nucleotide
  misc_feature (1347)..(1347): n = any nucleotide
  misc_feature (1390)..(1390): n = any nucleotide
  misc_feature (1805)..(1805): n = any nucleotide
  misc_feature (1812)..(1812): n = any nucleotide
  misc_feature (1867)..(1867): n = any nucleotide
  misc_feature (1871)..(1871): n = any nucleotide
  misc_feature (1891)..(1891): n = any nucleotide
  misc_feature (1971)..(1971): n = any nucleotide
  misc_feature (1997)..(1997): n = any nucleotide
  misc_feature (2012)..(2012): n = any nucleotide
  misc_feature (2028)..(2028): n = any nucleotide
  misc_feature (2031)..(2031): n = any nucleotide
  misc_feature (2053)..(2053): n = any nucleotide
  misc_feature (2086)..(2086): n = any nucleotide
  misc_feature (2112)..(2112): n = any nucleotide
  misc_feature (2152)..(2152): n = any nucleotide
  misc_feature (2313)..(2313): n = any nucleotide
  misc_feature (2620)..(2620): n = any nucleotide
  misc_feature (2678)..(2678): n = any nucleotide
  misc_feature (2706)..(2706): n = any nucleotide
  misc_feature (2708)..(2708): n = any nucleotide
  misc_feature (2755)..(2755): n = any nucleotide
  misc_feature (2881)..(2881): n = any nucleotide
  misc_feature (2901)..(2901): n = any nucleotide
  misc_feature (2950)..(2950): n = any nucleotide
  misc_feature (2970)..(2970): n = any nucleotide
  misc_feature (2976)..(2976): n = any nucleotide
  misc_feature (3011)..(3011): n = any nucleotide
  misc_feature (3037)..(3037): n = any nucleotide
  misc_feature (3089)..(3089): n = any nucleotide
  misc_feature (3103)..(3103): n = any nucleotide
  misc_feature (3156)..(3156): n = any nucleotide
atgccaccgaagaaggtcgtaaaggagaaggttacaaggcgaaaggaaagcgacgccggggcggatatggccgccgaagagggagcagagccttcggcgcctgtcgcngnagatggaggaacgccatntgcttccgcacctgcgcnatcactaccnccttnggcccctgctacctctgtgcaggtgccgaacgcggctgacatgacgaaggcggctgcagcggcgagggtactccagaccagggcggagatcctttcgacaagccaactgctggtgccccaagccgctccgtcacagccngcagnggccccaactgcgctcgctgctgtgcaagtccaagtcaaccctgacnccgagacacaaaccgaagccgacatggaagccatgcgacagaacatgacacgactcnaagacatgcttcnccaaatgcaaggacagcaacaagcgaagcgnacnaggcggtccaaggtcgcntnggcaccaatcctccagtattcggcaggaagttgngcnagcnccaatgtacttcgccgggcagccatcgaccgcagcagngcatccggcccctcacgtgcaactgcaagctcaaccggtcgctgcccaagtacatccttaaccgcctggccaagtgccacaaacaatggcagaaggggcttcagctctgcaggcgcagctccaagctttccttcagcagctcagccaaccccacaacatttcaagtacaaccccttcggcccgcccggaggggaatacaagtcaaggtgcgcctcgttggttgccttcgaatcagctaggtctggggacttcgccttggagtcaaggaccacagttcgactccatcaatgctgcttaggcgccaaccgttcggccgcaagcaccaacgccaggtttcggagcaaaccaagcaccaaaccaggtcgtcatgacatggtcacagccaactttcgacccattcatggcggtacagcaagcatcaccaatcgggccgggcagccgaatgccatggcccaacctcacgcgcaagccgtgatttcgcccttcgccacgccatacccgcagcaaggtgccatgaacagggcagggggcgaaaaggggctaccattgagtgggggaatcaagacccgtccaatcccaccccagttcaacttcccacccgtcccacgctactcaggcgaaactgacccaaaggaattcctctccatttatgaatccgcgatcgaagcggctcatggcgacgaaaataccaaggcaaaggtaatacatctcgccctagacggcatcgcccgctcttggtatttcaatttgccagccaatagcatttactcatgggagcaattccgngatgtntttgtccttaactttcgaggcacctatgaggagccgaagacgnagcagcatctactcggcattcgccagaggccgggggagtcgataagggagtacatgtgtcgcttctcgcaagcccggtgccaagttcaagacataactgaggcatcagtcataaacgccgcttcggctggtttactcgagggcgaactcacaagaaaaatcgccaacaaggagccgcagacgcttgaacacctatttcgcatcattgacgagttcgcaaggggcgaagagaattccaagcgacggcaagcaatacaagctgagtacgataaggcttctgtcgccgctgctcaagcccaacaacaagttcaagttgccgaaccacctcctctcgttgttcgccaaccccagccggcgatccaagcacaaccgccaaggcaaggtcaagcccccatgacctggaggaagttcagaancgaccgngcgggcaaggctgtgatggctgtcgaagaagtgcaagccctccgcaaggagttcnacgntcagcaagcaagcaaccatnagcagcctgtccgcaagaaggtccgaaaagacctctactgcgccttccacggacgctcttcgcacaccacggagcaatgncgaaacattcggcaacgtggcaacgngcaagatccaaggangcagcagggagcagcngcngaagcaactcgtgaagtagctnaagaacaagcacccccggccgaacagcgccaanatgcgcaacacagagtgatccaagtnattacaagggccgacccgccgatccaactgtcgaagcganagaagaagatgcagctgcgaacggtccacaatatcacttcggcaggcgaaggggctccgcagtatctgaaccagcaaatcttttttgggccagaagatgccgaaggagtaatgttcccgcatcaagatcctctggtgatctcagccgagatagctggtttngaggtccggcgaatcctggtcgacggaggaagttcggccgatgtcatctttgccgaagcatatgccaagatggggttgactacccaagcccttaccccagcaccgacatcgctccgaggattcggcggagaagcagttcaagttcttggccaagcacagttgatagtagccttcggcacgggggaaaacagacgcgaagagcaagtattgtttgacgttgtcgacatcccatacaactacaacgccatcttcggccgtgcaaccttgaacaagttcgaagccatttcccatcacaattatctcaagntcaagatgcccggcccggcaggagtgatcgtggtcaaggggcttcagccttcggctgnttcaaaaggcgatttggccataatcaananagcagtgcacaatgttgaggccgaaccgcatgaccgggcgaagcacncgccaaagcccgcccctcacggcaagatagtcaagatgcagattgatgatgccgaccccacaaagctcgtatcactggggggcgacatgggcgaagaagaagctaagaacatcctagaggtactcnaaaagaacattgatatcttngcctggggccctgatgaagtgggaggtgtttcggcagatctcatcatgnatcacctggcagtcaagccngatgcnaagccaaggaaacagaagctacgcaagatgtccgntgatcgccaggaggcagcaaaagccnaagtccaaaaattgctcaaggcagggtcattcaagagatcgatcatcctgantggctggcgaatcnagtgctggtgcggaagtcaaatggcaaatggcgcatgtttgtcgatttcacanacttaa

SEQ ID NO: 1130 - DNA, 2682 bp, Oryza sativa
  misc_feature (99)..(99): n = any nucleotide
  misc_feature (101)..(101): n = any nucleotide
atggctgaattctcgtcagcgaaatgctgcatgaaatctcggcggacaccagaagcaacctggtgtgattttggtgtgatgaacgaggagaagagggcnanggttggggatactgccgagaccccgcggaaatcccctcgcctggatcggccagctgcggcggcggcggcggcggcgccgttaaccagcaacggcgtgatgggcgagaagaagaagaagaatgcgacgcgggatgtgagcgattggtgttggtgggggaaagcggcggcattactatccggcggcgaccgccgtactcgacggtgccgccatgtcttgtgtgagcaggctgacattgatgtggccataacactgatcaagacccgcgttgacaccccggtgtgttgtgttaacaagtgtgatgatactgaggggagggaaatctcggtgtgtttggattgccagttgagtttctgcacggcacacgggaagccgcacgtctttatgaacgaccattggattgctctggtgtacaagaggcccaatgtggcgcattgcttcgcgtgtgaagagtgctatttcatcagaaccgacagtctcggggagggaatggcggtcggtgagaatggcttctccatcggtacccataagaaggatgagaagggaatgacgacggtcaacaatgaggcaggtgttcatgcatctatggtgtctgattatgaaagcgccctcatggtggctttactcagtgatgtcggtactccacggtgcaggcatgacatgtataacaaggatgaggttgatttggtccaaagacggatcatgttctgcgatatcaccagaatgtgtagtgattgtgacaacatcagtgtgcttatgatctttgtgtgcttgggatgtgaaaagcctttctgcactgtacactccagtttacatgctgagagcaccaagcatttggttggtctggtgtaccataacccgtatgtggcgtgctgcttcctgtgtagtgaaacctttgtcctcattggtgagggggataagaggatgccagttgacaaagcggcaggtggttatgcatctgagtcagttattgggcatgcccatgctatcaaagggataccgaatcttggaaacacttgctacttgaattcattgatgcagtgcctccttgtgcttggaaaactgcgggcaaggatgttaggaccggacgctccatcagggacccttggtactgcattgcatgacctctttgagcaaacatacagtgtgaataatgcaacaggcctgctggagacgtcattgctcttggattgtgtatgcaatttggacccacagttcgtaggaggttttatgcatgataaccatgaattgctttgctgtttacgtaaaaatttggatgaggaggagaggatgaggacgcctcctaacatgcaagacagttctgctggtgcagtgcctcctacggtttttaattccattttcggtggtcagctatttgttaccagatcgtgcaaatgttgctcgttttgttcagtttcccacgctgtattctatgatctctcagtaccagtaccaccgaagaagcctccagccaaaagtgttgaatcaacaccatggattgaaggtcacagatctcaaccgaagatttgtatcaaccagtttgaagcaatacataagaggaacacagaaaagactcatagaattgttgaagatgccgattctgatcctgcttcagaattgaaagatatggtcatggtgaaaacatcagagccattggaagttgattatactgaagtggaacagatctcacaaagcaaggactatgtacaagatcctcaaaatgtgttggctgatgtcaaaactgcaggaatggatgcgacaacaacagatacccgcattccagaatatatagggccacatccacctgtctctcaattaagggaagagaatgcacagttagaatcatgcaatgatgtggggaaagatggcaatgctattctcgaagtgctccggaagtcagatgtcactgaaggtacatacagtgaacagatgctgtcaagtactaatgaggacacagcagttggtggataccagagggaacagtcagagaagataacatgccaaagtgagcaatccaacaaaaaacctgaatgccctgaaggtgttcaagacgctgtacctcattgtgtcccagctgagagacaggacaacctgttgagcagtcaggatcaaaatgccaccacactagatgaaggaaggggtaagcaaaagcttcatcatagtgcacaccaagtcgaagaatgccaaaatgagcagaaagataggaataaaggtgctactcaaacacggattagcaagttgccacttgtgttaaccattcatctgatgagatctttgttggggcctgataaggtgatgggacatgtgagctttaaggaaatccttgatatgggactgttcatggaccccagctctgaagacaaagataattccatttatcgtctagctggtgttattgagcaccatggccgcggcaaagattcagggcactttgttgcttatgtgagaccaagtcctcggcagcagaccaatggttcttcctcatggttttgtgcaagtgataccgacatcagagaagtctctttagaagaagttctcaagtgcgaggcttaccttcttttctacgagaggatggaaggctga

SEQ ID NO: 1131 - DNA, 2652 bp, Oryza sativa
atggggtgcggccagtccaagactgacgggggccggggccggggcggcgcggctgtggcgctgtgccgggaccgcgccgcgctgctggccgacgccatccgccaccgctacgcgctcgccgacgcccaccgcgcctacgccgcctcgctgcgggacgccgccgccgcgctgcacgacttcctccgcggcgtccaggcgctgccgccgccgtcgtcgtccgacgtcgaccacgccgcgccgctgcgcctccccgacctgaggaagggggaccactcgctccccgccgccgtggttcccctccccgtcgacgcggtggtcatcaaacagggcggttctgatggtagtggtggccacatccatttcccgtccgacgacgacgacgacgctgagccgcctcccccacgccccgccgcggctccggcgccgcacgccgccacgctatacacctacgctccgccgtacggctacggccccggcgccgggcagtatgaatacggcgtcgacatgggcggctacggccagagcttcttcagcatcagctacgcccggagccagccgccgccgccgtcgtccgttgtgtcctacgagcaccgcccccaaacggtcaatgcgactgttcactactacccgggggacggcgccgccgggccaccgtttcccggctcctactacggcagcgccgcgccgccgcaatcgccgccgcgggtgtccgcctgggacttcttcaacccgttcgagtcattcgagagctactaccaccaggaccagccatctcctgctccaccggcctacacgccaagccggagctccaatggcgcgcgggaggaagatgacaatggcatccccgaggtggagcacgacgaggtcgacaaggttgacaaccaccaggatgccaatggcatgccattgccggcgaaggatgtcagtgaggagcagcacaggaagtccaagtcctcggaggccagcagtagtaccagcagcagcatgatcagtgatctccatgtagttcagaagagtgtgattgaagaacagctgcggcattcggatgccgcggggcctcccgcgatccccaggaaggtttacaatgacgatgtcgaggtggtggaggagatcagatcacaattcgagcatgccgcaaagtccgcattcgatgtatccaaggtgcttgaggttgggaagatgccttactaccagaagagttcaggattaaaagtatcctcgatgatgatttgtgggctatcttcggtgggggaggagttcctgcaatttgaggaggacaaggctatggaatgtggtaacctttcttcaacattgcagaagctgtacatgtgggagaaaaagcttcttgaggaagtcaagtgttgggttatactcaagcaactttgtttatcacagactgaggagaagatgagggtgctgtataaccaaaagcgtgaggagctgaaagttttgtatggaaggggtgccgaagcacacaagcttgaggcaactgaaactcatatcaggaagctatcaacaaagataagcattgccattcagattgtcaatactatctcaaaaaacatcaataatctgagagatgacgaactatggccgcaaacatgtgaactgattcaagggcatttagtgattactggtgagcagggtttcccataccaccggggccggggttaccgcgccccggcggaggttaccgcggtatttattaccatacccccgcagttaatgcaaatgtggcatgccatgtcaaaatgccatcagatccaatgccacgccatatcccaagctagaaacttggactctaagctagattctgcaaggttcagtgaagctcacatggacttaatcaagcggctagagcttcagttactggagttgatttctagttttgctacatgggtcaatgctcaaaagagctttgttggcactttaaatgagtggctcaagaggggaattgactatgtgcccgaagttaccgatgacgggactccccccttttctccaggacgcttaggagcgccccccattttcatcatctgtaataattgggcaatcggcacgggaagaatatcggagaaggaagtagtagacaaaatgcaggcttttgcctcaagtgtcctgcacctctgggagaagcacaggttagaatggaggcaaggtatgatggctaacaaagatatggacagggaccttagagtgatggagagggatgaactctcaatgcgcaaggctctcgatgcgcaaagcaagaagcttgtgcttgtttccaatcagagtggcgtgtcgttatctgcgcaggtggttcacgatagtggtccaactgctgaagttggtttgcaatcttgtatgaataaggtctttgaagcaatggagagcttcactgccgcttgtgcgaatgcatacagtgatctccatcttcgctctgaagaagagaagactcgactcggccaaaacaatggcagagttcctagcttcatttcagacttagctgcaacagtgtgcagagccatcacagattctcaattccagtctcacaaccgatgtgccttgcttttgcttggtttgggccctctgccaagtttcagggtcatccttaggcctgcagcaactgatgtgagatctgtgttggcctgcattctcagggttgaatga

SEQ ID NO: 1132 - DNA, 2574 bp, Oryza sativa
atggcggagagcaagcggttcgatacacagagcccaggctgccttgaaggcctgttcaacttccttgccctgaaccagcggttgcaaatgccgaaggcgattgcgtaccgaaagcacaatgaaggaagtagtaatacacttagagtaaaagttccaaagcccaaaaaccgctcggagaacgatgagtctgttccgaaggggactaattctccaaaggcaaaggtcggcacatttatatggaggacactaatgttcaagaagaaaacactcaagaaagatcaaaagaagagcgactcaccagccaactccccatcatcatcacgtttgacacgctccagatcaattcatcattcaaaatgctttgaatatgtggttccagatgagctggcttctcaataccataccatgattgaatcaagctccaatgaggtggattcatttcacagtgcaccaccgttggtgcaggagagtcctaaagttcccaattttcaagagtcatgcaaatcttctggtgccaaacatagtttcaatgcagaagcaccctgtgaaactgtacctcagagcagtaatgatgaaactgaagccgcctctaagcagaagagtcgtgatgctgcaacacatcactcgaaggagttcatggatttccttgaactgttcaatgcgcacagggagctatttctcaaaattcttcatgatccttcattattagtaccattggaaaaccaagatcaagaagcttcctccagcggtgcagtgccactgaacaaatcagattcgttcccaaggccaggaggatcatcagggaaacgtaaccctatatttgatcggaatgacagtgagaacaatagaaggtcagaaatccaaaagtcaccgtctaggttgaaatctgacattgaaactgctaaagttattggtacaagaatgcctgatggtgttgaaggctcatcggtttcactcacagaatcaaaaagcctgaggaaatctggaaccacttcaaatcgttttaaagttattcgtaaaaagattaaagctgctgtaaaggagaaccggaaagagcttgctcggattaccaaggatggagtttttcataaactgccatatggacaaaagatggctgggttcatgaagagtccctccacagacaagtatgtccaggaggagaaacaaatgcgaaaatcatactccattgcagaatcaatagacaagtattcaacactctatgaatcaatatcaagggaccccaagatttctccagaaagaccaagtacaatgtttgaaggtgatgcaaagttgaaagacaagaagccaccactttctatgaaaagaatagcttctcttccagaaatgagattatattcacctcagcgagatgttttatctgaagtttcagattcccagattgtgcccaagactcacgatctggaatctggttgcttctcttcacaacaaactgatcccttcagcatctgtacagacggaagtttctaccctgacgatattacagaaagaacagcagatatttacagcgaacataattatggagaaagtgctttacttggctcactggaagaggatttgcgcagtatacttcgaagtccaagtttaccttctgtggctcaatctttctcccatcgccgcatcaatagtttaccttcttttgatcgttctttcttccaagatcgtgtcactaatgttaccgagcattctatagcagattcagagccgacgtttgaacatatgcagcttgaggatgatgactggttggtgaagccacctcatcctccaggaccatatgatgctagtttgaaggatgatgagtggttggttaggccacttaagtcctcaggtgttgacactattgatcatgaggatgaagagtggttggtcagtacatcgcagctgcccggtggcaatgctgctgatttcgaggatgaagagtggctggtcaagccagtgcagtcgtcgagtgccgatgctttggattcagagttccagtttatacatgaatttgctgaagatgcaggttccttgcacatttatgttaatgacaagaatgaagccgatttccattatgtcaaggacatactcaaaaaatccggattcagctgcggggaggccgactggtatgcttccaatcagccactcagcccagtgatatttgaggaagcagaattctcgtgccaggaaacatacaccgcgaatgatgacccccacagtgtcgtcaggcgcatgcttctgttcgatctcatcaacgaggtcctgatggatatctatgattcttccttggtcaccggcccatggcactcgcgcttcgactcgcgtaccaggccgatacccatggggtctcatgtcctaggggaggtgtgggggaaggtgagctacaacctgagcctgcaatggaagccggacctgacagtggaggacgttgtggcgcatgatgtcatgatgaaggacaggtggatgaaccttgtgtatgacgcggagtgtcttgcgctggacctggaggatatggtggtggatgaccttctggatgacattgttcttcagatagtgttgatttccattgacgcgtaa

SEQ ID NO: 1133 - DNA, 2334 bp, Oryza sativa
  misc_feature (498)..(498): n = any nucleotide
  misc_feature (548)..(548): n = any nucleotide
  misc_feature (551)..(551): n = any nucleotide
atgcaagccccatctacaacgattcagagaaacgagaatgcaattaatcctgctgagatatgtagtgaagcaggcagcgtcgtccgtactccgaatggcacgccgccgccgccagccgacgcctaccggacttacatcgtgctcgtcgacccgccgccgcacggcgcggccacggacgacgacgggcaccgccggtggcacgagtctttcttgccgggaggccggcgcatggacgacggcgccgatcaggcacggatcatccgctcctacaccgaggtgttcgagggcttcgccgcgaggctcaccgccgccgagctcgccggcgtggtgtccaagaagcccgggttcgtgcgcgcgttcccggggcgccggacgctgcgcctcatgacgacgcacacgccggagttcctcgggctgacgagaggcgccgggttctggagggacgtcgccggctacgggaagggcgtcgtcgtcgggctgctcgacaccggcgtccangccgcgcacccttccttcgacgaccgcggcgtcccgccgccgccggcgangtngaggggctcctgcgccgtcgccgccacgcggcggtgcaacaacaagctcgtcggcgtcaagtccttcgttgacggcggcggcggcggcgacgacgacgtcggccacgggacacacaccgcgtccacggccgccgggaacttcgtcgccggcggcgcgtcggaccgcggcctgggcgcgggaacggcggccgggatcgcgcccggcgcgcacgtcgccatgtacaaggtgtgcaacggctcaggctgcgatgacgacgccgtgctagccgggttcgacgaggccatgaaggacggagtcgacgtcctctcggtgtcgctcgggaggtggtcgagtccccccttcgatgaggaccccatcgccatcgccgccttcagcgcagtggcgcgaggcatcaccgtggtgtgcgcggccggcaatggcggccccgagccgtcgacggtctcgaacgacgcgccgtggctgctcacggtcgccgcaggctcggtcggccggagcttctccaccaccgtgctgctcggcaacggcgagctcgtcgacggccaggcgctcgcccagcagcccaactcctcgacctcgtactacccactccacttctcggagaagcaaccgaaatgtaacgagctcgccggaatcgtcggagatggcgtcgccggccacctcgtggtctgccagtccgatccggtcgaggacgagtccgtcgtgagcgccatgatggccaccggcgccggcggcgtggtgctgatcaacaccgagagcgaaggctacacgaccgtcctcgaggactacggcccgggcatggtgcaggtgaccgtcgccggtggccacaacatcacggagtacgctaggtcgtcgtcatcatcagccggcggctgcaaacccaacgccaccgtggtgttcgacaacacgttgctcagcgtccacccggcgcccaccgtcgcctccttctcgtcccggggaccgagcaaggtcgccccgggcgtgctcaagccggacgtcctggcgccggggctcaacatcctcgccgcatggccgccgcacctccagcacggcggcggcggcggaggcggcgggctcttcaaggtcatatccgggacgtccatggcgaccccgcacgcgagcggcgtggcggcgctcgtcaagagccgccacccggactggttgccggccgccatcaagtcagccatcctgacgacgtccgacgccgtcgacggcgccggcaacccgatcctggacgaacaccacgagagggcgaccgcgttcctcaccggcgccggccacatcaacccggcgagggccgccgacccaggcctagtgtacgacatcgccgtcgctgactacgccggctacatctgcgcgctgctcggagacgccgggctggggacgatcgtgcgcaacgagagcttgagctgcgggaagctggacaagaacaagataccggaggcgcagctcaactacccgaccatcacggtgccgctgccgcggtcgtcgtcgtcggcggcgccgccgccgttcacggtgaaccggacggtgacgaacgtcgggccggccaggtcgacctacacgatgaagctggagatacccaggtcgctgacgatgcgtgtgtcgccggagaagctggtgttctccggtgtcggcgagaagaagggcttcagcgtgacggtgagtggcggcggcggcggcggcgaggtggtggagggaagcttgagttgggtgtctgggaaacatgtcatgcgcagtccgattgtcgccgttccccaaccgtacctgaagttaggaagctag

SEQ ID NO: 1134 - DNA, 2232 bp, Oryza sativa
  misc_feature (805)..(806): n = any nucleotide
  misc_feature (808)..(809): n = any nucleotide
  misc_feature (811)..(811): n = any nucleotide
  misc_feature (814)..(814): n = any nucleotide
  misc_feature (817)..(819): n = any nucleotide
  misc_feature (821)..(823): n = any nucleotide
  misc_feature (826)..(828): n = any nucleotide
atggactggtctttgctgctcagcgacgtcctacttgccatcgtcattgtcgccatcgcaaccgaactcgttgcctctgctcccaccggcgccggtggtggatctggccctcttgaggccgccgccgccggatggacgatggagaaggagaggcgagggaggccagcccctcccgagttcaacggcagtggatccgcacctcttgaggccgcatccgctagatcgatgatggaaatggagaagctagggaggcctgctgctcatctgaggctagtggaggcatatctgaccctcctatcaccagtaacggtagatccatcgaggccgatggtcacccctgtcaccaacattaacatgtgcctcactgctgaactcacctctacatcgcactgtcgtcgacgccgagcttctgccgagagagagatagaggaggctgaggtgagggagataaggcctgcccgcaaaaatatgtctatttcgcagttaggcatgttaagatgcccgcccgcgaaaattgatttctgcatgcggtccttgaagcgtcctcaggggagcgatctttgcatcggcgatggtgggtccagcgggcaagggcggcagtctcaagcgagagctcgggtggtggcggtggcttgcaaccatgcgaatcccgtcgacggcggcaacagtagtgccggatccagcacctcctccccctcccgtgctgacctcgccgcctctccaatgacgatgacggtggcagcagcagcgacgatagtggatccaggcacgatgacgacgatagtcgatccaggcgtcgcatcgnngnncntcncgnnngnnnccnnngttggatggcttaagtgcccatatgtgaatgccctacccgtatacaaaattctgatactttcacagacacctgggtgtagcatcggtgccggtgctagacattgtgatgtagaggaagaagaccttgacgaagagaatgcagtgccaagagcagtcgcgcgtagacgcgctcccgaaaaccttgatcgccctactcaggcgagcggagtcccggaggattgctcgtcccaagcactagtgcgcacaagtgctcgaaaccggggaagtagaggcttagcacaagtggggttcagtaacaagcaatctggcgatctaaccgatcacaggattaactcggcaaaagggggagaacaaccacaggggtgctggggtcgtgctctaaccctagaacgcgcccctaatgggcccaacttgatacacagcccattgggcccaatgagtccgagtccaccccacgcaaatcctctccccgttggatcctctccatcattcctgagtaaaaccagagtgcacacgtttccctggtataaagaagaggatgagttgagcttgtggaggcggggatgtatcgatggtgttgatgtcctcataactctctctctctctatcctcttttcttctaagccgccgcctatggacggtggccgattcgggccttggctcctccgccggcaccactctgacccccaagaggctcatggcctcgctctccggctcgggcctcgaaccgaccttaccgggcctcctcgacgccgtccttcgccgctgcggcgccgcctccgcgctcgcactccacttcttccactagtgctccctcccgctgccgccgccagagccgctcccttcctccctcgcactcctcgccaagtcctttctcccgcaccttcgccgcaccatccccttccctcctcgcctcactcccgcccagctcctctccccgtccctcctctcccccgtcctccgccgcctcccgcccccgcgcctcctccccttcgcgacctctctcgctcttcctctccctcctcgagtccctcaccaagaccggccatgctcccgctctcgctccgccactacaccgcgctactctacgggtggtgccgcatgggcaagcttgatgaggccaagcacgtgctcgcccgcatgaaggcagcggaggttgcctcagacgtcgtcttcttcaacaccctcctcgctggcttcgttgccgacgggagcgtggctgcccgcccaccaccgccacctcgcctagccttcacgctgcctctggatctccgcgttgtgctcctcctcgctgtccatggccacctggagagagggggccggcgagcctcttccacaccaccaccgttgccaccaccgccacctcgccccgccttcgcattgccttcggatctccgtgcctag

SEQ ID NO: 1135 - DNA, 1791 bp, Oryza sativa
atggccgccgcgttcgacctgcctccggtgaccacgccggcgcccgccgctccaagtgacgtcctgctgccgacgcagccgcaggtgtcgggtcccgaagaattccccgctgccgccgtcaactccaacgacgacgacatgatgatggtcgacgacgtcgtcgtcgccggcggcgtcggcgggagcgggagcaccggcaaccggtggccgcgggaggagacgctggcgctcatcaggatccggtcggagatggacgccgccttccgcaacgccaccctcaaggcgcccgttctgggaggagctctccaggtacggaactcaactcaactcaacccaacccgcgcggtgcagggacgatacaggaggcttgcggaattggggtaccagaggagcggcaagaagtgcaaggagaagttcgagaacgtggacaagtactacaagcgcaccaaggaagggcgcaccgggcggcaagacgggaagagctaccgcttcttctcgcagctcgaggcgctccacgccgcggcgccgccgccgccgccgcagcaacggcagggcatgccggtggaggacccgcagccgctggcgatggcgtggatgatgttgcccggggcggcggacctcgggttcttgtcgatgtcgtcggagtctgagtcggacgatgagtccgacgaggaggaggaggaggaggaggcggtggcgccgggcggcggcggtcgggaggggcttggcgatgatggtgacggtgatggcgaagggggcagcagcaccaggaagctgatggccatgttcgaagggatgatgaggcaggtgacggagaagcaggacgcgatgcagcgggtgttcctggagacgctggagaagtgggaggcggagcgcaccgagcgggaggaggcgtggcggcggaaggagcgcgtcggtggcgccggcggggagcccgtgaggctctccccttcgtccgccggcgccacccgccacgacgcggccgcggcggggctgcagctggtgcccgtgccggcgccgagagcgaaggcggaggacgcctgggcggcagcaggaggagacggcagcgggacgacggcgccgtcgcggtggcccaaggaggaggtgcaggcgctcatcgacctgcgcatggagaaggaggagcagtacaacgacatgggacccaagggcccgctgtgggaggagatcgccgccggcatgcagaggatcggctacaaccggagcgccaagcggtgtaaggagaagtgggagaacatcaacaagtacttcaagaaggtgaaggagagcaacaagcggcgccccgaggactccaagacctgcccttacttccaccagctcgacgccatctaccgcaagaagcacttcgctggcagaggcggcggcggcggcggcgtcacgatcgccgcctcccactccagcctcgccatcgtcaccgtctccgagcaggacaacccgagccagcgtgagctcgaggggaagagcagcaacgacgtcggcaacgtgcagctggcggtgcccctccttgtccacaacgccccagacaagaaggtggaaggctccgaaggcgaaccaaatgtcacagcagcagcggaggagacggacagcgacgagatgtgtggagaatacaccgacgatggcgacgacgacgacaaaatgcagtacaaaatagagttccagaagccaactgcgggcggcggcggcgacggcaacgacgcacccgtgccggcgacaactgcggcagcgacgagttcagccccaaccagcaacaccagcttccttgcggttcagtag

SEQ ID NO: 1136 - DNA, 1773 bp, Oryza sativa
atggctcgcatggatgctagtagtatttctgcttgctttttgctcatggaaattattaaaggactaggcaactgggcatttaaggagtggcaactgacaaccccgcttcctatggtcggccaagtccttagcatctggggattacaaaagaaaactgccccgagtgagtggctcccactcgccttcctcgatccacccttttttgttgttcgaatccattggagcccacgaggtctttgcctcccattctcccaaaaccacttggattctcgaagattcagagcagggacctcaccttcgctgcagcttttttctttcaggcttttggcttcttggatccgtgcaggcgcgagaattcaatggcggttattggagcttcttggggtggtcactgaaggtacactgcctgatgctgctctgcctcgcctttgcagtagaccagtagtacgcagtcttgcgatggagtcggcgacggagaaggtgaggaggacgccctcctcctgcctgctgctgcgcatctccgacatctgcaaggtgcgctccgtcggcgtcgcgccgaccgtccgcgaaaagcccaaggccgacggcagcgccaccggagagagcagcgaagacggcggcgcgcacctgaaagtccacccgcatcatgtgtccgaccatgagagcgtctctgaatgctcctctgctcgctgcgaggaagcgtttgttgagaggcttctcgacgcgatttctggcctcaaattgagttacgtgaaccttcagcaagctcttgtgccatatgatcctgaagagattacgatcgctgatgagcgattcacatcggagcttcaagagactgccgggttgaaggatctgtatgtcaacatgaacaaatggagaaatccaatgtaccagtgctatgtgggctctagaattcaggagcaacaaaagttggccgtggagttgcaagctggcatgtgcaagagagactctgagattgtgtgtttgcgagcggagttggatgaactggaaaggaagaacatggaactggaggagaagatcggtcaaagtgcgttacagaaagaaggaagttttgcaattgggatgggagtatcaacggatatgtttatggaattattcgagctttcgacaaagtctatccatgattttgcaaaactcgtcgtccgttggatgaaactttctcggtggaatcttggcaacttaacatccccaatagacaattctgttgtctatgataaaaggtctcacaagaattacgccgttgaggcctactttgcttgtatgatgttgatggggcacaaagaggagtacctttcgctggatgtcttcgattatgtaatgagtttcagtgatccttttgatgctcttatgaaggccccagactcttgttttgggagattctgtcgagaaaagtatctggccattttgcctcctagtatggaggattcattcttcggaaatttggatcatagatcatttgttgagaatggcggccatccaagaacaccattttatcaggcatttgtgacaatgtcaagatatgtatgggcgtccctaaccgtagcacgttctctgaatccaagagcagagatgttctatgtcaagggtggtactgaatttaggagtaaacacatggaatgtgttccatccaagataaccaaagaaggagacaaggtcagtgttgggtttacagtaatgccggggtttaagattggatgcactgtcatcagatgcagggtgtatctgtccatggtcaacgaaagaaacttctga

SEQ ID NO: 1137 - DNA, 1728 bp, Oryza sativa
atggccgtcttttcgttgatcacttgtgctgccgacctcgtcatcttcttctccgtctgctacattcagcctccggctcatttcgccgccttgtccttcaactaccccaccttcgcctcctcacacaaccagtacatcgaaattgaaggcaatgcctctgtcagcgtcgggtatatcgacatcagtgcgaacatctctggacgcgcaccggcaagtgccagcttcaccacgcgcttctccttcaacatcatcccgggaaatagaagcaaaaagggcgatgggatgaccttcttcctcaccagctacccatcgaggttaccagagggcgacgccggtggccaaaacctcggcctaacgaaccagacggtcggcgtctcgaccggcgagaaccggttcgttgccgtcgagttcgacaccttcgtcaaccccttcgaccccaacgcaaccaacgaccacatcggcatcgacgtcaactccgtcgtatctgtgacgaacgagtccctaccaaacttcagcctcatcgggaacatgaccgccaccgtcgactacaacaacaattcgagaatactgtcagttaagctatggataaatggctcgacgacgccttacacccttagctccatggttgatctcaagagagccttgccggagaacgtcaccatcggcttctcggcatcaattggctcagcctatgagcagcatcagctgacttcttggtacttcaagtcgacttcgtcgttcgagcagaagctggcagcagaaagcaagaaaagaagggaggcacaggatggaagctggcacggcagtgacgacgacgacgacggcgagctcatcatggagatcgagatggggacgggaccaaggcggttcccgtaccacaagctcgtcgacgctacgaagagctttgcgccggaggagaagcttgggcaaggcggtttcggtgcagtgtatcggggctacctcagagagcttggcctcgccgtcgccataaagaggtttgccaaaaattcctctaagcaagggaggaaggagtacaagtcagagatcaagctcattggctggtgccatggccgcaccgagctgctcctcgtctacgagctattccccaaccgtagcctcgacgtccatctccacggcaatggcaccttcctcacatggccaatgaggatcaatattgttcatggactcggatctgcactactctacctacatgaggagtgggatcaatgtgtagtgcaccgtgacatcaagccgagcaacgtcatgctagatgaatccttcaacgcgaagctaggcgatttcggccttgcaaggcttattgaccatgctgttgggatacaaacaatgacccatccctcagggacgccaggctatcttgatcctgaatgcgtgatcaccggcaaagcaagcgccgagtccgatgtttatagttttggcattgttctattggaagtggcatgcgggagaagaccaattagcttacaggacacccaaaacaattgcctcttccgactggtggaatgggtgtgggatctgtacggccaaggagccgttctcaaggcagccgacgagcggctcaacaatgaatacgacacaactagcatggagtgtgtcatggccgttggactttgtcgatatcctagtccttatagagggcctggaattgttggagttatctcatatgatattcagctaatgctgtccaatgactgcatagattactactga

SEQ ID NO: 1138 - DNA, 1626 bp, Oryza sativa
atggttgacattaagcaaactgaggttgaccctgagaatatcatcccaataacaatggatcaacttacaccagaacaaaaggcagagtatgagcagatgatgaacaacttgcagaatcagtttttacattcatttgtgcaaactcatttaggtacggttatccaaaggtataaattgaaagtgccatccaatgatgacttagaatcaagtaccaccaaagatggcaagcccaaacatgacaaacccaaggatgaaaaaccggaagaagaagagcctcaagagttcaagaacttgcaggatcagattgattatgttgtttatcatgcatttatcaaccagtcaggggtgcttgtcaacactttaactaacatgattaagtctgtgattgatggttcaattgccaaacatcaagctaagagtccgacttttcttcctgatggcgtgtttcctccatataggaatctagtgaccggcaaacaacaacccgtttctggtatagcaccggagcagccgatggcatcaacttcggcttttgggaaacagtgcgcatcaacgtcagcacaaggacagctagggtttaatcctcatgtactggggaagcaatcagttgttgacccgattcagcaaataccaattgggcagcaaacacctattgtacagcaacatcagcctattggtgctcagtttattcctgatcagcaagttcataatgtgcatcaatctcctcaacattatgctggtggtaatatgaactttcagtatcagccttattcaccccagatacagtatcagccagggggatcacctcagccccacatcttgcctcggtataatcagcttgaccacattcaacaacagatgcaaggaatgcctcaacagaagccttgggctgatatgattgcagatgtgatgagggagcaatttggtcttaaaccaaagaatattgggaacttgtatcaaccccgatatccagaatattttgagggggttccattgccgaatcggtacaaggttccagatttttcaaagttctcagagcaaaataatgtgtcgacttatgagcatgtcagccgatttttggcccagtgtggtgaggcatcggctattgatgctttgagagttagattattccctttgtgtttatctggatcggcattcacatggttttcttcattgcctgatagttctgttcaaagttgggccgatatggaaaaacaatttcataaatatttctacagtggaaatcatgagatgaaactttctgatctggcagcaattagacagaggcatgatggatctgttcgagattatattcagaggtttagggacatgaggaatagatgttatagcttggctttgacagattctcagttagccgatcttgctttccaaggtttggcaaccccaattaaggagagattctctgctcaagattttgagagtttggcccacttggctcaaaaggtaacactacatgaacaaagatttgcagaagccaaaaagaacttcaagaaggttaatcatgtatatctgttgatgcgaaaaacacacactgccctgggagatctgcttagctccagtgcaggtctaaatcttggtgagatgcaggcgtgccaattagattga

SEQ ID NO: 1139 - DNA, 1605 bp, Oryza sativa
  misc_feature (785)..(785): n = any nucleotide
atgcttgatcagtgcgcctgtatgatctccactctgcgtaagtcacgcgtaacttatctggactccacgccgttccacgcattggattattcggtgtgtttccaaaaacaaaatcgaattttctacagcaaaacaaaactgcaaaaggagaccgcatgtgcgcaaggtctcccgtaccgcttcactccatcatcccccgacgcccccgcatcgccgcttcaccccgacaccccgcgcgacctagtgcgcaacggagggggaagcggtcgtcgtcgtcgtcagcggcggcggctgcggtgcaccggcgggaaacagaattggtgtaagcagaaacagtccacaatgacaactccactccctgtcagtgctggtgatgcttcacgagtcctcttcactggcattcgagaccacactgacatcctcatcgaggtcctccttcggctgccaccctggtccctctgccaactacgctgtgtatgcaaactatggctagagcggacaacatcgtccaccttcctctctgcctatgctgaacgtcataccaccaacccttcaaactggttcctcctggaccgaacaatctttattgacactgcccccacaccccgaggcccaatacgtgcactgcttcgcaattctgaaccaccaaaagtctcatcaatcatcacctcctctcgcatgtgttccattcaccggaaagagtccttctatgaccagctacccatggttttccgaagccccaacttccgcaatgctgaaagcttgggcattgttgctcgggatgntgagggtgacatggtattctcctctggtgggatgcttcattgggttgatctcaactgtggcatactctcctgtgacccatttgcatcagaaccaactgtactttttatcaacctgccagaggccagtggaagacccacccgtggcctggatgaatggatccacatgaggtatgttggtgtctctgctgggcggttgtgcttctttgacattgatgaggatgatggagaatctgggtcaatgagcttgtgggcactaggtgggaacagtggtgagtgggtgttggaatacaaagtggatttcgaagatctgtgggaagatgaaagctatgatgattattcgctggatgaggatgaggttccattagttggcttggttgacccattgaatgagcacagtgtaaaaggagctgcatcgccggtcgcctctcctcctcaagaccacgaagcgccggttccacaccgccgttcttcttcgctttctccgccaccgccgccagggagaagactccgccctccgccatggcgccatcggcagcaacgtcagcgaggtcgtcttcaagagcatttgattggagacaatgtacagtgcaccagggaggatgaccgcgaacggtgtgagctcgatatccaagggcggggctgtaatgaggaggtatacccgtggaccatgacggaacgaaaaacactttttagggtagacgaccagctcctgctcaacaaaaacagagcaaaagcaggggaagtggagaaaaacagaggaagcagcgaaaacgggagaaagaaatgtcacaactcacaagggctgaaaacggaacgataa

SEQ ID NO: 1140 - DNA, 1551 bp, Oryza sativa
atgggaaacgatggagaaaaggcatcaaaactatgcaaggaggcaggagggcctagcctagattcaaatcttgctccaaccatcgtgctagcgctcaccaccgtccccatggggtgggataaccgtaggaggaaacaagcgagtacgataatgaatgcacgtggccgaggggctaggaatggaaacgggcccaaccgggggcctgggggtggaagggctcattcagatgtggtggttggagcaaacaccaccgtactagcaacaaggaggtgggttgggttggagatagattccgtgccaggtaatgaggggcaacgtgacattgtgaactactacctccgttgcgccactggcgttggtaatggggagagggagctggcggtggtaggaacacaccatagcaataggagggtgacttatgtggtgcatgagccattcctacagtccctcaaggagctgcaggtggctgcggttgttggagttgaacgactcatgtggaagtcgaggaaggatgtggtgcactggctcaacatgctcatctcagatgttgcatctgatgaagttgcaatttgtaacaatgatggcaaagatgctaaacttgctaatatctccacaacaaagggctcttcatcatcaactgctggaaatgattcaggggatttcaaatggttaggtcctgaatcgcattctaaaaaagggaagagctacaaatccttctggcgaaggggatttacattcatggttcacgattttgtttacatcttggtccaacatggcaacaaacttgttgcttatgtggaagaactctatgaggataaccatgcaaacaagatggttcagatacgacggttccgcacactcaactccaccggtattcaactttctccaggtgttaatgatagagagatcctccactccgacaatttgcaagacatcggagttgaatgcatagatggattggcttcagtcctgaacgaagaacactttgagatgtttcaggcaattgccaacaacaccaacaggcaaccctacctatgcatccggcatatcgacaataacagcaatgtcaagacctttgacattgcacaactgcaagggtattcagaacaggagatatttagaatagtctcaggcacacctcccgtgaccgtgcatcccgacgcatctgaaggcagcaagaacacaccaagatcatcagccagaggtcatcatcatcatcggaccatggagaaccccactgctagtgatgagaccaatgttcaggccacaacaatcaatgtccttgcacgcaatgctgcaccaacagagtctgcttctgctctgataaactctgccctggagaagtatcttgagcagtacttctctcatggttgccttgtggaatgcctaagccaggacagtggcattaggggctgttggttcatcggttcagtgattaggaggtgcggagatcgcatcaaggtgaggtaccaacacctccaagatcccgaaacgccaagagcaaacctagaggaatggttgcttgtgacaagaaccgttaatcctgaaacg

SEQ ID NO: 1141 - DNA, 1542 bp, Oryza sativa
  misc_feature (27)..(27): n = any nucleotide
  misc_feature (45)..(45): n = any nucleotide
atgatgagggtgacgccagcggcggcnaagaggagcagggcggtntggctagggcgggggttcgtcgccgcggcggcggcgcccttgtgcgcgtgcgtggcaggatttccgctgaagaaggggccgtggacgcccgacgaggacaagcggctgcgggagtacgtggaggcgcacggcgaggggaactggaaccgggtgcagaggaacgcggggctgaaccgctgcggcaagagctgccgcctccgctgggcgaaccacctcaagcccgacctcaagaaggggcccttcagcaaggaagaggaggagatgatcatcaagctccatttatggcttggggaacaaacacatttgacatgctgcactcttgtaaatggccttgttaaaaggagtagacaaatgctttgccattattccttgtttgcagagaataacaaaaaacgatactgtcatcaggaaaagctgacatctaggccacaggataagttgccaggccgcacagataatgaaatcaagaacttctggaacactagatgtaagagaattcagagaactggtgaacctctatatccgaaggagtttaatcattttaagttgacagatctggaagtgatgaactgtgaaagccctgatgaatcacgtgccaagaaacgaacaaatgaggttttacagggaaatggtcaaagttacaaagaggtttttttcgataatttagactatagtagaccagaaaattatattcggccaaattgtgtgactccaaattctcttccagttgatgccacaagtccatttggtagtgccattgccacacaagatcagtcagtaccttttggtagtgccattgtcagtggacatccaattcttgatggcaacttctctacttctgggaccatacagaggcccatgaatgtagagctcccttcactccaatatcccaactatgactttaacaataataatgcatggtcatatcacgaccccttaggacatcctattgaccaggttgactttggctccctgagatcagaatatctctctccaaacaacaatggtctgctggatgcattggttcatggaggacatggacaaggggaacttgcaaattcccaaggatcttttgatgcttgttttcctcgtgttcaatgcaatcaagtgattcaatcgaatgctttctctctgagttcttcctttccaatcattggtgatgatctcctcgagaacagttgtcatgcttttgttggcatcaacaataatgcaagcagcctattccttgacagccaacctccacccttggtggaccctactttctggaggcacgatgtatcactagaaccgaatttgccagtttattgccagtttaacgaagaattgccgccctcaaatgagcagtttgccaaagatgcagatgacgctttcggtcatgggggtctttctgatgagaccaatctagctgctgcaggtcaaggcgatgaacatgaccttgaggacccctgggcgagcatgcccggtgcctgtgacatacctgattttccaagtgaatga

SEQ ID NO: 1142 - DNA, 1524 bp, Oryza sativa
atggatcgagaggattttgatgagttcttggggacgttgggtggggaagcagatcgagctgggtgcgggctttatagttggccgaggagagtgaagtggagtgtgagaagtggatgggggatggacgcgtccttggccgtgctgcccgaacggtcactggccagctggctttgcgtggcctgcctgctcccagctgttgctgagcgggcatctgaccattctacccctcaagctggcgcctcggatactgtagatcagtggctcgatggcatggtgaatcctgcgttggcttctcgaggaggcttgaagcagcttgcagagtggagtgcggagagcaggggaacacgaacgttgggatggcatgtagcgtgggccagcgccatcccagttttgaacgttggggacttggggtgtatcactacagctttgatgtaccgcacagcagtagttactcgtacgagtagcgtgttagaacttataccagaagccaggctggtgctggctatgcaaagcaagcaatgtgaggacgaacacggcgataacagtgaaaaatgcagggagagatggagggatgtttcatttggtcacgcaggtgaggtcgtgaggaggaggaggcggccacgagaagctgcggatgagaaagcgctcgcccccacggctgacccgcgccatcctccacacttccgcaccgggctactactcgctctatgcgcgtcatcgggatgcgcggcagcacgatccgctggccctactaccatcaacgcacatcacgccgcactcgcagatcaggcagcagcagcagcggcggtgaattgcgaacggacggatcgcgcattcattcgtgcctgcccgcgttgccctttcgctggtatcatatctaggcgcgtcacgatggaccacgggagcggcgcttttgttggtccacttccgtgcaggccagctagctcagctccgccggagccgagacgaaatggcaaggcagctggcgtccggggttaccgtgccccgacagtaagcacggaagttaccgcggtatttatattaccataccctgcggtaagcctgaaaacggtggcaagggaaacctgcttccatccgcgatctgctcacgcgaggtcgcgagccccggttgcctgcaggccgtcctggttttctcacgttatccggcttcaagctttcatgtcctccgggactggtaggctcgtgcaaatcaataatcacatcgacaacgatgctgtaaccattactccgtacagcacaatggcagcagaggactgggattggatgctcgagctgtcatctcgtaggacgtcgggctcgtcatcaaaccggctgctctgtgtctcgcgcgtgtctcccgtcctctaccccctcgttaattctcctggtgatcttatcttggatggggcacttgaatctccacacgttgttctcttgacaagggaccggataagcacggagatgccgcattccacgggctttggatcatgtgttaccgctgctgcttggaataaactaacttga

SEQ ID NO: 1143 - DNA, 1482 bp, Oryza sativa
  misc_feature (30)..(30): n = any nucleotide
atggacggagcgacggtgggcgacgggagnaagcggagcagcggcggggcgaaatggagcggcagcgggccgtgggtggagcaacaagggtgcagcagcagcgcgatagcgggcggcggacaccataagaggaggggcgagcaggggacgcgttgttggccggtgctgctcacccgtcgtcgctgcgacgaggcactgcggaggcagtcggcgcttgggcaaggaaggggcagcaggcgccagaggagaagggaaacagggccggatttggcaccgccgaagctggggactgccggatctgtagcaccagcggcggcggcggctgcggcggcggatgttggctatgcggcggtggtggcggcggaggatctcggtgacgcacttgtggaggggagacggcgaacttcgtgggctatcgccgaaaaaaaaaagagcagtggcggctgggcctggaggagaaggaggagagagagagggagaaaggagaaggcagccgcgtggtggagcaggacgaggaggcggtggcgaatccggtggtcggcgaggcggagtgtggaggaggaggcagctgtgaatccgatggtcgtcgaggtggggcagcctatgagaagaccaacgagggcggggagccagagcagcgcggtaagggaggggagcttgagggcgacccttgccgaggccgcgccgtcgtcgtcctcctcggcggctagggtcctgagccgacaggagaagctcccacccaacaacgccttccccggcgccagcggcggcctccacgtcccgctcctactctccctcttgttcaccgcacccatcgccgagctcctcgtcgtcgcctcgacccctgcagtgtgtccgtcctcgcggcggaacggtggcggcggcaggccgcgggcagagcaaaggggcgggcagagcggcggccacctcgccaaggacatcgagcgcacctctgacgcgagaggagcggcggcgcgcaccagcctacgggagggagggagaggagcggcggtgcgcttgggtcggcggccggcgggagggagagagaggagcgacggcgcgcggggactggcggggggagcggcgcgcggctgccggagggagagggtcggcggcgcacatgagtcgacgggtgggagggagaggagcagcggcgtgcgccgcgccggtggagagggcagccaacaggagggtggaagaggagcagcggttcaccggcctctgcgcccttgtcactccgcccaccgcctgctgccgctccattttaccccgctgacgctcaactccgcttcctcccgccgcccaccattgctccgtccaccgccggccgctgcgccacttcgctccatcgccgctccgctcatcgtcccctcggctccgccgctcgcccttctttcctggcagtgtagggggagagagatgggggatagagagaagagggaggctgacatgtgggaccacatgggccccacctttttttaa

SEQ ID NO: 1144 - DNA, 1230 bp, Oryza sativa
  misc_feature (504)..(504): n = any nucleotide
  misc_feature (574)..(574): n = any nucleotide
  misc_feature (976)..(976): n = any nucleotide
  misc_feature (1012)..(1012): n = any nucleotide
atgggtctgtggattgattttaaagcctctcatcagccagttgcatacacccccggaactcctttcgacaactctatcaatgcccttagtcatactcttgaactcgaacatatctacctcattctgaccatatctaatgttgccttcactctcgagcttggtcgagctcgagccgagcctgtcggaaagctcgaacattttataggctcggctcaagctcgactcgagcttgtaattgagctcgagcctaggcagacgagctcgctcgagctcggctcgttgacaaccctattttgggccggaacaccacccgtttgggccgaaaatccagcccgtctcccaccatcgcagcaaccgacgaagttctcgcctccccccaacacgcgtggccacctccgcggcgcctcgtgtcatcccccacctcctcgcctctcctcctcgtcgtcgtcggcggcgggccggagccacatgggccagaccctgcgcggcgccgcggggcccttnagggccccacccaccccggcgccccctcgtcctcatcaccttccgcctgcgccgccgtcgccggcgggcnctggcggcgcggcggcacaggatcgtctccgtgtcttccaggatgtgggacatgatgttgattataagctcgaacaatatggccctgatttcgtgaaatcgggtactgatcccatttgggaagcatatcctcctgggctctctatcggtttccagttagacagcttatttccagctgagagtgatgagggacgaggggttattttcaagagaactgaaggatacttgaacaaatggactgcagatgtcacaacacaaccaaaagatgcccctggtgtacttaaggagcgtgatccaagttatgatgagatgcttaagcacatggttgggagaatcactacaaagcctggaggaaagccagaaatgggtgaagctttcgtcgtagatcagtacaacaggccantcccaagggttagaacatccagacctgaacccgggnaaggcggacacagacaactacctccaggaaccattagcgtcgctcatgtccatgaaatcatccaactgtaccaaggaaagtccagtaaccaccctggcccaatgagcgtggacaagattgcctcaaagttcagagtcgaagcctcagtggttcaaaacatcgtgcagttcgtctcacttccgcaggaagaacatgttaccaagaaagaggaatactga

SEQ ID NO: 1145 - DNA, 1164 bp, Oryza sativa
atggcgctgctgatggatcccggggcgggaggccccctgacggagagcgagaaggccgacctggacgccatcgccgccatcaaggagtcggcggcggcagagtacaaggagaagggcaaccggctcgtcaagatgggccggagccactacgccgacgccgtcgactgctacaccaaggccattgcccagatggagccgctgccgccgccgccggtgccatcccccgacgcctccgtcctcttcgccaaccgcgcccacgtcaacctcctcctcggcaaccaccgccgcgccctcgacgacgccgcccgtgccgtccagctctctccctccaacgtcaaggcgtactaccgggcggcgaaagcggcgattgctctcggcttgctgccggaggcggcggccttctgccggcgggggatcgagcaggaccctgctaatgaggagctcaagaaattgctcgcacaagtggacgcccaacagagtgagcaagatcgtcatagggccaaggttgcgcaggccgtgtccgctgcgaaggatattgttgccgctatagagaagagggggttgaagcttgggaaggcagcatatcaagagcttaccggtgtaaagaagccgaagttggatgagcaggaaagttctccaccattaccatgggatgataaacacgcttacacacgggatgctgttgagttatattatcaggctggcgttggcacagttctgtccaaaagtgaaatattgaaaattcttttggaaggcactatggactcaaagtcacttcctgaaagcctgcttgatgaggaagatggagaaaatgatgatggcaagagcagcacaattacatcatcagataagggttctgtgaagtggatcaatgtaaaagagggaaaaactcttcaagaagtgctgcagcataaagacttcatcatccctgcaattcctggtctgaatgatgaggtgagcgcgacgggcgccatcgtggagggcgacgccaaggaggccatctgccaggccgtggaggagatgcacgccgacatgctcgtcctgggaagccgcggcctaggcaagatcaagagggcgttcttgggcagcgtcagcgactacctcgtccatcacgcgtgctgccccgtgctggtcgtgaagcccaccaaggcgcacgacaagtga

SEQ ID NO: 1146 - DNA, 1098 bp, Oryza sativa
atggtggatttggtgaacggcgtgctcaactgggtggcgacgccggccatggtggccagcctgctgctcttctacccgccctactacctcttcaagaccgtccactccttcctctcctacctcttccccgacgacctcgcccgcaaggtcgtcctcatcaccggcgcctcctccggcatcggcgagcaattagcatacaactatgctctgaaccgggcatcattggtccttgttgcaagaagagaatggagcctgcgtaaagttgccgatcaagcgttcgagcttggagcacctgatgtgatcattcttccgggcgacgttgcgaatcctgaagactgcaaaagatttgttcagaccgcaatcgatcactacgggcgatgcaagtctccaatatcactgatttgttcagtaaatttcttcagcaaaatggaccatcttgtgtgcaacgctggcatcgcaagtgttggcgcgtttcaggagattccagatgttactaactacagctctcaatttgatgtgaacttctggggttcagttcagtcaacttttgaagctctccctcatctgaaaaggagccgaggaagaatcgttgttactgcgtcggcaaccggatggaatcctgttccaagaatgaccttctacaatgctgccaatgctgcactgataaacttctacgagacgctgcggacagagcttggtagccaagttggaatcacaattgtaacacctgggtggatcgagtctgagatgtcaaaagggaaatttctcaaggatcatggtgaaatggaggtcgatcaagaaatgcgagatgctcaaattggtttatttcccgtggagtacgcgaagaattgcgcaaaagccatggtacaagcggttcggcaagggaagcgttgtctcaccgtgccaccatggttcagcacaatgtacctgtggagggtattcgcaccggaggtcgtcgagttctgctaccgcctcctgtacatgcaccgccatggtggtagccaagctgatgcgccgagcaagaagatggctgaggctggtggaaagaagctcttgtatccaacgtcgctgcgctctgatgacatcaaggatgagtga

SEQ ID NO: 1147 - DNA, 1092 bp, Oryza sativa
atggagggtacaccaaacaaatcagttcaaagcttcgctggctcgagaactgagaaatctaccgggtctagtcatcatagagaagcagagcaaaatgacagttttacaagaagggaatatacttgtgctgattttattgaagcacttcgcttgattgatcaggaggcattcaagtgtagcattgttctgaatgacttctccatgcgagcaaacatcactgaaccatcttaccgcacagtgaaattagatggtatctgctcaacctttgtttcatcagttttagctggtggatatacctacacaggtgaggttgctaccactgatggagatgcaaaggaaaatgcagcccgtgtggcgatcaagtcaatccttgtagatattattgcagttactagaagcaaccacatgttggagagcatcaggtcaaacaaaccaacaggaacaacaatacaaggagagcagtcaagccagcagacaagtgcccatcctgcagtaattttcaccccacctgctagtaataacatcccttgtgctccccaccatcactatatgctgcatgcgccatttgctcctcttgaacagatgcagtggcgccatcctggtactccacagatggtgccggtttttcctcatgaacagatacagtggcgccatcctaccccagtacatatgccatttcatccccatgaacagatgcaatgccgccaatcccctgcaccaatgccgtttcttccccgtgaacagatgcaatggcgccatcccgctgcaccaatgccaacatttcctccccatgaacagatgcaatggcataatcctgttgcacagatggcatatcttccacctgaacagatgcaacggaatgttccaattgtacacacaccatctgaaatgatgcaaatgtggcagcttcctcaatcaatatccagctctaatcctgtgctgcaaaatgggctttactcgaatacaggtggcgatgatgacatggtagtagaggttggttccgctgaggagactatgactttgagtggtactaagcgcaaaatggaccaaactgaagaggcagagggcaagcaggcaaagatctccaagtag

SEQ ID NO: 1148 - DNA, 969 bp, Oryza sativa
atggggaggcctccttgttgtgatgagaatggcctcaagaagggcccctggactcctgaagaagatgagaagctcatgagctacattcagaaacatggccatgcaagctggagagtcttacctgaacttgctggcttgaacagatgtggtaagagctgcaggctaagatggaccaactatctgaaaccagacatcaagagagggaacttctcgcgtgaggaagagcaaactatcctccagctgcattccatccttggcaacaagtggtcagctattgcaaagcatctccctggacggacagataacgagatcaagaacttctggaacacccacctcaggaagaaactgatcaagatgggcattgatccaatgacccactgcccaagaacagacttctttcagtccctcccgcagctcattgcacttgccaacctccgccagattatcgagcgacaaccgtgggatggccacattgagggcctgcagactgtggcagttcaggctgccaagctcgaatacatgcaatcactgctacattctgcagtgtccattgtgaccagccccaccaccaccaccaccaccagcagcttaaacaccttcaccaccgaactggagcagaccaaccacctatgccctccacaggtgccttcttcaagtgtccctgaattagctgtacaggtgcctcacagccaaatgcctagcacttcatttgatcaggaaattggcaaaaccaacctgttctcaaataacattgtcaatggcaatgagtggtgcagcatggaggcagataacagcagccagaaaagcttgttggtccctgaaaactccattccaccactcattgacatgccagtgcaaaacttttgtaatactatcagcacaccaaactgtgacggcggcaatagtattccactgcccagttggtctgaaatcctacttgatgaagaactcatgggtgaatttgcttga

SEQ ID NO: 1149 - DNA, 969 bp, Oryza sativa
tacttgctttcatcctcaatggacaaaactgttaaactatgggacattactactagtacctgtctgaaaacattttcacacacagactatgtgacttgcatccagttcaatcccgtggatgataacttcttcattagtggatcactggatgaaaaagttgcactggtgggatcacacaagggaagctgtcatttatttgatacaactgaaaagaagcttcagtacaaaagtcagatagaactaagaatcaggaagaagaagtctggccagaagaagataactggcttccagtttgctcctggaagctcgtcggaagtcctgattacctctgcagattcaagaatccgtgttgttaatggtgatgaactcgttcacaaatttaaagggttccgaaatacaagtagccaaatatccgcttctgtagctccaaacgggaaatatgtggtctgtgccagtgaggactcccacgtgtatgtctggaggcatgacaatacttcccatccgagcagaagcaggagtgcagttgatgtaaccaactcatatgagcatttccattgccatgatgtcactgtggctatcacatggcccggcgctgaatcccgtggctcattcgggtcccgtagcagcagaaacagtgattcagacgatgcagtgatgaacacgggtcgggatgcccctgtagagaacagtgagcatgatctgaatggcactgtcaatagatgcaccaagcgcccagtttgtgaaggtgttgcaagcacaagcaatcctccagcggatggagtatcaacgtcctggcctgacgagaaacaatcgtctgccaagagcagtcctggtcactgctcatccgacctttgcattggagctttggatgttcagcgccggtcagcttggggattggtgattgtcactgcaggaaggggtggtgaaattagggtgttccagaatttcggcttcccggttcaagtgtaa

SEQ ID NO: 1150 - DNA, 933 bp, Oryza sativa
  misc_feature (816)..(816): n = any nucleotide
  misc_feature (819)..(819): n = any nucleotide
atggggcgcggcaagatcgagatcaagaggatcgagaacgcgacgaacaggcaggtgacattctcgaagaggcggggagggctactgaagaaggcgaacgagctcgccgtgctctgcgacgcccgcgtcggcgtcgtcatcttctccagcaccggcaagatgttcgagtactgcagccctacctgcagtttgagggaactcatcgagcattaccagaccgtcaccaacactcatttcgaggagatcaaccacgatcagcaaatatttgtggagatgactcggatgaggaacgagatggagaagctggacggtggcatcaggaggttcaccggcgacgacctctccaacctcacgctcgccgacatcaacgatctcgagcagcagctcgaattctccgtcaccaaagtccgtgcgagaaagcatcagctcctgaaccagcagctggacaaccttcgtcgcaaggagcacatcctggaagaccagaacagcttcctgtgccgcatgatcaacgagaaccatcatcaggcggcggtgggcggcggcgacgtgaaggcgatggtggatgatggcgccggtgctgtcgatgctgacggcggcgccggcgtactacggcgaggagtcgtcgagcaccgcgctgcagctcaccccgccgctgcacgccgtcgacgccgccgccgccgccgggttccggctgctatgccgacgcagcccaacctgcaggaccccggctgcagtcagcagcagcttccatgccgccgccgccggccacggcctgcagctgtggtaagaacacaaagacgcaagcaaagcatacanggnctacatcctgatactctcatcagagatctagatgattgcttgctaattaagcacatgatggcattgtcgattctgggagctaggagtaacttggagacgcatgaagatgcatga

SEQ ID NO: 1151 - DNA, 867 bp, Oryza sativa
atgaaccgtgacctcgtcatcattgggattggcactgagatcaaaaacgcggagccattggcaggtgcgatagggttcaagaaaatgagtgacaagaccgatgtgtacaacctccgcgtcatcaccctcaacctcaatctccttaccgagtccagatacaggcccgagttggataatccgccgaaccggagatggagcccaacgcgaacgctgggcgtcgcggccgtatcggaactggaaaccaacccgaacggcgaaagcttgcctctaccaccaataaaaaccacaggaccggagccgcataacacaacaccagtcctacatcgatcgattcaagtctcgacgcaaagccaatacgcccacagcatcgaagcaaagccccgcggttttgtcgtacgtcgtaaatcttccacaaaccagcagccgaatccgtcgtcgatcgacgtccgtcgagacacgaagatgcagatcgtcgtggagacccagatggggaagctcatcacgctcgaggtggagagcagcgacacgatctgtcaaggagaaggtccaggagaaggagggcatcccgatcccgccggaccagcagctgctcttcttcgaccacaagttgctggagaacggctgcacggtggctggctacaacatccaggacggctcgacgctgagcctctatctccgcctccttccaggcagcatgaacatcaaggtgaagcctctcagcggcaaagggcgcgcatcgaggaggaggacaggcaaatagggcagctcatctacaaaggggtgctggtcaccgacgacaaggcggcccacgagtacaatatcgaggccggatccgtgctccacctcacacttaatctcagggcctag

SEQ ID NO: 1152 - DNA, 849 bp, Oryza sativa
atggacccgccgccccgccgctccgcgggcggctccgagccgcgcgccaagcgcccccgcagcgccgccgtggcctcctccgcggagcactcgaagcgcccgtcgcgtgtctggagccaagccgacgagctcgtcatcctccgcggcctcatcacgtaccgcaccaagcgtggggtgctccctggctcaacgcaagacattggaaagctccacagctacatccgtggccagctcagtgctaaggtatcaactacacagctcagtgacaaggtccggcgcctcaagcagaagtatcagatgctcgcaacacgcgccaagactgggaaggaagtattccccactccgcatgaccacaatatctaccagcttgccaagaaggtctgggggacaatgagtactgctggtgagggaggaggaagtgggtatgataatgctgatgctggtgagagcgaagaggagcaatatggcagagagagcgatgatgatatggagagtgggcgggataaccgtcaccgcaagaatcagagatcagtgccagtcactatggcaaatggcaatgggactgggatcggtgctgtgaatgccattgtgagagggaggagtgagtttgagaaagggaaggatgtatatccttacctgtgggaaacagttgaggagctgtccagccaacatccaactggagcagtgttcaagaaggcgtttgagttgcttgaaggatcgaaagcacaggtgatggaggaaaagctgcggaagttcaggctgactgagatgagacagcagttgcgtcggatggacctgatgaaggacacactgagtatggtgcttgatgccctggagatggctgactga

SEQ ID NO: 1153 - DNA, 804 bp, Oryza sativa
atggggatgtgtagcaagacaaggaagaaggggtcgtggagggcggaagaggacgcgctgctgacgaggctggtggcgcagcatggcccccaccggtggagcatcatcagcggcgccatcccggggcgctccggcaagtcgtgccggctgcggtggtgcaaccagctgagcccggccgtgcagcaccgccccttcaccccgcaagaggatgccctcctcgccgccgcccatgcccgccacgggaacaagtgggccaccatcgcccgcctcctccccggccgcaccgacaactccgtcaagaaccactggaactccaacctccggaggtgcctccgccgccaagccaaattcaaatccaaggaccctgatctgctgcccgatccaattaatattccacctgactgcatcgtcgtgctcaacgacgacgacgagcctgcagatcggccggtcacgccgcccgccatcatccaggcccaggcccaggagacactaccgtcgctgaccctgagccttagcctttccctgcccggcgccgctgctgctgctgctgaggttgaggtggcaccgccgccgcccagggcactggcagctgcttctgagatccaagacggcagcagcagatcatcatcggcatcgcgtgtcatgttgcaggtgatgcgacagatggtgagggaagaggtgcagcgccatactgcgcagctcgcctactccctcatggccctggcctcctgcagccgtaggcccccaaatttaggagcattcattttcagactttgttcaaacatcgatcgatcatcaaattaa

SEQ ID NO: 1154 - DNA, 672 bp, Oryza sativa
  misc_feature (178)..(178): n = any nucleotide
  misc_feature (181)..(181): n = any nucleotide
atggcgacgtcgatggagctggcgcccggcgacgcgcggttcgcgaagctggcaaaagagctcgacgacaaggcgccgcccaaggccgcggccgcgccaccggcagcatcagaagaccaagcagcagcgagctccgggaagcccaagtacaagcacgacttctacaacggcgcgagcnagntggtggtgacggtgttcgccaagagcgtggcggcggagcacgtgtccgtggacttcggcgagcagatgctgagcgtctccgtcgaggtcgtcccggccaagtgccgctacagcatcctcccatcgaagatcgaggtgcgtctcgccaaggcggatgagcaagtgacatggacgtcgctggagtacacgagcaaggccaacaacaagctcgcggcgacggcgacgacaacgacgaggaagaaggtagactgggacaagctggaagccgaggtgaagaaggaggaggaggaggaggaggtggacacggcgacgccggtggtgaacaggttcttccagcagatgtacggcaacggcgacgaggacatgcggcgagccatcatgaagtcctacgtggagtcctacgtgctgtccacggactggaaggacgtcggctctaagaagattgaggccagcgcgccggaaggcatggagctgcacaagtgggagtattga

SEQ ID NO: 1155 - DNA, 659 bp, Oryza sativa
  misc_feature (586)..(586): n = any nucleotide
cccaatgccgcgccaggcgggcttcagccattcgatgtagtcaagatagagcgcggagatgatcatctgctgcgccgagcccgccaccgaggtaatggaaagcgtcacgatgagcgcgaccagcaggcctatcagcgacacaaaatcgcggagatacttcacccaaattttctcctgatcctgcggcttacgctcccagacgtcgcgcgactgggcgcgaatggcctcgcgcaggttgcccatccagttaacgccggaataaagggcgatcagcaagccgacgatgccgacggtagtacgctgctgaacggcggtattgatggtgcttttgagcgtgccggcaagggtcgggtcgctgacgttgttcaggatcttattgaagatatcctgcagcagcgtcgggtgcgacgcgagtacaaaaccggccgccgcaaacgacaccatcaggatcgggatcatcgacaagaaggaaaaataggtgatggccgcaccaaactggttccccatgcggtcattgaagcgttcggtcgcgcgtatcagatgcgcaaccatggggaactgctgaattctcgcggcgatgccggtnacggtccccagcgctttgctggcggtgcctggcgttttggcctcctcaggcccggtttccatctttttgacgg

SEQ ID NO: 1156 - DNA, 654 bp, Oryza sativa
  misc_feature (169)..(169): n = any nucleotide
  misc_feature (174)..(174): n = any nucleotide
  misc_feature (178)..(178): n = any nucleotide
  misc_feature (204)..(204): n = any nucleotide
atggcggcgctcttcgaggccgcggagacggcggccatcgtggctgcgctgacgcgcgtcattgccgacggcgggcgtggaggcggcggcggcgtctgcgtgccgccgcccgcgccgtcgttggtcgtgccgccgcgggcgggaacaggcggcgggcggcgcttcgacnttgcncggnaggaggagatggtcggcgtcgtctcngcgggagatcacgccggcggggcaaacgtggccgaggcggcggcggcggtggtggtggcggcgccggcgacagcgcgcaggtaccgcggggtgaggcggcgaccgtggggcaagtgggcggcggagatcagggacccgaggaaggcggcgcgcgtctggctgggcaccttccgcaccgccgaggacgcggcgcgcgcctacgacgccgccgcgctacgcttccgcgggcgccgcgccaagctcaacttccccgaggaggtgtcccgcccgtggcagggtcacgatgtcgatcacatgtcctgctcgccgccgtcgatctcgaacgctcgctttctgggttcgtggaccttcggaccgccgcagccgccatcgcggtccgtcgcggcggcggcgacgactctgcttggtgggagccatggaggcaacggagcagagaacgggagggaatag

SEQ ID NO: 1157 - DNA, 600 bp, Oryza sativa
atgggcccacccgatttcatgggccttccgcttccgcaccacctgggccgcgccgccgcagctcttagcccgcgcgcacatgcggcacgaacgcctcttgccccatttccaccgccctctcccgcttccggcgatgtccacgccgaacagcctcacgacacgtgctgcttcgctgcttgtaattggcttctcgtcgccggtggccgccgccgtgttgttcttctagcagtcgatgaagagcagctcgtcggcgcagaggcccttctccctcacgaatcggctccatcccttggtcagcacgtagctctggctgctgttcctggacgagtcacagcggtggcggcagttggagggtttgtcgctgcggccgcgctcgccgagagggccggcgtgatcgcgccaaggaaacgctccaacgcgcccccagattcgcatcgcaccggtgagtttctgaggaattggagatgtgtgttgctgcttgaaatcaaaaactctgatctcttgattccctttgaagatttgagagccaatcaagtttgcattcgccacaattttcgcaccgttctccgtcactgtctcttctcactctctgtctcttga

SEQ ID NO: 1158 - DNA, 537 bp, Oryza sativa
atgacaacttccttttcttttaatctccccttcgtgatcgcgatctgctctcgagatggatccggcgccgcctgcctcgtcctccgccgcgcggacaaactggtcgtccacgcgggtagtcgccgccggcggcggctgcagaagtctcgagcaggcgcggcgaccgagggggagagaggtggccggcggcggagcggggacggtggcagcgggagagggagagagaggcgatcgacgcgacggcggcggcgggagaagaggagaggtggcggccggcgcgacggcgagctcggcgtcggagatgttcgaacgtgtcgggtgctcgaccacgggccccgccgccgcccgccgggcgagcgacgcgctctccctgttgaccctctctccctccccaaggcgatggggctgctccgctgccgaaagagctgctgcctccactggatgaactacctcagccccgacctcaagtgcagcaacttcaccgacgacaacgacgagcttaccatcaagctccacgcccttctcggcaacaagtaa

SEQ ID NO: 1159 - DNA, 450 bp, Oryza sativa
  misc_feature (134)..(134): n = any nucleotide
atggcgatggtggtggaggagctcgacgagttcgaggtgctgtggcctgacaccgacgccgccgacgacgacgcgccgccgccggcgatctcgcctgcgccgccggtgcagccatacgagacacgcgcgcccangccgcgcgtcaagcactctcggccggtggacgtcccctgcaggggagcgcgcttacaccggtggaactggagatacggtggtgccagcatggaggaggacggccacggcagcgtcgtcgggaaggtggtgatcgtgccgccgcacctgctgctgctgttcggcgtgcggcggccggaggaggaggaggaggaggagatggcggcggcgccgtgcacgctgccgtcgtcgttggggacgcggccgtgcaagcgggcgcgcgacctgcgccacctgcgcaactcggtgctgcggatgaccgggttcatcgaaggatga

SEQ ID NO: 1160 - DNA, 402 bp, Oryza sativa
  misc_feature (367)..(367): n = any nucleotide
  misc_feature (378)..(378): n = any nucleotide
  misc_feature (386)..(386): n = any nucleotide
  misc_feature (390)..(390): n = any nucleotide
atggccttcgtgaatgagcagatggatatctaccgcaagattgggtatcgcgtgctgatggtctccagccacaccaaggatggcctgaaaccgcttgaagaggcgctcaccgatcgcatcagcatcttcgcgggccagtccggcgtgggcaaatcaagcctgctgaacaacctgcttggcctccagcaggagatcctgaccaacgatgtgtccaacgtctcgggtctgggccagcacacgaccaccgcctcgcgtctgtatcacttcccacacggcggcgacgtgatcgactccccgggcgcgcttgcaaataccgcgactgtaaacacgataacgacccgggctgcgctatccgcgaagcgttttnaaaaacggtgnaaattgcngganacccgcttttga

SEQ ID NO: 1161 - DNA, 390 bp, Oryza sativa
atggcgcgcgcgcagccgcgcagcgaagaatctgacgaaattttggctcggtgggaagcgaaatacgagggcctagtagccatcgtcgatccccaagtctccgcggcggaggcgcttgcgttgcgaccccgtcgccgccgccggcgatccgctccagccgaaccccgccgcaccgccgcggtagctgccgtcggcgaggtgcgtctcggcaccggactccaggaatcgtgctgctgctggaacgccgcgcccgctcagccggcggccgggcgtcccgcgtggctcgctggcatcgatcggggatccctcctacgggctcgccgtcgcggagggtttaagccgagttactgggtcaggatgggtcaggatgatatatgttctgcttgttag

SEQ ID NO: 1162 - DNA, 390 bp, Oryza sativa
  misc_feature (289)..(289): n = any nucleotide
atggggccatattggcattggctggctgggtgcggagcagcgggttctgactcgcggccaaatcgaggtatgccacgtgccatagctcatgcggggacttcagggacgacacatctcgttaagatgtttgatcctgttggcgttgtacctgctcctctcttcgctggtgaggagatcgacgatgcaatccatgtcgagtcacataccccctgcactcgtgcaggatgtcctgcttctgggcctcagtgcatttccttatttttggttgttgatgagggggtttcttctngcttgtgcgctagcttgttgcgcaacaaggaggatgaggaggagtcctccggctgctgccactctccaggagaccattgttgtaagaggactaggatgtag

SEQ ID NO: 1163 - DNA, 369 bp, Oryza sativa
atgcagggaggatgggagaatgatgaaactgttgagcaggcagctgctcgagaggctgtagaagaagctggagttcgtggagatatagtgcaatttctgggtttctacgacttcaaaagcaagacgcatcaagatgcgtgctgccccgagggtatgtgcagagccgcggtgtttgcgctgcatgtgaaggaagagctggactcatggcctgagcagagcacccgcaggaggacctggttgacagttcctgaagccacgtcgcagtgccggtatcagtggatgcaagaggctttgcttactggcttctctgactggcatgacaactggagcaaaggtggcggtggcgacaccaactatgactctctctag

SEQ ID NO: 1164 - DNA, 327 bp, Oryza sativa
atggagcctccatcgccgcgcgcagggccttcggcgagggctccccggccgtggccgccgcatggaagccacttcaccaaccctgtccctccctcccgccaccgccgcatgcaagccatcctcgccgttggtcccgggggcgccgccgctgccagggcgctcgtcgtcgccgatgccaccaagaaggccgtcgccgaggccctcgccatgcgggagctcagcgtctccaccgccgtcgccgtcgccaggaagcgctccccgccgctcgctatcgctgggaacgaccgccgcctccccttcccggactcctccgtcgacttcatctaa

SEQ ID NO: 1165 - DNA, 309 bp, Oryza sativa
atggctttatcactaccggttcataataaaagctgggtatcaccattgattcctggaattcttcccaacctcatatatgatggtgtggcggctgccaagatgtgtcatgatccaagccaaaccttcagaggcttgtgcggccaccccaccaactgcatcgcctgctgcaccaacgagggctacacaggaggctactgcacaactgttagacacaaatgcatgtgcaccaaagcgtgtggaggggagagtccgcctgatgatccgccgtcggcgatgccggcatcgccagtgacgacgacaagagcctga

SEQ ID NO: 1166 - DNA, 5509 bp, Oryza sativa
  misc_feature (3440)..(3440): n = any nucleotide
  misc_feature (3521)..(3521): n = any nucleotide
  misc_feature (3523)..(3523): n = any nucleotide
agtcgacatcttgaagttcagttgctttgtgatcaatatggcaacgtagcagcacttcacagtcgagattgcagtgtacaacggcgacaccaaaaggtctgctgtctcagataatcgaggaaggaccagttactgttgctcctcgtgagactgtgaaagagcttgagcaggcagcacggaggcttgctaaagctgtgggttatgttggtgctgctactgttgaatacctttacagcatggaaactggtgaatattattttctggaacttaatccacggctacagcaggttgagcatcctgtcactgagtggatagctgaagtaaatttgcctgcggctcaagttgctgttggaatgggtatacccctttggcagattccaggagatcaggcgcttctacggaatgaaccatggaggaggctatgacctttggaggaaaacagcagctctagcgactccatttaactttgatgaagtagattctaaatggccaaaaggccactgcgtagctgttagaataactagcgaggatccagatgatgggtttaagcctactggtggaaaagtaaagcaggagataagtttcaagagtaaaccaaatgtttgggcctatttctcagtaaagtctggtggaggcatccatgaattcgctgattctcagttcgggacatgtttttgcgtatggaactactagatcggcagcaataactaccatggctcttgcactaaaagaggttcaaattcgtggagaaattcattcaaacgtagactacacagttgacctattaaatgcctcagattttagagaaaataagattcatactggttggctggataccaggatagccatgcgtgttcaagctgagaggcctccatggtatatttcagtcgttggaggggctttatatgccactgtttctgattatgttggttatcttaccaagggccagattccaccaaagcatatatcccttgtctatacgactgttgctttgaatatagatgggaaaaaatatacaaggagtggacatggtagctacagattgcgaatgaatggatcaacggttgacgcaaatgtacaaatattatgtgatggtgggcttttaatgcagcagctggatggaaacagccatgtaatttatgctgaagaagaggccagtggtacacgacttcttattgatggaaagacatgcatgttacagttgcagaatgaccatgacccatcaaagttattagctgagacaccatgcaaacttcttcgtttcttggttgctgatggtgctcatgttgatgctgatgtaccatatgcggaagttgaggttatgaagatgtgcatgcccctcttatcacccgcttctggtgtcatacatgttgtaatgtctgagggccaagcaatgcaggctggtgatcttatagctaggctggatcttgatgacccttctgctgttaagagagctgagccgttcgaagatacttttccacaaatgggtctccctattgctgcttctggccaagttcacaaattatgtgctgcaagtctgaatgcttgtcgaatgatccttgcggggtatgagcatgatattgacaagtgcctagacactccggagcttcctttcctgcagtgggaggagcttatgtctgttttagcaactagacttccaagaaatcttaaaagtgagttggagggcaaatatgaggaatacaaagtaaaatttgactctgggataatcaatgatttccctgccaatatgctacgagtgataattgaggagaggcttgttgagcctcttatgagcctactgaagtcatatgagggtgggagagaaagtcatgctcactttgttgtcaagtccctttttgaggagtatctctatgttgaagaattgttcagtgatggaattcaggatgtgattgagcgtctgcgccttcaacatagtaaagacctacagaaggtcgtagacattgtgttgtcccaccagaaaactaagctgatactaaaactcatggagagtctggtctatccaaatcctgctgcctacagggatcaattgattcgcttttcttcccttaatcacaaagcgtattacaagttggcacttaaagctagtgaacttcttgaacaaacaaaacttagtgagctccgtgcaagaatagcaaggagcctttcagagctggagatgtttactgaggaaagcaagggtctctccatgcataagcgagaaattgccattaaggagagcatggaagatttagtcactgctccactgccagttgaagatgcgctcatttctttatttgattgtagtgatacaactgttcaacagagagtgattgagacttatatagctcgattataccagcagcctcatcttgtaaaggacagtatcaaaatgaaatggatagaatcgggtgttattgctttatgggaatttggtgacaaaagatggggtgccatgagaatagccaaacttcccttgatactaaaggataatgtaaccgatctgcatgcctctggtgtgaaaacaataagtttcattgttcaaagagatgaagcacggatgacaatgcgtcgtaccttcctttggtctgatgaaaagctttcttatgaggaagagccaattctccggcatgtggaacctcctctttctgcacttcttgagttggacaagttgaaagtgaaaggatacaatgaaatgaagtataccccatcacgggatcgtcaatggcatatctacacacttagaaatactgaaaaccccaaaatgttgcaccgggtatttttccgaacccttgtcaggcaacccagtgtatccaacaagttttcttcgggccagattggtgacatggaagttgggagtgctgaagaacctctgtcatttacatcaaccagcatattaagatctttgatgactgctatagaggaattggagcttcacgcaattagaactggccattcacacatgtatttgcatgtattgaaagaacaaaagcttcttgatcttgttccagtttcaggatacatgaacttgttggtgcaagaatgcaccatctttctgtatgccaatgggaagtgaaacttaagttggactgcgatggtcctgccagtggtacctggaggattgtaacaaccaatgttactagtcacacttgcactgtggatatctaccgtgagatggaagataaagaatcacggaagttagtataccatcccgccactccggcggctggtcctctgcatggtgtggcactgaataatccatatcagcctttgagtgtcattgatctcaaacgctgttctgctaggaataatagaactacatactgctatgattttccactggcatttgaaactgcagtgaggaagtcatggtcctctagtacctctggtgcttctaaaggtgttgaaaatgcccaatgttatgttaaagctacagagttggnatttgcggacaaacatgggtcatggggcactcctttagttcaaatggaccggcctgctgggctcaatgacattggtatggnancttggaccttgaagatgtccactcctgaatttcctagtggtagggagattattgttgttgcaaatgatattacgttcagagctggatcatttggcccaagggaagatgcattttttgaagctgttaccaacctagcctgtgagaagaaacttcctcttatttatttggcagcaaattctggtgctcgaattggcatagcagatgaagtgaaatcttgcttccgtgttgggtggtctgatgatggcagccctgaacgtgggtttcagtacatttatctaagcgaagaagactatgctcgtattgggcacttctgtcatagcacataagatgcagctagacagtggtgaaattaggtgggttattgattctgttgtgggcaaggaagatggacttggtgtggagaatatacatggaagtgctgctattgccagtgcttattctagggcatataaggagacatttacacttacatttgtgactggaagaactgttggaataggagcttatcttgctcgacttggcatccggtgcatacagcgtcttgaccagcctattattcttacaggctattctgcactgaacaagcttcttgggcgggaagtgtacagctcccacatgcagttgggtggtcccaaaatcatggcaactaatggtgttgtccatcttactgtttcagatgaccttgaaggcgtttctaatatattgaggtggctcagttatgttcctgcctacattggtggaccacttccagtaacaacaccgttggacccaccggacagacctgttgcatacattcctgagaactcgtgtgatcctcgagcggctatccgtggtgttgatgacagccaagggaaatggttaggtggtatgtttgataaagacagctttgtggaaacatttgaaggttgggctaagacagtggttactggcagagcaaagcttggtggaattccagtgggtgtgatagctgtggagactcagaccatgatgcaaactatccctgctgaccctggtcagcttgattcccgtgagcaatctgttcctcgtgctggacaagtgtggtttccagattctgcaaccaagactgcgcaggcattgctggacttcaaccgtgaaggattacctctgttcatcctcgctaactggagaggcttctctggtggacaaagagatctttttgaaggaattcttcaggctggctcgactattgttgagaaccttaggacatacaatcagcctgcctttgtctacattcccatggctgcagagctacgaggaggggcttgggttgtggttgatagcaagataaacccagaccgcattgagtgctatgctgagaggactgcaaaaggcaatgttctggaaccgcaagggttaattgagatcaagttcaggtcagaggaactccaggattgcatgagtcggcttgacccaacattaattgatctgaaagcaaaactcgaagtagcaaataaaaatggaagtgctgacacaaaatcgcttcaagaaaatatagaagctcgaacaaaacagttgatgcctctatatactcagattgcgatacggtttgctgaattgcatgatacatccctcagaatggctgcgaaaggtgtgattaagaaagttgtggactgggaagaatcacgatctttcttctataagagattacggaggaggatctctgaggatgttcttgcaaaagaaattagagctgtagcaggtgagcagttttcccaccaaccagcaatcgagctgatcaagaaatggtattcagcttcacatgcagctgaatgggatgatgacgatgcttttgttgcttggatggataaccctgaaaactacaaggattatattcaatatcttaaggctcaaagagtatcccaatccctctcaagtctttcagattccagctcagatttgcaagccctgccacagggtctttccatgttactagataaggtaattagcttactgatgcttatataa

SEQ ID NO: 1167 - DNA, 4997 bp, Oryza sativa
  misc_feature (3713)..(3713): n = any nucleotide
  misc_feature (3765)..(3765): n = any nucleotide
  misc_feature (4190)..(4190): n = any nucleotide
  misc_feature (4195)..(4195): n = any nucleotide
  misc_feature (4220)..(4220): n = any nucleotide
atgcgctccccttgcttcttgaatcacggaggttcaaggacagacggtacagaggtttgtgttttcttgctgagatttctctttcattgcgctccctttgctctccggatcgtggagcgagatcccatcgctcgggtatggattgagccctctccgcttgtatggtgtcttctccactgatctccatacatccagatctacagtagatcggccctgggaaggggcttttgacgcagatcggttctaccctcggcgccggatcgattccgccgcccaatttggcgctgatccgcgggtgggtcgcatccgccgcacgatacaatcgagaagctgtgtgttttcgtgtgaaatctgtggagttgttagagattggaggtctgaggtggtttgtgtgatccggattttctctgcagccggcggtggttctgggctcgattcggtggtcggatcaacgctcctgctcagcagtggtagtgacaggcctagtgcaacggatgcaactgaatcagtacaaggcttagatggagaggagactttgtccgagagggcatcggttggagcggggcaaggaccaagttcacagaatgggggtgggaaggaggagccttcgagcagttcatctgcagggagtaagaggaagcgtactagcttgagttctgatagagtggaacttaatgggctagatgcggcaggaaccagctcaggcgattccacatggagcgaagatagtttcaatggccgtcacggacgttcattgccaagaaataaggatggccacttagagcattcagttaattcaggtgaagttgcagtgatcaggcagcctcgtggtgtattgaggttaaggaagctggctcagaatgttagtatcaagagtggtaccggaggtcgcaaggttctgcgatccaatggcattacgaaagctactcaggtccagaggaggaagcggaggaaatcacagactcttaaggagaacagagttggtagtaatgaccctatcaattgcttgaaagttgagaatggcacttgtgaccaggacaacagtacaaacttctgttctgaaaatgatgtctcagtcgaaaagcagccaaatctttcaggtgaaccatcaaaacatgtccatcctaccaaggaaagctccgtgcatgttcaagaggaggataatgttaatttggaagaaaatgctgctaggatgctctgttctctatcagataatatgtgtgctagctcactgaggaagagtgcaaaatcactgaatagatcatcaaaagcatactttgtccagcattcagaacatttcaaggattcatgtaacaaagacaagggcatggcgggtcctgctaggttgctacggaatcgtgatggcaaagcttcatccaagaagcgtcgcccacgtcggcatttttatgaagtcagccctcatgatgtggatccgttttgcattgtaaaagagagaatccgggtgttttggcctctggatgagatctggtactttggcctggtaaaggaatatgatcccatgacaaggttgcatcatgtcagatacgacgataaagatgaggaatggatcaatcttcaaaatgagaggattaagcttctccttttgcccagcgaagctcggcataaatctaatcgtcgtaatccaaggtcgatattcaaaccaaaatatgaagtggatgagagggaagacattgatagaaacagcacaggaagttctgagtcaggccccatcatctcattgctgtctagatcaaaccatgcaaggtctgctacatccagtaatacgaataagcagaatcacactcattcagatatttctcctgttatgtttgatcaaaagcagtctatgctgtgctctgatgatagacctggtggttcacctgcaaatgcgggtgaggagatccctgaagacaggactacgcttaaagatagcaggtttcgctttgtttactcaaggaagcgatcttgcaggagaaagaatggatttctcaacacttcagaacaagattctgatcttaaatacagaaaagttacaggtgcgttgtttgcttcagttgctggctgggggtctgttactgaaaatgttacttcgagaagacatggcatattagtactgagccagccattaaaatctatttataagatcatgtctgaagcatgccatgtctggcttctcaatgctcttgttctccttcaccgtggtgcaatggtttccttgtggcctgccgtacatctggagatacttcttgttgatgatactttaggattgaaacacttgcttcttgagacttccttaagatcagctgtatccttattctgtttacttgttggatgtttcaattcgtattccaaggcgagtacacgcaatgagtcaaaaatgctatgcacctcagtcagagttcggatatctggtttgcacggtagaagccaagttgtgtttttgatgttcagcttcgtgggggtaaagtaccccaaatggaagcacctgcaaggacagctgcagcatcaccatataaaaagggggctatctaaagttaattgcgcatgtgctgacataaagcaacttacaaatggaactgatcaaagagtctgtacttcaacagaacacttctctaagagggtctatcactcgatgctcaggactctctgtttttcacagaatcaaaatattcaaatgtcgaccctatcattttttgtcttgatgagcgaagtaaatctgttcaaaatcatctggatgtggcagctgcaccttcactgttgttttttcaccacttaaaattgcgcagtgaaagcaacttgacttctaaaagtcttccggaattcatgccgattactttagaagaggatcagcagtctctgccacagcacacatctgatctggttcatctggctgcttctgcttctgaagtttgttctgtttatgttagtccatctaatactggttccttggatatgggtaccgctggttgcatcaatcattctggttctgctagcagcaagctcaatactgctaaaaggactgtaagtctggattgtaatagcagaggtattggtggtgccaacataacaagcaggagttttccagatcaaattatggatggaagcctttctgctgtttgccctcctcagaagtatcaaaagaggtgttcttctatatctattcctggagataatatatcagatccaccagatgataagctacttaacaaagaagaaaaggccatgcagcctacatctgacttggtccaggaactgaatgagtatcctattggtcgtgttacaccaactgcccccaggactccctaccatcggaaccgatttacatccctatcacgcacttttggtgatggttcaaaattatggcaagaagatattatggtgacaggctttgctggtggctctaagaagccaaggactcaggttttgtactcggtttctcctagaagtgatgaacctggctcaaaacacaaaggacatttccgcaagatacagtctcatagcagtgcaaagagacttcctgataattcaagaagtgaacagagcagtcctgagtcattggcttgtgttgcaaatgtcctagttacagttggtgatagaggatggagggagtacgatactcagatcacaattgactctgatgggcagattgaacggaggatttgtgtgaagcttgcagaaggaactaagtatgctcacaaagttcttcaagtttngcagcctggggcgacaaaccgctatacacatgcaatgatatggaaagggggnacagagtggtgcttagaatttcctgacagaagtcagtggttgattttcaagcaaatgcatgatgaatgttatagtcataacattagagctgcatctgttaagaatattccaattcctggtgtctgctttgctgaagctcatgatgatcatgatgctgtatcctttgtacgctctcaagattatattggtcatattggaacagatgttgaaatggcacttgatgaatctcgtgtgatatatgacatggacagtgatgatgaagtgtgggtttcaagatggaggaaactaggcaaggacagcacctctgtgacagatgacttgtttgagaggatcatggacaaattcgagaaacttgcttatagccacaactgcaatgaactcactattgatcagatgaaggaactagatagtgataacataccacntggancaccattaagtgatacatgattatnggcaggacagaggaagaaaagggaatgccactcattcgacactttcagcattttcagtccgctatgtggaagatccacgagcagcagctacaggaatgggaatcaacagcactcagaatacagggttcatcaaatggttaccaagttaagttgcctccaaaacctgccttgttcgccttctgtttgagacctcgaggactccaaccccaaataccgtataagggaccgaagcagcgttcccataaaaaacttatgtcctcaggaagcttttcgagagagcaagatggcttttaccgaccagcagggtactctcccaggttctctgtgaaaacagaatcccctcgcgcatttgatggtttggaaagatgttctacaccaaggtttttgagaaccaacagtgtcaaaaggactgcaagctttgcattctctgaggatcaccagccatcaccttccttccgtcatcagagagtgaagcgaggcgcgcctgatcactggaacgcggtcatccacgaatggcagagctcaaagcacctgctcccgggtgcgtcccagagcccccgcgtcgacatagaggagctcaagcagcgagatgcctccagtgcagcgcagcatgcggtggccatggccaagctcaagagagagaaggcccacctgctgatgcacaaggctgaccttgccctccacaaggccacagttgctctcatgatggccgacgcgatcaaggcgtccagcagggactcttcccgggatgggaggagagatttcagggacgactga

SEQ ID NO: 1168 - DNA, 4483 bp, Oryza sativa
  misc_feature (2310)..(2310): n = any nucleotide
gttggttctcatgtttgggtcgaggacccaattctagcctggatagatggagaggttgttagcataaaagacaatgaagttcatgtgcagacttcaaatgggaaaaagtcaaaagttttccccaaggatatggaagctccaccaggaggagtggacgatatgacaagattatcatacttacatgaacctggtgttctacagaatcttgctacccgttatgagctaaatgaaatatatacttacactggcagcattttgattgcggtaaacccatttcaaagattgccacatctctatgatacccatatgatggaacaatacaaaggtgcagattttggggagctgagtcctcatgtcttcgcagttgcagatgttgcttacagaatgaagggaaaagcaactctatattggtcagtggtgaaagtggtgctggcaagaccgaaacaacaaagatgcttatgagatatctggcacacttaggtgggcgatcaggagtagaaggaagaactgtagaacagcaagttctagagagtcaaacccagttcttgaagcttttggtaatgcaaagactgtgcggaacaataactcgagaagtcgctttggtaagtttgttgagatccaattcgacaagactggacgcatttcaggagctgctatcagaacttacttgctggaaagatcccgtgtatgccaaataaatactccagagagaaattatcattgcttttatttcctttgtgctgcacccccagagcagaggtataagttggccgatgctagatcctttcattacctcaatcagtcaagctgtattgaagtagaaggaattaatgatgctgaagaatatttagcaacaagaagggccatggacatagttggaatcaatgaggaagagcagcaggaagctatattcagggttgtagctgctatacttcatcttggaaatataaattttgctaagggaacagaaattgattcatctgtgatcaaggatgacaaatccaggttccaccttaacactgcagcagaactgttgaactgataacacgagtaatagttactcctgaagaaattataactagaacacttgatcctgcttctgcacttgttagcagagatgcattagcaaaaacaatatactcccgattatttgattgggattgtggagaagatcaatgtctccattggacaggacccaaactcaaaacagttgattggtgttcttgatatatatggttttgagagtttcaaaattaacagaacagttttgagcagttgtgcatcaattatacaaatgaaaagctgcaacaacattttaaccagcagcatgtgttcaaaatggaacaagaagaatacaccagagaggagataaactggagttacatagagtttgttgataatcaagatgtgttagacttgattgagaagagaaaggtggtttgatcgcacttctggatgaagcatggtatgtttcctagatcgacacatgagacgtttgcgcagaagttgtatacaacatttaagaataacaaacggtttgccaaaccgaagctttcacgcacagattttacaattgttcattatgctggtgatgtgacgtaccaggctgattttttcctagacaagaacaaagattatgtagtggctgaacatcaggatttgctgaatgcttcttcttgtcctttcgtagctgctttatttcctgcactccctgaagagactgcaaaatcttcaaaattttcatcaatcgggtcacgtttcaagagctgcaacttcaatctctcatggagaccttgagctcaacagaaccccattatattagatgtgtgaagccaaataacctcctaaagccagccatttttgagaacacaaatgttatacaacaactgcgatgcggaggtgttcttgaagctatcaggatcagctgtgctggatatcccacaaggaaaacattctatgaatttgttaatcgctttggtgttcttgctcctgaagttctagaaggaagagcaatgatgataaaattgcatgccagaagattttggaaaaaatggggctggagaactaccagcagatcggaaaaacaaaggtatttctgagagctggacagatggctgatctggatgcacgaagagcagaagtgctaggaagagcagcaagaattatacagagacaaatctctacatatatcgcacggaaacagtttgtttcgctcagaagatcagcaacacagctacaatctttcgttagagaccttggcgcgtaaattatacgaatgcatgaggcgggaagcatcagctagtgaagatncaaaagaatgttcgtcgtcacaaagctcgcgtgtcttatttacaactacaggaggctgcaatcacgttgcagacaggattaagggcaatgtctgcccgcaaagagttcagattcagaaaggaaactaaagcagctgtccatatccaagctcgatggcgttgccacagagactatgcacattacaagaatctgcaaggagcagctcttacttatcagtgtgcatggagacaaaggcttgcaagaagagagcttagaaagctaaaaatgagagaaacaggggcccttaaggaggccaaggataaacttgagaagcgtgttgaagaactgacatggcgccttggactggagaagcggttaagggactgaccttgaggaagcaaaagcccaggaaattgctaagctgcaagagacattgcatgatatgcaacagcaagttgaagaagcaaaggctatgattgttaaggaaagagaagcagctagaaaggcaatagaagaggcacctccagtaatcaaagagacccctgtattggtcgaagacacggaaaagattaactcactgacagcagaggttgaacaactgaagaggctttgctgcaaacagaaaggcaagcaacagaaactgcaaagaaagaatatgctgaagctgaacggagaaatgaagaactaatcaagaaatttgaaggtgcagagaaaaagattgagcaacttcaggatactgtcccagagaggctggaagagaaagcaactaacatggagtctgagaacaaagtgctacgtcaacaggctgttgctatttctcctacggcaaaatcattagctgcatatcctaagtctcccttccagatatcacccctatctcactcaaccctaaagagcctgagactgaggagaagccacaaaaatcactcaacgagaagcaacagcaggaaaaccaagatatgctgatcaaatgtgtatcacaagatctaggtttctccagtgggaggcccattgctgcttgccttatatacagatgccttctgcattggagatcatttgaagttgaaaggactggtgtttttgaccgtataattcaaacaataggcactgctatagaggcatattggctctccaattcatccacattactcctactattacaacgaacactgaaaacaactggagcagctggactcacacctcagaggcgaagatcttctgctgcatcatttgggcgggtgttctcggagcttcaccacagagtgctggccgtccttttctggctagccgcttgatgggaggaataggtgatcttcgtcaagttgaagccaagtatcctgctctgcttttcaagcagcagcttacagctttcccttgagaaaatctatggcatgataagagacaacttgaagaaggaaatatccccattacttggtctttgcatccagcaggcgccgagaacatctcgtgctagtctaattaaaggatctcgttctcaagcgaatgccttggcccaacaaaaccctgattgcccattggcagagcattgtgaaaattctaacgaactaacttgaatgttctgaaagccaattatgtacgtcccttcattcttaatcagcaaggtgttcactcaaatcttctcatttattaatgttcagttgtttaacagtagtctgcttcttcgacgagagtgctgttcatttagcaatggagaatatgtcaaagctggactggcagaattagagcagtggtgtatttatgcgactgaggagagtatgcaggttcttcctgggaagaattgaagcatattaggcaggctgttggattccttattcatcaaaagccaaagaaaacactgaaagaaattaccaacgatttatgccctgtcctaagcatacaacagctataccgaatcagcacaatgtattgggatgataaatatggaacccatactgtttcgtcagaggtcatctcaagtatgaggataatgatgacagaagactcgaataacgcagtgagcagttctttcttgctggacgatgattcaagtgattgcagcattccgttttcggtggatgatatctcaaagtcaatgaaagaaattgaggtaacagatgttgacatgccgcctttgatcagggagaactctggctttaccttcctacactaaagaaaggactatcaagagtggtga

SEQ ID NO: 1169 - DNA, 4345 bp, Oryza sativa
atgccatttccatttttgtgctgttttgcagagaaaaagatagcatcatatctcagtaaaattggccaaaagtttctttgggtgtatcgctcgtatggaacctatgtggctttcctcacaattcttttgactctctacttggtgactcctaattatatatcctttggttacctttttttccttctggtttggataattggaaggcaacttgtcgagaagacaaagagacggctttggtttccactaaaagtatatgccactttggttttcatctttacatactgccttagtgtgtcacccctttttgcagggttagtctcaaaatttgttaaactatatcctgatctgggatttgatcccgaggcctcgctgttgatgaatgtttggcaatcattggctgttctagtagtaatgcaactttatagctatgaaagacggcagaatagtgacaagaactttggtgtatctgatgcttctgaatctgggcttctggggttcctaaggagattgttaatttggcatagtgagaagatattatcagttactgtgttctatgcttgcctatcatcaatcagtttatctggcctaatttatcttttaggtctcattatgttttccattttacctaaagtttctcgaattccttccaaggtttaccttgtttacactggtttacttgctacatcagaatacctatttcaaatgttatgtgaacctgctcaaatgtgtcctggtcagcagttccatggcttgtctgtctttcttggtttgaagcattatgatgctggattttggggtgtcgaatatggtcttcgaggaaaagttttggtaatcgtggcttgcaccattcagtataatgttttccattggttggatttgatgccaacatctcttttacatgagggcaaatgggaagaaccttgccagctctttatctctggtgatacatcttctaacgctagggacaataacaaggatagtcattcatcaaataggtttagttcattgttttcaaaagttcaaggtctgattggtagcagctcaagttcatctctgagttcagggagcacttgtcagacatcagaacctgtccagaatgagacaagcggctcagatgagggcaaaagatactcattttcaaagatttggggaatgtcaaaagaaagccacaagtgggataagagaaagattatttccttgagaagagaaagatttgaaactcagaagacaacctttaaatgctacatgaaattctggatggaaaatctctttaaattgcgaggtcttgaaattaacatgatcgtgttactattggccagctttacattgttgaatgttatatcaattttttacatcacatgcctcgttgtatgtattcttatgaacagagatcttatccagaaactgtggcctctttttgttgttctctttgcttcggtcctactactcgagtactttgctctttggaaggaaggaatgccctggttacacagtatcaatgacattgaagttcattgtcgcgaatgctggaaaaattcaaggattttctttgcatattgctcaaaatgttggctgggacgatcctcgaatgctcattagctactatattgtcttcattttttcctcttttaagttacggtccgatcgtttctctggtttctcagactcagatacttatcatcagatgatgtcacaaaggaaaaatgcattagtttggagggacctctcattggaaacaaaaagtttctggacttttcttgattatatacggctttatgcttattgccatttattggacatagttttagcattaattgctattactggtacgctggagtatgatgtgctgcaccttggttatcttggatttgctttggttttcttcagaatgaggcttgaaatattgaagagaaaaaataaaatattcaagtatctgcggatgtataattttgcgcttattgttttatcacttgcttatcaatctccttattttgggcaatttagctctggcaagtgtgaccaaattgactatatttatgaaattattggattttacaagtatgattatggttttaagataacatcacgatcagcttttgttgagatagtgatcttcttattggtgtcaattcaatcatacatctttagttctggtgaatttgattatgtatcaagataccttgaggctgaacaaattggtgcgatggtccatgagcaggagaaaaaagctttgaagaaaactgaacagctccaacatcttcgaaggtccgaggagcaaaaacgtgagcggaacatgcaagtggaaaggatgaaatctgagatgtacaatttacaaagtcagcttaatcgaatgaattccttcaccccaatcaacaatgcatctcacagtgaaggcttacgtcacagggagatcactgaggtcgaagaaaatgagggcaaagtgaatcataatttactaaaactgcagtatggaagaggggcagttaaggaaaacccactaaaatctgctgtgcaattaattggtgatggtgtctcccaagttcagtcctttggaaaccaggcagttacaaatattgtgagcttcttgaacattgatccagaagaaccacattccagtgatcatcctgcagaagatgacatttatgatatggtagaaagtcagagggaaacacatgatggccagttgttaagaacacattcagttacctctggaaatggcacaaaatcgtctgcaaacatgccgataggtgtaatctttcggtatatatggtatcagatgcgaagtaattatgattatgtttgctattgctgtttcgttctggttttcttgtggaattttagcttgctatccatggtttaccttggagcacttttcttgtatgctctttgtgtgaactatgggccaagttacctgttttgggtcattgttctgatctacactgagctgaacattctctcacaatatatataccagattgtcattcagcactgtggtttgaacatacatatacctcttctccagagattaggttttccggatgataaaataaaggcatcatttgttgtcagcatattgcctctctttctggtgtatatatctaccctcttgcagagttccataacggctaaagatggtgaatgggttcctgtaacagagttcagctttctaagtgcaagaaataatgtagaagagaaacaacgtatgccttacaattggagagataggctaaaaaatattcacttgcctgtaatgaatcttataaggatgattgggagaggcatatctagatattggttgtcactaacacaaggggcagaatctcctccatattttgtgcaagttacaatggaagtaaaccattggccagaagatggaattcaaccagaaagaatagagtcagcaataaacagggtccttgctatagctcatgaagaaagatgtcaagccaactcgccttcatcttgccattcttgtagtcgggttcggattcaaagtattgagcgaagcaaagaaaactctagtatggctcttgctgtcctagaagttgtctatgctgctcccttggactgccaatcagcaggatggtacaaatcactcactccagctgctgatgtagagaaggagattcatgaatcacaaaaggcaggactttttgaagatgtaaattttccttacccagtagtctctgtgattggcggtggtaaaagggaaattgatctttatgcatattattttggtgctgatttggcagtattctttcttgttgccatgttctatcaatctgttcttaaaaacaaaagtgaatttctggaagtttaccagctggaggatcagtttcccaaagagtttgttttcatcctaatgtttttcttgattgtggttgatcgcatcatatatctgtggtcatttgccacaggaaaagtcattttctatcttttcaacctagtgcttttcacatactctgtcactgaatatgcttggggaatggagctagtgcacagaaatgttggaggatttgttctacgtgcaatctatcttacaaagtcgatttccttggcacttcaagctttacagattagatatggtattcccaacaagagtaacttgtatcgacagtttttgacaagcaaagttacacaagtaaattattttggtttccggctttaccgtgctctgcccttcttgtatgagctgcggtgtgtgcttgattggtcatgtacaactacatcattaacaatgtatgattggcttaaggtacatctatacttgatcttccccaaactatcatggttgtttcaaaatattttgccatattaccatataggtctgcacgttgaaatttaa

SEQ ID NO: 1170 - DNA, 4066 bp, Oryza sativa
atggggtcgctcaccagggcggaggaggaggagacggcggcggccgaggagtggtcgggcgaggcggtcgtctacgtcaacggcgtccgccgcgtgctccccgacggcctcgctcacctcaccctgctccaatacctcagagggtcttcctggaacaaagcttggatgtggtgaaggtggctgtggagcctgcactgtgatggtctcatgctatgatcattttgcaatcaacgcatgcttggctccgctttattctgtggaaggaatgcacataatcacagtagagggaattgggaatcgtcagcgaggtttgcacccaatccagcaggaacgtttagccatggcccacggttcacaatgtggattttgcacccctggttttgtgatgtcgatgtatgcattgctgagatcaagtgaacagcctcctactgaagagcagattgaagatagccttgcaggaaatttatgtcgctgtactggctacagaccaataatagacgccttccgtgttttctcgaaaagagatgatcttttgtacaacaattcatctctgaaaaatgcagatggccgacctatctgcccttcaacaggaaaaccatgttcctgcggagatcagaaagacatcaatggtagtgaatcttcattattgacacctacgaaaagctactcaccttgttcatacaatgagattgatggaaatgcgtacagtgagaaagaactcattttccccccagaacttcagttgagaaaagttacgtcacttaaattgaatgggtttaatgggattcggtggtatagacctcttaaactaaagcaagtattgcatttgaaagcatgctacccaaatgcaaaactaatcattggtaactctgaagtaggagttgaaacaaagttcaagaatgcccagtataaggtcttgatctcagttactcatgttccagagcttcatacccttaaagtgaaagaggatggtatacatattggttcttctgtaagacttgcacagctccaaaatttcctcagaaaggttattttagagcgtgattcacatgaaatttcatcctgtgaggcaatactgcggcaattaaaatggtttgctgggacacaaatcaggaatgttgcttctgttggaggtaacatttgtactgctagtccaatatcagatctaaatccactttggatggctacaggtgcaacgtttgagataattgatgtgaacaataatattaggaccattcctgcaaaagatttttttctgggttatcgtaaagttgacttaaaacctgatgagatattgctctctgttatactgccatggacaaggccatttgaatttgtcaaagaattcaagcaggcacatagaagggaggatgacattgcgttggtgaatgctggaatgcgtgtctatataagaaaagttgaaggtgattggataatttcggatgtttcaattatctatggaggggtagctgcagtttcacaccgtgcttcaaaaactgaaacctttctcactggaaaaaaatgggactatggattgttggataagacttttgatctgttgaaagaagacgtagttctggctgaaaatgcacctggtggaatggttgaatttcgcagttcacttactttgagtttctttttcaaatttttccttcatgttactcatgaaatgaatataaaaggattttggaaggatggattacatgcaaccaatctttcagccatacagtctttcactagacctgtcggtgttggaactcaatgttatgaattggttagacaaggaactgcagttggccaacctgtggttcacacatcagctatgcttcaggttactggtgaagcggaatatactgatgacacaccgacaccccccaataccttgcatgctgctctggtgctgagtacgaaagctcacgcacgcatattatctattgatgcttcacttgccaaatcttcccctgggtttgcgggtctcttcctttcaaaagacgtgcctggcgctaaccatactgggcctgttatccatgacgaggaggtttttgcatctgatgttgttacatgtgttggccagggacttgttgtggcagatacccgtgataatgcaaaagctgctgcaaataaagtcaatattgagtattctgaacttccagcaattttatccatagaggaagctgtgaaagctggtagctttcatccaaatagcaagagatgcctagtaaaaggtaatgttgaacaatgttttctgtcgggtgcatgcgatagaattatagaaggaaaagtacaagttggaggtcaagagcacttctacatggagcctcagagcactcttgtatggccagttgattctggaaatgaaattcatatgatttcatctacccaggctccccagaagcaccaaaagtatgttgctaatgttcttggtcttccacaatcaagagttgtttgcaagactaagcgtattggtggtggatttggtggaaaagaaaccagatcagcaatatttgctgcagcagcatctgtagctgcttattgtttaaggcagcctgtaaagcttgttttggacagggatattgacatgatgacaactggacagaggcacagtttcctagggaagtacaaggtgggatttaccgatgatgggaagatattggccttagaccttgatgtttataacaatggtggtcattcacatgatttgtcccttccagtcctggagcgtgctatgtttcattcagacaatgtctatgatataccaaatgtcagagtcaatgggcaagtatgtttcacaaatttcccaagcaatactgctttcagaggttttggtggtccacaagctatgctgattgcagagaattggattcagcacatggctacagaactcaagcgaagtcctgaggagataaaagaacttaattttcaaagtgagggatctgtgcttcattatggccagttgcttcaaaattgtacaatacattcagtatgggatgaactaaaggtttcttgtaattttatggaagctcgcaaagctgtaattgattttaacaataataaccgttggagaaagcgtggcattgctatggttcccaccaagtttgggatatccttcactacaaaattcatgaatcagttagtgcaagtttacactgatggaactgtccttgtaacgcatggtggggttgaaatggggcagggtttacacacaaaggtagcccaagttgcggcttcatcattcaatatccctcttagctctatatttatctcagaaacaagcactgataaggtaccaaatgcaacaccaacagcagcctctgctagttcagatttatatggtgctgcagttttggatgcttgtcagcaaattatggctcggatggaacctgttgcttcaagaggaaaccacaagtcctttgctgagttggttctagcatgctacctggaaaggatagatctctctgctcatggattttatatcactcctgatgttgggtttgactgggtgtctggcaagggaactccattctactatttcacatacggagcagcatttgcagaagttgaaattgataccctaactggggatttccacacaaggacagtagatattgttatggatcttggctgttcaattaatccggctattgatattggccagcagattgaaggaggttttatccaaggattaggttgggcggccctggaagaactaaaatggggggatgataaccacaagtggattcgacctggacatcttttcacttgtgggcctggctcttacaaaataccctctgtaaatgatatacctctaaacttcaaggtctcacttttgaagaatccaaaggtcattcactcatccaaggctgtaggagagccaccgtttttcctcggttcagccgtcttgtttgccataaaggatgcgatatctgccgcaagagctgaggagggtcacttcgactggttcccactcgacagcccagcaacaccggaaagaataagaatggcatgcgtggattccatcacaaagaaatttgctagcgtatattaccgtcccaagcttagtgtatag

SEQ ID NO: 1171 - DNA, 3780 bp, Oryza sativa
atgtgggatgagaaggaaaggccccgggtcttctgtctagcaccacaagatggagaagctgtctggtggttagcgatggaagatcctgaaattactggtcagcagtcaccaaatgccacaagtattgtgacggatctcatggatttggatgacattattgttgagggcaatgaggtacagtttgctatggatgtggatttgagagcaataccatctctgaaagatggagggcacacagacccactggtacaaatcccaggtgacatgtctcatatggatgtggatttgagagtgataccatctctgaaagatggagggcatgcagacccaccagtacaagtcccagttgacaagaggattgcaagcctagagaagctctgtaaagaagcatcaagatcatttttcagggaaactaggctagttagccatcagataaactcctacaatgattttgtctctcatgggctccaaaagatgtttgattctctcgatgaagttactgtcgagcctgactatgatccttcaaagaaagtaggcccctggaggcacgcgaccatcaagtttggtcgagtggagcttgaggagccggtgttttgggtcgacaactgtgatcttgatgtggaaacactcaaactgaagcctaaacatgctcgcctccagaagatgacatactcttcaaagatgaaagtagaaatgactgttcagttctattcactccacaaaagcgacaaagctaaaactggcgaggacccatatatacaaagaaaagatataatgaaagagactaaatgggtcactattggcaagttacctgtcatggaaagcgaatgcgagtatgattttggtggatattttcttatcaagggaatggaaaaggtattcgttgctgaagagcagagatgcctctccaggatttggatcaatgacagccccacctgggaggcttgttaccaacggtctcaaatccgacgagaaaagatctctataaaacctgttcagtctaatgatggtttcagaaaagtcattaacctgtactttttgggtgcaactataccaatctggataatgttttttgcactaggtgtatcatcagacaaagaagcttttgatattattgacatacaagaatgtgatgcttccatggccaacataatatcagctactataactgaatctcatgagcagtgcgaaggctttcagagagaagggagagccagtgaatatattgataagttgatcaggaatacaaagtttccaccaaaaggatcctttgatgagtatattggtaggcatatgtttcctgatgttagtgggaataggagcaaagcactcttcttgggatacatggtgagatgtcttctattggcttcctctggcaatcggaagagtgataatagggatgatttccgcaacaagaggctggatttggcatgtgaattgctccagagagagctatgggtacatattatgcatgcccagaaacgtatggtcaaggtcatgcagagacatttgagtggtgatggtgacctacaacctcttgagtgttatgtccatgcatcaattgttaccaatggtctcaaccgtgccttctccactggttcctggtgccatccatttaataaaagagagaggtgttcagggattgttgcaacccttaggagaacaaatcctcttcaaatgatgtctgacatgaggaagacacgacaatgggttgcatatgctggaaaggctggagatgctagatatccggtaaggaatccatcatattggggaaagctatgtttcttgtccactcctgatggtgaaaagtgtggatttgtgaaaaatcttgccattactgctatcgttagttgtttggcaagggagccctcggttgacgcacttgtttcttgtgggatgaagaaactggatgaactgcttctacaagagatcagcgggaaagacagaatcttcttgaatggaaacttggttggagtttgtgcagactcagtcgagtttgttttgcacttaaggagcatgagacgcaggaagcaaattgatgcacaggtggagatcaaaagggacaagcaaaacaaagaagttcgtatattttccgatccaggaaggattctaagacctcttcttattgtcgaaaatctacgaaacatcatgaatcgaaagaatggatcatactccttccaggaacttatggatcaaaatataattgagctgattggtgttgaagaagaggaggatatccggtgtgcttatggaattaggcatctctttgcaggggacgaagaaaagaatttctcattctatactcattgtgaacttgacccttctttcttgctaggattgagttgcagtatcattccctttgccaaccatgatactgctaagagaattctaatgcaagctgaaaagatatcgcaacaggctattggctactccactacgaatcctctctttagagttgatacacattcccatcagctctattatccacagagacctctgttcaaaactgtagctgctgattgtcttggtaagagagactatacatctggaagcaaacatgactttgccagaccagagtatttcaatggccaaaatgcaatagtctcaatcagtgtccatcagggatttaaccaagaggattctttggtattgaatagggcctctttagagcgtggcatgtttcgaacacaacattttaagagctataaagcactgatagaaaacaaagagatcaccaaacgattaaaacacaaggaaaatatcaattttggaaaaactcctagcaagaaaggcctggttgacagtttagatattgatggcttaccatatattggagcaagtcttcagagtaatgacattatcattggaaaggtctcagactctggtgaagatcatagcatcaagctgctacatactgaaaaaggaatagtggagaaggttgttctttcagctactgatgatgggacaaattctgcgtttgttactctaagacagactcgctcgccacgcattggagacaagtttgccagcatgcatggccagaaaggagtcattggcttcttggattcccaggagaacttcccttttactcaccaaggcatagttcctgacattgtgatcaatccccatggctttccaactcgtcagactcccggccaacttcttgaagctgcactaggcaaaggaatcgccctcggcggtgccacccggtatgcgacaccgttcacaagtccatctgtggaagtgatcacagagcagctgcacaaggctgggttctccaggtggggaggggagagcgtgatcaacggccgcaccggcgagcgtgcggcgtcgccggtgttcaccggaccgacgttctaccagcggctccaccacatggccgaggacaaggtcaagttccggaacaccggcccggtgcacccgctgacgcggcagccggtggaggaccgccgccggtacggcggcgtcaagttcggcgagatggagcgcgactgcctcctcgcccacggcgccgccgccaacctccacgagcgcctcttcctcctcagcgacgtgtcgcgcctccacgtctgccgccgatgccagcgcgccgccgtcgtcgtgtcgcccgccgtcgccgccgacggcggcggcggccgaaaggtgagggggccgtactgcaggttctgcaggtcggcggaggaggtggtgagggtgagcgtgccttatggcgccaagatcctctaccaggagctcttctccatgggcatctgcctcaagttcgacaccgagctcatctag

SEQ ID NO: 1172 - DNA, 3669 bp, Oryza sativa
  misc_feature (14)..(14): n = any nucleotide
  misc_feature (22)..(22): n = any nucleotide
  misc_feature (27)..(27): n = any nucleotide
  misc_feature (87)..(87): n = any nucleotide
  misc_feature (93)..(93): n = any nucleotide
  misc_feature (99)..(99): n = any nucleotide
  misc_feature (102)..(102): n = any nucleotide
  misc_feature (235)..(235): n = any nucleotide
  misc_feature (256)..(256): n = any nucleotide
  misc_feature (296)..(296): n = any nucleotide
atggcggggagcangggggttnggatnggagttggggatccgagtagcccgagcgcgagggctggggcggcggcggaggaggaggcnggggcngggaangtnaagctgctgtgcagcttcggggggcggatcgcgccgaggcaaggggacggggcgctgcgctacgtcggcgggcagatgcggctcatctccgtgccgcgcgtcgcctcgttcggggagctcatgaggaaggtgnaggcggtggacgacgcggggngagccggcggcggcggcggcggcggggtgctcgtcaagtnccagctccccggtgaggacctcgactcgctcatctccgtgtcctgcacggaggactacgagaacatgatggaggagtacgagaagctggccgccgccgcgcccgacggctccgccaagctccgggtgttcctcttcccggcctccgggagcgaggcggccgccgcgggggcgtccggctccgggtcgcacctcgctgccgccgtcgacgagtcggggcagcgctacatcgacgccatcaactgcgtctccgcggagtccgtcgcggccatgcggcggaaggagagcgtcgccagcgctgggtcatcggcgcacaactccgaggcctccgagcacggcggtgccgtcgaaggtatgtcgccgcaggctgccgtgccgccgccttcgcttccgccggaatatctgtattcaggtgggaacaaataccatggcgccttcccggactccttgggattcagtgccgtgacagcttcatctccggcgatgggtatccaggcacaaaatcatatcatggttagaacagagccattgccgccgcagccgcatcaagttgcctcttacgcgccatcgcatcagccgccacaagttgcttcttatgcgccgcatcaacaaccacaagttgcctcttatgcaccacagcagcagcagcagcagcagcagcctcaagttgcttcatacattccacagatggcgcagtcgttcagggagccacagcaagtccaatacatcaatgcgcagcaattgggtgtgcatggtgtgccccaatctgtcaattttgttcctgtgcaaatgagcccatatatgcccagcattccggtgacgaactccatgccaacctctgccgctcaagtcggcaccatgaagccagcttctccagcttcagaacctgttttagagaacgttcataacacaaggccaatgcaagctacaggtgatcagagttacagggtgctacagccactgtcacagcttcctcctttgcctcctgtgcatttgcagactagtgatgcacacagatatggcgtccagacagtaatgacaagttcagcgagcacgccgttggtgacaacctcaggtacaattccaatggtgattagctcggctaccatgcctgcattgaggtatgatgattgcacaatgtgccagaaagcactgcctcatgctcattcggacaacatgatccaagagcagggcactccacatggagtgaacaatcctgatgctgctccagtgttttacagcctccatcaagagaatgttaccaaacaacatattccaggtgcaaccgcaggaactcctgctaattacatagtagagccaagatctgaggtcacggcagggatgatgcaaactgaacaaaactttgctgcaaacaatcatgtactccagccaacatcatttccagatgctagtggattggttccaaacaccagggttacttccagactagcatttgcggggaatccaccacagccccgttctgaagatcctgtcatgtaccagcatcaacagcagaattcttatagcatgcaaccatcactgataccagtaaatggagttattagcaatccacaagggatagatgctagtgcatttaagaattcaaataatcaggtaccagacccatttagagaatatggccatgatcttccccatgattatgtcagagctatcaatgcacagatgcaaggagttcatttgggacctattgcccctccagaatctagtgtgcaaggaaagcctgccagtccacatggtgctattggtgatggaaaacttgagaagccatcgcatgtgaatattggtggtggttccatctacaagtctcaagctggaggttatcatttgggtattactaatgccttttctgcaccagctgaggacaatcttgtgagacatactgaacagtcatcttcagcttttgattcacaacatcttcattctgagataggccaccagctaaatgtgttacagaatgtgcctgtctcaaacaaccttggtgtacctgccaaaccacatatttctaacgaaagatttcttgcaagacctgctagtgctggtgttcaggttcctgttgagcattctccactgcgacctgcggaaatgctgaatcatgtggtttccgctccccctaatggcaacagtcaaattccactgcaggcgaccgctggtattgatagtgtggaagccacacgtgatccagcttacacagattctctattctcaaatcaggatccttggaatgcagtgggaaatgcttctgtagcgcctccaagactgaataagttggctaaggagcctgctgtttctggagatccatatgtggaaggccatgggcttgccatcaacagttcaaatgctgctacactcttagaagaaggcaatcttccactcatccaggaccgcacttttaaggacatctatcctgaaccctctcaaatgagcaaaggatacggagaagaaactattaagcgacagttacaagctgttgctgagggtgtggcagcatctgtccttcagtcacctttccctgaaaaaccaaccgtattctctggtgatcacacagataaacaaggagctgtaattgatccaaaattggaggatgcggtgaacaatcaatcagacaaaacaagccaaggagttaaagttttagatgatattgataatcttcagagaactgatttctggaatgaagctgacaagcttgcatcattgcaccatccgaatgttgtagctttctatggtgttgtactggatggaccaggtggatctgttgcaacagtaactgaatacatggctaatggttctcttcgacaagcattgcaaagacatgaaaagatatttgatcggcgtaggcgtctcctgattgcaatggatgttgcgtttggtatggagtatttgcatgagaagaacattgtacactttgacctaaagagtgataatctgcttgtcaatctaagagatcctcagcaccctatatgcaaggttggtgatttgggcttgtcgaaagttaaatgccagacgctaatatctggtggggtgcgaggaacacttccttggatggccccggagctgttgaatggaagcagcagccttgtttctgaaaaggtcgatgttttctccttcggaattgtaatgtgggagctgctcactggtgaagagccttatgccgaattgcattatggcgccatcataggcgggattgtaaacaacaccctgggccctccggtgcccgagtcatgcgaccctcggtggaggtcactgatggagcaatgctggtcgtcggaaccgtcagaaagaccgagcttcacggaggttggcaagaggctacgggccatggcaaccccctttaccaaggcgcaacctcagaaataa

SEQ ID NO: 1173 - DNA, 3390 bp, Oryza sativa
atggcatggacccagccgtcgttcgacccatccatggcggcgcaccaagcgtccccgttcggagacgggccgccgaacactgtggcccaacctcacgcgcaagccatgacttcgcccttcgccacgccatagccgcagcaaggtgccgcgaacaaggcgggtggtgaaaagaggctaccattgagcgggagaatcaagatccgtccaatcccatcccagttcaagttcccacccgtcccacgctattcgggcgaaacagacccaaaagagttcctgtccatatacgagtccacgattgaagcctctcatggtgatgaaaataccaagacgaaggtaatacatctcgctctagacggcatcgcccgttcttggtacttcaatttaccagctaacagcatttactcatgggagcaattgcgcgatgtcttcgtccttaactttcgaggcacctacgaggagccgaagacgcagcaacatctactcggcattcactagaggccgggggagtcgataagggagtacatgcatcgcttctcgcaagcccgatgtcaagttcaggatataactaaggcgtccgtcatcaacgccgcttcggccgggctgctcgagggcgaactcacaagaaaaatcgccaacaaggagccgcagacgcttgagcacctacttcgcatcattaacgggtactcaaggggcgaagacgattccaagtgacagcaagcaatccaggccgagtatgataaagcctctgtcgccgctgcttaagcccaagtacaagcacaggtcgccgaaccggctcctttcgccattcgccagtctcagtcggcgacccaaggacaaccgccaaggccaagtcaagctcccatgacttggaggaaattcagaaccgaccgggcaggcaaggccatgatggctgtcgaacaagtttaagacctccgcaaggagttcgatgcccaacaggcaagcagccatcaacagcccgttcgcaagaaggtcagaaaagatctttactgcgccttccatggacgctctgtgcacaccaccgagcaatgccgaaacattcggcatcgtggcaacgcgcaagatccaaggccgcagcatggagcagctgccgaagcatctcgcgaagctattcaagaacaagcacccccggccgaacagcaccaaggtgtgcagtgcagagtaatccaagtgattacaaggactgacccgccgaatcaactgtcaaaagggcaaaagaagatgcagctgccaatggtgcacaacatcactttggcaagtgaaggggccccgcgatatttgaaccagcagatctcttttgggccagaagatgccgaaggagtgttgttcccacatcaagaccccctggtgatctcggccgaggtcatctttgccgaagcatatgccgagatggggttgcctaccctagccctcacccaagcaccggcctcgcttcatggttttggcggagaggcagttcaagtcctaggccaagcacaattggtggtagccttcggcacaggtgaaaacaggcgcgaagagcaaatactgttcgacgtcgtcgacatcccatacaactataatgccatctaaggccgcgcaaccttgaacaagttcgaagccatctcccaccataattacctcaagctcaagatgcctggccttgcaggagtgatcgtggcagctggggtgatccaggagatcgaccaccccgagtggctggcgaatccggtactggtgcggaaatcgaacagcaaatggcgcatgtgtgtcgacttcacagacctcaacaaggcatgcccaaaagacgatttccccttgccgcggatcgactagctcgtggattcgacagctggctgcgaactcatgagttttttggatgcgtactaaggctaccaccagatccacatgagtccggccgacatccccaagacagcattcgtcacaccattcggcaggggcaaccttcaccaagctagtgtacaaggtcctttacaagcagctggggtgaaatgtgcaggcttatgtcgacgatatcgtcataaaaagccgcaaggatttcgaccatgcgtctgacctgcaggaaaccttcgacaacttacgcgcggcgggtatgaaattatatcgtgagaagtgtgtttttggtgttcgcgcgggccagttgttgggttttcttgtttctgaatagggtatcgaggcgaaccacgagaaaatcgattccattcagcaaatgaagcccccgtcgagcgtacgcgaagtacaaaagctcgcaggccgaattgcggcactcagtcgattcctctcaaaagcagacgaaagaggcttgcccttcttcaagacccttcggggcgcggagcggctttgccggtggcggtcagtgcagccctcgtccaagaaacagagtcaggccagaaaccagtattgaaatggaaaagcttgcttacgccctagtgatggcttcgcgcaagcttaaacactactttcaggcccacaaagtcacggtgccatcgcagtatcctttgggcgaagtgctccggggccaggcagaatatgaagctatattgttgggcctaaaaaagacgaaagctttgggggttcggcgcttgctcatccgaactgactccaaattggtggcaagtcatgttgacaaatcctttgaggcaaaagaagaagggataaagagctgggtgaagacccagaagactggcgaacctcgttcgtaaaatcactgacaacgacaagcaattcgattctgacaagttcagagagatgtgcgaggggctaaacctggaaatcaggttcgcttcggtcgcgcacccacagttaaatggggtggccgaacgcacaaatggtaaaatccttgaggcgcttaagaaaaggcttgagggggcagcgaaggaggccaaccaagttcagcccattcatgcttctctatggcgaccaagcaatgacctcaacagagttaggggctaattcaccaagggtgatgttctctagaggcgaagaggcgaagaggggcgcgaggtgtcgctcgaactcctagagggggtgagagtcgaagcactagaacacatgcgcaaatacgccacaaacacttcggcaaattacgacaaaaaagttcgaccgacagagctattgcctggccatctcgtcctaaggaaggagaacccggtggtggtcgggaagcttgaatcgaagcgggaagggccgtacctcatcaagcacatgtccaggacatgctcctttcgcctagcgatgctggaaggcgaagagttcgaccattcctggaacgcggcttcccttaagcgtttctatgtgtagcgcgggtggcacccaaatcgctaacttgtaaaaatgtacatactgttatgtaagcctttcggcactatgtaa

SEQ ID NO: 1174 - DNA, 3329 bp, Oryza sativa
atgagcgtgtggaactacgtcgtgacggcgcacaagcccaccagcgtcacccactcctgcgtcggcaacttcaccggccccaaccagctcaacctcatcgtcgcggaaatgcacccgtatcgagatccacttgcttactcctcaaggcctccagcagcctatgattgatgtacctatctatggaagaatcgccacactagagctcttccgccctcataatgagactcaggacttccttttcattgcgactgaaagatacaaattctgtgttctgcagtgggatggagaaaaatcggagcttctcactaggtttgtagagcgatgggagatgtttctgatcgcattggtcgccctacggacaatggacagagattgggatcatcgaccctgactgtagacttattggtcttcacctctacgatggattatttaagaggttataccgtttgataacaaagggcagctgaaggaagctttcaatatcagtcaggcttgaagaacttcaagtattggacatcaagttcctgtatggctgtgttaaacctactatagttgtcctctaccagctttaccaggataacaaagatgcaagacatgttaagacatatgaagttgcattgaaggacaaagactttgttgagggtccttggtcgcagaacaatttagacaatggtgctggtctgttaatacctgtaccagctcctcttggtggtgtcataattattggtgaggagacaatagtttactgcaatgccaactctacatttagagctataccaatcaaacagacagtcaatcataagagcttacggacgggttgacccagacggttcgcgctatttacttggtgataatgcaggcatattgcatttacttgtccttacccatgaacgagagagagggtaaccggtctgaaaatcgagtacttgggagagacttcaattgcatcatcaatatcatatctcgataatggtgttgtctacgttggttctcgatttggtgattcacagacagcttgtaaaactaaatctccaagctgacccaaatggttcatatgttgaagttcttgagcgatatgtgaaccttggacccatcgtggacttctgtgtggttgaccttgacaggcagggtcagggtcaggttgtcacttgttcaggagcatttaaagatggttcccttcgggtggttcggaatgggataggtatcaatgagcagaggcttcagtagaactacaagggatcaagggtttatggtcgttgaaatcttccttcaatgatccgtatgacatgtacctagttgtgagctttataagcgagacaagattcttggctatgaacatggaagatgagttagaagaaactgagatagaaggctttgatgcgcagactcagactttgttttgtcaaaatgccatcaatgatctgcttatacagacaggttactgctaattctgttcgtctggttagttgtacctctcgggagctagtggatcaatggaatgcaccagaaggattttcagtcaatgttgcatcagctaatgccagtcagcaggttctgctggcaacaggtggtggccatcttgtttacctcgaaattaaggattctaagctggttgaagtgaaacatatacagttagaacatgagatctcctgtgttgatttgaatccaattggggagaatccacagtatagctctctggctgctgttgggatgtggactgatataagtgttagaatactttcacttccagaccttgaattaatcaggaaggagaacttaggtggagaaattgttcctcggtctgttctgctttgtaccttggaagggggtttcatatttgctctgtgctcttggagatggtcatctgttcagttttctgttgaatgcaagtacgggtgaattaactgatagaaagaaggtttctcttggtacccaaccgataagccttcgtacattctcatcaaagggtacaacccacgtgtttgcttcatcggatagaccgactgttatttatagcagcaacaagaagttgctgtatagcaatgtcaatttgaaggaagtcaaccatatgtgtccttttaatacagctgctattcctgacagcagccttgcaattgctaaagaaggtgaactctcaattggaaccatcgatgacatccagaagcttcatatccgtacaatccccttgaatgaacaagcacgtcgcatttgccatcaggaacagtccaggacactagcgttctgcagcttcaagcacaaccagactagtatagaggaaagcgagacacattttgttcgtcttttggatcatcaaacttttgagttcctgtcaatttatcagcttgatcaatatgagcatggctgctccatcattagctgctcattctcagatgataataatgtttattattgtgtgggaacagcatatgttttaccagaggaaaatgaaccatcaaagagggccggatccttgtatttgcagttgaagatggcagactgcaattaattgtagagaaagaaactaaaggagctgtctattcgctgaatgcattcaacggaaaattgttggcagctatcaaccagaagattcaactatataagtggatgctacgggaggacggttcacatgagctgcagtctgagtgtgggcatcatgggcacatattggctttgtacactcagactcgtggcgatttcattgtagttggagacttgatgaaatcaatatccttgctcgtgtacaagagcacgaggaaagtgcgattgaagagcttgctagggattacaatgcaaactggatgagtgcagttgagatgcttgatgacgagatctatattggagcagagaataactacaacattttcactgtgcggaagaacagtgatgcagcgacagatgaagagaggggcaggctggaggttgttggagagtaccatcttggagagtttgtgaatagactccggcatggttcgctggtaatgcggcttccggactcagagatgggccagatcccgacggttatctttggcaccatcaacggggttattgggattattgcttcgcttccacatgagcagtatgtatttcttgagaagctccagtcgactctggtgaagttcataaagggcgtggggaacctgagccatgagcaatggcggtcgttccacaacgacaagaagacgtcggaggcccgcaatttcctggatggtgacctgatcgagtcattccttgatctaagcagaaacaagatggaggaggtggccaagggtatgggggtccccgttgaggagctatccaagagggtggaggagctgactagattgcactag

SEQ ID NO: 1175 - DNA, 3300 bp, Oryza sativa
atgtcccgtatcaggaggatcgccaggcactttcggccatcttgcgagcggtgccggctgagattgtccggccgctcgccgagaaggacagtgccaaagacgcctgggacgcgctcaaatccatgcgagtgggcgcagatcgtgttaaggagtcccgagcatagaagctgcgccaaacttttgagtccatgcgattcaagaatggcgaacacctggaggatttcagccttcgtctccagggtgttgtcagcgatcttcgtctccttggagatgatctgtctgaagagaaggttgttcgaaaaattgcttcgcgtcgttccccggaggtatcgccaaatggctctatcgattgaaaccttgattgatctgacctcgctttctattgaggatctgactggccggcttctcaccgtcgacgatcaccccgactctgacggcgaggacgcgggtcaggcgctcttcagcgaaaaggaggcctcttctcactcaaacaaggaagctgggcataactcagccggggggagcgcgtccagctcgcggcaaccacaccgcagtgggcgcaggcgcgacggcaacggctccgacggcaagtcgggttcgtcccaagcggcgagccgcaatgtgtccaaggacaaatgccgttactgtggcaaacttggtcactgggccaaggactgtcgcaaggcgaagcgagaccgcgagaagctggctcaagcaaatcttctcatcgctgagccagctcaccccgcggacgaaggggagccgacactcctgatggcgcaagtgtgcgagcttgcccctgctaccgattctgtcattactgatggggagcttgacaccaccgtgcgcggcactgtcaagtttggtgatgcgtcgagagtccggattaaaggacgaggcacggtgctgttcgcctgcaagaacggcgatcactgcgcactcacaggtgtctattacatccccaatcttcggagcaacatggtcagccttggccagcttgatgaggcacgttgcaagacggtgatcgaggatggcgttctcactctgcgtgattcacagcgacggctgctgtgtagggtgcgccgaggaactgggtgcctctatgttctccacgtcgagctggcgcaaccggtttcccttctcgcaaaggggaacgatcaagcctgggtctggcacgccagatacgggcacctcaacttcgacgcactccgctcactggcgagccgcggcatggcgcgcgacattcccactctggagcgggtcacccaggcaggagtggaggtggagaccggctgcaagctgcgcgttctccgcactgatcgaggaggcgaattcacctctgtcgagttcgggctatactgcgcgaacgaaggcgtcgctaggcagttgatggcgccgtactctccacagcaaaacggcgtcgtcgagcgccgcaaccagacggttgtggcaatggccagatgcatgatgaaggccaagaacatgccgggggagttctggggcgaggcggtcacaactgccgtctacatcctcaaccaggcgccgacaaagagcgtccgcgacaaaacaccattcgaggcgtggcacggtcgtacacctgctgtgcactactttcgcacatttggctgcatagtctacgtcaaggaggtgaaaccacacatcaacaaacttgatgatcggagcaaggcgatggtctttctcggctacgagccgggttccaaggcgtatcgtatctacgacccggtggccaagcgcatcgtcgtgagccacgatgccgtgtttgacaaggcagcgtcgtggccatgggcgtcacccggggaggaggatggggtggcgtcttctcaggaaaccttcaccgttcgctacgaggtagcggcggtggaagtgccgtcccgccactccgactccatgtcgtcgccggctcactcgggaccaccggcgccatcaatctctgcatcaccgggcgtcccagcggtcgagttcgtgtcgccgcctgcggaaacgcctgatgtcgacgacgacaacgtagggccacgtcgtttccggacggtggctaacatcctcgacactacctcgccaattgagctcgattccgacgagcttcatctggctgctgccgaggaaccaagtaaccacactgaggcggcacaggacacactctggcagcgagcgatgcaggaggaactaaagtccatcgtggagaacaacacgtggactctcgctgacctccctgctggcaagcgtcccattggcttgaagtgggtgttcaagctcaagaaggacgagacgggcgtaattgtcaagcacaaggcccgactggtcgctaagggttacgttcagcagcaggggattgatttcgacgaagtattcgcccctgtcgccagaatggaatccgtgcggttgctactcgccattgcagctcaccttgggtggtttgtgcatcacatggacgtgaagtcagccttcctgaacggagagctggaggaggaggtgtatgtcgcccagccaccaggtttcgtcgacgacaagcacccacatcaagtcctgcgcctgaacagagcactttatggcctgcgtcaagctcctcgtgcctggaacgcgaagctggatgttagtcttcatgaactcgggttcacgcggggcatcacagaacatgctgtgtacacgcgcgggaccgggaacgcgcggctaatcgtcggcgtctacgtcgacgatctcatcatcaccggcgctcactctgaaacaattcaaagtttcaagggggagatgcactccctattccggatgagtgatcttggattactcagctactacctcggcattgaggttcatcaaggcaacgatgggatcacaataaatcaatccacttacgcgcagaagctcttgaagatgggtggcctggcgggatgcaattcagcttgcgttccaatggaacccagattgaaactgacgaagaatagcgatcgaccaagtgttgattcaaccttttatcgcagcttagtggggagtctgcggtacttggtgcattcacggccggacattgctttcgctgtgggctacttcagccgtttcatggagtcgccgcgcgatgatcatctcacggcggtgaagcacattctgcgctatgttgcaggtactgtgaactacggttgcaagtttgcacattcaggagaagaggggatccatttgctgggattttccgacagtgatttggggggagatgtggacgatcggaagagtacctctggtgctctcttcttcctcggctcaagcccggttgcatggcagtcccagaagtag

SEQ ID NO: 1176 - DNA, 3243 bp, Oryza sativa
  misc_feature (3064)..(3064): n = any nucleotide
atggaaaatctaccaaatggctcagcaaattatagctgagaagaaccaggataatgagatgtctacagatgctggtgagcctgaagaagtagcagatatatttatttatagagaagatgttgtcagccttgaagtcaaaagaggacacccgtgggttggttttggaggtagcaggagaatatgattctgaaggtagcatcactgatgatgatactgatactgaggagcatgaacacaaaagttctcataggactgaaaatggtggtgctgatggtgataatgtcagtaatggagttgatgttgatagtcagagttcattgcctgataacaaggttagggttctatggattgatggtgtcgagaagacggaagatattgacagcgtggttgtcatggacagaagtttccttcatggagatatagtggcttctgccacagatccaactggtcagatgggacttgttgctgatgtcagccttgtggttgatttgcaaggacctcacggagaaataataaagggagtatcctctaaagatttgagacgcatcagggaatttaacgtaggtgattatgttgtctctgggccatggcttggtcgagtcgacgaggtgttggataatgttaatgtgttatttgatgacggctccgtctgtaaagtagccagggcagatcctatgcggctaaggccagcattggggccactgaatccaaatgcaagctgtcccttttatcctggacagcgtgtcaaggcagtgaattcatctgtttacaaaacatccaggtggctcaatggactatggaaagcaagtcgtcttgaaggcactgtcacaaaggtggaaacagttgcagttatagtctattggattgcatctgcacactttgccacgaatcaagaatctgttcctcctgaagagcagaacccaaaggatctgactcttttatcttgtttttcatatgcaaattggcaattaactgattggtgtcttcctaaccaatacacatcatcgtgtactgatgattctttgattgaaagttcagaaataaaagactctgatgacattcctgaatccagtgatgttaagacagaactaacgcagaagactgatatggatgaaaaccctgggaggatggatggagattcttctgctgatggatcaaatatggtttatgaagataacacatgcttagccaaacaatcagaatcaggcactattgcatcaaccgttccaaaggagggatcacaggacaatgcaacttacaggaaaaaacttaggaaagtttttgtcaaaaaaggataaaagaacaagaagaagagacgagagctttgaaagggctctgcttattgcaaatacatacacgaaggttgatgtgatctggcaagatgggacaaaagaatgtggagcaagctcaacattgctcatcccgatccacagtccaaatgaccatgaattctttccggagcagtatgtcgtggacaaggttggtaatgatgttgatgattcttctgaaacaaaacgtgtgggtcttgttagaagtgttaatgcaaaggaccgaactgcatctgtatcatggtttaagccttcattacacccagaggagcccagagaaatcgagtgcaatgaaattgtgagtgcatatgaattggatggccatccagattatgattattgctatggagatgttgttgttcgcttgccatctgtttcactgcctgttgaatcaaccaatagggagaacaccatggaactggataatgtaaattctacagaagtatcggcaacccctgtagctgatgcagaggaacagtttccacagaaggaatccagtttggaatttactagcctttcatgggctggtaatatagttggttttgaagacggtgatattatagtcatttggggcgatggttcagtgtcaaagaggttggtccacatgaaatatatgttgttggtcgtgaagatgatggtgcctcactagatgatggaactgccagtgatggtgctagctgggagactgttgatgacaatcaaacggatttgcctgatgattctgcacagcaggatggaagctctgttgcaactggtccactttctgttgcttttggctttgtgactcggctcgcgagtgaactctttgctcgaggtaaaaagcatttagatggatcaaactcagatgctatggatgaagttgaatctcaccagtctaatgagatttcagaatctggtgatgatattgataaagctgagggggagaacaatgtggcaacatctgagagtaccgttgtaacaacaaatgacgcttccggtgggaagtctgtagatgttgatatggctgacaagcctggagattcagatggcttcaaacactttgatgttcagcagtgccctccagaccatcattacctggaaaacatggcgcaggcagggcactggtggaagaaagtgggtaaaaaaggtacagcaggaatggaacatacttgagaaaaatctaccagagattatatttatgttagggtatttgaggatcgaatggacctcataagagccgtgattattggagcaagtggaacaccataccaagatggtcttttcttcttcgacttccaccttccacctgagtttccacaagttcctccgtttcatttgttaccaaatctgcagtcggcgtactatcattctggaggtttgcgcgtaaatccaaacctgtatgtggatgggaaggtctgcttaagtctcttgaatacctggacgggcagagggaatgaagtatgggatccatcatcatccagtattctccaagtcctggtttcacttcagggcttggttctaaatgaaaagccttattttaatgaagctggctatgagaagcaagttggtactgttgaaggggagaagaatgcattgccatataatgagaacacatatctgctgagcttgaaatccatgttgtatatcctgaggcgacctccaatggcatttcgaggactttgcaaagagccacttctccaagcgtggcaaatacattctcaaagcttgtgaggcctatttgcaaggtaatggggttnggacgctcacagatgatgcctgcaccaccgagagaagcaaagaacagccatgctcggtgggtttcaaactcgcattagcaaaaattatgccacggttgattactgccctgaaggacgctggagcaaattgtgaccaatatgagcaccttgggaaaacggaaactgctcaagaacactga

SEQ ID NO: 1177 - DNA, 3105 bp, Oryza sativa
  misc_feature (768)..(768): n = any nucleotide
atgggtggcgacgatcgcagcgccgggaaggcgaagccagtgctcggatcgttcatgacggtgttcatgcacgcggacgcggtggacgtggtgttgatggtgcttgggctcctgggcgccgtgggcgacggactctcgatgccggtgttgctgctcatcaccggcagcgtgtacaataacttcggcggcggcgccgacaacgtccaggagttcagctccaaggttaacatgaacgcgaggaacctcctcttcttggccgccgaggggtattgctggacacggacggcggagcggcaggcgtcgcggatgcgggcacggtaccttcaggcggtgctccggcaagacgtggagtacttcgacctgaagaaggggtcgacggcggaggtgatcaccagcgtggccaacgacagcctcgtggtgcaggacgtgctgagcgagaaggtgcccaacttcgtcatgaacgccgccatgttcgtcggtaactacgcatttgggttcgcgctgatgaggcagctcatgctagtggcgctgccgtcggtggtgcttctcatcatcccgacattcatgtacggccgcgtcgtcgtcgacctcgctcgccggatcagggagcagtacacccgccccggcgccatcgccgagcaggccatgtcgtcggtgcgcacggtgtactcgtttgtggcggagcggacgaccatggctcagttctcagcggcactcgaggagtcggtgcgactggggctcaagcaagggcttgccaagggcgtcgcnatcggtagcaacggcatcaccttcgccatcttggccttcaacgtctggtacggaagccgcctcgtcatgtcccatggctacaagggtggcaccgtcttcgtcgtctcctacgccgttatccagggcggcctagcgcttgggtcagtgttgtcgaacgtgaagtacctctcggaggcgagctcggcggcggagaggatcctggaggtgatccggcgggtgcccaagatcgactccgagagcgacaccggcgaggagctgggcaacgtcgccggcgaggtggagttccggaacgtgaagttctgctacccgtcacggccggagagccccatcttcgtcagcttcaacctccgcgtgccggcggggcgcaccgtggcgctggtcggcggtagcgggtccggcaagtcgacggtgatcgcgctgctggagcggttctacgacccgtcggccggcgaggtgatggtcgacggcgtggacatccggaggctccggctaaagtggctgcgagcgcagatggggctggtgagccaggagccggcgctgttcgccaccagcatccgggagaacatcctgttcgggaaggaggacgccacagcggaggaggtgatcgccgccgccaaggcggccaacgcacacagcttcatctcccagctgcctcagggctacgacacacaggtgggcgagcgtggtgtccaaatgtctggggggcagaagcagagaattgctattgcgagagcaatcctgaagtcacccaagatcctcctccttgatgaagccactagtgcattggacactgagtcagagagcgttgtacaggaggcccttgacctagcatctatggggcggactactattgtgattgcacatcgcctatccactatccgcaatgctgacataattgctgtcatgcagtctggtgaggttaaggagctgggatcgcatgatgagctcattgccaatgagaatggcctctattcatctcttgtgcgccttcaacagacccgagattcaaatgagattgatgagattggtgtaattggtagtacatccgctctagggcagtccagcagccacagcatgagcaggaggttctctgcagctagcaggtcaagctcagtaaggtcattgggcgatgcaagagatgctgacaacactgagaagccaaagcttccagtgccatccttcagaaggctacttatgcttaatgcaccagagtggaagcaagcactaatagggagttttggtgcagttgtgtttggaggcatccagccagcatttgcatatgccatgggaagcatgatctcagtctacttcttgacagatcatgcggagatcaaggacaaaacaaggacctacgcactcattttcgtaggtctagcagtgctctcatttttgataaatattggtcagcattacaactttggtgcaatgggggaatacctcaccaagagaataagggaacagatgcttgcaaagatcctcactttcgaaattgggtggtttgaccgtgacgagaactccagtggtgccatatgctcacagctagctaaggacgccaacgttgtgaggtctctcgtgggtgatcgaatggctctggtgatccagactatttcagcagtgcttattgcatgcaccatgggtctggtcattgcctggcgtttggcccttgttatgatagcagtgcagcctctgatcattgtttgcttttatgctcgccgtgtcttactcaagagcatgtccaagaaatcaatacatgcacaagctgaaagtagcaagctagctgctgaggcagtctccaatcttcgtacaattacagccttctcatcccaagagcgtatcttacgcctttttgaccaatcacaagatggaccacgcaaggaaagtatccggcaatcatggtttgcagggctcggcctcggcaccgccatgagccttatggcatgctcatggaccattggcttttggtatagtggcaggcttatggctgagcaccaaattactgccaaggagatcttccaaaccttcattattctagcaagcacaggtcgtgtaattgcagaggcaggaagcatgacaacagacctagctaagggtgcagatgcagttgcttcagtatttgctgttcttgaccgggaaacagaaattgatcctgacaaccctcagggatacaagccagagaagctcaaaggcgaggtggacatcagaagagtcgatttcgcatacccatcaaggccagatgttataatcttcaaagggttcacattgagcatccaaccaggcaagtcaacagccctggttgggcaaagtggctctggcaagtcaaccatcattagctcatag

SEQ ID NO: 1178 - DNA, 3025 bp, Oryza sativa
  misc_feature (1754)..(1754): n = any nucleotide
atgggcgaacccatcgtcgccatcgccatgaacgaagctggagatgatggagcctccatggaaaagaagcttatttacatctaattgttctatctaagctgagatttaccttgacagatgtccagactccacagatccctgggcttatgcagactgcagagaagctgggacatgtgtccatgctgatgaactggtgctcagtttgcaaatgccaacaagaacagccggcctctccacgctgcgcggggccgcctccggcgagcaggctgggcctcgggcctcggggcctcattccaccgccctgcgcctctcggttcggatcggcttgaaggtgaagaggtatggacttcggtgattctagacgcaagcctaatgtcgtcgggaagttcaccgtagctgttgcactcacggtcatgtgcatcattgtgttgaaacagtcgcctggttttaccagtacaagtgtggttctctcgccatgaaattggtgtgactcatgtgttggtgactggaggagctggatacattgggtcacatgctactcttcgtctacttagggacaactaccgagttaccattgtgggataacctttctagagggaacatgggagctgtcagagtccttcaacgtttgtttccagagcctgggaggcttcagtttatttatgctgatttaggcgatgcgaaagctgtatcctttttctctacaatgtgaactttaataccttattatagccatttttccatacattcatgtgttggtgtgatctgttttgcacttaaccaatagccaggaaaatgcattcgatgctgttatgcactttgctgccgttgcttacgttggtgagagcacgttggagccactgagagatacttcaacgtcattggatcagacccaggggggcggttaggggaagctccacgaccagagctgcgtgagcatggacggatttctggtgcttgctttgatgcagcactgggaatcattccaggtttgaagaggttcggggaactgattaccctacagctgatggaacttgcataagggactatattgatgtcacggatctcgttgatgctcatgtgaaagctcttgataaagctcagcctggcaaagttggaatctacaatgttggcacaggacatggtggtagatcagtgaaggagtttgtagaagcatgtaagagcgcaacaggagctagcatcaaggtttcattccttacccggagaccaggagactatgctgaagtttacagtgacccatccaaaatccatgacgagctgaactggacagcccgttacattgatcttcgcgaaagcctttcaactgcatggaaatggcagaaagcacacccgaatgggagtacaagtggttggattataccgtatgtacatgaacctacacttcttcaaagagaagattaattatgtactacatgttattcgcaactacagttcttcagaagagaagaacaaacaatgcaatggacgaaaccgagccattctgcaagaagagggcacagcagcaggaccatcaccggcgtcggcagcggccgctcgacgccgccggcgttccagaggaccgccgccgccacgtccacggcgcggcggaggaacaggaccgcccccgccggcggcggcggcgcggcggcgccgcgcccccgcatcccgtacatgatgaacagcagccccgccgcgaggatcgcgcacgccaggacgagctgcagctgctcggctccttccaccggcggcgcccngccccccttgccgccgccgccgccgatggtgttgagggtcaggaaggacaccgccgtgagcaccgtcgcgaagcccgtgccgacgaggtccccgccgcttccgcctcgcggttggtaggggcgccctggttgccggcgcattgttcgtcgccggcggcgagcggcggccacgaggaagaagctctgcgagaagcgggatcgcgagccaagttaaagcttgtgtcgttatgtactaccataattgagtacgtacaaaggttcttctgtttgtctgaaagcctgaaatcaccggcaaaaaacgatggtgtgatctgccgtcgccgtccgctcgtggaggagcgcacgtcgctagcttctcccgcgagattgacggcgccgtcgtcgccgcgggggaaggtgtttggaaggggcgcggaaactctagcaccagatgtgtgggcgtcgcgtacgtcgtcgtcgtcgtcgttgtcatggttcaaagtacgagtatgagtgtacgacgtacttgacgatgacggcgcggtgaggcgagaggtcagtggagacgacatgtgtgtgtccatgtcgtcgttgttccatgggaaattttaccatagaacaaagcgccgcggcccaggcgcgtgcccgccgcgtcctctcgtggcctcgccacggaatacgcataaggcttgcgtatctttcgacgctgagcttgctgcagcaacgataaaagggctgtgcacacaaagagttcactatgagtgcttgcataaccataggtctgatgaatctgcgacgtggcgaacagtggattggtgccggaatccactacatcgacacgacacccctgctccatcctcgcaatgttgcaccatctcgcctataaatatgcccatgcaaagttgcaaacacaaatcaagctaagcagccacacagcccacagcgaaagaattcgccgaacagtggaaagctatagcagcagtcatggccaagcaccacaatcgtcgtctctccgtcgtcgtcgctctgctgatgctagcggcgtcgatcgtcctgctgcttcttgcgccgccctgcgatggtaggagacagctgaggggaagcgaggccaccagaggcggtggagtcggcgaggagaaggcgtcgttgctgccgcctccgatacccaacctgccgctgccgcccatcgtccccgggaatcctcctgctcgcaactccgtcgtcaacaacaaatctccatagctctcttcatcatcatgtctttttaagataagcttgttgttgagaggtag

SEQ ID NO: 1179 - DNA, 2938 bp, Oryza sativa
tccccgctgctgtcctccctccgggtctcggcctcctcctccctgctactccacctccccctgctcggagggatgcgctacgacttcctcaactccaagccgcccccgaactacgtggccggtctggggcttggcgccaccgggttcaccacccgttcggatatcgggccggcccgcgcggcgcccgatctgcctgaccggtccgccgccgccgccgccgcccccgccgtcgggcgcggccgtgggaagccacccggggacgacgacggcgacgacgatggcggcgacgaggagaaggggtacgacgagaaccagaagttcgacgagttcgagggcaacgacgccgggctgttctccaacgccgactacgacgacgacgaccgcgaggcggatgcggtctgggagagcatcgaccagaggatggactctcgccggaaggatcggcgggaggcgcggctgaagcaggagatcgagaagtaccgtgcttccaaccctaagatcaccgagcaattcgctgatttgaagcgtaagttggtcgatttgtcggcgcaggagtgggaaagcatacctgaaattggggactactcgctgcgcaacaagaagaagcgatttgagagcttcgttcccgtgccggacaccctgctcgagaaggctcggcaggagcaggagcatgtcacggcactggatcccaagagccgtgcagctggtggcaccgagacgccatgggcgcagactccggttaccgatctgacggctgtgggcgaaggtcgtggcaccgtgctctccttgaagctggacaggttgtcggattcggtatctggtcttactgttgttgatccaaagggttacttgacggacctgaaaagtatgaagattactagtgatgctgagatttctgacattaaaaaggcgcgattgttgcttaagtcagtgacacagacaaacccgaagcatccaccaggatggattgctgctgctaggcttgaagaggttgctggcaagcttcaggttgctcggcagcttatccagcgtggctgtgaggagtgccccacaaatgaggatgtttgggtcgaggcatgccggctggccagcccagacgaggcaaaggcagtgattgctaggggcgtgaaggcaattcccaattctgtgaagctgtggttgcaggcagcaaagttggaaactagtgatttgaataagagcagggttttgagaaaagggttggaacacattcctgattcagtcagactgtggaaagcagtagtagagcttgcaaatgaggaggatgcaagactgttgcttcacagggctgtggagtgctgcccactccatgtggaactgtggcttgccctagcaaaggctggagacatatgaccaagcaaagaaggtacttaacaaggcaagagaaaagcttcctaaggaacctgccatctggattacagctgcaaagctggaggaagctaatggaaacacccagtcagtaatcaaggtgattgagagaagtataaaaactttacagagagaaggattggatattgacagggaggcatggctaaaggaagcagaagctgctgagcgtgctggatctgtattgacttgccaggctattgttaagagcactattggcattggtgttgatgaggaagacagaaaacgcacatgggttgccgatgctgaggaatgcaagaagcgtggttcaattgagacagcccgtgccatctatgcgcatgcactcagtgtcttcgtttccaagaagagtatttggctgaaagcggctcagcttgagaagagccatggaaccaaggagtctctttataatctcctcagaaaggctgttacctacaatccacgtgcagaagttttatggcttatgagtgcaaaggagaaatggctggctggagatgtcccggctgcccgagccattcttcaggaagcttatgcttctctccccaattcagaggagattctggctagctgccttcaagcttgagtttgagaacaatgaaccagagagagcaagaattcttttgtcaaaggccagggaaagaggaggcactgagaggtctggatgaaatctgcgattgttgaaagggagttagggaatgtagacgaagaaaggaagctgttggaggaaggtctgaagttattcccctcattcttcaagctgtggttaatgcttggacaaatggaagaccggcttggccatggatccaaggcaaaggaggtttacgagaatgcactgaagcactgcccgagttgcatccctctttggctctctctagctaatctagaggagaagataaatggcttgagcaagtcacgtgctgtcctcaccatggcaagaaagaagaacccagctacacctgaactctggcttgcagcagttagggctgaattgagacatgggaacaagaaggaagctgatgctctactagccaaggcattacaggaatgcccgacaagtggtattttgtgggctgcagctatagagatggtgccacgtccccagcgtaaagcaaagagctcagatgctataaaacgatgtgaccatgatccccatgtcattgcagctgtggccaaacttttctggcatgataggaaggttgataaagctagaagttggttgaatagagctgttactcttgctccagacattggagatttttgggccttgtactacaaatttgaactgcaacatggaaatgctgatacacaaaaggatgtcctacaaagatgtgttgcagcagaaccaaagcatggagagagatggcaagcaataacaaaggctgttgagaactcacatctgtcaattgaggcccttctgaagaaagctgtgttggctcttggccaggaagaaaatccaaatgctgcagatccctagtttgtctcacttttaacttttgataaggtattgcaatctgttatcattatactcttctga

SEQ ID NO: 1180 - DNA, 2925 bp, Oryza sativa
  misc_feature (855)..(855): n = any nucleotide
  misc_feature (2692)..(2692): n = any nucleotide
atggggcgcctccagcaccaccaccgctcccgctccgcctcctcctcctccttcgcgcgctcctccgacaccgccgccaccgacgccgacgcccgcagcctcgccgcggacgccaccgtcgactgccccttcggccacgtcaatggcctcacccgctccgacctccgggaggccgcctacgaggtcttcttcatgtcctgccgcgccgccggtggcggccggctcaactacttcccggccggggagagcggcggcggcgacgtgtcgccgaccatcggcgccggcccccggggtggcacggggatgagcgtcgtcaacagcagggtcaagagggcgctggggctcaaggcgcggaggtcgtcgcagccgaccacggcgcgggtgagctccatgaacgcgtcgtcggcgcccggctcccccggccgcgccatgtgggcgatgagccagccgtcgacgcccgtgtcgcccgggaaagggaggcggccgatgacctccgccgagatcatgcggcagcagatgcgtgtcacggagcagaacgacgcccgcctccgcaagacgctcatgcgcaccctcatcggccaggtgggaagaaaagccgagacgatcgtcttgcccctggaactgctccggcaggtcaagctcaccgacttcgccgacagcggcgagcaccaccagtggcagcgccggcagctgaagctcctcgaggccgggctcatcgcgcacccgtccctgccgcatgaccgcctcaacgcggtggtgctcaggttccgcgaggtcatgcaggcggcggacacccgcgccatcgacaccggcaagacgtcggacgccatgcaagccctctgcaacgccgtgcangcccttgcctggcgctccgcccccggaagcaaggccgccggcggcgacgcctgccactgggccgacggctaccctctcaacgtgctcctctacgtgtcgctcctccaggccatctttgacctcaaggaggagaccgtcgtgctcgacgaagtcgatgagctcctggagctcatgaggaggacatggccaacgctgggcatcaccaagatgctgcacaacgtgtgctttgcatgggtcctcttccagcagtacgtggtcaccgggcagatcgagccggacctcgccggcgcggcgctcgccatgctcacggaggtggcggccgacgccaagcaggagagccgcgaccccgtgtacgcacgggtgctctcgagcatccttgccacgatacacgactggtcggagaagaggatgcttggctaccacgagtggttcggcaacggcaactgcggcgccggcggcgccatggccatggagggcgctctgtcactggcgctcgccaccacccagatcatctccgacaacgcgatcttcacgagcatcagcaccgcggaaaccgaacacgaagactgcagcgtcggaagcttcgccggcgaccgtgtggattactacgtgaggtgttccacgagaagcgccttcacgaaggttagcttcctacgcgtttggccacgccatggcgagcgtcttgtgttgatctgccgcggaaacgtgtgccagatactggagaacggactcgggcaaggggacagcctgatcatcgatcgccacgacgacgaagacccgggcgacatcctggcgcggctcgccggcgacacggagcacatcgcgctatccgagcgcgacgccttcgggccggtgctgaggcggtggcacccgttcccgggcgccatcgccgcggtgacgctgcacggctgcttcggcgtcgtgctgaagcagtacctgggcaaggccaccgtgctgagcaacgagctcgtgcacgtgctgcacgcggcggggaggctggagaaggcgctggtgcagatggtggtggaggacgtggcggacagcgacgacggcggcaagtcggtggtgagggaggtggtgccgtacgacgtggagtccatcgtgttcgggttcctcaggacgtgggtcgaggagaggctcaagatttgcagggagtgcatgctccgagccaaagaaaccgagagctggatgccgagatccaagaacgagccttacgcgcagtcggcggtggagctgatgaagctggctaaggcgaccgtcgacgagttctttggcataccggtggccgtgagggatgacttggtccaggacctcgccgacggcatggaggcgatctttttggagtacatctccttcctcacgtcttgcggtagcaagcagagctacctcccgtcgctgccgccgctgacgaggtgcaaccaggactcgaagatcatcaggctgtggaagaaggcggcgacgccgtgccgggcgcccgtgtcgagcccgcgcgcccacgggcaccaccaaggccagggcggcatggcgtccggcggccagaacccgcggccgtcgaccagccgcggcacgcagcgcctctacgtccgcctcaacacgctccacttcatcctcagccacgtccacgcgctcgacaagtcgctctccttcttctcccgcggcaggtgctcgtcgtcgccgtcgtccgccgccaccgcccgcctcctcgcgccgtgctcccacttcgaccgcgcgcgcgccgcggcgcagtccgcggtcgggcacgtcgccgaggtcgccgcgtaccgcctcatcttcctcgactcgcaccactcgttctacgacgggctctacgtgggcngcgtcgccgacgcccgcatccgcccggcgctccgcacgctgaagcagaacctgtcgctgctcctctccgtcctcgtcgaccgcgcgcagccggtggcggtgcgggaggtgatgaaggcctcgttccaggcgttcttgctcgtcctcgtcgccggcggcggcgacaggagcttcacgaaggaggaccacggcatggtggaggaggacttccggagcctgaagcgcgccttctga

SEQ ID NO: 1181 - DNA, 2880 bp, Oryza sativa
  misc_feature (2091)..(2091): n = any nucleotide
  misc_feature (2118)..(2118): n = any nucleotide
  misc_feature (2145)..(2145): n = any nucleotide
  misc_feature (2158)..(2158): n = any nucleotide
atgctgcgccgccgcgggctcctcctcgtcttcgtcgtcgtctgcttcggcggcggcggctggctccttcccgcctcccgtgccatgccgctatgcacggactccaggcctcccgtggcgctcaacaagacgctcgccttctgcgcctacgcccgggggagcagcagctgctgcgacgccgccgcagacgctactttgcagaaacagttcgatgccttcaacgtctccgacgcctcctgcgccgccctcctcaagcccatcctctgcgcgaaatgcaatccgtattctgctgagctgttcaacgccggcccaaacattcggactatccctttcctgtgcaactctacctcatcctcttctgctcaatcaaaggactccacacaagactactgcaaattagtctgggaaacttgcaaagatgtgaccatatccaactccccctttcagccaccgcttcaaggcggcgcgccacttcccacttcatcatccaagcttactgatgattggcagtctgaagctgacttctgcaaatcatttggcggtgcgcctaacgaccaatctgtttgcttcagcgggaactctgtctcatttaacaccactccaccttcgccctctctgaaagggatatgcctagagaggataggcaacggatcataccttaacatggctcctcaccctgatggctccaatagaatcttcttaggcagccaacctgggaagatatggttggcaacagttcctgaccagggatctggaggcatcctgcagtttgatgagacaagcccatttgctgatctaaccgatcaggtgcatttcgattcgcaatttgggctcatgggcatggcatttcatcccaattttgcaaccaatggccgcttctttgcctcttacaactgtgataggacaaagtcacccagctgttctggtaggtgctcttgtaactctgatgtcggctgtgatccctcaaaggttggcacggataatggcgctcaaccatgccaatatcaagttgttgtatcagaatattccgctaaaggttcttcagcaaatatttctgaggttacgtctgctgatccatccgaagtcacaaggatatttaccatggggctgccttatacgtctcagcatggaggacagagtgaaattgctaaccagagcttgtggggtaactactccattccaaaagacaacccatacactgatgacagtgacttagaaccagaagtttgggcattgggtcttagaaacccatggagatgcagctttgattccgcgaggccttcctacttctactgtgccgatgttggtcaggatcaatacgaagaagtagatttgatctccaagggtggaaactatggatggcgtgcatatgaggggccacttgttttcaatccaccttcggcacctggagggaacacttccctcaattccataaacgccattccccctatcatgggctacagccattctgatgtcaacaagaagattggatctgcgtcaataataggtggtaatgtttatcgaggatctaccgacccctgcttggtcggaaggtacctatacgccgatctgtatgcatcagcgatgtggaccggcacagaggctccagagagcagcgggaactacagctcgagtctgatctccttcagctgctccaagagttctcctatagcgtgtgacactgctgctggaagccccctcccatcacttgggtacatatactcgtttggcgaggacaacaacaaggacacctacgtcctgtcgagcaagggcgtctaccgggttgtgcggcccagcctctgcggctacacctgtccaacagagaaacctgcgacgaacactgggacgacgacgccttcgtcagcggcatcagtgacaggcaagcagatgatgggagcgcttctgctgtcggttcttatgttctgggttttggcgccagactccgaccgggccaacctcgccgccgacctcgccgaccaccctgtcatcgccgccgccgccaacgtccacgtcatccaacgggccaacctcgtcacctaccgtggccccaccatggtcgccaacaccctccacgccgccgccgccttcctntacaccaaccaacacccgcacttggantgggactggttcatcaacctctccgcntccgactacccgntcctcacgcaggatgatctgatccatgtgttctccaagctgcctcgcggtctcaacttcatcgaccacaccagcaacattgggtggaaggagtatcagagggccaagccggtcatcattgaccctggcctctacatgaagaagaaggccgatgtcttctggatcccgcagcgccggagtgtccccactgccttcaagctcttcaccgggtctgcttggatggccctgtctaagccgtttgtcgaatactgcatatggggctgggacaaccttccaaggactgtactcatgtactacgccaatttcatctcttcaccagaaggctacttccacactgtggtctgcaatgctgaggagtttaaaaataccacggtgaaccatgacctgcattacatatcatgggacaaccctccgaagcagcatccgcactacctcacaattgaagacttggacaggatggttgctagcgatgcaccatttgctcggaagtttcatgcagatgacccggttctagacaagatagatgcggagatcctgttgcgtggcccagacatgctcactcctggaggatggtgtggagggacacgagaaaatggaagtgacccttgctcagtcatcggcaataccactcaccttcagcctggtcgaggagctgtacggctgcagcggctcatgacgtcgctcctgtcagaggagaagtttcacccaaggcagtgcaagtga

SEQ ID NO: 1182 - DNA, 2860 bp, Oryza sativa
atggcgctgtcggcgtccaacagcgagtgcgtgggcgacctggacggggagcagatcaggaaggccaagctgataagcctcggcaggggcgaccgcttcgccgccgtccgggacgacgagcaaaccgcggatgcgctctcccgccgctaccggggactacaactttctgattaccatgagaaagttattgatggcttctatgacatttttggcccctctatggaatcatcaaagcaagggaagatgccatcactagcagatcttcaaacgggcataggcgacctgggttttgaagtcatcgtaatcaatcgtgccattgataccaccttacaggagatggaacaagttgcacaatgtatcctgcttgactttcctgttgcaaatattgcagccttagttcaaagaatagccgagcttgttacagatcacatgggtggacctgtgaaagatgcaaatgacatgctcactagatggctagagaaaagcactgagctaagaacctcactacacacaagtttgttgcctattggctgcatcaagataggtctgtctcgtcaccgtgccctacttttcaagcagattctcgctgatagtgttggcattccttgcaagcttgtcaaagggagtaattatactggtgatgatgatgatgctatcaacataataaagatgaatgaaaggtattgatagggagtttttggttgatctcatggctgctcccggtactcttattccatcagatgtcttaagttggaagggcaactcattaaattctaatgcaagactcacccagaatccattggctgggtcatcaagtacaactgattctaatctcagtgccaatgcattaccacccggacataaaggtggccaactgcctttatttagcagtggcgattggatatcggccagtcaatctggatatgaaaaagatggagccaccacatcttcacaggcctcttcaagtggcacaacatctgttgctgctggaagcgcttttgatagttcttggacattagtttctcatggacaatcagatgatccatcaacctctgctggtatgtcagcacagcagaaagttatacttccaggtggagaacatccatggaatgagaatataaatgcgcgaaatgagaatataaaacttgtttcagatttacaagggaattcagagtccatcaacttatttgccgaccttaatccttttgggggtagggagcccaaaaggacttcagtgccattaaatgggccagataatagaaataatgagttgcaaagacgcagagagaatgtagtccctagcacacgaagaccccagcagcgattagttatgaaaaactggtctccttacaatgatgtttccaacaacaagcagtacaattatgttgaggattcatttgcacgtagaaatattggtgataatgctgcatcatcatctcaggtgccacggccatctgcaaaaaatactaatcttaatgttgtagtgcgcactgatacaccatacatggcagctcataattatgataatagtatggctggttcctctgcaatgaagatgacttctacagctgggattgggaaggttcctgataaggttctgtacggtgatttggacaagggccttactaattctagactgggggatcaaccaccgatagaaagacataaatggggcaattctgtagaaggaaggattccaacaggcacagttcacaatcaagcaaaagaacacaaggagaacttcgatggaaagcaagacaataagaagttacatcctgatccaaagaaatccccacttgacagattcatggacacatcaatgccatcaaggaaccctgaatccgtttcaccatcctttgctaggtcacacaagctagacaccatgttcgacgatgtgtctgaatgtgaaattcattgggaagatcttgtgattggtgaaaggattggcttagcaggttcatatggagaggtgtaccgtgctgattggaatggaacagaagtagctgtcaaagaaattcttggatcaagatttctatggtgatgctttggatgaattccggagtgaagtgcggattatgcgtcgactgcgtcatccaaatattgttctcttcatgggtgctgttactcgtcctccaaacttatctattgtatctgagtatcttccaagcttggcaggggaagcttatataagatccttcaccgtcctaattgccaaattgacgagaagcgtagaattaaaatggcccttgatgtgggccaaaggaatgaattgcctccatattagtgtaccaacaattgttcatcgggatcttaaatcaccaaacttgctggttgacaacaactggaatgtgaagaggtttgtgattttggactttcacgcttgaagcacagtacattcttatcatccaaatccactgctggaactaaacatttactatttctgttttcgatatctcaccagccggagtggatggcacctgaggtcttgcggaatgaacaatcaaatgaaaagtgtgatgtttacagctttggtgtcatcttgtgggaattagcaacacttaggatgccatggagtggaatgaatccaatgcaagttgttggggcagtcggcttccaggacaagcggctcgatattcccaaggaaattgatcctctagttgcaaggatcatatgggaatgctggcagaagggatccaaatttgcggccctcgtttgcacagttaaccagtgctttgaagactgtccaaaggctagtaaccccttctcaccaggagtcccagagccctcctgtgcctcaagaaatatgggtgaattcttccaccccttgatgttgaggggcattccactctcaaaattgtga

SEQ ID NO: 1183 - DNA, 2802 bp, Oryza sativa
atgcctctggggcctgcctccgctgcagcgccgccgcctcaggccgccgctgctccgcctgctcagccgcccgccggcggcgcaacggccggccagaagctcaccacgaacgatgcgctcgtctacctcaaggccgtcaaggataagttccaggacaagagggagaaatacgaggagttcctcgaggtcatgcgcgatttcaagagtgagagaggattgataccaacggagtcattattcgtgtcaagacactcttcaacgggtaccctgagctcatccttggcttcaataccttcttgcccaagggttatgcaatcaagctgcaggaggagaagaagcctgttgatttcgtggaagccatcaatttcgtaaacaagattaagcatgtctataaggcattcttagacatcctcaacatgtaccgcaaggacaataaatccatccaagatgtttaccatgaggatttactcgaagagttccaacacttcttgcctgatacctccgtgcctccacaagctgtggccccttcaaggcctggtattaggcgggatgacaggacctctctggtgcctcctgctagtaggaatgaaaaggagttccatttctgcgaaaaagtgaaggagaagctggagcatgatgcttaccaggagtttttgaaatgtcttcacatatacagccaggaaattattactaggagtgaattgaagaacttgaattgtcagcggtgcactccaagttaccggtttctacctaaacattacccaatgcctcccgcaggcaacaagactgagcttggagcttcagtgcttaacgatcactgggtatcagtgacatcaggaagtgaagactattcatttaagcacatgagaaagaatcagtacgaagagagtttatttagatgtgaagatgacaggagatttgagttggacatgctgttggaatcagttaatgcagcaactaagcgtgtcgaagagttgatagaaaagatgcaagacaactccctaaaaccagatagcccaatacgcatcgatgagcatttaactcgtatgcatcttttatttgtttaatttgtattgttatgtttgttgaatctgaggtgcattgaacggttatatggtgaccatggtctggatgtgatggatgtccttcgaaagaacgctagtgttgctctaccagtcatcttaactaggcttaaacagaagcaggaagaatggtcaaggtgccgatcagatttcaacaaggtttgggcagagatatatgccaaaaattatcacaagtctcttgaccaccgcagtttctatttcaaacagcaagatacaaagaacctgagcacaaaatgctctattaactgagatcaaagaaattaatgagaagaaaagaaaggaagatgatgtgctccttgctattgctgctggaaataggcgtccaatagttcccaatatgtcatttgactatgtagattcaaacatccatgaagatatgtataagatcattaagtactcctgtggtgaagtctgcagttcctcagaccaactggacaaagttgtgagaatttggacaacttttctggagccaattttgggtgttcagcctcggacacatggtgctgaggatgcagatgcagtcaaacccaagagtcgaaccacaaagtctggtcttgcaactgttggggaaatcaacactactgcagcaggggctgttgccaagcatggccatgatgaaaatattccacaggagcaaacaccgtcatctctggctagaatgtcccacaataccccaaaagttgaaagagaagagggtgaattatctcctaatggggattttgaagaggacaattttgcgccttttgaagatggagctgtagatggagtatctaaagcgaaggaaggttccacaagcagaccattccagggtaggtctggagaagcacaaccatcttgtgctgaagcagctggtgagaatgatgctgatgctgatgatgagggtgaggaaagcgcacaaaggtctaccgaggacagtgagaatgcctccgagggtggtgaagatgcatcaggaagtgaatctggtgatggtgaggagtgctctcgtgaagatcatgatgaggaagaggaagatatggatcatgatgatcaggatgccaaggctgaaagtgagggtgaggcagaaggaacaactgagacacatgatgtggaagggggaatatcactcccgctatcggaacgctttctacactccgtaaaaccacttgccaagcatgtacccacagctttacatgaccgagatgaaaagtcctcgcgtatattttatgggaatgattcattttatgtactgttcaggctgcatcagcagatcttgtacgaaagattactttcggctaagacaaactcatccagtgctgaaaagaaatggagaacttccaaggatacaaacccacctgacctatatgcaaagcttcaagctatagcaacagatgaaatggacaacaagcttctccagctttatttatatgaaaaatcaagatcccctgggaggttctttgatctagtctatcatgaaaatgcacgcgtgctcctccatgaagagagcatataccggtttgaatgttcaaatcctacaaaattgtctattcagctgatggaatatggccatgaaaagcctgaagtgactgcagtatcaattgatcccaatttttcctcgtatctttttaacgagtatttgtcgagtatgtcagacagaaaattgtctgagggtgtcttcctggaaaggtattttatccccttaataaaactgaaatgtatctaa

SEQ ID NO: 1184 - DNA, 2764 bp, Oryza sativa
atgatgccgtcggggccgctcaacccgatgggtcccgggcagccggtgggcgccgccgcctcgctgctccggacgagctcaagcctgcttagtggtggtcagcaggggatgggcagtggcggaggcatgattccttcgcagtcgcccttctcatcccttgtgtcgccgcgcacgcagtttggtgctaatggcctgctgggaggtggctccaatgtttcctccctgctcaaccggccgtttgggaatggtggacatatgctcggtccggggttgatgccaggtggtggtgggattccaatgaataccctccagcagcagagaggagggcttgatggtgctggcgatttggttggcgtgggaggttctgatcctctctcgtttccttcatcgtcgcaagttagtttgggcaatcagctgggttcagataatctgcatcaaccaccgcaacatcagcaacaacaacagcagctggatgctatgcacgacttgcagcagcagcagcatcatcagcaactgccaatgtcttacaaccaacaacattgccaccgcaaccaccacagcagccacaggctacagtgaagttggagaatggtggcagcacaggtggggtcaaattggaaccgcagatggggcagcctgaccagaacagctcagcccagatgatgcgccatgctagcaatgttaaaattgagcctcagcagttgcaagctctaagaagtttgagtgcggtgaagatggagcagccgacttcagacccatcagcattcctgcaacagcaacagcagcagcaacatttgctgcagctgacaaagcagaaccctacaagctgctgcggctgctcaactgaaccttttgcaacagcaacggatattgcaaatgcagcagcaacagcagcaacaacaacaacagattctaaagaatctgcctttgcagagaaaccaattacaacagcagcagctacttcgccaacagagtctaaacatgagaactccaggaaagtcggccccttatgagcccggaacctgcgcaaagagattgacccattacatgtatcatcaacagaacaggccacagcaggataacaatattgagtactggagaaattttgtcaatgagtatttttctccaaatgctaaaaagaggtggtgtgtatctctctatgaagtggtcgccaaactactggagttttccctcagaggatgtatggcattgtgagatatgcaatcggaagcctgggcgaggctttggagaccacagttgaggtgttaccacggttgtgccaaatcaaatatgccagtggtacattggaagaattactatatgtggacatgccacgtgaatcgcagaatgcctctggccagattgttttggactataccaaagctatccaggaaagtgtattcgagcaattgcgtgtggtacgcgaaggacatctaaggatagtttttaatccagatctcaagttgaagatcgcgtcttgggagttttgtgctaggcgacacgaggaacttattccacggagatcaataataccacagcaggttagtcaactgggcgcagttgtgcaaaaataccaaagcgctgttcaaaattcgacaaatctgtcaactcaagacatgcagaataattgcaactcgtttgttgcatgtgcccgccaattggctaaagcactggaggtgccattggttaaagaatctgggatacacaaaacgatatgtgcgctgccttcagcagattgcagaggtggtaaactgtatgaaagatttaattgattacagcagacaaaatggatctggaccaattggctagtttgcatagctttcctcggaggacttcatcaggggtcagccctcaccagtcacagcagcaacagcctgaagagcagcaatctataccgcagagttcaaaccaaagcggtcaaaatgctgctcccatgaccggtgtgcaggcttctgcctctgcaaatgcagatgtgacatcaaataattctctcagctgtgcaccctcaacgtctgcaccttcaccatccgttgttgggctcctccaaggttcaatgaactctagacaagatcatccaatgagcagtgctaatggtccatataccagtggaaacagtgctgcaattcccaaggtgaactcgacaacctcactgcagtcaaatccatctacctcttttccttcacccatgccaacaacatccaataacaacatgatgcctgcccctcagagcacaaaccaactcagctccccaaccacatcatcaaacctaccgccaatgcagccacctgctactcggcctcaggagcctgagccaaatgagtcccaaagctcggttcagagaatattgcaagatttgatgatgtcaccgcagatgaatggtattggccagcttgggaatgacatgaaaagaccgaacggacttacatctagtgttaacggagttaattgtttagttggtaatgctgttacaaataactcaggaatgggaggaatggggtttggggccatgggtgggctaggtccaaatcatgcagctagtggattgagaactgcaatggtgaacaatgcgatggcaatcagtggtaggatgggaatgaatcacagtgcacatgacctatcacagttgggccaactacagcagcaacagcaacatcaacagcagcagcagcagcagcaacatgacttaggaaaccaactgttgaatggacttagagcagcaaacagcttcaataaccttcagtatgactggaaaccatctcaataa

SEQ ID NO: 1185 - DNA, 2751 bp, Oryza sativa
atggctgttgtcgatcctgttatgtttgacaacgacgacgaggaaggtccgatctccttcaagaggtcgagcacctctgtgaagaacaggcccacccccacaaagcaggagggctcatcagggaatgccggacctattaggagccctaaggctgttgcttccaatcaacagaagaatgggctgactggtgtttcgaggcctttgcaacagaggccgcagtcaagcagtccaaaccctcgacctttgggatcaggtcagccgaacagttccaaagaacatagtagccataatagtaactcagtggataagagtaaattgaaaagacctttcgtggaagataagtcggatgactcagaagatgaccataagccaatcggattaaggagaaaggtcgaggatagaaatttgaagaaacctgctgtaggaagtgggacagcaaatgattcagatgatgataaaccattgagtctcaagataaactcaacaaaaacgccttcgagtagtgcaaataaggctattgtactgaaaactacacctaaaattgagcaacctggtgatgattcagaggacgataaaccactggccagcaggttgccaactaatgctgctctgaaaaggggaggtaatgtttctgatgattcagaggatgagaagccattggctgcccgattttcgaaagttactggcaatgcatctgcaagtatctcaagttcaaaggacaaggtcctgtctgcaagtataaaagcaagttcttccagcaagatgtctaacaatgacgcgagcacatcacgaaattcaattaaaaggccaattgacaataataatcaaacaagttcagctctcaagaaggcgaggccttcagatgtttctgcgtctgcaagtgtcaaaagagaacccaaggcggatgacaatgacaatgtacctctttcacaaagactgaaaatgggtgagtcttcaaaaagcaagccacctgcaaagaatatcgtaaagaagagtccttcatctttaaagaaggacaacaagaaaatgaaaatgaaaatgaaaacaaagaaaacaatgaaaaattctcagttctcaaagacaatgaaggtccctcctggatctggtggtggacagaaatggactaccttggtgcacagtggtgttattttcccccctccatacaagcctcatggtgtcaagatgctttacaacgggcaacctgttgatctgacgccagaacaagaagaggttgccaccatgtttgctgtgatgaaagacactgattatgcatccaagcaaacattcattgacaacttcttcactgattggagaaaaattcttggtaaaaaccatgtcatcaagaaatttgagctttgtgatttcaccccgatctatgaatggcacctaagagagaaggagaagaagaagcagatgacatctgaggagaagaaagcattgaaggaagagaaattgaaacaagaggagaagtacatgtgggctattgtagatggtgttaaagagaaggttggcaatttcagagtagaaccacctggcttgttcagggggcgcggagagcatccgaagatgggaaaactgaagcgccgcattaaaccaagcgatattacaataaatatcggaaaaggggctccgatccccgaatgtcccatacctggagaaagttggaaagaagtcaaacacgacaacacagttacatggttggccttttggaatgatccaataagccaaaaagatttcaagtatgttttcttggcagcaagcagtgcattaaagggccaaagtgacaaagagaagtatgagaagtctcgaaaattgaagcatcacgtacacaaaattcgtgacacttacacaaaggatttcagaagcaaagataagacaaagaaacaaattgcagtggcaacataccttatagataagttagcccttagggcaggcaatgagaaggatgaagatgaggctgaaactgttggttgctgtacactgaaggttgataatgttacttgtgttcctccaaataaactgcagttcgacttccttggtaaagattctataagatacttcaatactgtagaggttgaactgcttgtatacaaggcaattgaggaattccgtgctggcaagaaaccaggacaagatctctttgacaaactcgatacaaccaggctaaatgctcatctaaaggacttgatgcctgggcttaccgcaaaagtgttccgtacatataatgcttcaatcaccttggatgatattttgcacaaagaaacagaagatggaactcttcttgaaaaaattgcggtttatcaacgagccaacaaagaggttgctataatctgtaaccatcagcgtagtgtctcaaaatcacatgattcccagatgactagattgaatgagaagattgatgaattgaaggcccaaagggatgaattgaaggcagacttgagcaaagtaaggaaaggaaagaatctaggcaatgacaaagatgggaaaccaaaaagaaatttggcccctgaagcgtttgaaaagaagatatctcagattgaaaccaagatagagaagatggagatggataagaagattaaagaggatttaaagacagtggcactaggaacttcaaagatcaattaccttgatcccagaattactgttgcatggtgcaaacgccatgaagtacccatcgagaagattttcaacaaatcactcattgcgaaattttcgtgggcaatggacgtcgacccggatttcagattttaa

SEQ ID NO: 1186 - DNA, 2582 bp, Oryza sativa
atggcggggttgattccgccgttctccggattcttccatgaggttttggatttctatgaaatccatgccttgcatctcgcacccaacgccgtgatgacgctggccatcttcgcgcatctgtgcgagatgttcatcggggtgcggctgacgatgcggctgttccagtctttcttcatcccacagctgctgcaaggtgcggtggtggggggatggcctgcgaagcctgggcctcacaggggcgatggtctttggtgactatttccgccgccgcatcgcacctctccaggatcgatcccgtggcgcgtgggagtacactggtcccaacaaccccatgcgcacgcatgtgggtgagcgctgggactgggaggaggaggacgcgaagatggtgattcggcgggtactgggcttggactccgccgagcaaacactgattccagacgggatcctttccctatggtgcgaccgcgaccgggagagcatcctggccgtgtcggttgttggcaccggcaggagcaggtccagccgggacggcaccggtggtagcgctgccgatgttgctggcggtggcgcgacagcaggcgggagtcggacaagcggacccggcgggggtgggagctctaggtctcccggcccaaaccgcggacccggggacgactcggccagcgacccgaaagggaagcggaagatgtccgaatctcgaccgccctctcccccgcgtggagggggcgccgagcgcgtggatcgtccgctagcgggccacaagagccctgccgggaccgaggccggacggaagaagaaacggctccggaagataggacaaatggagccgtgtcgggggagcttcattgagcccccgaagtggactttcaaccgccctccccgcagatccaaggccgcggggccttcacagcccctcggcagggcccacgggccgcataccgggtccggccccgagcgaaccccagccgggactcgtcccgccgcgggcgatagcggcggtgacgtccctcctgggggcgactccgagaccagggttcatgcggagcgccacccgggatcggggggcgaaggaggtcgtggctcggatgccgaggccggaggcggccttgagctcgaggtcaaggccgaaatcgggggcgggcccgagccggaggccgagtccgaaattgggggcgggcccaagcctgaggccgaggccgaatctacccgaggacccgaggcgggggccaaaatccaggcgcgcgaggagtcgctggactccgtcatgcgagaggtggaggaagagcggcaggcggcgctgattgcctcgagcgtcctggacgaagcactgggtgacatcgccttcagtacgaggcccatgccgaggatctggcgaagaggatcaaggacgcccgcggtatcctcgacgcagctgctgcccaagagcagcggggtatcggaggccgatgcctcgctgcgggctcggaacagcggcgctcgaggccgaacgcagggccttggatgagcgtgtccgctccacgcaggagttcgagaccacgattcgccggcgaatcgaggtcctcgatcagagccagcgtgagcaaaacgcgcgtggccaggagcaggcgcagcgagcccaggagctgaggcggactcaggcgctggaggagcgagcgcgtctgctcgatctgcgggagtccaccttggccgcccacgagagaacagcagcggaggtggaggcctcccttcaccttcgtgaagaggccgcagctgagcgtgaccggatcaccgagctacggctctgggaagaggcgtgccgagaacgggacgttgtactcgccgagcgcgaagctgagagtgctcgcgccgagcgcgcggcgatagcggcgagggcttctgagctggaggcccgtgagaaggacctggcggcgggcgggcagcccggcggcgcggagttggggagccagcttgccatggctcagagcactctcgccgatatagagcgcttggtgcaagatcaggccagggagattgcggccctccgcctcaccaacgggatcggacccgggaagctctccgacgccgtcgaccggctggagcgcgcggggcgccgagtcggcatttccgtgcaccgggatagtaagcttccgcccacacgcccggcagtcgcactccggctggacgggctggcggcggatctggagaggctggagaaggaggtcggcgagactgtgaaatcgtcgtcggctttcttggcgcgggacgcggtggaactggtcctcgcgagccaccaagcgcgtgaccccgacttcgtcccatggcgcgcactcgaggattttcctccagggaccgaggcaagggctcgggagcaagtccgggaggcggccgacgcgatcgtctctaacttcgaggggtcggccccccggttcaccttcgggcttgcctcggacaaggagagcgggagcggggacgatgatgacgacttcggcggcgaggactgggacgacgtctgtcacgcccagaaatttaacccaaatttccggactattttgtgtattaaatccctgtccaggacaagccagggtacacaaaacgacaagtaa

SEQ ID NO: 1187 - DNA, 2494 bp, Oryza sativa
  misc_feature (1102)..(1102): n = any nucleotide
tccgttgtggaggaggaggacgagcgccgggtggcgcacatcgtcgagcacctcgccttcagcgccacgtcgcgctacaccaaccacgacatcgtcaagttcctcgagagcatcggggccgagttcggcgcctgccagaacgcgctcacctcctccgacgagaccatctacgagctgcttgtccccgtcgacaaacccggcctgctctcccaggccatctcagtcctggccgagttcagctctgagcgtgtgtcggcggaggatttggagaaagagaggggtgctgtattggaggagtataggggtggacgtaatgctactgggaggatgcaggattcccattgggcattgttgttcgaaggctccaagtctcagtatgcagaacgcctgcctataggtactgagaaggtgatacggactgttcctcatgagactgttaggcacttttaccataagtggtaccatctaagcaacatggctgtctttgctgtaggggacttcccagatacacaggttgttgaaatgataaaggagcactttggccagaaagccccaccttcatgtcctccaccagttataccagattttccagtaccatcgcatgttgaacctcggttttcatgctttgtggaatctgaagctgcaggggttgtcagctgttgttgttagctgcaagatgcctgctgatagaattaaaacggtgacggattatcgggattctctggcagagtcaatgtttcattgtgctttgaaccaaaggctgttcaaaatatctcgcaggaatgatcctccatacttctcttgctcttcagctgcagatgctcttgtagttgctagggttcggctccatggattttctgaacgtgagatatccattgcacgtgctttaatgatgtcagatatcgagtctgcatatttggaacgtgatcagatgcagtcaacaacccttcgggatgaattcttgcagcagcattttcttcatgaagatcctgttgtcgggattgaatatgaagcacagttgcagaagactcttctaccccgttgtattgaaagtcaacactcttgaacaagacaacgctattcctccatgggatgaagagcnaatccctgaagaaattgtcagccaaagtccagagccagggtattagctgtctcatgattgactgtcttctacagagatgatactttcgaatggcatgcgaatttgctacaagtgtactgactttcttgatgatcagcaggttgtttttactgggtttgcctatggtggtctgtctgaattgtctgaagatgaatatacctcatgttcaatgggttcaacaatagcaggagagattggcatttttggctacagaccatctgtcctgatggacatgcttgctggcaagagagctgaacagcttgtctaccaattatttacaacaaaggtggagccaagagaggaagaagtaaaaatagtaatgcaaatggcagaggaagctatctatgctcaagaaagagatccttacactgcatttgcaaatcgtgcacgggagataaattacgggaattcatacttctttaagccaattagaataagtgacttgaagaaggtggatccaataagagcgtgtgaatatttcaacaattgcttcaaggatccatcagcttttactgttgtaatagttggaaacatagacccatctatctcagttccactgattctgcagtacttgggtggaatacctaacgtagggaatgcagttctgccacttactcgtgatgatctaaaaggattgccattcaagtttccggagactattattaggaagttgttcgcagccctatggttgaagctcaatgctttgtgcaactaggatttcctgtggttttaaagagcacaacaatgattcactatgttgggtttctaagtaaacttctggagacgaaaatcatgcaagtgcttcgtttcaaatatggacaggtaggtgtcttcttaggtggcaacaaaccttcaagaagtggagatattcgtggagatataagtgtgaatttttcatgcgatccagacatgtcatccaaacttgtatgctctatatcctctggttaacctgtatgctattttgttgttgactttgtgctggaagagatatcatttctacaaaatgaaggcccttctgaagaagacgtattaactatccttgaaattgaacaaagagctcatgaaaatggattacagcaggaaaattactactggctggatcgagttctgcggagctatcaatcaagggtttattctggagatgttggatccacctttgaggagggacgtctaaaggttagagaggctttgacaccacaatcgatgcaaatggccttgcaaagagttgtgcctttcccttgcagaaaacagttcactgtagttattcttatgccgattttggctggcatggctggcgcaatagtgttagcggtcagtttgtggagatactcacgtagcacattgagatcatag

SEQ ID NO: 1188 - DNA, 2469 bp, Oryza sativa
atggagcacgggagcatcatcgcgtcggccgtgggggtgggcgtcggggtgggggtcggcatcggcctcgtctcgtcgcggctgaccgggttggcgactggcggcggcgccacggcggcggaggtggaggcggagctgcggtgtctggtggtggacggccgcgacgtcggcgtctccttcgacgacttcccgtactacctcagcagcgagcagtcgaagctggccctcaccagcacggcgttcgtgcatctgagcccaacgatcctgcccaatcacatccgcgtcctctccgcgtccagccgcaccatactgctctgcggcccatcagcagaggcgtaccttcagtcgctcgcgaaggctctcgcaaaccagttcagtgctcgcctgctgctgctcgatgtcatcgacttcgcgtgcaagagctccatcataagtacggcggtccaagcaatacacagacacagacccgtgagagatccatgacagaggcagccttcgatagagtgtctagtttggttggagctttcaatctgtttcgcaagaaggaagaaccaactggaacagaggaccattgagccgtgaaacaggcatccttgatctcaggactagagcacttgttgtcctcataacacaccttcagtacgggttcagttatccttggtacctcccgagaaggaccatgatcccgaatcttctaaataccttggcatcagttaaaccatgctggagtttgaatgagaaggttctcatacaatccctttacaagagattatagtttctgcttctgaaatcagtccagtcattctttacataagggatgttgatgacttgcttggaagttcagaaaaagcatactgtatgtttcagaaaatgttgaaaaaactatctggacgggtaatcgtgattggttcacaattcctcgatgatgatgaggatagagaagatattgaagaatctgtgtgtgctcttttcccttgtattctggagacaaagcctcccaaagacaaggtccttcttgagaaatggaagacccagatggaggaagattcgaataataacaataatcaagtcgttcaaaactacatcgcggaagtgctcgcagaaaacaatcttgagtgtgaagatttgagctcgatcaatgcagatgatgattgtaaaatcattgtggcttacttagaagaaattataaccccatctgtctcttaccatctgatgaataacaagaaccctaaatacagaaacgggaatcttgtcatatcttcggagagagcttatcccatggattacgcatattccaagagagcaacgaccttgggaaagatacagtggaagcaaaggatgagacagagatgggtcgttccagacaatgagtatgaaaagaagatccgaccaacggttataccagccaatgaaataggagtgacatttgatgacattggagcactggctgatatcaaagaatgccttcacgagcttgtcatgcttcctcttcaacgacctgatttcttcaaaggtggtctcttgaagccatgcaagggcgttctgctgtttgggccacctggtacggggaaaacaatgctcgccaaggccctagcaaacgcagcaggagctagcttcttgaacatctctatggctagtatgacatcaaaatggtacggggagtctgagaagtgcatccaagccttattcagccttgctgctaaacttgcaccagcaatcattttcatcgatgaggtagacagcatgctagggaaacgagataaccatagcgaaaatgaggcatcccgcagagtaaaaaatgagttcatggctcactgggatggactcttgtctaagtccaacgaaaggatattagtccttgctgcaacgaacaggccctttgaccttgatgatgcggtgataaggagatttgagcacagagaatcatggtcggcctcccaacgttggagagtagagagctgattctgaagacattgttgtcgaaagagacggttgaaaatattgatttcaaggagcttgccaaaatgactgaaggatacaccagcagtgacttgaagagaatatttgcgtgacggcagcttatcatcctgtcagagagctacttcagaaagaaaagaacaagaggtcaagaaggaaactgcaccagaaacgaagcaagaaccaaaagaaaagaccaaaattcaagaaaacgggacaaaaagttcggatagtaagactgaaaaggacaagcttgacaacaaggaaggtaagaaagacaagcctgctgacaagaaagataaatcagacaaaggcgatgctggagagactaccctgagaccgctaaacatggaggacttgagaaaggcaaaggatgaagtcgccgctagcttcgctagcgaaggcgttgtgatgaatcagatcaaggaatggaatgagctctacggcaaaggcgggtcgaggaagcgggagcaactgacatacttcttgtag

SEQ ID NO: 1189 - DNA, 2463 bp, Oryza sativa
  misc_feature (1454)..(1454): n = any nucleotide
  misc_feature (1598)..(1598): n = any nucleotide
  misc_feature (2090)..(2090): n = any nucleotide
  misc_feature (2101)..(2101): n = any nucleotide
  misc_feature (2128)..(2128): n = any nucleotide
  misc_feature (2158)..(2158): n = any nucleotide
  misc_feature (2174)..(2174): n = any nucleotide
  misc_feature (2186)..(2186): n = any nucleotide
  misc_feature (2201)..(2201): n = any nucleotide
  misc_feature (2220)..(2220): n = any nucleotide
  misc_feature (2255)..(2255): n = any nucleotide
  misc_feature (2275)..(2275): n = any nucleotide
  misc_feature (2277)..(2277): n = any nucleotide
  misc_feature (2283)..(2283): n = any nucleotide
  misc_feature (2285)..(2285): n = any nucleotide
  misc_feature (2300)..(2300): n = any nucleotide
  misc_feature (2312)..(2312): n = any nucleotide
  misc_feature (2372)..(2372): n = any nucleotide
  misc_feature (2377)..(2377): n = any nucleotide
  misc_feature (2383)..(2383): n = any nucleotide
atgggcggacttgtgcctttcaccgagctgaatgagttcgacgaggggtgcactgtagcgaaaagcctgcttgttcaggtatgtgtttcgatttactttgcatttgagcacactgagcgaccgagcgacccgtttaagctagaactagcgcaattgcagtatcaaagacctgaggatgacccggattatattcctatcgagcaggcgatggttacccgtcgtcggtcgaaacgaaatgccggcagggctgaacctgagtcggacacaacgacctcaggaccacagccaacggacacaacgacgagtggggaagcttgtgcaaagaaaaaacgtggcaagaggagcaggaacctgatgccgaaggagacgtactacattgctgctctcaacgatgatggcaaacccgtcgagctgcaacatgtgagggcgaagtttagcaccgcatgcggttcgctggcaagacttcatgtggctctcaacgtggacgactggaagcacgttagcatacacatcaagaacttaatgtgggaagccccctgggtcagaggcacttggttggaaatttgcactgcaaacaattgcccatcgctggcgatagtggaagtcggacatgaacactcattatgttcagaagaataagactccatttgaagaatggggcaccatttcggcagtcgagtgggacaagtttgtgcccaagatgacaacgcctgaagctctagaaaggaggaagaagatgtcagacctggcgaagaagaacatatatccacacaggttagggtcaagtggatacgccggtcacgagaagaaatggcgagctacggaggataagtttgcgaccgaaggcaaacctttgattgtgcaacccctaaataagcgaactagaaattgggtgtaggcaagaacttcgggccaagtgacagaagaggatgagatgccgttggattgtcctgacatacagaacatgaccacgtctctccaacagatcgtccagaaggagaagatcggggagttcatccctcgacggcagcatgatgagctaaccgaagctttgggaactacagaacactccggtagggttagaggacagtcgtgcaggacgaattggaaggtagggtttccacaggaagcccaaagttacaagaagcgcgatgcctataaggccaagatgcgccaggaaatcatagattaagtcacacaacaagtcacccaacagttctatagtcttgccacacaacatcctcaagccttccctgacctggttcctcagggatcgcagtcgacgcagatcccaagctctgtcgggtcggtagaaaatacaacctacccagtagatagtataactgctccgacaccatgcagccttgtggttctgatagggagagcgggaaaaacaaaggaggttgtgtccggattagcgataccgggtagacagttccataacattccggcgnagtacgcaagggttcaggtggcacgtgttaatggcgaccagatgtcgttggagcttgacatcgtaacaccagaggggattgaacttctcggggatgcggttcaccagttcatactttggcatcgtcaagacatcatcctcactnggacagttcacgtagacgacccaagctccgtgccaaaggagtatgaatatggcaagccgttcttgccgtacaacttgatgtgtgaattcgcatggccaacgaggttgatgcatgactggtacttgagggcaagtgagttaggtctcgggatgattactgtgcatgttctggaaggcgctttcaaggatggacctaacgcaaacttcgccatcagtttcaaggacctccacgctttctttaagatggataaaatggatatcaatttcgtcggcgcgtggtgcctgtaagcattccatggggcatcaatcggttatgtaaatccaacgacggtttgcgagacggcccacactgtgcggatatcggaggatagtgcggtactaaagaataagacacctcaggagaaaaaagattacatcgagcgtatgcataagagaaaaatggccgaggtgggaaattacttggccacctcatttctcgcacactccgacaaangagtcatcatngtcccctaccactttggcactacatantattcctcgtctatccaacggaccaaaccntcgtagttcttgatcnggcagactatgncaaggacgcgtacanggagttcctatgcttgctnaactttataagaaacgtggcggtgttataagcaanctagcttgacgaacctatgngngtgtgngngatgctcagggtcantgggagatacanaactgagtttacagatgcggacttgtgccggttcattcgtcgcgacatctgcaatcatcnagganagttcnatgatcctcatagcaaacttgctacggaccccaaattcaagaacctaagagagtgggagagggaacatgctgtggactaa

SEQ ID NO: 1190 - DNA, 2426 bp, Oryza sativa
atgagcaggccaaacacacgaaataagagcaagaggccgcgggctgatgactgcgagagcccgtctgctgttttcaaaggaagatacattccactggagcaatcacaaaaggcgatattaaacaactttatatggtgtggaaacctgtttgtcatggttgccatgggaactccaaggactcacccaattgtttctgcgggttgatccctgctgctaatggggtgaggaaatctggcctgtggcagagaacaaacgagatcattcgcgcccttggtcctaacccgtcgacggatcttcgtgactccactgagacgcctgctggattgactaacctgggcgctacctgttatgcaaacagcatactgcagtgcctttacatgaacacctccttccgcttgggcattttctctctagagcccgacatcttgaagatgcaccctgtgctggatcagcttgctcggttattcgctcagctacactccagcaaaatggctttcattgattcggcaccttttataaaaaccttggaattagataatggtgtccagcaggacagccatgaattcctcacattatttttgtctttgctcgagggttcactaagtcattccaaggttccaggggctagaaccattgtgcagcatttgttccgtggaagtgtgtcccatgttactcggtaggtgctcatcatgtggaagggattccgaagcatcttcaaagatggaagacttttacgaactggagcttaacattaaaggtttaaataatctagaacaaagtttggatgactatttgagtactgaggcactggatggagagaaccagtacttctgtgagtcatgtcagaaaagggtagatgccactcgttgcataaaacttcgctcacttcctcctgttgttaattttcagctgaaacgctatgtattcctcccaaagtttcgtccacagacaacaacaaagaaaaagatttcttcggcattcagtttcccaggacagctagatatggggaagcggttatccaatccttcatctagttatactctgctattttgatccacaagggtagtgctgccaatagtgggcactatgtagcacatgtaaaggacgaaagcaatggtcaatggtgggagtttgatgatgagcatgtatccaagcttggtcttcatccctttggtgaaaaaccaggagatgttttcttctacagatgcttatatgctgatgtacacagagaggcgccaagaagtaaaatctgttctgacagaagcgcctgcaactccagaggaggattcttatttttggatttcaacagattggcttcgccaatgggcggacaactgtgaacatggaaaagttccagcgtcaaaagttacatccatgaaacgactatcagctggagcttggcataagctattttctaaacttaaggatggagcaaaaaattcagtatctgcagatgtttatcgtgatcggcaatggttgcgcagaaaaaatgtggatatcccttcagatgctgacagtggaccaacaattgctctaacgtgcacccatggaaatcttcttccggaacatgcttcaggcgcaaagcgggtcactgtgccagaggacctatggttatttctctatgaaaccagtggaatgaagattgatgatattgtgacttttccgtcagatagtaaactcaagcaacgacaaagccatgaaaagttaacttctgggaaaagtcttgcacttcatcctgggcaaaaatattatttagttccttcctcatggttgtcagagtggagagcttacattacagcgactgggaaaaatatttcttcgttaccagaacctcaatctcttgaagttaccatcaattcactaatctgtgaaaagactgatggattaacaatgatatcagaatctgattggattttattctctgaagagtggaatgtagcacatggaaaagtgtgaagaatgtattggagaaaaagagagctgtgcattggttgagaagctcaattatcagaatgaagatatccaggtttatcttgtccgtggtaaagaagcgccaaagtcaattagagaggcatcggcagctgttcctgtaccagatcgtaggacttcaaagcgttcccggagaacaacctcaggaaattcgatcagtttgaaagtctctggttctacaaccgtatatcagttgaaactcatgatatgggaatctttagggaaggagaaccaggagcttcacaaaggctctgttgagattgaagatgattttgctactcttgctgacaagtgtatttttcctggagatgttctatgggttaaagattccgaaatctacgagaaccgtgacatagcaggaggaaggctttcgtgggactctgttgacatctagtgcttcagctcagctttgccaggatatatcatttagcgattga

SEQ ID NO: 1191 - DNA, 2329 bp, Oryza sativa
  misc_feature (221)..(221): n = any nucleotide
  misc_feature (1565)..(1565): n = any nucleotide
atggctctctcggcggcgctccggctgccgctcccgcgcctcctgtggggccccacggggtccctcctcgcggcggccgctgcggcctcccgccgccgcgccgcggtcgtggccgtccccgccgtccgcttcctctcctcctcatcctcctcctcggacggctcgcgctccgtgcagcccctccgcgcgggccgcgatgagcgggcggcggcgggtaaggncggggcggcggtaaaggagcgggtggtgcccgtggagctccacaaggaggccaccgaggcgtacatggcctacgccatgtcggtgctgctcggccgcgcgctccccgacgtccgagatgggctcaagccagtgcaccgcaggatactgtgagctctctccctttatttttcctggattgttcgctttgcatctatacaccgaagctatgcatgagatgggtcttgcatcccgtagaccattcagaaaatgtgcaagggttgtcggtgaggtactaggtaagttccatccacatggagattcggccgtatatgaaaccttagtacggatggctcaggttgacttcgtcccaaactttgataattcacagaaagagccttctctgttgccagctcgtgttccatctctattgttgaacggttcttctggaattgcagtagttggaatggcaacaaatattcctcctcataatctgggtgagcttgttgatgtgctctctgttatgattgaaaaccctgaagctactctccaagaactactagaatgcatgcctggacctgactttcctacaggagggacaatcgtgggaaatcaagggtatttggaggcctataaaactgggcgtggtcgagttgttatgagaggcaaaactgacatcgaaacaattgatgtgaaaagcaaacgctctgccattataattaaagagccataccaaacgaataaatccactcttgttgaaaggatagctgagcttgttgaagaaaagttagaaggcatcagtgatattcgggacgaaagtgatcgctctggaatgcgtgtagtaatagagctgaaaagaggtgcagatcctgccatagttctgaacaacttgtaccgtcatacagctctgcaatctagttttagctgcaacatggtagcaaacttctgctttaggcattcattgacttcagatgttctgttattgaaaggcgtgcaagatttaagctttcacaagctctggaaaggaaacatatcgttgagggcattgttattggtcttgacaatttggattctgttatcgaatttggtctgtctgacaagcaagcagaagccctattggatatcacactaaggaaacttacttcccttgagcggaaaaaatttgttgacgaagctaaatctttgtcagaggagatctccaagttaaatgagctcctgtctaacaagaagcttatttttcagcttattttacaagaggcaactgacttaaagaacaaatttgctaccccacgacgttctttcatagaagattcagcaagcactgaagttgatgatcttgatattattcctaatgaggaaatgctttnggtgagaaacagtgagaagggctacgttaagcgtatgaagcctaataccttcaatctacaaaaccggggaacgatcggaaaatctgttggaaagatgcgaatgaacgacaatacatccgatttcatgtctgccaaacacatgatcatgtcctttacttcagttcagtgacaagggaatagtatactcagcacgtgcttataagatacctgaatgcacaagagctgcgactggaactccactggtacaggtatagtgatggatgttcagctgctttctttgtccgatggggagagaataacctccatcgttcctgtaaatgaatttggtgaagatcagtatcttgtgatgctgaccgttaacggttatatcaagaaagttcctcttaatgctttctcagcaatcaggacttctgggatcatttcaattcaactgggtgatgagctgaagtgggttcgtcgttgtggggatgatgaccttgttgctttggcttcacaaaatgggatggttatagttaatacatgcaacaagaggaaaacaaggggcgtcctggcaatgaagctaaaggaagccatggctgcttttcatagctgataatggtattgggaagcgtgtgcccctaaatgcattccggcaaggaaatttcaacagagtgggcttgcaaggctacaagagtgacgaacaggtggttttagttagccagagtggtactgtaaacagaatcaaagtcaaagatatatccatccggtctcgttccgcaaggtaa

SEQ ID NO: 1192 - DNA, 2325 bp, Oryza sativa
  misc_feature (259)..(259): n = any nucleotide
atggggaagccggcggcagccaagaagccgccggcgagcgcggcggtcgacggcgacgaggaggtgttcctggagctgtcgcgggagctcaaggaggagggcggcaggctgttcaaccggagggactacgagggcgccgccttcaagtacgacaaggcggtccagctcctccccagcggcggccatgccgacgcggcggcacacctccggacctgcgtcgcgcagtgctacatgcggatggcccccgccgagcaccacngcgccatccacgagtgcaacctcgcgctggaagcggcgcccaggtacagcagggcgctgctgcggcgggccgcctgcttccaggcgctggaccggccggacctggcttgggaggacgtccggaccgtgcttgcctgggagccggctaaccgcgccgcgcgggagatctccgacaaggtcagggcggcattggaggagaagggcgttcttgtcttggagaaggaacccgtgccgccgccgccggagcacaaggctgttagtgcgaagggacaggggaagttgaagaaatctcataaacagtgtgattctgctattgaggggcaggagctgattcatgtcgaagattatgagcaaagtgagaaaacagagctgaagattaatggtcaggagaatggagaaaatcgtgccgggaaggagcaatttgattgtaatgtacctgtcaagcaagaaattcgaaccgaccagccggaagcaaatggagtaggaaaacatcaatatcatatggacgataaggaaaacaagggtttagataaggaaggaaagaatggcaaaccagggaagcacagtgcaggaaagaaaattaggcgtgctgacgccaagaagcaaaagcattccgctatggagccagtgcatcatgctgaggaaaatcgtcatgagcgttacacggagaccagtgtccatgtcaaggaagcaatgaaggatctgaagctggtctttggggaggacattagatgtgctcaaatgccagctaactgcaatctgtcacaattgagagacatagttcaaaacaagtttccatcgttgaaagcgttgcttattaaatataaggacaaggaaggtgacttggtgacgatcacttcatcggatgagcttagatgggcctacagcttggcagatctggaagggccaattcgactgtacattgtagcggttgatcctgcacaagagctaggtgtggatgtggtcaggagacgctcttcatttgcctcattagagaaagcttattatagcatgtcggagaatgggagcagtaggcatgatgatgatcacaactgctctattgatgactggatgatacaatttgctcggctattcaagaaccatcttggttttgattccgactcgtatttggatctccacgaccttggcatgagattgtactatgaagctatggaagacactgttgcaagtgaagaagcacaggaaatatttcaagttgcagagctaaaattccaggaaatggcagcattggctctgttcaactggggcaatgttcacatggcttctgcgagaaaaaggcctcccttgtcagacgatgcttcaatggaatgtatacttgagcaggttaaggttgcttatgaatgggcttgtgcggaatatgccaaagcgggcgcgaagtatggagaagctgtgaaaacaaaaccagatttttttgaaggtcttattgcacttgggcagcagcagtttgagcaggccaagctctgttggtattatgctcttgcatgtaagatagacatgggaactgaggttttgggattatttaaccatgcagaggataatatggaaaagggaatggggatgtgggagggaatggaaaatacacgcttgagggggctctcaaaaccaagtaaggagaagatcatatttgagaagatgggcatagatgggtacatgaaggatatgtcttccgatgaagcatttgaacaggcttctagtatccgatcgcatgtaaatattttgtggggcaccattctttatgaacgttctgtagtggaatttatcttgggacttcctagttgggaggagtctctaacggttgctatagaaaaatttaagactggaggtgcttctcccgcagacatcaatgtgatggtaaaaaaccattctgctaatgaaactactcaagaaggactgagttttaaggttgaagaaatagttcaagcatggaatgaaatgtatgatgcaaagaagtggagaaatggagtgccatctttccgacttgagccaatattccgacgtagagctccaaagttgcatcatatgctggagcatatacactatgcttga

SEQ ID NO: 1193 - DNA, 2310 bp, Oryza sativa
  misc_feature (1248)..(1248): n = any nucleotide
  misc_feature (1261)..(1261): n = any nucleotide
  misc_feature (1272)..(1272): n = any nucleotide
ccttatgaagttctgtttcgtctgaactctctcatgcatatggggaagatagtcgccaagcattctacctgctacgggcctttacaatttatccaacaggaggcttatagcatgaagagaagccataatgttttgctctccaatgaaggtgaaggtgaaggtgaaagaaaattgatgaagtgttatagagttaacataactccctccaaaatattctgctttggacctgaagaagaggttacaaattatgtggttaagcatcattctgcatatgcttctgactttgtgagagttacttttgttgatgaagattggagtaagctttcttctaatgcaatctcagctagaattgaacaaggtttcttttctaagcctttcaaaactggtctatattatcggattctctccattctaaaaaaaggattttccattggtccaaagaactttgaatttttggccttctcagcaagtcaacttcggggaaattctgtttggatgtttgcttctaatgcttccttgaatgctggaggtataagaagatggatgggccactttgagaatatccgttcagtttctaaatgtgcagctagaatgggtcagctgttcagctcctccaggcaaacatttgaagtcttacgatgggatgtggaagtgattccagatattgagatcacaactgatggctccaaatacatattttctgatggtattgggaagatatctttgagatttgccaagcgagttgcacaccacgttggattagatcctactaaccttccttcagcttttcaaataagctttctctgcgtcctagtatgaagaaatttgagtctgagagcaggatgttgaacattacaagttggagcaagtctcagccatgctatgtgaatcgtgaaattatttctcttctctcaacattgggtataagggatgaaatttttgttgcaatgcaacaagatgagatgcgtgaaacagaagaaatgctaaccaacaaagaagttgctttgtcagtcctagggaaacttggtggttctgaaacaaagacagcagtgaagatgttgctgcaaggttatgagcctagttcagagccttacctgtcaatgattcttaaggcccatcaggagaataggcttactgacattagaactagatgtaaaatacatgttccaaaaggccgtgttcttattggttgtttggatgaaacaggtgtattagaatatggtcaggtttacattcgaattcaaagtnacagcaaagaacnaaaggacagtnatcaatcatatttttataatgatgacgggaaaacagccacagttgttggaaaagttgcaatcacaaaaaatccgtgtctccatcctggtgatatccgagtacttgaagccatctatgaccctgatttggtgggcatggttgattgtcttgtcttccctcaaagaggagaaagaggcctcatccaaacgaatgctcggggggagatttggacggcgacctctattttattacttgggatgacaaacttattccagagaaagttgatacacctatggactacacagcaacaaggccgcgcataatggatcatgttgttacactcgagctgcaggaaattcagaagcactttgttgattacatgataaatgactcgcttggtgccatctcaactgcccacttgattcacgcggaccgttcgccactgaaagctcggagtcccgagtgcctccagctggcaactctgcattccatggcagttgacttcgccaagacgggagctccagctgaaatgccgcgaacattgaggccgagggagtaccccgacttcatggaacggtgggagaagccgattacgatcctgacctcgaggtccctggctctgacgaattcctgcaagctgcagaggagtactacgagctgtacgaggagaaactgaccacgctgatgaactactaccgtgcggagctcgaggacgagatcctgacgggcaacatccggaacaagatgctgtacctgaagagggacaacaagaggtacttcgagatgaaggaccggatcgtcgccgccgtcgacgccctgcacagggaggcgaggggctggctgctgagctccaggaaggaagaggacgcgtcgcggatggcgtcggcgtggtaccgcgtgacgtaccacccagaccgccgccgcgggaagcggttctggagcttcccgtggatcgcctgcgacaacctgctggcgatcaaggcgtcgagccagctcaggcggcggcggcagaaggacgatgactccaccgcggtggtgcagatggactgcagcgcctga

SEQ ID NO: 1194 - DNA, 2307 bp, Oryza sativa
  misc_feature (144)..(144): n = any nucleotide
  misc_feature (177)..(177): n = any nucleotide
tggtacggcagcatccagtacctggtcaacatctccgcggttggggccgcctcctgcgtgctcctcttcctcctcgtcaagctccgcttcgaccaccgccgcatcccggggccctccgcgctcgccgccaagctcctcgccgtntaccaagccaacgggccgcagatcgcgctccantgcggggccgacgccgcccagttcctcctcttcgagcgcgcctccttcctcgtgctcgccgccgtggccgccgccgccgtcgccgccgccctcccgctcaacctcctcgccggggacgccgccatcgccgaccagttcgccgccaccaccatctcccacatccccaagtcatccccgctcctctggctccatctcctcctcaccgccgccgtcgtcgccatcgcccatctcggcatctcccgcatggaggacgcccttcgcatcacccgcttccgcgacggcaacggcaaccccagcgaccccaactccagctcggttgccgtcttcaccatcatgatccagggcattcccaagacgctcgccgcagacaagaccccgctcaaggattactttgagcacaagtaccctggaaaggtgtaccgggtcatcgtgcccttcgatctctgcacgctggagtatctagctgaggagtgggggaaggtgcggaacaggatttcttggctggaggcaaggatggatgcccgcaacctatttgatgaatttgctcagggtggaagacattcagaagagcattggattgtgaggagatgcaaagagctgtgggtgatgacagcagagaggttcgggtttactgacgaggaaatgctaaggaggttgcagacaaagaaacttgtcctcggtagcaggttatcggattataaggatgggcgtgctcccggtgctggcatagcctttgtggtttttaaggacgtgtatacagcaaacaaggctgtgagagatttccggatggaaaggaagaagacaccaatagggaggttcttcccggtgatggagctccagcttgagagaagccgttggactgtggaaagggcaccaccggcatcagatatctactggaaccatctagggctgagcaagcggcgtattgcagtcaacacctgcctcattctgatgctcttgttcttcagttcaccattggcaataattagtgggatgcaaagtgcagcgcggatcatcaatgtggaggctatggataacgccaaatcatggcttgtctggctccaaagctctagctggttctggaccattatctttcagtttcttcccaacgtcctcatttttgtgagcatgtatattatcatcccatcagtgctgtcttacttctccaagtttgagtgtcatctgacagtgtcgggagagcagagggctgcattgttgaagatggtttgcttcttccttgttaatctcattctactgcgtgcgctggtggaatcatcgcttgaaagttggatactcagtatgggccggtgctacctagacgattgcaagcagattgaacaatacttaagcccctcttttttgtcaagatcttcactctcctccctggcattcttgatcacatgcacctttctaggaatatcctttgatctgttggctccaatcccttggataaagcatgtaatgaagaaatttagaaagaatgatatggtccagttggtccctgaagaaaatgaggactaccaactgatgcatgatggcgaagaaacaaataatttgagagcgcctctaatgtctgagagagaagacagtggcattctgaatggtattgaggagcatgatctttcattgtacccgataaacaggagcttccatatgccaaagcagacatttgactttgcacaatactatgcatttgacattacaatattcgcgctcacaatgatctactcactgtttgctcctctgacagttcctgtcggcgcagtatactttggctaccgataccttgtggacaagtacaatttcctgtttatctacagagttagagggtttcctgcaggcaatgatgggaagctgatggacatggtgatctgcatcatgcaattctgcgttattttcttccttgttgcaatgttactattctttgcagtccaaggtgatcctatgaagctacaggcaatatgtactcttagtttgttagtcttttataaattgctgccctctagaagtgatcgcttccagccatccttgttggaagggatgcagacagttaatagctttgtagatggtccaacagattatgaagttttttcacaacctgacctggattggagcctgtatcaatcctga

SEQ ID NO: 1195 - DNA, 2288 bp, Oryza sativa
  misc_feature (539)..(539): n = any nucleotide
  misc_feature (760)..(760): n = any nucleotide
  misc_feature (773)..(773): n = any nucleotide
  misc_feature (896)..(896): n = any nucleotide
  misc_feature (2082)..(2082): n = any nucleotide
atgatcccggcgaggcatatgccgtcgatgatcggccggaacggcgcagcgtacggatcctcatcggcactgtcactcagccagctccttgaccagatcccggcgacgacggcggagagcggcgacaacatgatccgcagccgtgcgtccgaccctctcggcggcgacgagttcgagagcaagtccggcagcgagaacgtcgacggcgtctccgtcgacgaccaggaccccaaccagcggccgcgcaagaagcgctaccaccgccacacccagcatcagatccaggagatggaagcgtttcttcaaggaatgtccacacccagatgataagcagcgcaaggagctgagccgggagctcggcctggagcctctccaagtgaagttctggttccagaacaagcgcacccaaatgaagagaaccagcatgagaggcacgagaactcgcagctgcggtcggataacgagaagctccgggccgagaacatgcggtacaaggaggccctgagcagcgcctcctgcccaactgcggcggccccgcngccctcggcgagatgtccttcgacgagcaccacctccgcatcgagaacgcccgcctccgcgaagagatcgataggatatcggcgatcgcggcgaagtacgtggggaagccaatggtgccgttcccggtgctgtcgaacccgatggcggcggcggcgtcgcgggcgccgctggacctccccgtggcgccgtacggcgtcccgggcgacatgttcggcggcgntggccccgggganctgctgcgcggggtgcagtcggaggtcgacaagccgatgatcgtggagctcgccgtggcggcgatggaggagctgcgcatggcgcagctggacgagccgctctggagcgtcgcgccgccgctngacgccacggcggcggcgatggagacgctcagcgaggaggagtacgcgcgcatgttcccccgagggctcggccccaagcagtacgggctcaggtcggaggcgtcccgcgacagcgccgtcgtcatcatgacgcacgccaacctcgtcgagatcctcatggacgcgcgcggcagtgttctcgaacatcgtgtcgagggccatcacgctggaggtgctgtccaccggcgtcgcggggaactacaacggtgcattgcaagtgatgtcagtggagtttcaggtgccatcgccactggtgccaacgagagagagctacttcgtgagatactgcaagcagaacgcagacgggacatgggccgtcgtcgacgtctcgctggacagcctccgccctagccccgtcctcaaatgtcgccgccgtccgtcaggctgcctcatccaagaaatgcccaatggctactccaagaggtgacgtgggtggagcatgtggaggtggacgacaggtcggtgcacaacatctacaagctgctggtgaactccgggctggcgttcggcgcgcggcggtgggtcggcacgctggaccgccagtgcgagcgcctcgccagcgtcatggccagcaacatccccaccagcgacatcggcggtgattacgagctcggaggggaggaagagcatgctgaagctggcggagaggatggtggtgagcttctgcggcggcgtgacggcgtcggtggcgcatcagtggacgacgctgtccggcagcggcgccgaggacgtccgcgtcatgacgaggaagagcgtcgacgaccccgggaggccccccggcatcgtcctcaacgccgccacctccttctggctccccgtccctcccaagcgcgtcttcgacttcctccgcgacgaatcctctcgcagtgagagtgggacatcctctccaatggcggtatcgttcaagaaatggcccacatcgccaatggccgggatcagggcaactgcgtctcacttcttcgcgtcaacagctcgaactcgaaccagagcaacatgctgatcctgcaggagagctgcacggacgcgtcggggtcgtacgtcatctacgcgccggtggacgtggttgcgatgaacgtcgtgctaaacggcggcgacccgactacgtcgctgcatgctgccacctcgggcttcgccatcctgcccgatnggccggcgcacgacggttgcgacggcgacggcggcgtcggcgtcggctccggcgggtcgctgctgacggtggcgttccagatactggtggactccgtcccgacggcgaagctctcgctggggtcggtggcgacggtgaacagcctcatcgcctgcacggtggagcgcatcaaggcggccgtctccggcgagagcaatccgcagtag

SEQ ID NO: 1196 - DNA, 2288 bp, Oryza sativa
ccaaattcacccaagtcccctgttgccagtgcaagtgcttttgagagtgtagaaggatcagatgaggatgatgctaaacaaccgaatggtaaacttgaaaatggctacctgaagatgaatggaaatgttgctgcagcaagtttgattcggtctcatagtatatccaatgatcttcatggtgttcaacctgatccagttgctgcagacattcttcgaaaagaacctgagcaagaatcatttattaagctgttaactgctccacatggatgagattgaggtttacaagctccttcagaagtgccttgagttaagagactgttatctttttagagaagaggttgctccatgggagaaggaggtcataaatgatccctgtactccaaaacctgaccccaatccgttcacctatgtgcctgaaccaaaatcagagtttccaaatggtcgatggtgttgtccatgtctatgcagataaagacgaaatactttatcctgttgctgatgcgacaaccttctttactgacttgcattatatgctccgtgtgatttctgctggaaacacaagaaccgtgtgccataaccggttaaatcttttagagcataaattcaaatttcatttgatgttaaacgcggatagggagtttcttgcccagaagactgcaccacatcgtgatttttacaatgtcaggaaggttgatactcatgtacaccactcagcgtgcatgaatcaaaaacacttgctgagatttataaaatccaaactaaggaaagaacctgatgaggttgtcattttcagagacggcacttatatgactctgaaggaggtttttgagagcttggacttaactggtatgacttgaatgttgatttactagatgtccatgcggacaaaagtacatttcatcgttttgacaaattcaaccttaagtacaatccgtgtggccaaagtaggctcagagagattttcctcaaacaggacaatcttatccaagggtcgttttcttgccgagctaacaaagcaagttttctccgaccttacagcaagtaaataccagcagatggctgaatataggatttcaatctatgggaggaagcaaagtgaatgggacaaccttgcaagctggatagtgaacaatgaattgtccagtgaaaatgttgtctggctggttcagcagatcccacgcttatataatgtgtacaaggaaatgggtattgttacatcattccaaactcttctggacaacattttccttcctctgtttgaggtcaccattgatccagcttctcatccgcagcttcacgtcttcctaaagcaggtttgcaggttgtagggttagatttggttgatgatgaaacctgaaaggcgtccaacaaagcatatgcctacacctgaacaatggaccaatgtcttcaacccagcattttcatattatgcatattactgctatgctaacttatacacactcaataagttgcgtgaatcaaaagggatgaccacaatcaaattccgtccacatgctggcgaggtagaatctcttcaatgttccactgtctttctgttattgtgtttgtctatagctggagacatcgatcacttggcagcaacatttcttctttgtcacaatatatcgcatggaatcaacttaaggaaatctcctgtgcttcaatatctatactatcttggccagcagattggtctggcaatgtccccattaagcaacaactccttgtttcttgattaccaccggaatcctttcccaatgtttttccaacgaggcctgaatgtttccctgtcaacggatgatccattgcaaattcacctgacaaaagagccattggtggaagaatacagcattgctgcttcagtactccctctttccctctcccctcaccctattcatcttatgcagacactaattggaagctcagttcttgtgatttatgtgaaatagctagaaactctgtctatcaatcagggttttcacatgctctcaagcactggattggcaagaactattacaaaagaggacctacagggaacgatattcataaaactaatgtgcctcacatcaggggttcagtttagggacttgatttggagagatgagatgcgtcttgtatacctaaacaatgtcatcttacctgacgaggtggaccagtaacatgtacctggtgtatatggcgcggttgccatgggagttacatttcatgtttgggtaagcattattcaccttttatctgccggttcatactctacatctcatttcatttctttattaatcgatcactga

SEQ ID NO: 1197 - DNA, 2283 bp, Oryza sativa
  misc_feature (711)..(711): n = any nucleotide
  misc_feature (949)..(949): n = any nucleotide
atggcggggttgatcccgccattctccggattcttccatgaggttttggatttctacgaaatccatgtcttgcatctcgcacccaacgccgtgatgacgctagccatcttcgtgcatttgtgcgagatgttcatcggggtgcggccgacgatgcggctattccagtctttcttcgtcccacagctgctgcatggtgcgttggtggggggatggcctgcgaagcctgggcctcacaggggcaatggtctttggcgactacttccgccgccgcatcgcgcccctccaagatcaagcccgtggcgcctgggagtacactggacccaatgaccccatgcgcacgcatgtgggcgagcgctgggattggggcgaggaggacatgaagacggtgattcgtcgggtgctgggtctggacactgccgagcaaacactgattccagacgggatccttcccctctgcagcgatcgcgaccgggagagtattctggctgtgatgtcggccgtcggcgccagcaggggtcagtcccgccggggcggcgccgatggtggcgttgtcggcgtgggtagcggcggcgcggccgcaggcgggagtcggaccagtggccccggcgggggtggcagctccagggctcccggcccgagccgcggacccggggtcgactcggccagcgacccgaaagggaagcggaagatgtccgaatcgcgaccgccccntcccccgcgcggagggggcgccgagcgcgtggcggaccgaccgccggcgggccacaagcgccccgccgcgcctgaggctggacggaagaagaagcgactctggaagataggtcaaacggagccgtgtcgggggagcttcatcgagcccccgaagtggactttcaaccgccttccccgcagccgatccagggccgcgggaccttcacagcatcccggcggggcccacatgcggagcgcnacccgggagcgggggccgagggaggtcgcggcccggaagccgaggctggaggcggccctgagcccgaggccgaggccgaaactgggggcgggcccgagcccgagcccgaggccgaatctacccgagggcccgaagcggggggaaatccaggcgcgcgagcagacgcgggactccgtcatgcaggagacggaggaagagcggcaggcggcactgattgcctcaagtgtcctggatgaagcgctgggcgacatccgctttgtcacgcacggaaattcactacgcttacagtacgaggcctatgccgaggacctggcgaagagggttaaggacgcccgcggtgtcctcgatgcggctgccgcccaagagcggcgggtatcggaagccaacacctcgctgcaggctcggacggtggcgttcgagtctgagcgcaaggccttagataagcgtgcccgctccgcgcaggagtttgaggccacgattcgtcggcgaatcgaggtcctcgatcggaaccagcgcgagcaggacgcgcgcagccaggagcaagcgcagcgagcccaggagctggagggcgggctcaggcgttgaaggagcgagcgcgcctgctagaccagcgggagttcaccttggccggccgcgtggaggagctacggctccgggaagcggcatgccgggaacgggacgccgcactcgccaagcgcgaagccgaggcttctgagctggaggcccgggagaaggacctggcggcgggcgggcagcccggcggcgcggagttggtgagccagcttaccacggctcagagcactcttgccgacctagagcgcttggtgcaagaccaggctggggagatcgcggccctccgccttaccaatgagatcggacccgggcagctctccgatgccgtcgatcggctggagcgcgcggggcgcccagtcggcatctccgtgcgccgggatagtaagctcccgcccacacaaccggcggatctggagaggctggaggaggaggtcggcgagaccgtaaaatcgtcatcggcttccttggcgcgagccgcggtggaactggtcctcgcgagccaccaagcccgcgaccccgacttcgtcccatggcgcgcactcgaggatttccccccggggaccgaggcaaaggctcgggagcaagtccgggaggcggccgacgcgatcgtctctaacttcgaagggtcggcccctcggttcacctttgggattgcctcggacgaggagagcgggagcggggacgacggtgacgacgtcggcggcaaggactgggacgacgtcgttagcggcgccggcctcgggggcccgggcactccgtga

SEQ ID NO: 1198 - DNA, 2276 bp, Oryza sativa
  misc_feature (856)..(856): n = any nucleotide
  misc_feature (891)..(891): n = any nucleotide
  misc_feature (899)..(899): n = any nucleotide
  misc_feature (1001)..(1001): n = any nucleotide
  misc_feature (1631)..(1631): n = any nucleotide
  misc_feature (1666)..(1666): n = any nucleotide
  misc_feature (1699)..(1699): n = any nucleotide
  misc_feature (1749)..(1749): n = any nucleotide
  misc_feature (1827)..(1827): n = any nucleotide
cttctccagtcactgccggaagatctcttgatgcaggtggcaaagaagcggacggcaaaggaggtttgggactgtctcaagacgaggttcgtcggggcagacaagagtcgtggcaggggtcgcggacgcggcggaacgcagagcagcggtggcggctccggcggcggtggccgcgacaagagccacatcaaatgtttcaactacgaagagttcggccactactcaacgcagtgcccatggtacttggataatggtgctagcaaccatatgactggggatcgacgacgtctactacatccccagcctctgctgcaacatgtgcctcatggcgaagcagatcaggcagccattccctgcgatggcgaattatcgagcagaagcgccactcgagctactgcacatggacctatgtggcccaatcacaccgtcgacgtttgccgttaatcgttattttctgttgattgttgatgatttttcgcgttggatgtgggtgtttgttatcaagacgaaggatcaagcactggagatgttcgcaaaattcaagccgctggccgagaacacggccgatcactccatcaaaacactccggacagaccacagtggcgagttcttgtccggcgagttcgcgcgggtgtgcgatgaggccggcatcgagcgacatctgacggcgccgtactcaccgcagcagaacggcgttgttgaacaccgcaacagatcggtgatggcgatggcgcgctccctcctgaagggaatgtctgttcccggcaggatgtggggggaggcggtgcggcacgccgtgttcctgctcaaccggctgccaaccaagtcgatgggtgaacacactccgttcgaggcntggacggggaagaagccacacttaggacacttgcnagtgttcnggtgtactgcgcacaccaaggtgacaactccaaatctgaagaaattggatgatcggagtgagcagttcgtgtaccttggcatcgaggaagggagcaaggctnaccggctgtttgatccatgacgccgcggaatccataagcacaaggcatggctggtcgcaaagggctatgtgcagaggcacggtgtagactttgaagaagtgttcgccccggtggcgaggttggatacggtgcgtaccatacttgctgtcgcagcggaccgaggttggcgggtgcatcaccttgatgtcaagtcagcttttctcaacggggagctagaagaagaggtgtatgttgcccaactggaggggttcattaagaagggacaagagcaccttgtgctgaaattgagcaaggcactatatggcttgaggcaggcgccacgggcctggaacatttgcttggacaagagtctgaaggaacttgggtttatgcggtgcaagcaagaacaagccgtatacactcgaggcagaggagcagaagctatgattgttggcgtttacgtcgatgatttaattgtgacaggggagaatcctgccagggtagaagcattcaagaaacaaatgatgggggagttcgagatgaatgatctagggctcttgagttattatctgggaattgaggttggacaaggtgtgaatggaatcacacttaaacaaactgcctatgcaaagaaggttctgtcatagttcnggatgttggactgcaatcggcgtgtgatcggttgncttcggtatttgctgcatacaagaccggacctntcatatgctgttggagtggcgagcagattcatggagcatcccaccatgangcacttgaaggcagtgaagcaaattctcaggtatttgaaggggacaatcgactgtggccttgtgtataccgcaggaantggtgagatcacaatcacggggtacactgacagcgatctagccggagatgttgatgatcgtcggagtacaggaggtatggcgttctatatcaacaacagtttggtggcatggagctcgcagaagcagaagacagtaactctttcttcttgtgaagcagaattcatggcagccactgcagctgcctgtcatgcactttggctaagggcattgctgggagagctactcggtgaggaggcaaaattggtaaagttgtttgttgacaacaaatcagctattgctttgatgaagaatcctgtttttcgtgggaggagcaagcatatagatactcggtatcaattcattcgaagaacagcgtgcagatgcgctgacaaaagggttgccggcggcaaagctagtgacggcaaggtttctgcttagagttcgtgatcttggagaacgccaggcctaa

SEQ ID NO: 1199 - DNA, 2268 bp, Oryza sativa
  misc_feature (300)..(300): n = any nucleotide
  misc_feature (330)..(330): n = any nucleotide
  misc_feature (354)..(354): n = any nucleotide
  misc_feature (408)..(408): n = any nucleotide
  misc_feature (429)..(429): n = any nucleotide
  misc_feature (433)..(433): n = any nucleotide
  misc_feature (435)..(435): n = any nucleotide
  misc_feature (627)..(627): n = any nucleotide
  misc_feature (1324)..(1324): n = any nucleotide
  misc_feature (1465)..(1465): n = any nucleotide
atggcccctcgcaagccaaaccctgcttcggcgaaagggccggatcccggccgagtcgatgacgacagcaccgcctttttgggggtttctcttatggacgacgtcgagctggtgaagctggtcagctctggggcgttggttgaggggcaggctttcgccccagggaaagccgtggtgccgaaaccaatcgacaatcggacggtggtgttcaccgtcttttttaaggcagggctacggtttccctgcaacgtgttgttgccggagatccttcgcctcttccaggtggaacttacacagctnagcctgtcggcgcttgttcggatcgctatnttcgactgggcatgccggacttcngggtttgagcctaacgctgagtttttcggcgccatattcttcgccaccgtgaantcgaagacggtgattaccccngctngnacgaagaagaccgtgttcgggagtgtgaacttcaacgttcgtcccgagcggtccgatctctggccggtgaacgctgccatgtcgaagtgggaccgccattggatggctaggtggttctatcactccatccccttcgaggctggttctgactcgacaaaagccctccggtgccggcgcagggcgatcgcgccnaaccggaaacccaagatcgccgtggacggcgctttggaggcgcggttcgttctgctgcgcaaagtttgctcccgccttagctgccatgacttggtagaggaattctgtatgcttcgcatctttcccctctcccaggcatggcaagtcacggttgatcaaggcgaagaggttgacggtttgccgaacctgattcttcctgagaggacgaacacccgcaggatgatcggcgacgtatcggtcgtcgagtatagccagctgctaacacgacaagcgtctgggcaggcgaaccgggtttgtaacggcgagttgcctcctcgggcaaacccccacaaagcggacgacgatgcagggccttcgcaaaagcgaatgcgcaggcaagtgaagcttgcccctaggaagcgaagggtccttgcttcgtcggactccgacgccgacgacgaggacgatgccgaagaacgcgacggtgagaatgaaggagaggaggaagaggaggaggccgtggccgataaggccgcgaaagaggcgatcgaagatcgcgtcgatacccccggctacactcctaccccaagtccaggtcacaacgagaccggggtggagtcgaacagctccccccttcgacggaaggatctggaaggggcgaaggctctagttgcgttctccttgggaacggtggcgaagggaggtccggtgaagaagntctccaaaaagaaaggactcgtcgacatcgcccgcgttttcagcgacgacgagtcttctgacgagactccgacttcgcctgctggccgcagtttggacctctcgactgctccccttgctccgctcggcgttgctggggcangcggtggcgccgccgccggggcttccgcctccgccgaacggatcgtgtcgaccgcggcgagggttttcgggagccctgtgcgtgagccagctatttcgctgctggtcaaggcgaaggggaaattcttgcggctcactgttcgacggagcgaactgcgggcccgttttgacggtttcaagagccgtcttcgggccaaggatgatgaaataagccgcaagaacttggaggtggaggccctggcccacaccctcaaggaggcgaaggctgaagtcaaacgccttcagtccgaatgggataaggggaaagaggccagggccaaggttgatcgcctcaaggccgaactggagaaggagaaggcccattcagcggtgcttgtcgattactacaaccttactgagccaaagatagaggctcttcgccagaaggctagcagggccgaagcgagcgccgcagtggagtcggagcggtttttgcgggagatggcgaagaccaccgaatccgcgagaacggcttgccaaacgctccgcctcgcccttaccgacatgggcgcgaagcagttcggctgcgagcacgttgccgagttccctacctatgcgaaggggtactgggagattagtgcgcagaacatttcgcccgctcttcgcgcatggcgaaaacagttctggcagaaagacggccggtccgctgccaaggcgcgccttctggagcaactggcgaaggcggaggtggcagatcggtgcgaagaagagggcgcggtgggcgaagaggttggaggcgatgcccaggatcacccagacgtgtga

SEQ ID NO: 1200 - DNA, 2262 bp, Oryza sativa
atggccggagaaggatgggtgatgggcatcatttggcatgtgttggtacttgcccggaacacgattgtcgatgtttggggcggctggtcaatggagatcctgctcggcgccagcttcctgatgcagcttgtgctgaccttctctgccgggttccgttggcgcggggactcccccatgctacgcaacgtcatctggctcttctatgtaagcggcgactttgtggcgacgctcgcactcggccacctctctgtaagtggcacatccggcaagcgtcgtctcgtcgcgttctgggcgcccttcttcctgctgcacctcggcggccccgacagcatcaccgcctatgagcttgaggacaaccagctgtcggcgcgctatgtgctggagctcgtcctgcgagtcaccggagcggtgtacatcgtctacaagtccatttccggtagctgggccttggtcccggcagcctggctgatgctccttgtcggcgtggccaagtatacagagaagacgttggcgctccacggcgccaacctggccaatgtccggagatccttagagaggcagcagcaccgccatcacatgggaggtggcaaccaccattctcagcagctcgcgtttgcgacagatgacaatgatggcgcccttgtgatgaaggctcatgccctgttccacatctgcaagaactccttggtggactcgtcggtggatatagaatccacatctccttccaccgcgctgttcgatctcaggtggaaagagctgttcagggtgatggagatagagctctccctcatgtatgacttcctctacaccaaggccaccatcatccacacctggcatggctactgcatccgtgcgttgtcgccactggcgaccaccgtgtcactggttctggttgagctgagcaatgagggcggccgccgccacaagcaatcggacattgtcatcacccgtgtactgctggtggccaccttcctccttgagtcggcgtcgctgctcagggctctcagctcgacatggaccggcttcttgctgcatagcaagttgcaaccgggttggattcgccatgaagtcctgtgcatgagacggtggcatcgtttccatagcgtcatcatgtcccttggctggcccgccaaggtgcaagctcaccggcagtggttaggcaagatggggcagctcaacatgttgcagctggtcatcacccagaaggagctagagcgaccggcgccaaagggtggtcagttctgggacaaggaatatcagcgatgctcaaatgaaaccatgatcccagaaaatgtcaagaaactggtttctgagcttgtcagccgtcagttgaaggagttgagggattatgtgaaaaaggtggtggcgcaagaaggggcggatgcgttgtcacaggacgttaacttgctggagatggcagtgtacttgaggaagaagaggggtcagcaggcactagaaaagaacaatttgctctcggatctccgttggagcctcggcaatgagctccagctaggcatcctcacatggcacattgccaccaacatgttcctcttgttgtccggcaaagccgccaaggcgaagggtgacgaaggaccgaaggtgtgtgcaatcatgacactgtccaactacatgatgtaccttctcgctcttcgcccttacatgctgccgggcctggtcacccgcaagcttatcgaactgacctgcgaggaattggcccagatttggtccgaacatcaggcagcacctgccgccgtcgatgacctagagtcgtcgtcttctccgagcttctgcaatattagggtcttcatgcggggcaaattctcccagtggcacaatcgttggcgagtttctaccaggctcagtcacggcagggcggaggaggaggagcttgctaggatgctcatcgaaagggacaatgaaactgcccttaacaaatatctctctcgtggaatcgatgtcgcccagaaactgctcgacctagtagacttgcgcaaggagattgacatggtgcaggtgatcctggcggtgtgggtggaaatgctgttctatgcgagctaccagtgcagcaaggagtcccatgccaagcagctgagccaggggggcgagttgacgaccatcgtgtggctcatggcagaacacgccggcctgttccttgtcaacaaaaccagaaagggagctgaagaggctaactggaggaaaaggaaagctaataagaaaaaagaggccggaacgtctgatgctacagttaacaagctaagttaa

SEQ ID NO: 1201 - DNA, 2213 bp, Oryza sativa
atgggagccttagtacttgtggcaaccagcctgatgctgctgatactacagcatagtggtgcatctgacggggctagggctgggtctggaagtatctggcagccccagcccgattgtccagctccagcgaagtgcggcaacgtcaacattccctacccgtttggcataagagaaggttgcttccgaccgaagggcggctttaatatctcatgcaagcaagaacaagcttatattggatcagaccggacattagggtcacgaattttgatgtagtccagagtgaggctcgcatcctgaccgatataccatcagggacggtagcatggaagtacaacaatgaatttgatccaattgcatggacgtccagaggaggattacgacttggtaatcaccatatggtttccagcgccaagaacagattcacagcaatcgggtgttcaactgttgcattcatctacggcagagacaaaaatggtagcaatggacagtttgatcagttcaccagcttatgtggatcgttctgcttcgacgagggtagcatcgaagacggcccagagtgctccggcatgggttgttgccaagtccccatttcaaccaaccttaggaggttcagtttaggattctataattataacacaaccaaaaaagttcttaattttagttcacgcagctatgcgttcgtggtcgagaaggatcaattcaagttcaagagttcctatgccaaagcagacaatttcatggaggagctcgctcgtgggattcctataattctccagtggattgctggtaatgaaacctgcaaggaagcagccctgaaggagtcgtatgcttgcgttgccaataacagcaaatgcatcgatgtgatagaggcgcccgggtacagatgcaactgcacccaaggttacgagggaaatccctacctcaaagacggctgccgagtgttcagttgttaatattgcagacatcaatgagtgcaacgccacaagattcccgaattcttgcaagggcatctgcactaacaccgatgggagctacgactgtatttgcatcagcatcatcttcctcatcatctgtatctccactctgctgatcaagattcagagaatgaagctggaaaaagagaagcagaggttctacgatcagaacggtggccacatattataccagaaaattatctcagggcaagtcaatacagtggaaatattcacagaagaggtactaaagaatgcgaccaacaacttcgacagcggacaaaagcttggcgccggtggtcatggcattgtctacaagggcattctcagggacaacaatgtcgtcgccgtgaagcgctccaacttcctccacgtgacagacgccgaggaattcgtgcaggagatcatcatgctctcgcagatcaaccaccggaacgtggtcaggctcatcggctgctgcctggaagttgaagtgcccatactggtctacgagttcatctccaatggcactctctcctacctgatccatggcgatagcaggcggtatgcttcactgaaacttcgtcttaggattgctcaagaatcagctgaagcattggcatacctgcacctgtcgacgaaccggcctatcatccatggcgacgtggagtctctgaacattatgctcgatgatagctacacggtgaaggtgaccgacttcggggcatcacggtggctgtccaatgaagctgtcgagcaaattgcgatggtgcagggaacccgagggtacctggatccggagtacctgcaggagaggaagctgacggagaagagcgacgtgtacagcttcggcgtcgtgctgctggagctgatcactgggaagaaggcgatctaccgccacgatggcgatggcgacttcgagagcctcgcaggatcgttcctgcgggcgatggaggagagggtggagaacatcttggacacaagcttggctggtgccagcatggaggcgctgcccctgctccaggaggtcgccaaggtggggagtatgtgtctgagcgccaaggggaaggagaggccatccatggcggaggtgaccgacatgttgaaagctgtaagaattgcgtggagggatcttctggtttcatcggagtacaacgtgacggaggttttcgtcgacagttcagaagctcctccatctggcaacccatcttccgctgtgttctggacgccggacatgcagtctctagaagttgaaactttgag

SEQ ID NO: 1202 - DNA, 2167 bp, Oryza sativa
atggggaattgttggaaaaatttcaagacaacgctggtcacagagtacgtcctcaaccccgcccagccagaaccatttgggaaatacccattcatcacccaacccgtgtgggatgagttccatgccgccaaatcaacgaaagagcctcgggcaaaaagccaagcctaccgtgatctgcaggcaaggaaccttcacccgcaccggcttggcaccggaggctacgcggggaaacaggcagaatgggacaaggaggatgaagctgtagcggaatctaacacccagcaagtgcttgctgatatcccagtccagtgggcaaggaactgggcaagggcaagggtgaagaagaatagtgacgaaactctttcgttcccaaatcccgcagatcaagtggtgtaccagaaaatcgtcgaactgaatgctgagagacaggcctcctaagagagtacaagaagcacaagctttccaaggcgcagaaagctgcatgcattaaggcccaacttcgggaggagcttaaagaagagcttagagaagagctcactgctgagctgttaggtatggaggcttggatggaggcacgcatcagggataggtcgaccgatgccactcccggtcccatagtacaagtgagccccacgcagagacgtagcagctgcacatcaactgaggctccggtagaacagcctgaaggccccgccgcgggtggaccacataacgggaacccacatcgtgtaccctagtcgttagggtgacaccaggatttgcaattcctgccgctgagggtcaagcattcaagcctaccccggagacccgagtgcatggggcacagctgcaagccggcaatgccaaagttcaggtggacttagtgaagcccgattgggttggctacactatcccacacccacctaatgacgagattccgacccttggggctgcacatgggacctttattcaatggcccaagcacagcattgagatcaatataactccaaggccagcgccaagttctcgtccgctgccgacgtgtccccatcaaactgttatatctctccctcctgccgttgaacaaagagatgaagatatccaattacaatatgatactgattttggggacgacggtatggaggttgacagcaggccgcacctcccccctcttgccaaaaggagcaagagagagaaatcttctccaacccaagattgacacacgtagaaaagctgctggaacggggagaggaaaaataaaggtgccattagccccaaagaagcttgatcttggcaaggcgccagtagctcctccaaagcctccaaccgagtttacattgggcatgccattggtcagagacgatgccttatttaagatgggccctgcatgcaaggagttgcatgggtactacatggaaaagtccaatgcaaggagaaagaatagagagacctccatgttgggccagcacgatggtcagccattcctcgggcctactgccttcatcgccgtagacttcaaagatctatgggacctctacagggtgcgagcgatcgacaccaacctccttaagtgctactccttgttaacctggaagcatgtccatcgtaaagcaccccatgttgcctaactcgatccagctgtcgtcaacgagacaacgctgaaaaacgatcgagcaaacatggtgggctatatcaaggactgcttatttgcctgtcaagacaaggacttcattatgtgtgcctacaatcaacagtatgcgtgtaccgtactgatactcaaatactagacgcgtacaactgtagcgacattggattcttctggtaataacgctgaagtggagccgggtacactaccttaactccaatatcaagccagaaatatacgattggtcggccatcgaatctgccttgaacgaggcatgggaccaatatgtggcaagaggcgggaggcataaggatgggcatcccaaacttggtcacaagaaagacttcccaatacgtcaacaagttggcgaccagtgcgggttccatgtctgccataacatgatgagcttcgtagaaaaggtgacattgctcgaccctgagaggaatttatttcaagtattccggaaatcaacttcgaaatcattagagaggagatagcacaattcatactagatgatatcttgtcaccgaaagggatgtttag

SEQ ID NO: 1203 - DNA, 2104 bp, Oryza sativa
atgctaactgaacaaggagaggccccacgcgtgaaaactttccgcttcgaaaacttctggatccagctcccaggtttccaggaggtggtgacagaagcctggtcagccccccaaccacaccatgaagcacatcacatactcttccacaagctaggaaatacggcaataagactaagagcgtggagtaagaaactaatatcgcacgggagactgcacctccatatggcgctcgagattattctccaattcgatatagctcaagagtcaaggcaactcagccaagctgaactcgcgctaagaagaaacctcaaagatagggtgataggcctagcgatcgttgaaagagctcgcagaaggcaggcagcacgaatcaccaatctcagagagggggatgcaaacacaaaattcttccatttgaagatgaatgcaaggaagagaaaaaatttcatccagaggctacgagtgggaaacatgtggaaattaaaacacaacgaaaaagttgccgctctaaaagagcacttccagaccttcatggcgcgcccaggcccacgttcaaaagatctcgactgggacgtcctgcagctaccgactttcaactgctctgcaatcagtggtcccattactgaagaggaagtccatgctgcgctaaagcagtcccctagcgataaagcgccaggctcggacggcttcaccggagccttctacaaagcttgttgggaaacgataaaaggagacatcatggcggtcatccattcctttgaccagctgcgaagcaacaacctcccgatcctcaattcggcaaatgtggtgctcataccaaaaggagactacaggccaatcagtctcatacatggaataggaaagctaatttcaaaagtgctcaccttgcgtttgcaaccccacatggggaccctgatcagccacacccagagcgccttcataaagaaaagatacatacacgacaactttatgtatgtgagaaacctgacgagaaaattccatcagacaagaacgccaaccctcctgctgaaactagacataaccaaagctttcgatttggttagatgggattacctaatcgaccttatacagaggaaaggcttcacatccagatggactaactgggtctcaaacatcttagcctcctcgacaacaaagatcctcctcaatggatgcccaggatcgcctataaaacacggaagaggtctcagacagggcgaccccctttcaccgctgctcttcattctagcaattgacccacttcaccaccttctagagaaagcaacggagctagggcatctatccccccttcgaggaagagcccccaggttcagaacctccctctatgcggatgatgcggccatattcgtgaacccaagtgtccaagatatgacagctctcaccaacatcttaagtgactttgggcatgtgaccgacctctgaacaaacatgagcaaaagccaaattgccccaatccggtgtgataacattgatctctccagcataactaggatcttcccagcgggactcacaaacttcccaatgaagtaccttggtctacctctcgtggttggaagactcaagaaaatccacatccagcccctgagggacaaatgtcgatcgcgtctcgccccgtggcaagggaaaatgatgtcgaccgccgctagaatctgtctgacaaaatcagtcctcacggcacaacccatctaccacctaacatctctaaaactgccagacgggaccttagaggagttggacaaaataaggaaaaaattcctatgggcgggaggcgaaaatatctcaggggaaaaatgcaaagtcaactggaaaagagtctgcaggcctaaagattggggtggcctgggtgttctggacctgcaacgcttcgcatcagccctcagacttagatggctttggaacgaatgggtggcgccagacaaaccttgggtgggaactgtgctcccatgcaatcagctagataaagacctcttcgcggccgcaacaacaataacggtgggagacggcaaactgcgcgcttttggagctcgaaatgatccgttggaatctcacagcaaatggacagtactccgcaaaatcggcctat

SEQ ID NO: 1204 - DNA, 2076 bp, Oryza sativa
  misc_feature (801)..(801): n = any nucleotide
atggcctgggagggggttgtcggcgcggttgatgcagctagaatgtcgaagcaacaagtagtggaagcagagcacctgatgaaagctcttctggagcagaaggatggtttagcgcgcagaatattttcgaaagctggaatagataacacatctgtcctgcaagctactgatgagttcatctcgagacagccaaaggttggcgatacaagtggaccgatcattgggtcaagctttgtatcaattttggataatgcaaggaagcataagaaagaatatgctgatgagtttgtatctgttgagcacatattgcgagcattcacagaagataagaggtttggacaacagctgttcagagatctcaaaattggggagaatgagttgaaggaagctatctccgctgtacgtggcagtcagcgggtcacagatcagagtatgtctatttggcacagcgtattgtgcggggagatgttcctgaacctttacagaatagaaagcttatttcattggacatgggagcattacttgctggggctaaattccaaggtcaatttgaagagagacttaaggctgttctgaaggagatcactgcctcgaatgggcagatcatcttgttcattgatgagatccacactattgttggtgcaggctattgacctagttgatgaagcagctgctaagctgaaaatggagataacatcgaaacctattgaattggatgaggtagatagggaaatcataaggcttgaaatggagaagctctcattgaagaatgataccgataaagcctccaaacagcgactntctctaactcatattttcttatctttgttgtagactgacagagttaacctggagattgaagctgctgagagagagtatgatttgaaccgtgcagctgagctcaagtacggaacacttctgtcgctacaaaaacagcttgaagaggctgagaacaaactcatggaattccagcagtcaggcaagtcaatgcttcgagaagaggtgactgatgttgacattgctgagattgttagcaagtggactggtattccagtgtcaaaccttcaacaatctgaaaaggaaaagctactgctattggaagatgtactccacaagagggttattggccaagatattgcagtgaagtcagtggctaatgcaatccgtcgttctagggcaggcctatcagaccctaaccgtcccatagcaagcttaatgtttatgggtccaacaggtgtaggaaagaccgaactggggaaaacactagctgaattccttttcaacacagagaatgctctaatacggattgatatgagcgagtacatggaaaagcatgccgtctcccgtttggttggagcccctcctggctatattggttatggggaagggggccaactgacagaagctgttcgtcgtaggccttattctgtggttcttttcgatgaaattgagaaagcgcaccaggatgtgttcaacatcttattgcaacttttggatgatggaagaataaccgactctcagggcagaacagtcagctttactaactgtgttatcatcatgacttcaaacattgggtcgccattgattcttgatacgcttagaaacacatcagacagcaaggaggcagtttatgaaataatgaagaagcaagtgattgacatggctcggcagtcattccggccagagtttttgaataggatagatgagtacattgtattccagccgctggacaccacagagataaatcgcatcgtggagatccagttgcagctgaaccgagtcaagaaccggctgaggcaacagaagattcatctgcagtacacaccagaagctgtggagcatcttggctctctcggctttgaccctaactacggtgctaggcctgtgaagagggtgatccagcagatggtagagaacgagatcgccctcagtgtcctgaagggcgacttcaaagaagacgacaccgtcctcgtcgacgtgagctccgtggcgatcgcgaaaggccttgctccacagaagaagcttgtcctccagaggttagagaatgcaaacttagagttagtcgccaatgactag

SEQ ID NO: 1205 - DNA, 2056 bp, Oryza sativa
cacatggcgctcgaggttattctacaactcgatatagcccaagagtcaagacaaatgagccaagccgaactcacactaagaaggggcctcaaagatagagtactggggattgcagttgtggaaagagcccgtaaaaaacaagctgcacgaatcacctatcttaaagagggggatgcaaacacgaaatttttccacttgaggatgaatgcgaggaaaaggaaaattttcatccaaaggctacgagtggggaacatgtggaaattaaaccatgaggaaaaagctaccgctatcaaagaacacttccaaaacttcatggcacgcccaagcccacgcttaaaagacctttcccagcgacaaagccccgggcccggatggcttcacaggagctttctacaaagcctgctgggaaacgataaaagatgacatcatggtggtcattcactccttcaaccatttgcgaagcaatagcctctcgattctcaattcggcaaatgtagtgcttataccaaaaaaagatggggcagaatgcgtgggggactacaagccaattagtctcattcatggaatcaggaagcttatttcaaaagtgctcgccctacgtttacaaccgcatatgggctccctgatcagtcatgcccagagtgccttcatcaagagaagatgcatacacgacaactttatgtatgtgagaaacttgacgaggaaattccaccaaacaagaacgccgactctcctcctaaagctggacataaccaaagcttttgactcggtgagatgggattaccttatcgatctcctccagagaaaaggcttcacatctaggtggaccaattgggtctccaacattcttgcatcttcaacaacaaggatcctgctcaatgggtgcctaggaacgcctataaagcatggaagaggccgcagacaggaagaccccctctcgccgcttctattcatcctcgccattgacccactccaccacctcctagagagagcaatggagttagggcatctatccccacttagggggagagcccccaggttcagaacctccctctacgcggatgacgcggcaatctttgtgaatccaagcgttcaagacatgacaaatctgactggcatcctaagcgactttgggcaggtgaccggcttctgaacgaacatgagcaaaagccaaattgccccaatccgatgtgacaatattgatctgtccagcattaccggcatcttcccagcaggcctaacaaactttccaatgaagtaccttggcctaccccttgtggtaggtaggctaaagaaagtccacattcagcctttgatggataagtgtcgatcgtgcctcgccccttggcaagggaaattaatgttgaccgccaccagaatctgcttgacaaattcggtcctcactgcacagcccatctaccacctaacatctctaaagctgccagatggaaccatagaagaacttgacaaaatgaggaggaagtttctttgggcggggggcgaaaacatctctggcggaaaatgcaaagtaaattggaaaagagtctgcaggcccaaagacctgggtggtcttggagtcatggatctacaacaattcgcatcagcactgcgactcagatggctttggaatgaatgggtggcaccagaaaaaccctaggtggggacggcgctaccgtgcaacaagttagatagagatctcttcacggccgcaataacaataacggtgggcaatggcaaaactgcacgattttggagctcgaaatggattcgatggaacctcacagcaaacgagcagtactctacaaaatcggcctatagactccaattccttggggctgcgcgatccatcttcaaccaatcaatctggaaggcctgggcgccgccaaagtgcaaattcttctcctgattggtcactcaaaacagggtttggacggcagacagactggagaaaagaggatggcaaaaccaaaagatctgcccactctgctgcatggtggatgaatcggccctacacctcctggccaaatgtaggctaacaaagagaatatggacataa

SEQ ID NO: 1206 - DNA, 2043 bp, Oryza sativa
  misc_feature (389)..(389): n = any nucleotide
atgcacactctcctattgtctttcctctttgtttccatccttcatattcacacaactagttccaccggtactgaaaatttcgatgcatctaggctagacacatatatagtgcgtgtgcgtccaccaccaaacttctcaattgacatgagcaacatcaagcttgagaagtggtacagatcatttctcccactcttgacaacgcacacaccagatttcctagggctgcgtctcagggaaggatcctggaaaaaaactagcatgggtgagggtgtgatcataggtgtccttgacacagggatagatttcactcatacctcatttgatgatgatggcatgcaggagccacccactaaatggcgcggctcctgcaagtcatctctgatgaaatncaacaagaaactcattgggggtagctcattcattcggggtcagaaatcagcacctccaacggatgatagtggccatgggacacataccgcaagcacggcagctggcggttttgtagatggtgcaagcgtgtttggcaatggaaatggcacagcagctggcatggctcctcgtgcacaccttgctatctacaaggtgtgcagcgataaaggttgccgtgtatctgacatacttgctggcatggaggcggctattgctgatggtgttgacatcatgtctatgtctcttggtggtccagcgaaaccattttacaatgatataatagccactgcatctttttctgccatgaggaaagggatctttgtaagtcttgctgcaggaaattctggtccatcttccagcactctaagcaacgaggcaccatgggttctgactgttggtgccagcacgatagatagacaaatggaagcccttgtcaagctaggtgatggagacttatttgttggcgaatctgcttatcaaccacataatcttgatcccttagagttagtgtacccacagacttccggtcaaaattattgcttctttctgaaagatgttgcaggaaagattgttgcctgtgagcacacaacctcatcagacattattggacgcttcgtcaaggatgctggtgcatctgggttgatcttgctaggtcaggaggatagtggccacataacatttgctgacccaaatgtcctaccggtgtcctatgtggatttcccagatgcaacagtaatcagacagtacattaattcaagtaacagtccaactgcctcaatcatcttcaatggtacctcattggggaaaactcaagctcctgtagttgcatttttctcatctcgtggccctagtactgcgagcccaggtattcttaaacctgacatcattggtcctggagtaaacgtcattgctgcctggccgttcatggaagggcaagacgcaaacaatgataaacacaggacattcaactgcttatctggaacatcaatgtcaactcctcaccttagtggcattgctgctctcatcaagggaacacacccagattggtcatccgcagcgatcaagtccgcaatcatgacaacagcttatgttgttgataaccagaagaaggcaatcctggatgaaagatacaatattgcagggcatttcgcagttggtgctggacatgttagtccttctgaagccattgaccccggtctgatctatgacattgatgatgcacaatacatttcatatctctgtggcctgggttacacagatgttcaagttgagataattgcaaatcagaaagatgcctgcaaaggaagcaaaataactgaagctgaacttaactatccatcagtagcagtaagggcaagtgctggcaagcttgtggtgaaccggactgttactaatgtgggagaagcaaattcaagctacaccgtggaaattgatatgcctagggaggtgatgacaagtgtgtcaccaacaaagctagaattcaccaagatgaaggagaagaaaacattttcattaagcttaagttgggatattagcaaaactaaccatgccgagggaagcttcaagtgggtatctgagaagcatgttgtgaggagccccattgcaattttttag

SEQ ID NO: 1207 - DNA, 2036 bp, Oryza sativa
ggtatggcggattctaaggagtttgcaagcgaggtgtttgtggcattggcgagaaggaggagcatcaaaccagaagatgggataacaaaggaacagctgaaagaattttgggaggagttgactgatcagaactttgattcacgactacgaatattctttgacatgacaagaatggtgatgggcagcttacagaggacgaggtcaaagagattgtgttgagtgccgcagcaaacaaacttgccaagttgaaaagccatgctgcaacctacgcctcactgatcatggaagagctggatcctgatcatcgcggttacattgagtggcagctggagacgctactccgtggtatggtgacagcccaagggcctccagagaaggtgaagctggcttcagcaagccttgcaaggacaatggtcccttccagtcaccggagtccaatgcagaggcgtttcaacaagactgttgacttcatccatgagaattggaagaggatatgggtgctctccttgtgggcgatcctcaatattgcattattcatgtacaagtttgtgcagtacagtaggcgggatgcatttcaggtgatgggctactgtgtctgcatagcaaagggtgctgccgaaacactcaagctgaacatggccgttatactcctcccggtgtgccgaaacacactaacaaggctccgatcaacagcactcagcaaagtcgtaccatttgatgataacataaacttccacaagtgcgacttcccaagattggtatcatgtccaagggacaagttcgaggccacactggggccttacttcaactatgttcaaccaacatactcatcgctggttgcaagcactccagggtggactggcatcctcatgatcttgataatgtcattctcgttcacacttgcgacacattcgttcaggaggagcgttgtgaagcttccatcaccactgcaccaccttgctggtttcaatgccttttggtacgcccatcacctactggtgattgcatatatcctcttggtgctgcactcctacttcatatttctcaccaagcagtggtacaatcgaacgacgtggatgttcttggcagttccagtcctcttttactcctgcgagagaactatcagaagagttcgtgagagcagttatggggtgaccgtcatcaaggcaatttaccctggaaatgtgctctctattcacatgaataaaccatcaagtttcaagtacaaaagtgggatgtatatgtttgtaaaatgcccagatgtttcgccttttgaatggtaccatctgatcgtctctgtccaaatcatcccttctccataacttctgcacctggagatgactacttgagtgttcatatccgtacattaggtgactggacaacagaacttagaaacctatttgggaagcccaaagtctttatagatggtcctttcggcgcaccagctcaaaattacaagaaatatgacattcttttgcttatcgggcttggaattggagcaacgcctttcatcagcatactgaaggatctcctgaacaacatagcttatttctactgggtcaccagagagcaaggttcctttgaatggtttaaaggcgtgatgaatgatgttgctgaaagtgatcatgatgtactactcagtctaactgcttcagtgcaacttccatgttctctccttcagattaataaatagatactaacataatcactcactatacagaatgtaatagagatgcacaattacctgacaagcgtgtatgaagaaggagatgcaagatcagctctgattgccatggtccaatcacttcaacatgccaaaaatggtgtggatatcgtctctggcagcaagcggacacattttgcaaggccgaactggagaaaggtattctcagatctggccaatgcccaccagaactctcgtatagggcgttttctactgtgggtctccaacacttacgaaaatgctgagggatctttcactagaattcagccagacgacaacgactcggttccatttccacaaggagaacttctaa

SEQ ID NO: 1208 - DNA, 2034 bp, Oryza sativa
atgaatcatttatcctatcttctacagttcttcttcctcttcatctctaatctttcagctctcgccaccggtgaagaccaattcatatactctggcttcaatggtgctaacctcaccctcgacggcgtggcctcggtaacaccagatggcctgcttaagttgaccaacggaaccttacggctccaaggccatgcctttcacccaactccattcagtttcaagaagaaacccaatggaacagtgaattcctttgctgtctcctacatatttgccatctactgtctccggcctgtcatctgcggccatggcatagcttttgttgtttccgtgagcaaaaacttctcaaccgcaatggcaagccagtaccttggccttataaatgaccacaacaacggcgatccaacaaaccatttcttcgctatcgagctcgacacgaaccaaaatgatgagttcaacgatgtcaataacaaccatgttggaatcgacatcaacagtcttacatcactgaactccagcagcgtgggatactacacagacagtaatggtaacttcaacaacattacactcactagttacaagatgatgcaagtgtggctagaatacaatggggacaacagacagatcaatgtgaccttagctccaataaaaatggccaagcctgttaagccattactctctacctactatgacctctcaacagtgctcacagacatggcatatgttggattctcatcatcaacaggctcattcgttgcgcggcattatgtgcttggctggagttttggcatcaataaacctgcaccagccattgatatcagtaagttgccaaagctaccttatgaaggtgagaaaacccattccaaggtcttggaaatcactctgccaatagccacagcaacatttgttcttgcaatgatagctctcatcattctactcatccgaaggagattaaggtatgctgagatacgagaagattgggaagttgaatttgggccgcatagattctcatataaggatttgttttgtgctacggaaggatttaagaacaagaatctactaggaataggagggtttggaagggtatacaagggactacttccaacgtctaaattggagattgctgtgaagaggatctctcatgactccaaccagggtatgaaggaatttgttgctgagatagtcagtataggtcacctccaacaccgcaatcttgtgcagttacatggctactgccggcgaaaaagtgaacttattttagtgtatgattatatgtccaatggaagtcttgacaagcatttgtatggtcaagagaacaattctactttgacatgggcccaaagattccaaataataaaagatattgcatctggattgctttatctccatgaggaatgggagaaagtaatactccatcgagacatcaagccaagcaatatacttctcgatgacaacatgaatggacgactaggcgattttggcctagcaaggttatatgaccatggaaccgaccctcaaaccacacatgttgttggtaccataggatacctagctcctgagctagcacgaactagcaaagcaactccccttaccgatgtatttgcctttggcatgtttgttcttgaagtcacctgtgggcgaaagccgattgaccacactgcacaagacaatcaactgatgttggtagattgggtgcttcattgttggcaccaaggatttctaaatgatgcagtggatatcaaactccaaggtgtctacaatattgatgaggcgtgcctagctctgaagttaggactgctgtgtgcacaccctttcatcaataaaagacccagcatgaggcatgttacgcagattctcaatagagagatggaactaccagagctaacaccaacacacatgagcttcaacatgctctccttgatgcagaaccaaggttttgatccagagaccatgacaaaccagtttctaatatcaaacagcacactatctgacctctcagaagttagatctcatacatggtctccctatgatatttaa

SEQ ID NO: 1209 - DNA, 2009 bp, Oryza sativa
  misc_feature (207)..(207): n = any nucleotide
gtagcgtactccctggccttggctgtcggtgcgccgtgcgcccgcggccgcgactacgacgcgcgctgcgtgtgcgccgtgcgcggctcacgggaaaccaagccgtttttaatacccgcgccggtcaagccacaccgccggcatgtgacagtgcgcgcgccgcatacgtacgcagcagcgtcactcgcggctcgggctcggggattncgtgagcgccagcaacacagcgcgcgcatgcatggcggactccacggccatgaccgtcgacttcctccgcgcgcggctgctctccgagcggtccgtctcccgcgccgccaaggagcgcgccgaccagctcgccaagaggcccaagtaccggatggggcagtcctgccgcaagaacaagcgcaaggagctcagagtcagaaggggcagcaagatggatcggattgcaccgacgacggccaggcggacatggacggcgaggatactggtggtcagtatgtgatcaggtacgagaaggacggcgagatggagagggtgctcgagaggcaggccgagctgatcggccagtatgaggcggaggaagaagctcagaggcagtgggagaagcagttcaacgagaatcggagctcagccaaggctcaggttcatgttgaggcagagaataaggcgtgccagatagaaaatggttgggagcagagcaaggagcatgctaggctcgcggatcaagcggtacattgcaacgaagaggcaaaaccaggcgttaaaaatcaccccagcgccagcaacaaccgctctgctggccttctgttgaatgattcccttcctgaatcacacgcatcaggacaagaagctgctgccgaccaacgtgacgcgcacgaggagcatcacgaccactgtcatgcacagtctcaaggaagctctaatgtcgccggcacaatgacagggaagaatcaagaacaaggaaacgagaatccggatggatgttcaagctactgtgacatcaaagcgccatcagatggaagcccgtcaatgagtgatgccaccctgaacagcaaggtctctgactggagctcatcaagcttccatgaccatggcgacaaccaggtcgatgcagggccagatcaacagccaacaagcaacatggacatagagagtgttcttcaggcacttcagcttgccaggatttccctgagtcagaagctgagcaagccagttccacccagccaggtgacgctggcgcttcctgcaccaggggacgatgaacattcagaagacgacggctactcccccgtcgacgacgagttcacttctgcaagagatgagctctgcagctcaagccaatctcctgagcaggagatactggctctccctgcaccagaggactaccatgacagggagaatttgcctgtcaatgacgacgctaccatttcactgacagaggaacagaccagttcaagcccacaccggcaggagatcctggctctcccggctccggtagatgattaccacagagagatagtggatgacatcaagatacctatctgcattgccgggttgtttcggttgccaacagactcatttccaaaggacgagacgctctcaacttgcagcatttgcttgatatccttgcataaagaggaagatcggattatacacgttctcttggattcgatacctttggaatactccgtaggggaagtgctacatcggtatattcgtgcgcttgtggattttatctgtgattgtaagaaataccaaacagcgccctactcgtcgtcgctcccggtcgctgcgaacccatcacccaatgccacagctgcccccaccgccgcctacatgcccagctgggggatgacgttggagaacgacccttcatcggtgttgtggtggccgtgtcggcatcctccgcgacatccttgtcattgctcctggtcgctgcggacctgtcacccggtgtcgcggccaaccccaccgccacctccatgcccaagcatcgcatcaagccgctagcctgcaatttatga

SEQ ID NO: 1210 - DNA, 1985 bp, Oryza sativa
atggagagggaagtaggagctgaaccgcaattctatcgcctttcttagcatcttttctcatctttgtgaggcctatattggggtagagccctttctcgatctctttcgcttctactacgagctgtgttggatggagtccaacagggtgtctggatgcgtcgggttccgacttcgggattgcctgaagtcgcgttatatccccttccagtgcccttcctctcacagcaaatggcgaacgaggtggttctaccttcagatcgaagattcggaccctgtcttcgttgttccagaggaacaaccggataagatttcgtcttggaccgcaaagccccccttgaccccttctctccagtcgttcatcgatattgtcgacgatctccgagtacgaggttgttctggttcacaggtctgaacagcgaaaccgtgggacgtcgtgtcggccaggtgatgatcagtggcccgacaacggcgagtaacatccatgttcccctttgtgagaaggaggcagccgaacgtgacactgccatcaatgctcttcctctgactgacatcatcgggccgctcgctgaccatcaggtggtggcgtcactgaaggagaaggtcgccaaggaggcgtccgatgctgctgctgctaccacaagtggtggcaatgttccgacaaaggggaggaagttctcctctgtaagcggacatcgtcgcaaggcatctaccccctcgatcctgttgtctgatcatacagccagaagaatttcgccttacttcgcatcaaccgttttccaggcctcggacgcgtctcccccgcctccacgacgacaacgacttgtgacacttggcgagaagaaggcggcgcaagatgagtccggagggacttccggcgcgtctcccgctgtggcctcgacggatgtcgtgcttgcgcccgggagccgcgaggcaacaccaagcggcccagccagcgatcccgcggctggtcgtggtccaccggctgccgtcctcacctgggaggagctccaggtcgaaatggggcgcctcctcgaggctggtgctcgtggcattggtcgcgagattgcggaggcgagctcgccggggagtgcggcatcaagtctaccatcccggcgaatcccgatgagttttcactgacatcttctcttgcgaagctggcggcggcgatggaggagatcccctccaagcatgcggccaggatcggggaggagacgtccaacggaatctataccgggacatgccacgtccttgcgtgtgtgaagctggcgcatcctgaactcgatctccgcgagatcttggatcagggggcggctagcgatgcgcgtaaggaggtgatggaagaagtcggcgatctgggggaatctgttctccctctttttgaagaggagatgttgatgatgaggatgtccagcagcgcgggcagcctgagtcaccggcgatcatttcggctctcgcgtttgaaccacatgctcgagagtgctcttgctggccaagatcgtcgtatccaatattggaagacaaaatttgaagtagcggaactcgagagaaccatgcttgcagtgaagaaaaagaaggctgtggaaacgctccgaggtcgtgaggtgtggttcaactcgtacttgaagagttgctgcacatccatggccaaggtttgtagagagctccgagtaccccgtggggatcccaaggagtcggcagccggatacatctcgtggctgaacggggcctgtgctcagctcgatggcgtcggcaaacgcatcgacgaggccttgaagcaggagtgtcgtcgatcgagccgatatgccggagggcacgtgttggcttgcctacgagatcatcgcccgcgcctggacctcgattttctccgtgaaggttttgctcgttcccggaggactccgacggagatagaccaactggcgaagtcgatggcgccattggcggagaaggtcttccaatctatggactggcgttggccttcttggtag

SEQ ID NO: 1211 - DNA, 1975 bp, Oryza sativa
  misc_feature (1507)..(1507): n = any nucleotide
cggtggatggacagacctcgaccacttcaacccacgttgagtccgatctcccaccaccgcctcctctttcggtggatttgtgctgtgccgtcactttgcatcagtttggtctttggctctgtcggaatctagtcaatctatatcctagtatagtctccagtgtgagaactaagcgaattggtactgaattagcacgcccacgtccgcactggcacaatcgattgattttgaagctgggagaatttatggagtttgaggatgctaaagaaatttctgttttgtttcatagatttcatgtgagcttcacttttgataacgccattccgatgttcatgtcccgtacacataatgttcatgagactttcggacctcataaaaaggcaatcggtgatggcaaagaagtttggtgcggcagtggtctcccctgagcatcggtactacggaaagagttccccttttgagagtttgacaacggaaaatctaaggttcttgtcatcaaaacaggccttgtttgatctggctgttttccgccaatattatcagaggaaactttgaatgctaagtataatcgctcaggagcagacagttcttggtttgtttttggagggtcgtacgctggagcacttagtgcttggttcagattgaagttccctcacttgacatgtggaagtcttgcgagttcaggagttgttctttctgtttacaactatactgactttgacaaacagagattggtgagtcagctggccctgaatgcaaagcagcactacaagaaacaacaaaacttgttgacggacaacttcagtctggtcgcaatgcagttaaacaactctttggagcatcaacggttagcaaatgatggtgacttcctctttctactggcggatgcagcagctattgcggtatgctaaatagttccaatacggtaatcctgatgctttgtgctccccaatagttgaagcaaagaagaatggcacagatttggtgaggaaacatttgctcgctatgtgaaagattattacataggaacatttggagcatcagttgcatcatatgatcaagaatatttgaagaacacaactccacctcctgctgaatctgagcatataggttatggtggtaccaagtttgcagtgaagttgcatatttccaagtggctccaaaaaatgatagtgtccgttctgcaaagattgacacaagaggtaccatttggacttgtgcagaaatgtttttggggaaggagtttaccctgatgtattcatgacaaatttatactatggaggcacaagaattgcagtgcaggttcgaaaattgtttttgcaaacggctctcaagatccatggcgccatgcttctaagcagaaatcatcaaaagaattgccgtcatacttaattgagtgcagcaattgcggacattgcagtgatctatctggatgccctcaagctccttcacatattgaagaggtgactcgtctaattgttcatctccagaagctgtgaacaaagtnagaaagcagatcgtcgatcacattgatttatggttatcagaatgtcaagagcaagaggacacgacaatgagccattgctgggcagtagatggagcatagctacttaactgaattaacctgctcgagctaccaaccatatgttcaaaaggcccatgagtacaagacaatgccagctgtcatttagactagtatgattcactcaaataatacggacagttggttgttccaagcattctcatggtaccaagcattatcctcaggactgcggtaacaattgctcaaacactactatggtgacgacctctgtcatttgtcaataaccttacaggttgctctcaggctcccccattctgcagaagattaccatgatatgtaaaatgttactgaattatgtacaagataaactttgtttattcatgagactaagatattagataaccgggtacatcctactccaaccatttttaa

SEQ ID NO: 1212 - DNA, 1949 bp, Oryza sativa
gatgagaagtctaatttctcaggttatgaaatctattctggaaaactcagactcacaagtaaagccctaatatggggttctgtatcttacagttctggtgtccaacatttcattgtgcatgcatacccttctaagaagtatttgtttggaaagacacacagagtacggaaggacctccggtttatagcccctactgtagaggaggccatttcatgggtaacatgctttgccgaacaaaacatatatgttaacatgctacctctccctccaacatccagtaccgagcaagaccttgatggtcccctcagtggtgctttatttgaccacccacccatcaaatgtagaactccaccgaggatacttgttatactgaaccctcggtctgggcatggtagatcatgcaaagttttccatgacaaagcagaacctatttttaagagcttgcaggttttcacatggaagtggttaaaactactcatgctggtcacgctaaatctcttgcatctacatttgattttagcgcattccctgatggtataaacagcacagatgttgccaaggaatcgtgtgtgtaggtggtgatggaattgtaaatgaggtcttcaacggtctactcagtagaagtgatagagcagaggctgtatcaattccagttggaataatcccagcaggatctgacaattcacttgtttggactgttttgggagttaaagatccaatttcagcatcattactaattgtgaagggtggctttactgccctagacatcctgtctgttgagtggatccagtctgggctaatacactttgggacaactgtttcatactatggttttatcagtgatggtcctggagctttctgagaaatatcaaaagaaatttggccctcttcgatattttgtggctggaatactcaaatttttttgcctgccaagctatttctatgagttagagtatcttccttcttcaaaggagatgactggccatggaaaaggtataggacaagaaaactttgtgtctgatgtatataccaatgtaatgcgcagccgatcaaaaagagaaggaattccacgagcttccagtttgtcaagtattgactctattatgactccaagtcggatgtcacttggggacgttgatacatcaggtagcacagcagcaagcactgaaccttcagagtatgttcgtggtcttgatccaaaagcaaaacgcctttctttgggcagaagcaacattgtttcagaaccagaggaagttttacaccctcaaccacatcattcatcattctggccaagaaccaggtccaaaacaagaactgagagaaattcagttggtgtcactactaacgatacacgattatcttgggcagccccatcaattcatgacaaggaggacatttcctcaacaatttcagatccaggacctatttgggactctgaaccaaagtgggacaatgggccaaaatgggatacagagctaacctgggagtctgaccaccctattgaactccctggaccaccagaagacaatgaaattggaccatcagtggaacttgtgccaaatttggatgataaatgggtagtcaggaaaggacactttcttggtgttctagtttgcaatcattcatgcaagacagtgcaaagtttgagttcgcaggttattgcaccaaaagccaaccatgatgacaacactttggacttgctcttagttggtggaaagggtagatggaagttgttgaaatttttcatacttctgcaatttggtcgccatctttctttgccttatgtggaatatgtgaaggtaaagtctgtcaagcttaaaccaggtgcaaacacgcacaatgggtgtggaatagacggtgagctttgccgcgtcaagggacatgtactctgctccctgttacaagagcaatgcatgcttattggccggcaaagcagacaatctacttaa

SEQ ID NO: 1213 - DNA, 1897 bp, Oryza sativa
atgcggaagcgggatctgggcatcctcctcctcgccgccttcgccgtcttcttctcgctccagcagcacgacggcgacctctccttccgcgaggcctggtaccacctctccgatgccgactaccccatcaagcacgacgccgaccgcctcccctctcccctagtcgccgacctcaacggcgacggcaaacccgaggtcctcatccccacccacgacgccaagatccaggtcctccagccccaccccaggccctcccccgacgatgcctccttccacgacgcccgcctcatggctgatgtctccctcctcccctccaacgttcgcctctcctccgggaggcgccccgtcgccatggccgttggcaccgtcgaccgccactacgcccacgccccctccccctccaagcagctcctcgtcgtcgtcacctccggatggtccgtcatgtgcttcgaccacaacctcaaaaagctctgggaggctaatctccaggacgatttcccccacgccgcccaccatcgcgaggttgccatttccattaccaactacactctcaagcatggggatgcaggtttggtcatcgtcggaggaaggatggaaatgcaacatcatcaggcttctgagacaggcaacacagacctgcgtcattttgccctttatgcttttgctggccgcactgtccgatgcttcagtgctgataccacaacacaattacaagcttgatgcccatgcccttaatagtcgtcatcctggtcaggataggagagaggatacttttctgcaacttgcccattttaggaggcataaaaggaaagcactgaagaaaacacctggaaaagctgttgtaaataacgtgcacaagcccagtgaacataatccacctggaaaggatgtttccaataggttagcaaatgtgattgggaaagctgcagatatggctaattcaaataaaatcaagaagtatgttccgacaatcaccaactatactcaagtttggtgggttcctaatgttgttgttgcccacgaaaaagaagggatagaggctgttcatctagcttctggacgtacaatctgcaagcttcatttaacagaaggaggccttcatgcagatattaatggagatggggttctagaccatgttcaggagcaaacagttgttagtggttcaatggaagtgctgaaaccttgttgggcagtagctacatctggtgtgccagtgcgggagcaactttttaatgtttctatctgccattacaacaatttcaatttgtttcatcatggtgacttttcaagaagttttgggaggacatttgatacaactggcttagaggtggcgactcctattctgctccagagagatgatggtcataaacacaggagaggaagccacggggatatcatctttcttacgagtcgtggggaggtgacctcgtactctccaggtctacttggtcatgatgcaatatggagatggcaactgtcaacaggtgcaacatggtccaaccttccgtctccatcagggatgatggaaaacattgtagttccaactttgaaggctttctctctgcgagcctatgacccaaaacaggtaatcatcgcgggtggtgatctggaggctgtggtgatttctccttctggtggtttattggcatccattgaactccctgcacctccaacccatgcgctggtacttgaagatttcaatggtgatggtttaactgatattattctggtaacatcggggggagtctatgggtttgtgcagacaagacatcctggggctcttttcttcagcacgcttgtgggttgcttgatagttgttatcggagtgatatttgtttcactgcacctcaactcctcgaacagcggtaaacctagggcttcaaccgactataggtga

SEQ ID NO: 1214 - DNA, 1896 bp, Oryza sativa
atgctgccaccgccggccgccgcggccgccgcgctcctgctgctcctggcgctctccgccggggccaacgacatcgcgtcggacgccgcggcgctgcaggcgttcatcgcgccgttcgggtcggcgaccgtgtcgtggaacacgtcccagccgacgtgctcgtggacgggcgtcgtgtgctccggcggccgcgtcgtggaggtccacctcccgggggttggactccgcggcaacgtccccgtgggcgcgctcgggggcctcgacaagctcgccgtgctgtcgctgcgctacaacgcgctctccggcccgctgccgtccgacctggccaagtgcgcggagctccgggtaattaatctgcagtcgaatcacttctccggcgagctccccccggagattctggctctcccggcgctgacgcagctcaacctcgcggagaaccgcttttccgggaggattccggcgagcattgccaagaacgggaggctacagctgctctacttggacggcaacctcctcaccggcgagctgccgaatgtcaacatgccattgctcacctcgttcaacgtctccttcaacaacctcacaggcgggatacccagcggtctcagcggcatgccggcgacgtctttcctcggcatgtcgctgtgcggcaagcccctcgccgcttgccgaacgccgatttccatcccaccgtcgcaggctccggcgctctcgccagaaggcgcggtctcggcggtcggccgcgggaggggcggacgccgcctagccggaggagccattgccggcattgtgatcggctgcgcgctcggcttccttctcgtcgccggcgttctggtcctcgcgtgtggcgcgctgcagcgcaagccaagaccgcaccacagccgtgacgtcgcggcggagctcgccttgcacagcaaagaggcaatgagcccgagcgtgtacacgccgcgcgtctcggacgcgcggctgccgccgccgccggcggcggtggtccccgcgatacaaccggccgtcgccgccaacgtcgcaggaaagaagaagctcttcttcttcgggagggtgccgcggccgtacgacctcgaggacctgctgcgcgcgtcggccgaggtgctcggcaagggcacgtacgggaccacgtacaaggccgcgctcgagaccgggccggtggtcgccgtgaagcgcctcaaggagacctcattgccggagcgcgagttccgggacaaggtcgcggcgatcggcgggctggaccaccccaacgtcgtgccactgcaggcctactacttcagcaaggacgagaagctcatggtgtacgagttcgtcgccatgggcagcctctcgtcgatgcttcacggaaaccgtggctccggccggtcgccgctgctctgggagtcgaggaggcgcatcgcgctggcgtcggcgcgcgggctggagtacatccacgcgacgggctccaaggtggtgcacggcaacatcaagtcgtcgaacgtggtggcggacccgtggcggctgtcgcagaaggccgacgtgtacagcttcggcgtgctgctcctggagctgctcaccgggaaggcccccacgcacgccgtgctgcacgacgacgagggcgtggacctgccgcggtgggcgcgctccgtcgtgcgggaggagtggacgtccgaggtgttcgacacggagctcctcaggcaccccggcgccgaggacgagatggtggagatgctgcggctggcgatggactgcaccgtgaccgtgccggaccagcggccggcgatgccggagatcgtcgtgcgcatcgagcagctgggcggcgcgggctccgcgcggaccgcccggagcgtgtcgatggacgacgccgacgaccggccgctcaggcccgccgggtcgacccgcgagagctga

SEQ ID NO: 1215 - DNA, 1876 bp, Oryza sativa
atggcagagcagccaagaatcaactcagcattagtttctgttatccgtatggctaaggtttcaaagaatgccaactcagctgtctctgcagctgcgtatcattacatacgaaatgatgatagacctgacaaggcttttacaactgaaagggctaagagggctggaaaagctaatgcttcaagtggccagatctttgttactatcccacccgaccattttggccccattcttgcagagaatgaccccaagagaagcattggtgttctagttggggatacatgggaagacagacttgagtgcaggcaatggggtgcccattttcctcacgtggctggtattgctggccaatccacacatggtgctcagtcggtagccctctcgggtgggtatgtcgatgatgaggaccatggggaatggtttctatatactggaagttatacttgtacagtggtggaagagatctaagtgggaacaagcgtacaaacaaggagcagtcctcagaccagaaatttgagaagctgaatgctgctcttcgtattagttgcctcaagggttaccctgtcagggttgtgcgaggtcccacaaagagaagcgttcttcatatgctcctgaagctggtgtgaggtatgatggagtttacaggattgaaaaatgttggaggaagattagtgttcagtagggtaaattcaaggtttgcaggtatctctttgtacgttgtgacaatgaaccagctccttggactagagtgatatttatggtgaccgtccgaggccactccccaaagttgatgagctgaaaggtgcaacagacatatcagagaggaaaggaactccttcatgggactttgatggagaaagaaggctggaagtgggtgaagcctccaccaatcagcagaaagcctaacctatcaggggatcctgcaactgacaaggaaatccggagggttgcaaggcgtgcccagatgtctgtgactgaaaggctgctgaaagagagtttggatgttccatttgcaagcaagtgatgaaggaaccactcactactccatgtgctcataacttctgcaagttgtgtttggttgggacatatggtagtcaatcgtctatgagggagagaagccggggtgggcggactctaagggcacagaagattgtgaagaagtgcccttcatgtccaactgatatttgtgacttcctagagaatccacaggtacaacaagtttatcagatcaatcgagagatgatggatttgattgagtccttgcaagaaaggctgttgaagaaggagataccaagacaagctcagatgttagcaatggtgctgagtcatctggagatgatggaaacaacgaagctttagagaagggagaggatgatagcagcttgaaggatgatggcagcttgaaggatgatggcaaagtggtcaaggctgtggttgtaatcaaggaagaggacctgcagccctaagaagagccaaaggagaagatgagaaagaacaaggtgacaagaagatggacagtgctgatgtggtggacattgcagttgaaaagaaacaggcgacgaagcgggcttctgagaaggctgagaagaagcaggcaaggaagcgcaagggggatgctgttgccacaaatgatggtaaaaggatgaaaacaggtggtgatgctatggagacagcagcggaagaggatgctcccctgagcggcggaactcctgtgaagcgcaacagcaggaagagtagtgaggttgatgccaaaggcggtggcggtagtcctgttgtgagcagccctcgcagggtgacgaggagcaatgccaaggctagcggtgaagctgatggtagccctgcgacaaggaccaggagggctacccgcgctgaagcctga

SEQ ID NO: 1216 - DNA, 1872 bp, Oryza sativa
atgatctcgtcggcgggaccgcatcctcgccggattcggcccctcgccgccgcctccctcgtgctgttcctcttcctgctctacagccgctccggcgggagcttggtgcggtctccacgggtattgagcttcgattcgcatacggggcaccgtagattcctctccgatgccgatcctatcagccccgcgtccaacctgtcggagatcggggagctaaacggcgagcagccgccggtggatccctccgtggcgtgcgccggggtagcgcggcacgaggggttcgggtcccagtgcgagttcctccgggcgcacccgcagtgtagctccggcgggttcgtcgactacttgggcttcttctactgccggtgcgagaggttcagggtgctcggctatgcggtgctcggtgtgtgcctagcggctctgttctacatgcttgggaacacggccgcggattacttctgctgcagccttgagaagatgtccgcgctgctacggctcccgccgaccgtggccggagtgacattgctcccctttggaaatggcgcgcctgatgtgtttgcgagtattgccgcgtttatggggaccggcgctggtgatgttgggctgaacagtgtgttgggcggagcggtctttgtgacttgtgttgttgtcggagctgtgtcattgtgcgtggcggagaagaatgtgcagattgatagaagatgctttgtgagggatgttgggttctttctgatgactctagtagcactgtcgattattttgattgttgggaaggtgaccgtttggggagcgattatgtttgtgtcgatttatgtggtttatgcgtttgtggtggctgcaaatgaggtattgaggaagcatgcacggaggcttaagtttgatgtggtcacaccactgctgcctgtgagagggagtatctttgcacaaggaacagaagatgatgagtccgtgtacagttcacttcttgaggaggaatcagatggtgacgtggctcaaataaacacatccttgcctcagtggatgtgggcttctcatgtggccatttactcaaatcatgggatcagaggtggttcacctgacagttccaggccgctatggggttggagtgatgaagaagtggataattccacagttagcttctccaagctgttcttgtttttggagctccccttgacgataccaagaaggttgacaattccaatagttgaggaagaccggtggtcgaaagaatatgctgttgctagtgctggcttggcgcctgttctgctggcatttctttggagcagtcaagatggggtatccactaaggctcacatagcagcatatgtgatagctggtatttctgggatggcacttgcttctctcgctttcatgttcactgaccatgaacgacctccacggagatttttattcccatgggtgttgggagggtttgtgatgagcattatctggttctacatcattgccaatgaactggttgcacttttagttgcttttggagtgatattggggatcaatccttcaattcttgggttaactgtgttagcatggggtaattcgatgggtgacttaatgtcaaatgttgccttggcaatgaatggaggagatggtgtgcagatcgccatgtctggatgctacgcaggacctatgttcaatacacttgctggattgggaatatcgatgctgcttggagcttggtcaacagcaccaaactcttatgttcttcctcaagacagctctctcatttacacaatgagcttcctcgttggtggattgatctgggctcttgttatgctgccacggggttgcatgcagcctaacaagatacttggagttggtctcaatgcccctttactcagtttttccttttaa

SEQ ID NO: 1217 - DNA, 1863 bp, Oryza sativa
  misc_feature (92)..(92): n = any nucleotide
  misc_feature (128)..(128): n = any nucleotide
  misc_feature (231)..(231): n = any nucleotide
atgggcggcgcccaaagccgcgaggacctcgacctcaactcctccgacgacgaggacgacgacgaggagtacgacgcccagaccgccacctncgccgcctttcgagaggacatcctccggacttctancccctcctccctcgagttcctcgacgcgaagctgaaagcgctcgatctcaagtaccaggcgccgaacgcggcgaagctgtacctccacgtcggcggcgcttcngcttccgcgcgctgggtgccggccgagcggcgggcgacctacgccttcgtcgacaaggcgacggcggcgggcgacagcgattgtggcggcccgaggtgggttctggaggttggtccgggtcccagggtctccgcccccgtcggcccggcgctacagctcaaggcgctccccgcgcagcgccgggccgatttcgccgcgggcggctccgtctgggcgctgcggctgccgaccgacgccgccttccgccgattccggcaggagtacgaccggtgcctgttcgagaacacgtatggcgtcgaggccacggatgagggccggaaggaggtgttcggcgctgacttcgccgcgtgggcgcgccccggtgagtccgacgacgccgtctgggccgacgcagaggactccttcacccctcccgttgcgaccccggcgagagacctgctcgaggagttcgaggaggaggccggggacggcagcatccagagcctcgcgctgggcgcgcttgacaacagcttcttggttggagggtcagggatacaggtggtcaagaatttccggcatggcgtgcacggcaagggcgtctctgtgaggatatctgatggccgtggtggtgggaacgcgtacatgacaccgcagaaggctctgcttatgcgtggcgagacgaatatgcttctgatgagccctggagagactggcactcgccattccaatggcgtccatcatgttgatatagagactggcaaggttgtggctcagtggaggtttgagaaggatggaactgacatcacaatgcgagacatcgccaacgacagtaagggcgcgcagctggaaccctctggatcaaccttcttaggattggatgacaaccggctatgccggtgggatatgagggattccaggggcagggtgcaaacaattgggagctcatctgagtcaccggtgctgcaatggtcgcagggccatcagttctcaaggggcaccaatttccaatgctttgcaagtacaggggatggttcgattgtggttggttctgtggatggcaagattaggctctattccaagagttcgatgcggatggcgaagacagcattcccagggcttggatcaccaatcacacatgttgatgttacttatgatgggaagtggattctgggcactactgatacatatttgatcttgatctgtaccatctttaaggacaaggatggtaaagagaagacaggattcagtgggcgtatgggaaataggattgcagcaccaagattgctgaagctctccccattggattcaattttggcagggtccgagaacaaattccatggcgggcagttctcttggttttcccaggtaacagagaatgggaagcaagaaaagcatcttgttgcgacagttggcaaatttagtgtcatttggaactttcagcaggtgaaggacagcaaccatgagtgctaccgcgatcaggaagggctcaagagctgctattgttacaaagttgtcctgaaagacgaatccattgttgacagccgtttcatgcacgagaaatttgcaacaaccgactcccctgaggctcctctggtggtggcaacacccatgaaagtcagctccttcagtttagccaatagacgattacactga

SEQ ID NO: 1218 - DNA, 1862 bp, Oryza sativa
  misc_feature (1064)..(1064): n = any nucleotide
  misc_feature (1124)..(1124): n = any nucleotide
atggcggagcggctgacgcgtatcgcgatcgtcagcgaggacaagtgcaagcccaagaagtgccgccaggagtgcaagaagagctgccccgtcgtcaagaccggggaagctttgcatcgaagtaactccggcgtcgaagcttgcgttcatttctgaagagctgtgtattggttgtggtatttgcgttaagaaatgcccgtttgatgccattgagattatcaaccttcctaaggatttggaaaaagatactactcatcgctatggtccaaacaccttcaaattgcacagttgcccgttccaagacctggtcaagttttaggccttgttgggacaaatggaattggaaagtcgacagcactcaaagtgttagctggcaagctcaagcctaatttgggacgatttaaaccagactggcaggaaattctgacatacttccgtgggtctgaactccaaaactattttacacgcatattggaggataaccttaagaagcctcagtatgtggatcacattccaaaagctgtccagggaaatgttgggcaagtacttgaccagaaagacgagagaggcgtgaaagctgagctttgtgtcgaccttgaattgaaccaagttattgatcgaaatgtaggagatctttctggtggtgagctccagagatttgcgatagcagttgttgctgtgcagaatgcggaaattttcatgtttgatgagccatcaagttaccttgatgttaagcagaggcttaaggctgcacaagtcgttcggtctttgcttagacccaacagtatgtgattgttgtggagcatgatttgagtgtcctggattacttgtccgactttatttgctgcttgtatgggaagccaggtgcttatggtgtagttactttgccgttttcggtccgagaaggtatcaatattttcttggccggatttgttccaacagaaaatctacggtttcgagatgaatctcttacttttaagctgtcctttcagattgcggagactcaggaaagtgctgaggagattgagacataccagcgatataagtaccctactatgagtaanacacagggcaatttcaagctcactgttgttgagggtgagttcactgattcacagattgtngtgatgcttggtgagaatgggacagggaaaactacattcatcagaatgctggctgggttgttgaagccagacactgtggaaggaactgagattgaaattcctgaatttaatgtgtcctacaagcctcagaagattagcccgaaattccagcattctgtgaggcacttgcttcatcagaaaatacgggattcatatactcatcctcagtttgtgtctgatgtcatgaagccactgcaaatagagcaactcatggaccaggaagttatcaatttatcaggtggtgagctacaaagggtggcaatatgcctttgccttggaaagcctgcagatatctatctgattgatgaaccaagtgcctatcttgattcggagcagcgcattgttgcttcgaaggttatcaaaagattcatccttcatgcaaagaaaactgcatttattgtggagcatgatttcatcatggctacctacttagctgacaaggtcattgtttatgaggggcggccttctatcgactgtactgccaatgcaccacagtctttggtatctgggatgaataagttcttatcggtaagttctgaatattaaatattgagaagagatccacaacttgacattacttttagaagagacccaaccaactataggccaagaataaacaaactggactccacaaaagacagggaacaaaagtctgcaggatcctactactaccttgatgactaatttgaaggcgtacag

SEQ ID NO: 1219 - DNA, 1859 bp, Oryza sativa
atggtcacaccagacggcatccttgagctcaccaatgacacaattaatctaggacacgcatttttatccaactccacaaaacttccaacagcacagtgcaatcattctcactcagctttgtgtttgcaatcctctcagtgcatgatgatataagtgcagatggcatggccttctttgttgctccaagcaagaacctttccaatacatgggcacagtatataggtctcctcaatagtaggaacgatggcaacagaagcaatcacatgttcgcggtcgagcttgatactacccaaaatgatgagttcaaagacatcgacaacaaccacgttggaatcaacatcaacagcctcatctctttgcaagctcaccacactggatactatgatgataagagtggtttcttcaacaacttgactctgatcagtggcaaggccatgcaggtatgggctgactatgatggagagtctgcacaaatcaacgttaccttggctcatcttggagcacccaaatctgtaagaccactgctttcatcttcctataacttctcagatgttcttagagatcaatcatacatcggtttctcagccacaacaggtgcgattagcacaagacattgcgtacttggctggagttttgctatgaatagtcctgctccagctatagacatctccagactcccaaagctaccacgccttggcccaaagcctcgttccaagaccttagatatcaccctgcctatagccacagcaatatttgtccttgctgctggtaccgttgttgttttacttgttcgtagaagattgagatatatggagctacaggaagattgggaggttgattttgggccacatcgattctccttcaaagacatgtaccatgctacggaagggtttaataaaaataacttactaggagtaggtgggtttggcaaagtttataaaggcgttcttcagaagtctaaagttccagtagctattaagagggtgtcccacgagtctacacaagggatgaaaaagttcattgctgaggttgtcagtattggtaagctcagacaccgcaacctagtgcctctacttggttattgtcggcgaaaaggtcaactccttctagtatatgactatatgtcaaatggcagccttaataagtatttgtatcctgaagatggaaaaccatcattgaattgggctgagaggtttcatgtcatcaagggtgtcgcatttggcttgctctatctccatgagaagtgggaaaaggttgtcatacaccgagatattaaaccaagtaatgttcttctagatagtgaaatgaatggaaaattaggtgactttggtctttcaaggttatatgaccatgggactgatccacaaaccactcacatggttggaaccatggggtacttagctccagaattggtacgcacagggagagcatccacttctacagatgtctttgcatttggcatatttcttcttgaggtcacctgtgggcaaagacctattaagaaagactcacagggaaaccagcatagtttgttcgattgggttcttcagtttctgcataatagctcactaatcgaggccatggacagtagactccaagctgattttaatatcgatgaggtttgtcttgtcctaaagctaggtcttctatgctcacacccatttactaatgcaagacctagcatgcagcaagtcatggagtaccttgaaggtgatacaccaataccagagatttcatcaaggcattttagctttactatgcaggctttgatgcagagcaaaggatttgaatcaccagacatgttatgcccacagtttacgagtattggcacattctctgaactgtcagggggaagatga

SEQ ID NO: 1220 - DNA, 1795 bp, Oryza sativa
  misc_feature (790)..(790): n = any nucleotide
  misc_feature (1267)..(1267): n = any nucleotide
  misc_feature (1274)..(1274): n = any nucleotide
  misc_feature (1286)..(1286): n = any nucleotide
  misc_feature (1632)..(1632): n = any nucleotide
  misc_feature (1757)..(1757): n = any nucleotide
atgaggggtgcggggtttctgctgctcgttgtgttcgccgttgccgtcgccggtggggcggtggcggcggcggcggatttggacggcggcgatggtggtggtggtgtggcggcggagtggcggtttccgagctcgaggatgcgggacgcgtacgtggcgctgcagacgtggaggcgggaggccatcttctccgaccccggcaacctcaccgccgactgggtgggccccgacgtgtgcaactacaccggcgtgttctgcgcgccgctgccgtgggatcgccgggaggtcgccgtcgccggcgtcgacctcaaccacggcgacatcgccgggtacctgccccccgagctcggcctgctcgccgacctcgcgctgctccacctcaactccaaccgcttctgcggcgtgctcccggccaccctccgccgcctccgcctcctacacgagctcgacctcagcaacaaccgcttcgtcgggaggttccccgaggtggtgctcgacatgcccgcgctccggttcctcgacctccgcttcaacgacttcgagggcggggtgccccgccagctgttcgaccggccgctcgacgccatcttcctcaaccacaaccgcttccgcttcgacctcccggacaacttcggcaactcgccggtctccgtcatcgtcctcgcgcacaacagcttcggcggctgcctcccggcgagcctcggcaacatgtccgggacgctcaacgagatcttgctcatcaacacgggcctcagctcctgcctgccgccggaggtcgggatgctgcganaaggtgacggtgttcgacgtgagcttcaaccggctcgccggcccgctgccgtcggcggtggccgggatgaggaaggtggagcagctcgacgtcgcgcacaacctgctcacgggggcgataccgcaggcggtgtgcgagctgccgcgcctcaagaacttcaccttcgcgtacaacttcttcaccggcgagccgccgtcctgcgcgcacgccgtgccgcgctacggcgaccggaggaactgcctgcccaaccgccccgcccagcggacgctgcggcagtgcgccgcgttcttcgcgcgccctcccgtcaactgcgccgcgttccagtgcaagccgttcgtcccggccctgccgccaccatcgccgccaccaccattaccgccgccgccttcgccaccgccgccatccccaccgccaccgtcgacatcaccgcctccgccttcaccaccaccgccatctccaccgccaccatcgcctccnccgcctncaccaatcttcncacccaccgcagccgccgccgccgccgccaccacccgcgccacaaccgcatccgccatgtccggagctgccgccaccaccaccgccgccgccaccctgcggcggcgcaacaccagcattgtcaccaccaccaccaccaccttactaccccgggccatggccacctgtccatggagctcatggccaccgatccacagcgtaccatatggatcaccacctcctcccccgctgcattgatagaatttctccgaagaatgtttggaaacatgcatgtgttccgctcttgctcctcacatccggcaaatcgacagcagcggaagtcgcacacaagtatacgtgttggttgnttgattgatgactaccggcgtgaagagcgtagtaaggtgcacaaaattttgtttggttatgatttgtcggcgtcagcatcgaaacagtttgtgttgctgtggtgttgaaagggattgggaagtgntgggggtgtggggatttggaggatttgggaacatatga

SEQ ID NO: 1221 - DNA, 1777 bp, Oryza sativa
ggtcatggtgttgttctactaaacacagatgaggctggcattctttcagtgacaaatttccgacttctctttgtggttatagagttgggtaccatcccactaactgcaattgagaagataaatgatccccgccagcatgataagaagcagccccgtgaacttcttcaagtcatcgggtaaagacatgagggtcattgtgttcgattttcttcctaaaaccaagcagggtagaaatgtgtttgatgctttgagaagatatagcaaacctactcatctgtgggatctatatgcattttcttgtgatccctccccaaagatgcggctcttgaaggaataccatcgccttttgcgtaatgaatggtggagggtaagtaaagtaaattccacctactcactatgttcgacgtacccatctgcattgattgtgccaaggagcataagagtgatgaagatttattgcaagcttcttctttccgatccggcagacgcttgcctgttatttcgtggtgtgaccctggggtctggagctgttctggcaaggtcatctcagccattggtaggattgatgatgaattttcggaaagcaataccgatgagaagcttgtttctgctctttgcacccaaattattgatgccactgggtctctaagaggaagttatatatagttgatgcccggccaagagcaaatgctttagcaaatggtgcaaagggaggtggctcagagtcagcatcaaactacccaagatctgagtttttaggaatacaaaatatccacacaatgagagatagtctttttcgccttagggactatgttgatacccatggatcagtatcatcaaatggaacatcatcagctgtatctcttgttggagaccggggatcaacctggggtggagggaatctgaatagcatgacacaattttcttcaatgttaggggagtggctaaaccatatccagagtatcatggtcggtgcttcgtggattgctgcacaaattgtccaagaatcagcttctgttctcgtccattgcagtgcagtgatggttgggaccgcacaactcagttggttgcacttgcttgtttgttgcttgatccatattatagaacgttcaatgggttccaggcccttgtggaaaaggattggctagcatttggccatccattttctcagttgttacgtttgtatccatctgcatttgagttctcatctttccttgttgactttatggattgtgtgttgtcatgccgctttgggaacttcttgtgcaatagagtgagcgagaaagggagcaatctggtgctgtaagctcttgccattgcatgtggacgtacttggctgatctccgagcttctggtggcagcttccataagcatcgtaatccattctatgatccattaaagcataatggtcccctagtgccacctgctgcagcacttgctcctaccctttggccccaattttatttgagatggacatgccccattgaatctcaaggtggtgatcttgaatctcaatggcatgccatgaataaaaagtacacagaagcaatgaagtccgacttctctgtatccatcaccgcgattgaggacagcttggtttcagaaacaccaagcaaccatatctgtgagtcactctgccctttccgcaccagggaaggattgtagatggcctgatgcagcgtgtgcacagcttggaagccagtttgttggtctaaaggcaaattttgatgccttcgaccggctatcggtacaagacagctattttggttcagaatag

SEQ ID NO: 1222 - DNA, 1767 bp, Oryza sativa
atggagaaggtgggcgggaagccgccgcagtcgcgcctctgcttcctcgccacgctctgcgccatgttctgggtcctcatcttctacttccacttcttcgtcatcgccaacgagcctggctccgcgggggcggacaccgccgccggcgccgcggcgagcattgcccgcgcagaacttccgctccccgaacccgagcgcgtctccgatcccgcggttcccctccctccgcctgccctcgtctcggagccgccacctaccaccgctactgtcgccaaagtggaagatgaggagaagcccacggccgtcgcccaccaggaggcggcgcccagggattacgcgttccagcgagcgctcaagaccgcggagaacaagagcgacccgtgcggcggccggtacatctacgtgcacgagctgccgccgcggttcaacgacgacatgctccgggagtgcgagaggctcagcctctggaccaatatgtgcaagttcatgagcaacgaagggcttggtccgccgttgggcaacgaggaaggggtgttctccaacaccggctggtacgcgacgaaccagtttatggtggatgtcatcttcaggaaccggatgaagcagtacgagtgcctgaccaaggactcgtccatcgctgccgcggtgtttgtgccgttctacgccgggtttgatgtggcgaggtatctttgggggcacaacatttcgacgagggatgccgcgtcgctggatttgatagattggctgaggaagaggcctgaatggaatgtgatgggcgggcgtgaccatttcttagttggcggcaggattgcgtgggatttcaggcgcttgacggacgaagagtcggattggggcaacaagctgcttttcatgccggctgcgaagaatatgtcgatgttggtggtggagtcaagcccatggaatgccaatgattttgcgataccatatcctacttacttccaccctgccaaggatgctgatgttttgctttggcaggatagaatgaggagcctggaacgaccatggttgttctcgtttgctggggctcctcgtcctgatgatcccaagtctatcagaagtcagcttattgatcaatgcaggacatcaagtgtctgtaaattgctggagtgtgatcttggggagagcaagtgccattcccctagcgcaatcatgaatatgttccagaactctttgttctgcttgcagccccaaggtgattcgtatacgagaagatctgccttcgactcgatgctggctggttgcattcctgttttctttcatcctggttcagcgtatgtccaatatacgtggcatcttccgaagaactatacacggtactctgtcttcatccctgaagatggcgtccgtaagggaaatgtcagcattgaggacaggcttaaaagtatccatccagatatggtcaagaagatgagggaagaggtcattagtctcatcccaagggtgatatatgctgatccaaggtcaaagctggagaccctgaaggatgcattcgatgtttctgtagaggcaataattaacaaggtgacacagttgagaagagatatcatcgaagatcatgaagataaagattttgttgaagagaatagctggaagtatgatctgttggaagaagggcagaggacaattgggcctcatgaatgggacccgttcttctctaagcccaaggacaagggtggagattctactaatccatctactaatgctgccaagaactcctggaaaaacgaacaaagaggtcagaactaa

SEQ ID NO: 1223 - DNA, 1752 bp, Oryza sativa
  misc_feature (335)..(335): n = any nucleotide
  misc_feature (353)..(355): n = any nucleotide
  misc_feature (432)..(432): n = any nucleotide
  misc_feature (829)..(829): n = any nucleotide
  misc_feature (834)..(834): n = any nucleotide
  misc_feature (839)..(839): n = any nucleotide
atggaggtgcgccgcagggcgccgctgccgccgccgcccgggagggtgcaggcgggcgacgcgctgccgctgccgatccggcacacgaacctgatattctcggcgctgttcgcggcgtcgctggcgtacctgatgcggcggtggcgggagaagatccggtcgtcgacgccgctccacgtggtggggctcgccgagatgctcgccatcttcggcctcgtcgcctcgctcatctacctcctcagcttcttcggcatcgccttcgtgcagtccatcgtctcctagcagcgacgacgaggaggaggacttccttgtcgggcccgccgtggctcctccgnggcggcggccgtcgcgcnnnattagccgccttcttctccggcgcagtgctcgctgctgggtagcccccacgacgatgccgcgcgggagagaatgccngaggaggacgaggagatcgtgtcgtcggtcgttgccgggaaggtcccctcctacgtgctggagaccaagctcggggattgccgccgcgcagccggaatccggcgcgaggcggtccggcggatcaccgggaggcagatcgaggggctcccgctcgacggattcgactacgcctcgatcctcgggcagtgctgcgagctcccagtggggtacgtgcagctccccgtcggcatcgccgggccgctcctgctcgacggccagcggttctacgtccccatggccaccaccgaggggtgcctcgtcgccagcacgaaccgcggctgcaaggccatcgccgagtccggcggcgccgtcagcgtcgtcctccgcgacgggatgacgcgcgcccccgtcgcccgcntcccnaccgntcgccgcgccgccgagctcaaggccttcttggaggattctgtcaacttcaataccctctccatggtcttcaatagaggtccagtagattcgcgaggctgcaaggggtacaatgtgccatggctgggaggaacctgtacatgagattcagctgctgcacgggggatgccatggggatgaatatggtctccaagggcgtgcagaatgtgctggattacctccaagatgacttccctgacatggatgttattagcatctcagcaggtaacttttgctctgacaagaagccagctgctgtgaattggatcgaagggcgcggtaaatctgtggtttgtgaggcagtaatcaaggaggatgtagtcaaaaaggtgctgaagaccaatgtgcaatcgttggtagagctcaacgtgatcaagaatcttgctggttcagctgttgctggggctcttgggggtttcaatgcccatgctagcaatattgtaactgcaatcttcatagccactgggcaggatcctgcccagaatgtggaaagctctcactgcatcacaatgttggaagctgtaaatgatggcagagaccttcacatctccgttactatgccatcaattgagaggtgggcacagttgggggagggactcagctggcgtcacaggctgcttgcttggacctgctcggcgtgaaaggcgcgaacagggaatccccgggatcaaacgcgaggctcctggccaccgtggtggcaggtggtgtccttgccggggagctgtccctcctatctgcactcgccgcaggccagcttgtcaagagccacatgaaatacaacaggtccagcaaagacatgtccaaggtgatttcctagtcctagtagttcgaggtttggatcgttgcattggaaagaaagaaagaaaaaatggatag

SEQ ID NO: 1224 - DNA, 1733 bp, Oryza sativa
  misc_feature (1489)..(1489): n = any nucleotide
  misc_feature (1491)..(1492): n = any nucleotide
ctgcctgagggtgttctgtcagtacctctgcttaggcaccaggcattggcttggatggtttcgaaggagaatagctctcattgtgcaggtggaattcttgcagatgatcagcagggtcttggcaaaacagtgtctacaattgcccttatacagaaacagaggatccagcagtctaagtttataggcctgctgcaggtactctagtggtgtgcccagctagtgttcttaagcaatgggcgaacgaattgactgacaaggttggtgaaagtgctaaattgtctgttttggtctatcatggtggctcaaggaccaaagatccaaatgagttggcaaaatatgatgttgttatcactacatacacaattgtggccaatgaagtgcctaaacagaatgccgatgatgacactgatcagaagaatggtgaagaatcttctgctggtaataagagaaaacaaccacccaaagcacagagcaagtcgaagaaaaagaaaaagagtggcccagttgcaagagtgcgatggtttagggttgtccttgatgaagctcagacaataaagaactttcgaactcaagtggctaaagcctgttgtggattacgtgcaaaaagaagatggtgcttatcaggaacacctatacaaaatgcaattgatgagctctacagctatttccatttcttgaaatacgatccatattctacttataattcattttgtacaatgataaagcacccgattgctagaaatgcagttcatgggtataagaaacttcagactgtgttgaggatagttctcctgcgccgcacaaaagctgattgatggtgagccaatcataaagctacctccaaagacaattaatctggataaagtagattttacaaaagaggagcgagctttctatttgacgctggaagaacgctcgcggcaacagttcaagtacgctgctgctggtacactcaaacagaactatgccaacattcttctaatgctgttgcgccttaggcaggcctgcgatcatcctcttcttgtgaaggggtcttttgcaatctttggacttcttttacggcaggatgtacctgaggatgccgtcgtgacgatgtgtggccatgtcttctgctatcaatgtatatacgagcggataactactgatgagaatatgtgtccctcccctaaattgtggaaacacattacatatcctcaaagatacaggcggcaatcgatatactgaattcgatcattaacacctatgcccttaccgacagtgataccgtcgaatcaaatcctagccgagtggccccagtgaaagccattgtgttctcccagtggactggcatgctggatttgctggagctttcattgaatagcaatctcatacagtacaggagactagatggaacaatgtccctcaattcaagagataaagcagtgaaagattttaacacagacccagagcctcaggtcagggttatgatcatgtcactgaaagcaggtancnnggatcttggtctcaatatggttgctgcttgccatgtaattctccttgatctttggtggaatccttatgctgaggaccaggcaattgatagagcacacagaattggtcagactcgtcctgttactgtctcccgtttaaccattaaagatacggtggaagatcgcattttagctctgcaggtaatagcttgtctttcatttgcactgtgctttcataaacttgtctttttcctacttagataa

SEQ ID NO: 1225 - DNA, 1728 bp, Oryza sativa
gttcttgagagagagaaaataatgaagtctttccaggatattactgcaaggcttgaacaagccttaggtttaatctcatttgatgaacttgacatatcagatgaagtaagagaacagcaggttgaattggtacatgctcagttcaaaagagctaaagaacgatctgatccatctgatgatgatctctttaatgatttggtgtccgtctacaactcaagcaccagtgctaatgttgacccagatattctccagaggttatctgacaagttgcagcttgccactatatcagacctcaatcaagaatcattgatcttgcacgagatggctagtggcggtgatcctggtgccgttgttgagaagatgtcaatgctgctaaaaagaatcaaggattttgtgcagagtcgagatcctgaaatgggaaccccaccggatgatttccgttgccccatatcgctggatttaatgaaagatccagttattgttgccactggacagcagacttatgagcgaggatgcatagagagatggttggaggctgggcatgacacctgtccaaagacacagcagaagcttcccaataaatctctaaccccaaattatgtcttacgcagccttatagctcaatggtgtgaagcaaatggtatggagccaccaaaacgtgctgctcaacatcataatgcaccagcatcatgtaccgctgctgaacatagcaacgtcgttgagcttcttcagaaattattgtcacaaaacctagaagaccagcgtgaggctgcaggtatgcttcgtcagcttgccaagcgcagtcctgaaaatcgtgcttgtataggagatgctggtgctattcctattcttgttagcctgctatctataactgatgttagcactcaagagcatgtagttactgctctcttgaatctttcgatatatgaagagaacaaggcaagaataatcacctctggagctgttcctggagtagttcatgtgttgaagaggggaagcatggaggctcgggagaattcagctgccacactgttcagtctttcactagtagatgagaacaaaataacaattggggcttctggggcaattccagctcttgtgcttctgttgagtaatggaagtcaacggggtaaaagggatgcagctacagccctatttaacctgtgtatctatcagggcaacaagggcaaagctgttagagctggattgatccctgtactattaggactagtcactgagactgaaagtggtatgatggatgaggcccttgctatattggcaattctctcgagccatcctgagggcaagactgcaattagttcagccaacgccattccaatgctagttggagtaatcagaaatggatcagcaaggaacaaggaaaatgctgctgctgttctggtgcatctctgcaatggtgaacagcagcaacagcatcttgctgaagcgcaggagcagggaattgtgaccctgttggaggaactagccaaaagtggcacagacagaggaaagaggaaagcaatccagcttcttgagcgaatgaatcggtttcttatgcagcaaagtcaagcccaagcccaagcagaggccatggcacaagctcatgcgcatgcacagtctcaagctcaggttcaggctcttaacgaagctcaatctcaggtagagatgcaggtggagcaattgttgcttccaactacttcacatctttctgatagacgagacggttga

SEQ ID NO: 1226 - DNA, 1723 bp, Oryza sativa
gtccaattaaacggaaggtccataactgctggcacaaaagttccccttaaaggaggggatgaagttgttttcagtccatgcggcaagcatgcctacgtatcctcagagttcgatttgactggtagatgccaagcctttaaggatgggatgaaacaaggaattattagtccaaatgatattgatgttacatttgaaaattttccttattacctcagcggattctattatctggtccagcagggttcggagatttatcaggaaacattgataaaggcacttgcaaaacatttcggtgctaggctacttgttgttgattcgcttttgttgcctgggtctagtgtgcatgctgatatcgtgggtacatcgactctgcattctgcatctttgcccaaacaggaatcatcaacagctacatccaagagctatacttttaggggacccagttatggttatcgaggcagagtgatgcttgcttttgaagaaaatgggtcttccaaaattggagttcgatttgacaagcagatccctgatggtaatgatcttggtggtttgtgcgaggaagatcatggtttcttctgctctgcttaaggatgtagagaaatcattcactggaattacagagtcactttcatctttgaggaataagcttgaagcgcttccatctggtgtgcttattataggatctcacactcaaatggacagccgcaaagagaagcacccaggtggatttctttttacaaagtttgctagtagcagccagacgctatttgaccttttcccgctcacagattggaagcaacaactggatcgtgacgttgaaacccttaaagctaaatccaatgttggtagcattcgcacggatgttgtcacagagaacgaatttgagaaaaggcttctggcagatgttataccacctaatgacattggagtcacctttgatgatattggagccttggaaaatgtaaaagacacattgaaggagctggtgatgcttcctctgcaaaggcctgaattgttctgcaaaggacagctaacgaagtggtttggcgaaggagagaaatatgtaaaagctgttttctcattagcaagtaaaatagctccaagcgttatattcattgatgaggttgatagtatgctaggaaggagagagaatccaggggagcatgaagcgatgcgcaagatgaaaaacgaatttatggtgaattgggatggattacgcactaaagataaagaacgtgtactggttcttggtgccacaaataggcctttcgacctggatgagggctgtcattaggaggttcccgcgcagaggttaatggttaacttacctgacgcatcgaatagagaaaagattctgaaagtaatattggcaaaggaagagttggctccaggtattgatatggattctcttgccactatgaccgatggatattcaggaagtgacctgaagaatctatgcgtgaccgcagctcattaccccattcgagaaatccttgagaaggaaaagaaggtggcaaaagcagaaggcaggcctgagcctgcattgtatggtagtgaggacattcgtcctctgaccttagatgatttcaaatctgcccatgagcagcaggtttgtgcaagcgtttcatctgattcagcaaacatgaatgaacttcttcaatggaacgacctatatggcgagggcggttcgaggaagaagaaagcactgagctacttcatgtga

SEQ ID NO: 1227 - DNA, 1716 bp, Oryza sativa
  misc_feature (94)..(94): n = any nucleotide
  misc_feature (816)..(816): n = any nucleotide
atgggcaacaactgcgtcggccccagcgccgccggccagaacgggttcttcgccaacgtcgccctctggcgacccaggcccgccgacgcggctncccccgccctcccgccgccctcctccgcgccgtccgaccaggcgcccgagcccgtcacaatccccccatcggagcactcctcccaccactcctcccgctccaccgacccgtcgacccccacctccgccgcggagcagccggcgaacaaggcggcgcccaaggtcaagcgcgtccagagcgccgggctgctcgccgattccgtcctcaagcgcgacgtcaacaccgcccgcctcaaggatctatacacgatcgggaagaagctagggcaggggcagttcggcaccacctacctctgcgtcgagaaggccacaggtcgggagttcgcctgcaagtccatcgccaagaggaagctgctcacgcaggaggacgtcgaggacgtgcgccgcgagatccagatcatgcaccacctcgcgggccacgccaacgtcgtctccatcgtcggggcctacgaggacgccgtcgcggtgcagctcgtcatggagctctgcgccggcggggagctgttcgacaggatcatccagagggggcattactccgagaaggccgcggcgcagctcgcgcgggtgatcgtcggcgtcatcgaggcgtgccactccctcggcgtgatgcacagggatctcaagccggagaatttcctcttcatccaccagaaggaggattcgcctctcaaggccatcgatttcggcctctccatcttcttcaagccagggtgagacatttanggatgttgttggaagcccgtactatgttgcacctgaggttcttatgaaacattatggtcgtgaggttgacgtctggagtgctggtgtgataatctacattttgttgagtggggttcctccattttgggatggtgagatcatatgaaagtgagcaagggatatttgaacaagttttgaaaggtgatctggacttctcatctgagccttggcctaatatctcagagagcgcaaaggatttggtcagaaaaatgcttattcgtgatccaaaaaagagattgactgcccatgaagccctatcatccttgggtctgtgttgatggagttgctcctgacaagcctcttgattccgctgtcttgagtcggttaaaacaattttctgcaatgaacaaactaaagaaaatggcgcttagggttattgctgagagtttatcagaagaagaaattgcaggattaaaagagatgttcaaaatgctagacactgacaacagcggtcatattacactggaagaactaaaaacaggcttgcagagagttggtgctaatttgatggactcggaaattgatgctctaatggaggcagtaagtattctaagaaggtttctgcgcatctattcatcatttatactgaaattagtaaacaagattttgttctgatctgcagatattgacaacagcggaacaattgattatggagaattcattgctgcaactttgcatataaacaaagtagagaaggaggataagctgtttgcagctttctcatactttgataaagatggcagcggttacattactcaagatgagcttcaaaaggcatgtgaggaattcggtataggtgatacccgtattgaggatattattggagacattgatcaggacaatgtgagtagaaaatgctaa

SEQ ID NO: 1228 - DNA, 1705 bp, Oryza sativa
  misc_feature (613)..(613): n = any nucleotide
  misc_feature (739)..(739): n = any nucleotide
gagtgcgccattggcaacttcggcgtgccccagtacggcggcaccatggtcggcgtcgtcgcctaccccaaggccaacaagaaggcctgcaagagcttcgacgatttcgacatctcctacaaggccaaacccgggtcactccccaccttcctcctcgtcgacaggggaggattgctttttcacaaagaaggcatggaatgcacaaaacgcaggagcagcagccatccttgttgctgatgacaagactgaacccctgattacaatggacacgcctgaagagagtggaaatacagactatttagagaatatcaccattccttctgcgctgataaccaagagctttggggacaagctcaagaaagcaattgataatggtgacatggttaatgtgaatttggattggagggagtccctgcctcaccctgatgagcgtgttgagtacgaattttggactaacagtaatgatgagtgtggccctaaatgtgatagccagattgattttgtcaagagcttcaaaggagcagcacaggtacttgagaagaagggatacacacagttcactcctcattacattacctggtattgcccagattccttcattctaagcaagcantgcaagtcccagtgtatcaaccatgggagatattgtgcacctgacccggaacaggatttcagcaaagggtatgatgggaaagatgtggtagtccagaatttacgtcaagtctgtgtttataaagtngctaaggagcatggaaaaccttggctgtggtgggactacgtgacagattttgcaatccggtgcccaatgaaggaaaagaagtacaccaaggaatgcgctgatggagttatcaagtcacttggataagtgcattgctgatccagatgctgataaagaaaatcctgtgctgaaagctgaacaggatgcacagattggcaagggctctcgtggtgatgttaccatcttaccgactcttgtaatcaacaatagacaatacagaggggaaacttgataaaggagcggttcttaaggcaatttgtgctggttttcgagaaaccactgaaccagctgtttgcttgagtgaagacaaatgagtgcttggagaacaatggtggctgttggcaagacaaggctgctaacatctctgcatgcaaggacacttttcgtggaagagtttgtgaatgtccagttgtgaaaggtgttaaatttgttggtgatggctacactcactgtgaaggcttcgggatctggccattgtgaaattaacaatggagggtgctggaaggattccaggcatggccggacatattctgcctgcacgtgtaaatgtccggatgggttcaaaggtgatggagtccacaaatgcgaaggatattgatgaatgcaaggaaaggactgcatgccagtgcaaggaatgtaaatgcaagaacacatggggaagctatgagtgcggttgcagtggcggcttgctttatatgaaggagcatgatacatgcataatcaggcaaaaatgcagcaacagaggtaggatggaacttcttgtgggtgatcttctttggcctagtggtagccggcattgcaggatacgcagtatacaagtacaggatccggtacatggattcagagatccgcgccatcatggcccagtacatgcccctggacaaccaaggagatgttcccaatcattctcaccatatcgagctatga

SEQ ID NO: 1229 - DNA, 1690 bp, Oryza sativa
atgccggacgccaggtccgccgccgagaatgcaagccgccaccaccaccaccaccaccgtgcccacgccatcgccgaccgctcggagcgtgggttgcctgaggagcattcacggggcagcgtggacgagcggttcgtcttcccatggatggggattctggtgaacgtgcctaccgagtggaagaacgggcggcaggttggggagagtgggaaccgcctcaaggagggattcgcgcggttctgcccacacaaggtcatcccgttgtggaatcacaggggtcacacggggaacgccattgtggagttcgccaaagactggaccggtttcgagaacgcgctcgcgttcgaggtccacttcgagcaacaagggtatggcaggagggcatggatggggaacaagtacagggggtcacagatgtttgggtgggtcgccagggccgatgatcacaactctccggggccgattggggtttatctgcgcaagaacggtgatctcaagactgttgctgatcttgagaatgaaggaacacgcaagactgacaagcttgttgccaatttggctagccaggttgaggtcaagaaaaggcatgtggaggagcttgaatctcagtacaatgagaccacagcgtcacttgaaagggtgatggagcaaagggagcagcagctccaggcttacaatgaagagaaattcgtaagatgcaagaccttgcgctcagacattcacagaggatcatggatgagaataagaagctgcgttcagatttggaatccaagatgcaactacttgactcaaggtccaaggagcttgacaagctagctgtccaaagtaactctgacagaatgaaccttgagaaagagaaggaaaagagaacgatattaaaactaagcatcttaagatggcaacattggagcaacaaaaggcagatgaaagtgtgctgaagcttgtggaagaacacaagagagggagaaacaagctgctctagacaagattctcaagttagagcagcagttgaatgctaagcagaagcttgagttagaaatacaacagcttcagggcaaattggaagtaatgaagcatatgccaggtaaagaagactccgaagcgaagagtaaaatacatgaactcagtgaggagctaaaagataagtatgctgaaatggaatcaatagagtcactcaatcaagcactggttatcaaggaaagacaaagcaatgatgagctgcaacatgcccggaaggtgctgatagaaggcttccaagatattatagttggtcgaacaaatataggcatcaagagaatgggtgtgattgatttcaaagcatttacaaatgcttacaaacagagatccttagaagaggatgcagatgttagtgctgcagagctttgttctctctgggaaaatgagattaaaaattcagactggcacccttttagggttgtcatggtcgacggtaaagagatgggaaattctttctgaagatgatgggaaactttgcgaacttaaagaagagcatggtgaagaaatctgtgccatggtaacaaaagcactgctagaacttaacgagtacaaccccagtggccgctatcctgtaccagagctttggaacttcaaggagaaccggaaagcaacactcaaagaggtcgtccaatacgtcctcaatcagtggaagaagaacaagaggaagcgttga

SEQ ID NO: 1230 - DNA, 1683 bp, Oryza sativa
atggtctacaccaggaatggcggccgcacagcgggtgagggcagcagtggcgaagaacgcgccgatggtggacaccccaacagcgcctccggcaatggttcgccaccgctccccgagaacccaatgcttgcacaagtgatggcccatcagacccagatgatggcggccatgatgcagcagatgtagcagcagcaccagcaaatgcaccagaggatgcagcagcaggctgatcagcaccagcagcagtttggtccccctccccctcagtccaagccgccagagtttctacgcgtcaggccacccaccttctctagcaccaccaaccccatggaggcaaatgactggctccatgccatagagaagaagctcaaccttctgcagtgcaatgatcagtagaaggtcgccttcgccacacaccagctccagggtcccgcatcagcttggtgggacaaccacgtggcaacccgtccgccaggcacagaagtcacttgggtgaagttctgtcgcagcttcaagaaggcgcaggtgccagacggggtcgtggcacaaaagaagagaaaattccgggcactcaaccagggcaacaggacagtgactgagtacctgcatgagttcaatcgcctagcgcgatatgcatcggaggatgtccgcaccgacgcagagaagcaggagaagttcctatcaggcctggatgatgagctgaccaatcaactgatttccggggattacgctgacttcgagaagctagtagacaaggcaatccgccaggaggatcagcgcaacaagctggacaggaagaggaaggccgcctagtttagggcacaccggggaggtcaccataggctgcgcttcactcccagacagcagggtggacccaccaccatgattgttcgccagcaccacccctattcttccggcaacttccaccagggtgccagtggatgtcagaaccaccagggaggtcagcctaaccgcagtgcagctccgcgcctaccaatggcaccagcacagccaactccaccaactcaagccaagaaggagaccagagcaaagccagggtcctgctacaactgtggcgagcatggccactttgctgacaagtgcccaaagccaaggcgtgccggaccaaggttttctcaagctcgcgtcaaccacgcgtccgcagaagaggcacaagtagcaccagaggtcgtactgggtacgtttcctgttaactcaatccctgcaacagtacttttcgattctggtgcaacgcattctttcatttccaagaggtttcttgggatacatggggtaagaaaagaggagcttagtacaccaatgagggttcataccccgggaaatagttcaaccacggtcagttatagcccttcagtgctaatagaaatccacaaatcacaatttctagccaacctcatccttcttgaatccaaagacctacatgttattcttgggatggattggctgaccaagttcaagggtgtcattgattgtgcaaatcgcacagtcaccttgatcaatgagaagggagaaacagtggtgtacaagtcaccagtctcaccgaagcagggaatctccttgaatcaaattaaggtggaaaatccggtggtcaccgaggagaagagtttgaggaaattggaaggtattcccatcatctgcgagtatccagaagtgttccccgat

SEQ ID NO: 1231 - DNA, 1653 bp, Oryza sativa
  misc_feature (354)..(354): n = any nucleotide
  misc_feature (361)..(361): n = any nucleotide
  misc_feature (447)..(447): n = any nucleotide
  misc_feature (554)..(554): n = any nucleotide
  misc_feature (647)..(647): n = any nucleotide
atggagaggtgccagcgcatcctattcaggaggttgggcatcctccatgacgaagaagatgcctccgtggagcgcgttctcagccagtacatggccatgtttgatgggcccctgccgccgcacgccatcgccgccttgacggcgatcttcggcctcgacgacgatgatgagtgcgccatggatgcctctctgctcccccttgtgggcgaagggatcactgatgtggccgatctggcgtgccgccggtggcctgcgtgccgcctccctagcatttctatggaacctcagctcttggagcacatgtcgtgcaatgagaactgggatctcgccttccatcaccatgtggctaggtgncctcctntacacattctacctcgcaagttcttctcaacggcatccctggtcaaagaatcacgcatgggagaggacttcggcagggagacccgntgtctccgctcctttttgtcctagcaatcgaccctctccaacgtctccttacaaaggcaacagacctgggttcgctctctaagcttcgaggcagaatgcctcgcctnagaacatctatgtatgcagatgacgctgccattttcgtcaatcccacaagaggggatgtccaagcgctcacggaaatcctgcaacgtttcggnacggccactggactcgttaccaacttccaaaaatctcaagtcgcggccatcaaatgcaataacattgatttggacgacgtcctagagggagtcccagcagtgagagcatgcttctcgatcaaatacctgggactccccctgatcctcgggcggatgcgaaaggcggacatgcagcacatctctgataagatcacagggcgtataataggatggagaggcaaaaacatgggacttgccgggaggtccacacttttaaaatcagtgcttacggcgcagccaatctacttactgaccgctctgaaaacttcaaaggaagccttggagtgcctagacaagcagcggcgacgttttctctaggctggcacgggggacatcacgggtggaaaatgcaaagtcaattggacaaagacgtgtctgccaattaggcaaggaggcctcgagggtcctgaacctagaaagattcatgagagccctgcgtctacgctggctgtggcatgaatggaaggacccaaacaagccatgggttggtctcgagatcccctgcgacgaagtagacaagagcttgtttgccgcatccactaagataaccattggtgatgggaatatagcgcgattctgggacactgcgtggattgatgggagaagaccaaaggacctcatgcccctagtatatgcaatttctaagaagaggaaaaagaacctgcgccaaggaaaggagaatgatgcctgggtaggtgatttggcactggagacaaacccagtaattacagtggcccttgtggagcagctggttgccctatggactgcagtctgcaacgtgcagttagaagaagaagagtcagaccaaatcgcctggaaagttcactcctcatgggcactactcggcttcatcggcctacaaagcgcagtgtgttggcgcgcctgacacaacttttgactccttgatctggaaggtctgggcgcccggaaaatgcaaactccacgcttggcttatcatacaaaatag

SEQ ID NO: 1232 - DNA, 1639 bp, Oryza sativa
  misc_feature (44)..(44): n = any nucleotide
atggtcgaggtcttgaaggaagaagtggtggtgcacacccccantcccttcgggagtgaggatgctagcgggagccgcggcccccatcaccgtcgccgcaactctcggactccgccccgccgcgacccctcgcggagggaggatcccacccggtcgggtggctcagccctctccccgcctccgggcagggggaagccatggcgcatcggagcgcgacaccgcctgacatacggcgacagcggctcgccccgaggcgcgcttcggacagcgggagcccttctacggcatcctcccaggagcgcccgtcggtcagccatgacctcgaggcggtccacggccccaacatcgtcgggggcctcgggaaatcagaggcatcacgatggcctctacggggagcaggacgctcggatcaacatcgagcgacgccaggacgagcgccgtgctgcccgcatgggagaaggcgcatcctcctccagagtgtagtgttcctccttgcgaggcggcccgccccccacgttcacccctggatggactggttgtaggggcttcgttgtgagtctccagaacgtccggtggcccccgaagtttcgtcccaacctcacggagaagtatgatggcagcattaatccctccgagttcctccagatctacaccacgatcatcacggcagtgggggggcgatgaacgggtcatggcgaattacttccccatggccttcaacgcaggtccgcaacactattccatgcattccggcccacgcggtcgtttatgcatttcggaatggcgtgcggcacaaccgcatgctagagaagattgcctccaaggagcccatgaccactgccgagctcttcgagctggcagacaaggtggcgcggaaggaggaggcatgggcctgaaactcgcccagcaccgatgacgagggccacgtcctagcttcaagaccatgaggcgtgagcttctggccgccgtcccaactcacgaggcggcacggaaggcgcgctggtcggaggtgaaactcaccttcgaccagagcgaccatccgacagtgctcactcggggagggaagttggccctcgtggtctcccccaccatccacaacgtcaagatgaagcgtgtcctggtcgacgagggagccagcctcagcatcatctccccagctacctttgacgctctcaaggctccgggaatgaagctccagccgtcattgccaatcattggcgtgaccccgggacataggtggcctctgggtcacgttgagctcccgttgacctttggtgactccaccaacttccgcaccgagcggatcgacttcgacgtggcggacctcaatctgccatacaatgcggtcctgggcaggccctcgttggtgaagttcatggccgcctacctccagatgaagatgccgggccccagtgaccccatcactgtctttgacgatgtgaaggtcgccctggcctgcgcggagcagcgcgccgacaacttggtggcagccaccgagccgcagccctcggagtcctcagcgtcccgcgcctcgaagaagcgcctcgcttcggccgacgaggtccccgtcaaggatatttcccttggcgatgatccgtccaaaaccgccaagattgacggtaccttggacgccaaatag

SEQ ID NO: 1233 - DNA, 1637 bp, Oryza sativa
  misc_feature (273)..(273): n = any nucleotide
agtagtacagcgcacaggccacgcgtgcgcgtccaccgaaacagcggcggcgacgacgaggcgatcgattcctggacactcgcgccacgccaccccactgtccctgcacgctgcagctacccctactctaccactgccctctccggcagggaagcgaggaagaggcacgcaccacgaagtcgccacctcgatttttccggcgaacgacgcaagaataacaccccccccccctttacctagggggatttgaatttttccgggaaaaaggccagnattaaaaccccccccccttacctacggggatagtgatacgatggcgatggcggccgcttccgcttcgccatggcgaagcgggccgcttcgtggccacgggtcctcctcctcttccgggccttcgccgccgccgccgctgagccgaagcgggtgctcgtgccggtcgcggacggcacggagccggtggaagcggccgcaaccgccgacgtgctcaaacgcgccggcgcgcgggtcaccgtcgccacggctgaccccgcgggcgacgaccgtggcctcctggtggaggccgcgttcggggtcaagctcgtcgccgacggccgcgtcgccgacctggaaggcgaggcctttgacctcatcgccctacccgggaggaatgccgggatcagctaacctcagagattgcaaggtgctggagaagatggtcaagaagcaggcagagcagggtggcctctacgccgccatctgcgccacgccggcggtgacgctggctcactggggcttgctcaaaggcttaaaggttgcaacatggatcatcattcagtcaggaggcgacttgctatccatcattcatggagaagttcaccgctgaaattatccctgtgaactctagggtggtggtagatagaaatgcagtgaccagccaagggccagcaacagcaattgaatatgctctcgctttggtggagcaactgtacggcaaagagaagtcggaggaggttgcaggacccttggtatgttcgtcctcaacctggggttgactatgtcatagatgagttcaattcagttgagtggaaatgcagtggtacacctcagcaggttcttgtgccagttgctaatggttcggaggaaatggaagctcttaatttaatagatatcttgcgtagagcaggagcaaatgttactgttgcatcagttgaggataagttgcaagttgtgacccgccgccacaaatttaacctgatagctgatattatggtggaagaagctgccaaaagggaatcgatctgattgtcatgccggggtggtctgccaggtgctcaaaagctttctagtacaaaggtacttgtagatttactaaagaaacaggcagaatctaataaaccatatggtgcaatatgcgcttctcctgcttatgttctcgagccccatggtttactgaagaggggaagaaggcaacatcatttccaccaatggcacacctgcttactgatcagagtgcatgtgacagtagggtggttgttgatggtaaccttatcactagcaaagccccaggctccgcgacagagttcgcgctagccattgttgagaagctgtttggtcgagagaaagcggtcagtatagcgaaggagttgatttttatgtga

SEQ ID NO: 1234 - DNA, 1627 bp, Oryza sativa
  misc_feature (63)..(63): n = any nucleotide
  misc_feature (66)..(66): n = any nucleotide
  misc_feature (107)..(107): n = any nucleotide
  misc_feature (113)..(113): n = any nucleotide
  misc_feature (121)..(121): n = any nucleotide
  misc_feature (123)..(123): n = any nucleotide
  misc_feature (148)..(148): n = any nucleotide
ctccaggagctgctctgcgccgtcgtcctcgccgagtgcgtctacaagaggcctgtttctganatnatgagatattttaataagttcaaatctgattttggtggacncattgngccccttnancgttttcagccatccttggatcatntaggacatagaggtatgtgttagcagaggctggtgatacattatttgctacatttatcggtacaaaacaatacaatatagagatattattgctgatgtgaatatactccaaggaaccgtatttcatgaggataccgcaaaatcaaaacctgctgcacaccggattcctgctctggagctatacaaacttgctcagaaaaagaacaggaaacttgttctgtgcggacattcgcttggtggagcggtagctgctttggctacccttgcaatattaagagtacttgcatcctcatctccatctaaagagcctgacaggcttcaggtgaagtgtatcacgttttctcagccaccagttgggaatgctgcactgagagatacgttcatcgaagaggatggcaagattatttcaaatcctactgtattccagaggacttggtgccacgagcaacttgttctaggtgttggtcctgttcaaaagtcactctggagactttcaaagcttgttcctttggaaggagtgcgaaaagcaatctcttgagattcaagaaggttcagaaggaattgctcttaccccagagtaccttctttgccttcatatgttccatttggtgaggctatacctgttgggagattcatcagtcaatacactttcagattcagagtactccaagatgacatcggtgcagtcagttataacggaattaagagagcgtttgcaatcacactcaatgaaatcttatagggctcgcttccagaaagaatatatgacatctgcatgtctgcaaatgcccagctttttacaggcattgaacaattgccacaattttcacatctacaagaactactcggtctaacagctgctgattctgttgaacttggccatattgtggagcctcctactattcgaactgccacttctattcttcctcttggatggaatggctaccctggtgataaaagtgctgaacccctgaaagttgatataattggacatgacctgcatatgtgcactcttttccaggctcagataaatggaaactgtattcatcagatcaggaagtgcagcctacattgcaaaaaatgcgcattctagttgaagattttatggtttctgacaagtgattttgtaactatatgtaaagaggtctatgtgaggaccaggagggtgcgattgcttggactagagggagcaggtaaaacttccttgctaaaagcattgttaggacaaggtttgtgctacgtagattcggcaacagtgaacttgcagcaggaactacctttagaagttaggcagttcaaagaagaattgcagttagggatacatgatctcagcaggaagactgacttagttattgttgtgcataaccttgctcatcgaattcctcagtatgctgctgccgtaggtgcatcacttggtgccggactcggggttgtaatggctgtaataatgggagctgcgtcagctctccggaagccatga

SEQ ID NO: 1235 - DNA, 1622 bp, Oryza sativa
  misc_feature (290)..(290): n = any nucleotide
  misc_feature (1331)..(1331): n = any nucleotide
atgtggtcgtgcgtgtgtcgtggcagcgcaaaaagggtacaattttcggttcgcgaggcacgcgcgggacgcgccgctggtgtcatattacaactacatcgtcgtcggcggcggcacggccgggtgcccgctggcggcgacgctgtcggagcggtcgcgcgtgctcctcctggagcgcggcggcctcccctacggcaaccgcaacgtgtccagcgagtaccacttcgccgacgcgctggccgacacgtcgccgaggtccccggcccagcggttcgtctccgaggacggcntcgtgaacgcccgggcgcgcgtgctcggcggcggcagctgcctcaacgccggcttctacacccgcgccagcagcggctacgtgcgcgccgccggctgggacccccgcctcgtcaacgcgtcgtaccggtgggtggagcgcgagctggtgttccgccccgacgtgccgcggtggcagtgcgcgctgcgcgagggcctcctccaggccggcgtcacgccggacaacggctacacgctcgaacacgtccagggcaccaagatcggcggcaccatcttcgaccgcgccggccgccgccacaccgccgccgacttcctccggcgagcccacccgaggcggctcaccgtgttcctccgcgccaccgtgtcgcagatcctcttccgacgcaccggcacccggtggcgtacggggtggtgttcacggacccggcgggcgtgcggcaccacgtgtacctgcgtggcggcgccaagagcgaggtgatcgtgacggcggggacgctggggagcccgcagctgctgatgctgagcggcgtcgggccgcgcggggagctggagaagcacggcatcctccccgtgctggaccagcccagggtcgggcagggcgtggcggacaaccccatgaactcggtgttcgtcccctccccggtgcccgtcgcgctctccctcgtccagatcgtcggcgtctcccgcttcggcaccttcatcgagggcgtcagcggctcgcagttcggcatcccggcagacggggcagctggggacggtgccgccgaaggagcggacgccggaggcgatgcggcgggcggcggaggcgatgcggcggctggacaggcgcgcgttccgcggcgggttcatcctggagaagatcctggggcccatgtcgacggggcacgtcgcgctccgatcagccgaccccgacgcgaacccggccgtgacgttcaactacttccgggacccgcgcgacgtggagcggtgcgtgcgcggcatcgagacgatcgagcgggtggtgcggtcgcgggccttcgcgcggttcacctacgccaacgcancttccccgtcaacctgctgcctcgccgcgccaccgacacgcggccgctgcagcagtattgcagggagacggtgatgaccatctggcactaccacggcggctgccatgtcggcgccgtcgtggaccaggactaccgggtgctcggcgtacgtggcctccgcgtcgtcgacagctcaaccttcaagtactcgcccggcaccaacccgcaggccaccgtcatgatgctcggcagaggtatatggggctgaagattcagaaggagaggtggacgaggaacgacgagacacattag

SEQ ID NO: 1236 - DNA, 1617 bp, Oryza sativa
  misc_feature (1326)..(1326): n = any nucleotide
atggcagcaattggtaacatgaatttgttcgacttgttcttcgtcttgcagcttctcctgtcaggagtatgcgtgctcgtcatctgctaccgatatcagcggcttaaatccatgaaaaaatgtagcctaggggttgtcagtggccgatcgtcggcgtgctcccggccatcgtcgccaacatgcaccgcctcctccgacggcgtgaccttcctgctggccacgtcgcagctcaacttccagtgccgcttctggctcgccggcttccggttcttcgtcacctgcgacccggacaacgtgcgccacatcttcacgtccaacttcgacaactaccccaagggcgacgtgttcgccgacatgttcgacgtcctcggcggcggcatcttcaacaccgacggcgagcggtggcggcggcagcggaacaaggcccagatgctcatgaccacgccgcggttccgcgccttcgtggcgcgctccagcctcgacaaggtggagaagggcctcctgcctttcctcgcgcacgtcgccgacgcccggaagacgtgcgacctgcaggacgtgttcacgcggtggtcgctcgacgcgacgtgccacctggtgttcggcgtcgaccccggctgcctggacatcggcctgccggaggtccccttcgcacgggcgatggacgacgtgctgcggacgatcttcctccgccacaccatgccagtgtcgttctggaagacgatgagatggctagggattgggcacgagaagaggaacgccgcggcgaggcggacggtcgagagcttcgtcgcgtcggccatcgcgaaacacagagccgatgacgagagcaagtccagacaaggcggcggcggaggcggcgacaagcaatcggtcgccgacttgctttcctccttcctctgcgacgacgagatcgccggcagcgccgacgccgacgtgtacatcagggacatggcgatgaacctcctcgtcgccggccgcgacaccacgagctcggcgctgtcgtggttcttctacctcctctccacgaacccgcgcgtcgagcagaagctcctgcaggagctggcgcccatcgcttcccgcaagccgcagctgcagcaggggcggctcttccccggcaacggcggcatggtgacgttcgacgcgagcgaggtgaggaacctcctgtacctgcacgcggccctttgcgaggccatgaggctgtacccgccggtgcctttggagcacaaggcggcggtcgccgacgacgtgctccccagcgggcacgaggtgatggccggcgacaaggtgctggtgttctactactccatggggaggatgaagcgggtntggggcaaggactgcagggagttcaggccggagcggtggatcaccgaggacggcaagctgcggtacgtgccgtcgaacaagttcgtcgcgttcaactccgggccgaggacatgcctcggcaaggagatggcgctcgtgcagatgaaggtcacggcggcggccatggcgtggaactttgccgtggaggtggtgccggggcacgtcgtggagccgaggctgtccgtcatactccacatgaagaatgggctcttggtaagggtcaagagaagagagccagtgatgaacacctga

SEQ ID NO: 1237 - DNA, 1617 bp, Oryza sativa
atggccggaggtgtcatcgtggcgaacgacggtgatggctccgccgtggaccacggcggacggctgacgttctcggtggtcatcacctgcctcgtggcggcctccggcggcctcatcttcggctacgacgtcggcatctcaggtaggcggcgtctcgacgatggagccgttcctgcggcggttcttccccggcgtggtgaggaggatggcggaggcgaggcccgggaacgagtactgcgtctacgacagccaggcgctgacggcgttcacgtcgtcgctgtacgtcgccgggctggtggcgtcgctcgtggccagccgcgtcaccagggcgatggggcggcaggccgtcatggtcatgggcggcgcgctcttcttcgccggcggcgccgtcaccggcttcgccgtgaacatcgccatgctcatcgtcggccgcatgctgctcggcttcggcgtcggcttcaccaaccagcaggcggctcctctcttcctcgccgagatggccccgacgcggtggcgcggctcgctcacggccgggttccagttcttcctcgccgtcggcgtcgtcatcgccaccgtcaccaactacttcgcgtcgcgcgtcccctgggggtggcgcctctccctcggcctcgcgggggcgcccgccgtcgtcatcttcctgggcgcgctcttcctcaccgacacgcccagcagcctcgtcatgcgcggcgacacggcccgcgcgcgcgccgcgctgctccgggtgcgcggggctggcgccgacgtggaggcggagctgaagggcatcgtgcgcgccgtggaggtggcgcgccagggggaggacggcgcgttccggcggatggcggcgaggcgggagtaccgcccttacctggtgttcgccgtggccatgcccatgttcttccagctcacgggcgtcatcgtgatctccttcttctccccgctggtgttccgcaccgtcgggttcggcagcaacgccgcgctgatgggcaacgtcatcctcggcgccgtcaacctcgtctgcctcatgctctccaccctcgtcatcgaccgctacggccgcaaggtgctcttcatggtcggcggcgccatcatgatcatcgcccagaaggttggggtggcgtggatcatgggggcgcaggtggggaagaacgggtcggaggcgatggcgaggccgtacgcggtggcggtggtggcgttcacgtgcctgcacacggcggggttcgggtggtcgtggggcccgctggggtgggtgatccccggcgagatattcccggtggacatccggtcggcggggcaggcgatgaacgtgtccatcggcctcggcctcaccttcgtgcagacgcagtcgttcctcgccatgctctgccggttcaggtacggcaccttcgcctactacgccgcgtgggtcgccgtcatgaccgtcttcatcgccgtcttcctgccggagaccaagggcgtcccgctcgagtccatggccaccgtctgggcgcgacactggtactggaagcggttcgcgcgggagcaaccaaagacgagcgccgacgaaccgaccgggacgtactgatgtttcacgatgtgtagatgtacttaattctgtggagtacatgtcttgtataa

SEQ ID NO: 1238 - DNA, 1606 bp, Oryza sativa
atgtcacaggactgggcttcagatagcgacaatgataagttcgagtgggacacagacggtgaggctgagacctcatctgccccggccctaaggaacatagatgctcctggtccgtccacgaggctgccgcagaatgggaaggccaacgggtcaggtgctttggttgctgaatttatgggaatgggattcccaaaagaaatgatcttgaaagcgattaaggagattgttgcttgagttacttctgacttatcaggcttcggcctgtgccccccagactaggatttctttcaagaaatgtcagagaaggatgaaaaaatgaagtccttagtcaacatgggttttcctgaagatgaagcaaagatggctatcgatagatgtggtgttggttgattcaatctatgcatcacaggaagcaggaaatggttactctgcaaacttatctgactatgagtcctttggaggaagaaagaaaacaagatttgtggatggaagcaagaagagaaagcggtatggaagtgggccatctgggaatcaagtgccgtttgatggcagccacgaagagcccatgcctcttccaaatccaatggtgggattcagcttgcccaatgagaggttaaggtcagtccacagaaatcttcctgaccaagctcttgggccaccattcttttactatgaaaacgtggccctagctccaaaaggtgtatggacaaccatctcaaggtttttatatgacattcagcctgagtttgtggactccaagtacttttgtgctgctgccaggaagaggggttatattcataacctgccgattgagaacaggtcacctgttctcccaatgcctcccaaaacaatatctgaagcctttcctaataccaagaggtggtggccttcctgggatccaaggaggcagttcaactgcttgcaaacttgtatggcaagcgcaaagcttacagagcgaattcgttgtgctttgggtagattcagtgatgtaccaactccacaagttcagaagtatgtcttggacgaatgtaggaaatggaacctagtttgggtcggaaagaataaggtcgctcctctagagcctgatgagatggagttcctgttagggtaccctagaaaccacactaggggagttagcaggacggagaggtacagggctctcgggaattcattccaagttgatacagtagcataccatctctctgtgctgagggacctgtttcccaatggaatgaatgtcttatccctgttttctggtattggaggagcagaggtagctctccacagactggggatacatatgaaaacagtgatctctgttgagaaatcagaagtgaacagaacgattctgaagagctggtgggatcagacacaaactggaacgctgattgaaatcgccgacgtgcggcatcttactactgaaagaattgaaacattcatcagaaggtttggcggttttgacctggtgattggtggcagcccgtgcaacaaccttgctggcagcaaccgccatcaccgagatggtctggagggcgagcactccgcgctcttctacgattacattagaatattagaacatgtaaaggctaccatgtcagcagtctag

SEQ ID NO: 1239 - DNA, 1605 bp, Oryza sativa
atgccaaggaggacggcgagctcgtcgacgtcggtgaagtcgatcaagtcgttctgccagccggtggactaccgggagacgtgcgagaccacgctggagcagacggcgggcaacgcgacgaacccgacggacctcgccaaggccatcttcaaggcgacgtcggagcggatcgagaaggcggtgagggagtccgccgtgctcaacgacctcaagaacgacccgcgcacgtccgacgcgctcaaggactgcgaggagctgctcgactacgccatcgacgacctcaagacgacgttcgacaagctcggcgggttccagacgagcaacttcaagcgcgccgtggacgacgtcaagacgtggctcagctcggcgctgacgtaccaggagacgtgcctcgacgggttcgagaactctacgtcgacggaggcgtcggagaagatgcgcaaggcgctcaagagctcgcaggagctgacggagaacatcctcgccatcgtggaccagttcgccgacacgctggcgaacctggacatcaccggattcagccgccggctgctcggcgacgacggcgtgcccgtgtggatgtccaacgcgaagcgccggctgctggaggcgaccccgggctccaaggagttcaagccggacgtgacggtggcggcggacggcagcggcgacttcaagaccatcaatgaggcgctggccaaggtgccggtcaagagcacggggacgtacgtgatgtacgtgaaggccgggacgtacaaggagtacgtgtcggtggcgcgcaacgtgacgaacctggtgatgatcggcgacggcgccaccaagaccatcatcacggggaacaagagcttcatgctcaacatcaccaccaaggacacggccaccatggaggcgatcggcaacgggttcttcatgcgcggcatcggcgtggagaacacggccgggtccaagaaccaccaggcggtggcgctccgcgtgcagagcgaccagtcggcgttctacgagtgccagttcgacgggcaccaggacacgctctacacccacaccagcaggcagtactaccgcgactgcaccatcaccggcaccatcgacttcatcttcggcaacgcgcaggtggtgctccagaactgccggatccaggtgcgccggtgcatggacaaccagcagaacatcgtgacggcgcaggggcgcaaggagaagcactccgcgggcggcacggtgatccacaactgcaccatcgagccgcacgaggacttcaaggccgacgccgccaagttcaagacgttcctcggccgcccgtggaaggagtactcgcggacgctctacatccagtccgacatcggcgggttcatcgacccgcaggggtggctgccgtggctcggcgacttcggcctcaacacctgctactacgccgaggtggagaaccgcggcgacggcgccgacatgagcaagcgcgccaagtggagaggggtcaagacggtcacgtaccagcaggcgcagcagaagtacaccgtcgagaggttcatccagggacagacgtggctcccaaagttcggcgtgccgttcatccccggcctgttgccgcaggagcagtcagggaggatacactga

SEQ ID NO: 1240 - DNA, 1543 bp, Oryza sativa
aagatcacgaactccatgaacctcatggccgacgagctggtcctgcagagaagcgagcagctgagggagctctacgactctctcctctccggcgagtgcggccaccgagcgaggaggcccgtcgctgcactgttgccggaagatctcggggacacggaatggtactacgtcgtctgcatgacctacgccttcggcccccgccaagggtgcgtatgttgccaggcaaaagcttcgcaagcaatgaatttgtttggctgacaaacgctcagtctgcagatagaaaactattccatcgcgcgcttatagcaaaacaatcgtctgcgtgccatttatcatgcatggtgtccttgagctcgggaccactgatccgatttcggaggacccggctctcgtcgaccgtatcgcggcgtcgttctgggatacgccgccccgcgcggcgttctcgtcggaggcgggagacgccgacatcgtcgtcttcgaagacctcgaccatggcaacgccgccgtcgaagcgacgacgacgacggtcccgggggagccacacgcggtagccggcggcgaggtcgccgagtgcgagcccaactccgacaacgacctcgagcagatcaccatggacgacatcggcgagctctacagcctctgcgaggagctggacgtcgtgcgccctctcgacgacgacagtagcagctgggcggtcgcggatccctggtcgtcctttcagctagttccgacgtcttctccggcgccggatcaggcgccggcggcggaagctactgacgtcgacgacgtcgtcgtcgccgctttagacagtagctccattgatggatcttgcaggccgtcgccgtcgagttttgtggcgtggaagaggacggcggactcggacgaggtgcaggccgtgccgctcatcagcggagagccgccacagaagttgctgaagaaagctgtcgccggagccggtgcctggatgaacaatggtgacagcagcgcggcggcgatgacgactcaaggaagcagcatcaagaaccatgtcatgtcagagagaaggcgccgggagaagctcaacgagatgttcctgattctcaaatcagttgtcccgtccattcacagggtggacaaagcatccattctcgcagaaacgatagcctacctcaaagagctggagaaaagagtggaagagctggaatccagcagccaaccatcgccatgtccattggaaacaagaagcaggcgaaagtgccgtgagatcactgggaagaaggtttctgcaggagcgaagagaaaggcgccggcgccggaggtggccagcgacgacgacaccgacggggagcggcgccattgtgtgagcaacgtgaacgtcaccatcatggacaacaaggaggttctcctcgagctgcaatgccagtggaaggaattgctgatgacgagagtgttcgacgcgatcaagggagtctccctggatgtcctctcggtgcaggcatcaacatcggatggtctccttggactgaagatacaagccaaggtcgtcatctcagcggctaagtag

SEQ ID NO: 1241 - DNA, 1519 bp, Oryza sativa
  misc_feature (139)..(139): n = any nucleotide
atggtggtgcgcggaggtggaggcagggcggagcgctgcggcggcgaatgcagggctccggctgcactccgccgatttctcgccggagccgggccggagcatggcggatccgcccctgggcacggaggcggaggcggangcggggtcaggcgccgtggtggttggcgcggaggccggcgccacggaggtgaagacgggcgagagcatacaggcgggcgccacggcgacggaggcggggctccggcggaactccgccgtcgagacggtggctttccaccgtgctcacggcctctgcaaccgccgcctccgcttctcgcgcgttgttgtcgttgccgccgccgcctcctctctccttcctctgttctccttcctcctctctccttcctctgttctcgatttctatgtgggctcgaagttgcagacgaacaggaggacgcctgacagacacagcctctctggagtgatgacctcattgagcagaacgaggccccacctggtcagtgggacgaccaggacgcctctgccgtcgggcggtgacgtcattgcgcaggatgaggccccacctgtcagcgagcaggaggctcgtgcaccttttaaagtgctcgccttggcgctcgcccagagccccaagccgtaaccgaaacccaagatcatcccaccgcgcccccgtctccgcctccgcctccacctccgccgctgctcgccggagcccggaagcgatggagcagttccacgacagggaccacgtgcggctgcggagccgcgtgcacggcacgtacctccacgccgatgaggacgggaggggcgtctccctgcagccgaccggggcatcgctcaccgcggtttggacggtgcacctggagggcggtagcccccagcgccgcctcctgctccacagcgccgcctacggccgataccttgcggccacaggcaagccggggccgagcggcctccgtggccaccgtgtcgcgcttatcaacctcgaccggctggacgacgagtccgtgtcgtgggaggcggttcggacggcgaaaggagatgacgtgctgctccggcacgccacggggcgcaacctacgcgccaaccatggcgctggcgccaccgttgacgatagatacagcaggatgctgctctgggtggaccaggtggttgaggccatcccctcggcagattccgtacccaggcctccaccgatctcaagggcgccaggacgggcctgagataagaaccatccggtttgtgccagcagctcctaatgggaccattgccgaggattggagaacctttcaatttactggaagatcagttcagcggttaaaggaagagattacaagccgtgctggggaggcaacccagtactgtgttcaagcaggccggtacggacgtcttatccctttgacacatgagcttcctcacaacactgagaccattgatatcatcattatgatgactggtactacagtacagatgggcggttttgatttccccccttcttgtctgtggcaatatatccatgtaa

SEQ ID NO: 1242 - DNA, 1515 bp, Oryza sativa
atgctccgctcgccgggccactccccgcgccacctctccccgtccccggcgccgtccacgcctcgcccctcctccccgacgccctcgtccgcctccgcctccgcctccgcatcggccctcgccgccgccgccactaccaccacctcctccaagcgccgccgcccggaggtgctcgacgaggacacctacgtcgcggccgtcgagcggatcatcgagcgggacttcttcccggacctcccgcgcctccgcgaccgcctcgactggctccaggccctgcgctcccgcgacccgctcgtcctccgcgacgcgcagctcaagatcctcgagcgccgccgccgcgcccagcgccagcgccagggcggccccgtgcccaccccgacgccggccacctccaccgcgctccgctccccgtccttcctcgccaccccctccgtcgccccctccgtcgccggcgacgagggcgccgacgtcgacgacgacgtcgaggccgcgctctcgctcgacgacttcttccgccgcttcaccagcgaggacaacgagtccttctcccgcatcctcgagaaggtgaaccaccgccgccgcgagcgctatgcccacctgctggagcctggtgaggtggcgaaggcgccccagttggaggacgccaagcgcgacaggataaccgatgggtacggcacgtcggggcagccgctgagcaccttggagggtgccaagttcacggccaagaacctgctcatgtactacccggctgaccgtggggaggccccgcttactgatgaggagcgcgccgagcggctcaaggggatgaccaaggagatcgacaggtcgaacaccaggttccatgggaagtcttctgttgatgatggtgcaaaggaggaggaggcagctgctatactttatgcgccagttgcaggttccactcccggaggtatggcataccatgatcctgataaagcgaagaagtacgatttggaggatctaaggaagactccaaacccattctacgttgagtcagggaagaatgcaaacaatgggtatagttttgtgagaacgccatcgccagcacctggcgtggatgagtcaccgttcatgacatggggtgagattgatggaacaccactgagactggacccagaggagacaccgggtggttctgggggaagtgatagggcgcatttcaagatcccacctccgcctgctcgggatgtaaaggcacatctgctgtcaagggatgcagcaaggaagataaaggagcgcactaaaatgttccacaagccaccgctaccatcgcctgtgaggggaggaagtgcaagcccaaggaccttctctcctgcagcacagaagtttgttaggaatgccattgcaaagtcctctcgtaccattgatgagtcgctccgagcgagctacagaggtacaaccccatctgcaaccactccaaagacaaggttttcaagagacccaagcttgggatcacgatctccatcgacaagacagggttccacccctccctggtga

SEQ ID NO: 1243 - DNA, 1509 bp, Oryza sativa
  misc_feature (488)..(488): n = any nucleotide
  misc_feature (610)..(610): n = any nucleotide
atggggttcctggtggggttggtgctggggatcgcggcgggcgtggctctcatagtgggcttcgcccgcgccgagaactcccgcgccgcccgccgccggcagctgttaaaatggctcaatcaagagctgataaaaatatggccatttgtgaacgcggcagcatcagaactgatcaaaacctccgtggagcctgttcttgaacaatatcgaccaataatcttagcttctctcaagttctcaaaactcactcttggtactgttgcaccacagtttactgggtgtttcgatcattgagaatgacgaatcaggcattgtcatggaactagagatgaattgggatgccaatccaagtatcatactagacgtaaaaactagacttggcgtgtcacttccaatacagatataggtgaaagatattggctttacaggagttttccgcttgatcttcaagccacttgttgatcagttgccctgctttggagcagttngcttttctctacgaaagaagaaaaagctggatttcagactgaaggtcattggtggtgaaatttctgctatacctgggatttcggatgctcttgagagtgatttggaactaaagcctgttggnacattggaagtcaagctagtacaagcgagggatttgacgaacaaagatctgataggaaaatctgacccttttgcaattgtgtatgtacgacccttgccagataaaatgaagagaagtaaaacaattcctatctggaatgaacactttgagtttattgttgaagatgcagatactcagactgtgacagtgaagatttatgatgatgatggtattcaggaatctgaattgattggctgtgctcaagttactctgaaggatctacagccaggcaaagtgaaggatgtctggttgaagcttgtaaaagacttggagattcaaagggaccggaaagatcggggtcaggtgcatcttgagctactctactgcccatttgacatgaaggaggagactccaaatccttttagacagcagttttctatgacatccttggagaggacaatgacgagcatggaaaatggtcttccaggaagaaaaaagaaatcattatgcggggagttttgtcagtaactgtgatatctggggaagatctgccagcaatggatatgaatggaaagtctgacccatatgttgtactttcactcaagaaatcaaaaaccaagtacaagacaagggttgtgagcgaaagcttgaatccagtttggaaccaaacttttgattttgttgtcgaagatggtttacatgatatgcttatgttggaagtatatgatcatgatacttttagtagagattacatgggacggtgcatcctaacattaacgaaggtcttgatcgaagaagattacaaggacagcttcaaactggagggagcaaagtccgggaaactgaacttgcatctgaagtggtcgccgcaaccaatcttccgtgattcgcgagaagaggacagcttaagattcagatga

SEQ ID NO: 1244 - DNA, 1503 bp, Oryza sativa
  misc_feature (135)..(135): n = any nucleotide
  misc_feature (180)..(180): n = any nucleotide
  misc_feature (330)..(330): n = any nucleotide
  misc_feature (333)..(333): n = any nucleotide
  misc_feature (339)..(339): n = any nucleotide
  misc_feature (441)..(441): n = any nucleotide
  misc_feature (578)..(578): n = any nucleotide
atggacgaggaccacgactgcgaccccgaccagccgccggccggagcggcggcgggggcgagcccgtgctcgtgctgctcgacgccgtgcgcggtcgcgacgtggcggcggtcggtgaagaggaagctggggganaagggggatggggaggggaagggggaaggggcggtggtgctggcncgggtggaggcggaggaggaggcggcggcgctgcgggaggcggtggcggctgcgcaggagacggccgcggcgctgcggtcggaggtggaggaggagcggctcgcggcggccagcgccgcgagcgaggccatggccatgatgctgcgcctncancggganaaggccgaggtccagatggagctccgccagttccgccgcttcgccgacgagaagatggcgctcgacgccgccgagatcgaccacttccgcgccgccctggcncgccgcgcccgccacctggcgcgcctccgctccacgctccgggagtaccgccacacgtgcctccgcctcggcatcccactcgccgagggcgaccaagccgatgagttggccctagacgacgggttcgttctcgaggncgaggatggcgacggcgccggatactacccagagctacgctgctacgacggggagtactactacgaggatggccaaaaggagggcgaggaggaggacgatcccgttgtcgtcgatctggagcgccggatctacctcctcgagcacgaccacaaaaaccatggagttgagctgtgcttggaggaagaggaaggcgctccactttacgcagacgagccgctgccggattcatctgagcaggaattgaacagcgtatatgtcgacgaggcattgcctgaagggactgtgcaggaaagaaaccaatgcagtgatgatgatgatgagttgccggagtctccagctgctagaaatggcagtgaggaagagggaagcgatagtgatggtggtcgcagcggcagtggcagcgatagggtatacacaatcgacaaggtgcatcaaggtgctactgctccagcagctagggtcttagagaattaccaggatggggaagtggagccagacattaagaagctatacatgagactggaggcgctggaggcagaccgggagtcaatgcggcaagccctggtggcaatgcactcggagaaggctcagcttgtgctcctccgggagattgcacagcagctagccaaggatgctactccagctaacacaggaggatttggggtggtgccaactgtgcaccattttcctggaaagcaagatgggttcagagatcagaggtttcgggaaaacaggaagatggcgattgccaagagactctccatggttgcgttgtgtaagtggattgttgctttatttcgctctcagaaaaggaacccatcacaaagcaggtacacatttggtctatctggcaacaatgtcggcttgctagtactcctggacaagtacccgcggattcagaaaactctcacaagaagaaagtaa

SEQ ID NO: 1245 - DNA, 1479 bp, Oryza sativa
  misc_feature (300)..(300): n = any nucleotide
atggcaggcggtggcggcaagtccgtagcggcggcgctggccatggcctgcttcctcctcatcctcgccgccttcgctcccccggcggcggcggcgccgccggacatcatgtcgatcatcaggtacaacgcggagcacggggtccgggggctggagcggacggaggccgaggcgcgcgccgcgtacgacctgtggttggcgcggcaccggcgcggcggcggcggcggctcgcgcaacgggttcatcggcgagcacgagcgccggttccgcgtgttctgggacaacctcaagttcgtcgangcccaaaaagcccgcgccgacgagcgcggcgggttccgcctcgggatgaaccgcttcgccgacctcaccaacggcgagttccgcgccacctacctcggcaccacgcccgccggcagggggcgccgcgtcggggaggcgtaccgccacgacggcgtcgaggcgctgccggactccgtggactggagggacaagggcgccgtcgtcgcccccgtcaagaaccagggccagtgcggtagctgctgggcgttctcggcggtcgccgccgtggagggcatcaacaagatcgtcaccggcgagctggtgtcgctgtcggagcaggagctggtggagtgcgcgaggaacgggcagaacagcggctgcaacggtgggatcatggacgacgcgttcgccttcatcgcccggaacggcggcctcgacacggaggaggactacccgtacacggccatggacggcaagtgcaacctcgccaagaggagccgcaaggtggtgtccatcgacggcttcgaggacgtgcccgagaacgacgagctgtcgctccagaaggccgtggcgcaccagcccgtcagcgtcgccatcgacgccggcggccgcgagttccagctctacgactccggcgtgttcaccggccggtgcggcaccaacctggaccacggcgtggtggcggtggggtacggcacggacgccgccaccggcgccgcctactggacggtgcgcaactcgtgggggcccgactggggcgagaacggctacatccgcatggagcgcaacgtcaccgcgcgcaccggcaagtgcggcatcgccatgatggcgtcctacccgatcaagaaggggcccaacccgaagccgtcgccgccgtctccggcgccatcgccgccgcagcaatgcgaccggtacagcaagtgcccggcggggaccacctgctgctgcaactacgggatcaggaaccactgcatcgtgtggggatgctgccccgtcgagggcgccacctgctgcaaggatcactccacctgctgccccaaggagtatcccgtctgcaacgccaaggctcgcacttgctccaagagcaagaacagcccgtacaatatcaggactccggcggcgatggcacgaagtgttccggaacaacctgattcaatctcttttgtagttttgaatagggaagatctagggtgtgtttag

SEQ ID NO: 1246 - DNA, 1479 bp, Oryza sativa
atggcgaggcgacagcgccacgccgtgatgatcccgtacccggcgcagggccacatcacgccgatgatgaagctggccaagctgctccacgcgcgtggcttccacgtcaccttcgtcaacaccgagttcaaccaccgccgcatgctcgcctcccggggcgccgccgcgctcgacggcggcgtaccggggttccgcttcgccgccatccccgacggcctcccgccgtccgacgccgacgccacccaggacatccccgcgctctgccgctccaccatgaccacctgcctcccccacgtcgtcgccctcctcgccgagctcaatgacccgacctccggtgtgccgccggtcacgtgcgtcgtggcggacgccatcatgtcgttcgcgtacgacgcggcaaggcggatcggcgtgccgtgcaccgcgctgtgcacgccgagcgcctgcggcttcgtggggtacagccactaccggcagctcgtggagcgcggcctcgtgccgctcaaggacgcggcgcagctcgccgacgggtacctcgacacggtggtggacggcgcgcgcggcatgtgcgacggcgtccagctgcgcgacttccccagcttcatccgcaccacggaccgcggcgacatcatgctcaacttcatcatgcgcgaggccgagcggctcaccctccccgacgccgtcatcctcaacaccttcgacgacctcgagcggccggcgctggacgccatgcgcgccatcctcccaccggtctacaccgtcgggccgctccacctccacgttcgccacgtcgtccccaagggcagcccgctggacacagccatcggctcgaacctctggaaggagcagggcggcctcctcgagtggctcgacggccggccgccgcgctccgtcgtgtacgtcaactacggcagcatcgccgtgatgacgaacgagcagctcctggagttcgcctggggcctcgcccacagcggctacccattcctctggaacgtgcgccccgacctcgtcaagggcgacgccgccgtgctgccgccggagttcctcgccgccgtggagggccgcggcatgctgacgacatggtgcccgcaggagcaggtgatcgagcaccccgcggtgggtgtgttcctgacgcactccgggtggaactcgacgctggagagcctcgccgcgggcgtgccgatgctgagctggccgttcttcgcggagcagcagacgaactgccggtacaagcgcacggagtggggcgtcgggatggagatcggcggcgaggtggagcggagcgacgtggccgccacgatacgggaggccatggagggggagaaagggcgggagatgcggcgtcgcgcggcggagtggaaggagatggccacgagggtgacgctgcccggtggaaccgcggatatcaacttgacaaggcttatcgacgaggtgctgctcagtggtgggaagaagcgtcaagctttggacgcccgtgactga

SEQ ID NO: 1247 - DNA, 1467 bp, Oryza sativa
  misc_feature (297)..(297): n = any nucleotide
  misc_feature (457)..(457): n = any nucleotide
  misc_feature (557)..(557): n = any nucleotide
atggacgccgccgcaatggaatccctcatcctggagctccacgccatcgaggccgtcaagttcggcgccttcgtgctcaagtccggcatcacctccccgatctacctcgacctccgcatgctcgtcgcccacccgcgcctcctctccaccgtcgcctccctcctcggctccctcccggcgacccgcccctacgacctcctctgcggcgtcccctacaccgcgctccccatcgcctccgtcctctccgccgccgcctccgtccccatgctcctccgccgctaccacgtcacgccgcangccgccgccgaatgcctcgacgggtccttccgcgccggggacgccgtgctcatcgtcgaggacctcgtcaccacgggctcctccgtgctcgagaccgtcgcgccactccgcgaggtcgggctcgtcgtcgccgacgccgtcgtggtcatcgaccgcgaancagggcgggagggagaacctcgccgcgaacggggtcgcgctccactcgctcatgacgctcacggaggtgcctcgccgtcctcgtgaagcgcgggaagctnggcgaggagaaggcccaggaggtgaagcgattcctcgacgcaaacaggaagatggctgtgccgggactgccggttaaaccgaaagtagttaggaaggcattttctgagagagctggattggcgacgaatccgatggggaggaagctgttcgagttgatggaggccaagcaaagcaacttgtgtgttgctgcagatgtcgggacagcaacagagctacttgatctcgccgataagttggtccagagatctgcatgttgaaaactcatgtggatatcttgtctgattttacaccggattttggccacaagctccgttcggattgctgagaggcacagctttttgatatttgaagaccgcaagtttgcagacattggaaacacagtaactatgcaatatgaagggaggaatattccgcatattagactgggctgatattgttaatgcacatatagtttctggacctggaattgtagaaggcttgaagctgaagctgaagggtctgccaaaaggaagagggttacttttgctttctgaaatgagttcagctggcaaccttgctcatggagattacactgctgcagccgtgaagattgctgagcaacattctgatattgtaattggatttatatcagtaaatcctgcatcttggtcagtgacgccgtcaagtccagcgttcatccatgctactcctggagttcagttggttgctgggggagactcgcttggtcaacagtacaacactccttactctgtcataaacgacagaggcagcgacataattatagtcggtcgtgggattataagggcgaacaatcctgctgagaccgcgagagagtaccgcatccaaggatggcatgcttaccaatccagcttatcatgagaatgctgtaaggtctctcccattctgtaa

SEQ ID NO: 1248 - DNA, 1443 bp, Oryza sativa
atgtgttccatttttataaacagtgccattttacaggcaagccttgctgattctttcttagcggatcttgatgaactttcagacaatgaagcctatcctgtgggcacggaagagattggtgatgatgatatgcctgacctcgagtctcttaattatgatgaccttgatagtgtttcaaagcttcagaaaacacaacgttacaatgacattatgcaaaaagttgaaaatgcacttcagaaaggtacagatttttccaatcaaaggtcgatcctggaggaagatccagaataccagctgattgttgattgcaatgctctatcagtagatattgagaatgagatcattataatccataatttcatacgtgacaagtataggctgaagtttcctgaactagaatcccttgttcatcatccgatcgattatgctcgtgttgtccagaagattggaaatgagatggatttaacgcttgtagatctggaagggcttttaccttctgcaattataatggtaatttcagtgacagcatcaacgacaagtgggaagccgctttccgaggagaacttggtaaaaactattgaagcatgtgagagagcccttactcttgatgctgcaaagaagaaggtacttgaatttgtagagagcagaatgggttacattgcaccaaacctgtctgccattgttggcagcgctgttgcctcgaagttgatgggaactgctggtggtttgggagcacttgcaaaaatgcctgcttgtaacgttcagttacttggtgctaagaggaaaaatcttgctgggttttctactgccacatctcagtttcgtgttggctatcttgaacaaaccgatgtattccagagtaccccaccagctctgaggactcgtgcttgcagacttatagctgcaaagtcaactctagcagcaaggattgattcgatcagaggtgatccaacaggaaaagctgggcgtaacttgttagaagaaatccgtaagaagattgagaagtggcaagaaccgcctcctgcaaagcttccaaaaccacttcctgttccagactttgagcctaaaaagaagagagggggtcggcggcttcgaaaaagaaagagatatgcacaaactgatatgatgaagcttgctaaccgaatgcagtttggtgtaccagaagagagctcattggtcatcaggtgatggtttaggggaaggttatggcatgcttggacaggcaggaagtggaaagctacgcgtgtcaactgcaccaagcaaactttctgcaaaaattaccaagaaacatcggggctgacttctagtttggcgtttacaccagttcaggtccaggggatagagttgtcaaatccacaggcccacggcaacctgcttggaagtggaactcagagcacctatttttcagagaccgggacgttctcgaagatcaaaaggacctga

SEQ ID NO: 1249 - DNA, 1391 bp, Oryza sativa
atgggcttttcctgcacgtcggccattatcagatcagtggaggactcgtgcgcgcggctgattcttgatttttgcagctctctgcaccatccacgcccaccacctgttcgacgaaacgcctcagcgcctcttgggtcaccgggttggctcatggaaccggagaaagcacccggcagaggcaggctcatgctcagcgacctccccgacgacctcatccgccgcatcatgtccttcctctacgcgcgccaagccgtgcggacgtgcgtgctgtcccggcgctggcgcgacctctggcgctccctcacccgcatcaacgccgacttctgcgagttcaagggggacaccaggacatgggtgggggacaaggcgcggttcgagaagttcctcaacgctctactgttgcgccgtgaccccgtcctattggtggacaagttctggctcagatgccccagctgcagcttcggggtttactcattagatgctaacctgtggatcagccatgtgttacagttgcaagccccggttctggatgttcgcgcagtgggcatcagccgtctcaatcaggcagtatttacctcccagtacttgagaagattggccctctcctcggttgttttgtccaaaggtttcttcaatcaactcaagatgcgctgcccggaattggaatgtctcttcttgcgagactgccatattcacgatcatcacatctcctcccagacactgaagatcctcacaatcaatatctctgatttcagtttcgttgacaagtacgattgctgcatttccactccgagcgtcactgctctgacattgtttggtccgaaagggcgggtacctttgctacaggacatggcatcactagtgtctgcttcagtttatcttgccaatgatttcagtaattttggtactgctggtgatgtccatcggttgctcacaagcttatctggtgtcaaatatttggccttggattttgatggggtaaatgagaggtgcagataacaaatgaaaacaatatacaatggtgtccagaattcattgatcttgtaagcctgactctgggttcgtggtgtctggagtcaaacttctatggactgactgtcttccttcagaactcaccgaaactggagaagctgacattgaaactcaataaagtagttcatactcgaagaatcgttggcaagcttaaagaaaaatcatttacttgtgaacgccttaaggttgttgaagtcatatgcattggggatgatcctctggtgaactgcgtggaagaattctttttcaacagcggcatgacctctcttcagattagaatcaaccacctggacggctacgagctttatgaacctaggttatacagagatgagtacaggcgtcgacagtacatgggttaa

SEQ ID NO: 1250 - DNA, 1389 bp, Oryza sativa
gacccggcgcgcgtcacccagctatcctggcgccccagagggcgttcctgtacagcggcttcctctcgcacgacgagtgcgaccacctcgtcaatctggcgaaggggaggatggagaagtcgatggttgcagacaatgattccggcaagagtatcatgagccaaggacgacattgtttctggaattgaaaagcgtgtagctgcttggacatttcttcctgaaggaaaacgccgagtcaattcagattctgcattatgagcttggtcagaagtatgatgcccacttcgattatttccatgacaagaacaaccttaagcgtgggggtcatcgagtcgccactgtgcttatgtacttgaccgatgtcaaaaagggtggagagactgtatttccaaatgctgcggtgaagccaaagaaaggcgatgcgctactgttcttcagtctccatgttaacgcgacaacggatccagccagtcttcatggaagctgtccggtgatcgaaggcgagaaatggtctgcaacgaaatggatccatgtcagatcatttgataatcctccggatgtaagcctggatttgccgtgttccgatgaaaacgagcgctgcacgagatgggctgctgttggagagtgttacaggaacccaaaatacatggttggcaccaaggattcgctcggattctgccgcaagagctgctttttttacaagggcttcctttcagatgatgagtgcgaccaccttgtcaagttgaagctgaagaggtccatggtggcagacaatgagtcgggaaagagtgttatgagcgaagtgcgcaccagctctggcatgttcttggacaaacaacaggcagcttggaccctgcttccgcaagcagatactccgatacgagaacggacaaaaatatgatcctcattttgattattttcaagacaaagtcaatcaactgcagggcggtcaccgttatgcaacggtgctgacatatctatcaactgttgagaaaggaggtgaaaccgtcttcccaaatgctgagcaacctaaagatgattcattttcagactgtgcaaaaaagggcttggcagtatgcagtgaaagcagtgaagggtgattctgtgctgttctttaatcttcagcctgatggcacaccagacccgcttagcctccatggaagctgcccagttatagagggcgagaaatggtctgcgccaaagtggattcatgtgcggtcttacgacaatgcatcaagcatgaagcaaagtgaagaatgttctgatttgagcgagaattgcgcggcttgggctgcatcgggtgaatgcaataacaacgcagtctacatgattggaacggaagatgcacccggtcagtgccagaagagttgcaatgcttgcagtttatag

SEQ ID NO: 1251 - DNA, 1384 bp, Oryza sativa
  misc_feature (610)..(610): n = any nucleotide
  misc_feature (668)..(668): n = any nucleotide
  misc_feature (676)..(676): n = any nucleotide
  misc_feature (898)..(898): n = any nucleotide
gatacgtcgcgtgcttgctttgcgttcgtagctttgtgcagacgctgccaagattgtcaggaggccaaagatcacaacggttgttgctcagcaaccaccaggaatccgtcgagccctcgctgacgtcagtaatctcgtcaatggccgggctgctctgcctgtcgttaatcgccagaaggctccagcagcagctgacaagtgcaggaaaccaatcaagcagcgcaacgagaacaacaaggctaagccagaagtcatcgtgatcagttcggactccgagaaacagaagaaaagtccagcccagagagcagcctcccggagggcaccaatccaaacgctcacctcgattctgaccaagtgcagcaggggcttctggcggtgtgatcagcccgaaaaaggagctgatatacgacatcgatgcatctgatgctcacaacgagctggcagtgattgattacgtcgaagatatctacagattctacaggagcactgagagaacacctaccggcctctctgcacctacatggtgtcacagaccgagatcaacgagagaatgagagcaatcctgactgattggctcatcgaagtgcactacaggcttatgctgatgccngagaccctgtacctcactgtctacataattgatcagtacctgtccctggagaatgtgnccaggaangagctgcagcttgtcggagtaagcgccatgttgatagcctgcaagtatgaggagacttgggctccattgttaaggacttccttgtcatatcagacaactccttcagcaggcagcaggttctgagcacagagaagtccatacttaacaagctccagtggaacctgactgttccgacaatgtacatgttcatccttcgatacctgaaagctgcattgggtgacnaggagagctggagcacatgactttcttctacgcagagctcgcactggttcagtactccatgctcttttttgcgccatcggtgatagcagccgctgccgtctacgctgctcggtgtacccttggcctgagcccactatggagcgatcttctggagtaccacaccggcttagctgagccgcaattgctggagtgtgcgaggcggctggtgagcctgcacgcggcggcgccggagagcaggcagaaggtggtgtacaagaagtacgcgagccccaagctcggagccgtctccctccactcgccggccaagaagcttctcccgccgccgtcgccggtggcggcttgagctctcgctgttggaattttggcctcgattggaagaacatgtgcatagataggatcggatcgtcgccgcgtcgtcgtatcatcgctttgatgttaccccccgtttctgatttgattcttccaaattttgggttcctgatttga

SEQ ID NO: 1252 - DNA, 1380 bp, Oryza sativa
ttgttcaaacgagcctcagaaatgatgaacctaaggaaatatgatggatcacttggtctgctaaatgctgtgttggaggttgacccaaatcactcagaagcttacaggcagcgtgcatctgtgcttcgtcacaagtgcagtatagcaaatacctggagctaaaacctgggagttcttctgtggaaaaggaattatctcaactgcttcaggctcaaaatgcattagagtctgcttatggccaatttgaatctcatgacttctcaaaagtcctggagtacatcaacaaaattgtgcttgttttttctccaaactgcttaaaggcgaagcttctcaaggctaaagcattgctagcacttgaagactactcaagtgttatctcagaaacaggatttattctgaaggaagatgaagataacctggatgccttgttgcttcgtggccgagcatattactacctcgctgatcatgatgttgcatccagaggcactaccagaaaggccttcgtctagaccctgaacattcagaactgaagaaagcatattttgggttgaaaaatcttctgaagaagactaagagtgctgaagataatgctgccaagggtaagctacgtgtgtctgctgaggactacaaggcagccctagcaatggatccagatcatacttcttacaatgtacatctttatcttgggctatgtaaggttctggttaaactcggaagaggcaaggaggctatcagtagctgtacagaagcactcaacatagatggagaacttgttgatgcattaacacagcagagaggtgaagctaagcttcttacagaagactgggaaggagcggttcaggatctaaaagaagcttcccagaaatctccccagcaggacatgggaatccgagaagcactaatgagagctgaaaagcagcttaagttaagcaaaagaaaagattggtataagatccttggcatttcaaagacggcatcagctgcagatattaagcgtgcctacaagaagttggcactgcagtggcatccagataaaaatgtagataaccgagaagaagcagaaaacatgtttcgagaaattgctgcagcttatgagaggttcttggggatgaagataaacgtgtaagatacgaccgaggagaggatcttgatgagatgaatatgggaggaggaggtggtggtttcaatccttttgggggaggtggtcagcaatacacattccattacgatggtggattctatggaggaggaggattccccgggggcggctttcctggaggatttcagttcaactttggatagaaagttactgtctgtggagttggagtttgtatgtttgtttgttttaggaacgctgataagcttaacaacaggtattga

SEQ ID NO: 1253 - DNA, 1368 bp, Oryza sativa
atggaccccacctgtcatcctctttctcccctcttatctctatcctcttcgtcctctagttctgcacttccgcgcgcggatcgagttggctcgagtgctcgacggcggcacgaggagttcgacgccatccactccgacaaggccaaggcgctcctcgacacctaccgcatcggcgagctcatcaccaccggctccgggtacagctccgacaactccgtccacggcgcgtccaacctctcccagctcgcccccatccgcgaggccatcaaggccccggcgcccatcgcgctctccagcccgggcgacaaggtcccctgccaactcatcgacaagaaggagctctcccgcgacgtccgcctcttccgcttcgcgctgccgtcctttgaccaggtgctcggcctccccgtcggcaagcacatcttgatctgcgccagcatcgaagggaagctgtgcatgcgagcgtacacgccgacgagcatggtcgacgaggtcggccacttcgacctcttcatcaaggtgtacttcaagaacgagcaccccaagttccccaatggcgggctcatgacgcagtacctggacttgctccccgtgggcgcctacatcgacgtcaaggggccactcgaccacgtcgagtacaccggccgcggtgagttcgtcatcaacgacaagccgcagaacgcgcgggcgccggccggcgggaggagaggagatgcggggggcggcgcacttcgttgggcggcggcgcgtcattcatgcggaagcggccgaggcacgcgcgggtggaggtgtcgccggccgaggcggcggcggcggttgagaaggaacggcaacacaatctcaacggtggtccaatcggtcttgatctcgcggcagcggcggcgacgaacatgccgaggcacacggcgcaatcagttgcgcggaggcagcggcgtcctcctccctccagttctgcgtgtggatcgagtcggctcgacggcggcacgcggctgcagcggcgactggcgaggggaagaggaaggggcctccttcttcgtagggagggcgacgatggcggcctccatctcccccgtcgtcatctccataggcaggccgtgcagcgctggcgtgccgcccggagctcctcggcgtcgaggcggccgcggcggagacggcctcccgctgccgcccgccacggcttccatgacggagacgccactgaaggcaagagaggagctaggagttgatggtggaggcgcaggcggcggcggcggaggtggcgagggtggtggtggaggcggagttggtagcggcagcggcgcgagggatgtggcggtggcgggaggcgggagcggcggcggagtcggtggtggtgacgctggagagagatga

SEQ ID NO: 1254 - DNA, 1367 bp, Oryza sativa
  misc_feature (391)..(391): n = any nucleotide
ggtggatgggaggacggggaagaggtacgaggtcaaggtgtcggacgaggggaccgtgcgcgccaccgacttcaagaagattaccactggaaaggacgacaagggtcttaagatctatgatcctggttatctcaacacagccccagttcgctcatccatctgctacattgatggggatgagggaattcttcgttacaggggatacccaattgaagagttggctgaaagcagctcatttgttgaggtggcctacctcctgatacggaagtttgcctacccagagccaattggctggatgggaatttgcgatttctcagcactctgctgttccccagggactcttggatatcatacaagcaatgcctcatgacgctcatcccatgggtgcctntgccagtgcaatgagcacgctttctgtcttccatccggatgcaaaccctgctcttagaggtcaagatctttacaagtcgaagcaggttagggataagcagattgtgcgagtacttgggaaggcaccaacaattgcagctgcagcgtacttgagattagctggaagacctcctatccttcctacaaatagtctctcttattcagagaacttcttgtatatgctagactcttttacaagccaaatcctagacttgctagggttctagatatcctttttattctccatgctgaacatgaaatgaactgctctacagctgctgctaggcaccttgcttcaagagtggtgttgatgtcttcactgctctttctggtgctgttggagctctatatggtccactgcatggtggtgcaaatgaggcggtacttaaaatgttaaatgaaattggaagtgtggagaatattccagatttcatcgagggagtgaaaaacagaggaagagaaagatgtcaggttttgggcaccgtgtttacaagaattatgatccccgtgctaaagtcatccgaaagctagcagaggaggtcttctctattgtcggacgggatcctcttatcgaggttgctgttgcgttggagaaggcagcattgtcagatgattattttgtcaagaggaagctgtatccaaatgtggatttttactctggcttaatatatagagggcaatgggattccctacagagttcttccctgttctgtttgcaattcctcgcatggctggttggttagcacattggaaagagtcacttgatgatccagacactaagattatgaggcctcagcagtcttcaggtatacactggtgtttggctgaggcattacacacctgtcagagaacgagtcccagcaagccagggcgaacagcttggtcagattgctacctctaacgcaacaaggcgtcggcgtgcaggttctgccctgtaa

SEQ ID NO: 1255 - DNA, 1359 bp, Oryza sativa
  misc_feature (165)..(165): n = any nucleotide
atgcagcggcggcggggcctcgccgcgctcgccgtcctcctcgccctcgcggcgcgcggcgcggacgcgtccgtccacgagtactcgggcggggggttcgcgccgcgggccaactccttcttcttccacggcggcagcgaggggctgtacgcctccgaccccacntcaaactcctccgcctccttcatcaggtttgactctgtcacatttcgacggacccaggagtcagcaggtaggcatgaggctatgcagcaaaagacagggttagttgaggctattattgttgagatccaggacagaagcaagattggtggttcttacttgcattctgatgcaatatgctgcactcctgagctcgataaagagaagtcctgcaaagttggtgaagtaattatacagccaaatcctgataatcctgactggccaaaaagggttcagacattttttagtggtagagatgaagaagctagcatggtcacacaagttgtatctataaacaaaacagggatgtactacctctattttatgttctgtgatccacagctcaagggattgaagattacaggcaggactgtttggcgaaacccacaaggttatctccctggtaaaatggccccaatgatgacattttatggtttcatgtcgcttgcatatcttgtacttggacttctgtggtttcttcagtttgtgcgatgctggaaggatattttgcagctgcactaccatataacagctgttattgctcttggcatgtgcgagatggctttctggtactttgagtatgctaacttcaattcgactggaaacagacctatggctataaccttgtgggcagttacatttactgctgtgaagaagaccatatctcgccttcttttattagtggtttctatgggatatggtgttgttagacccacattaggtggggttacatctaaagtaggtgctcttggtgtcgtctattttattgcttcggaaggtcttgaacttgttgaaaatcttggaaacatcaatgacttctctgggaaaacaaggttatttctggtgttacctgttgccatacttgatgctaccttcattatctggatattttcatcgctctcgagaactttggagaagctccagctgcggagaagtatggcaaaacttgaattgtatcggaagtttacaaattctctagctttgtcagttcttatctctattgcttggattggctatgagctatacttcaatgcaactgatccattgagtttgcgtattcggaggatacagctgacgaggctgatgaggaagaggataaacgtgcatgacaagttgtcatctttagtgcagctgtactcctggctgagtgctatgtga

SEQ ID NO: 1256 - DNA, 1347 bp, Oryza sativa
atgttcaagaagcatgttgatgtaaaggctctacagcgtttgtcgggagctgacaaaaagaagctcagaagaactgccaaggaaaggttcccacaagcatctgatgctgaccttgatgccatccttcctcccaagaatagggttcttgtatatggcatagagggagagttcccaatgcttttcgacattgatggaagaggccatgagctgtttccaacaggtttatgcactctggaaggttcccgatctgttgcctgcttttacacttaagggtggtgggcttccttcctttcaacctggccagccatggtcagtaaaggttcctggtaatcctgctccaattgctgttggggccacaactatgagcagtaatgaagccttaaaggcagggttacgtggcaaggctttgcggattactcactactttaaggattcattatgtctgctgatggtcgctatgttccaaatgaaggattttatgaggacattgttgttgaagatcttgtctacggaagaaattgactctcttttagataaatgtcttctgcaagctttacacacgagtgtaaaagataaagaccttcctattcctggaagtacattgtgcctacaggtgttactctggatattaagaagtcatcacacaaaaagctatccaagtggttgcaatcaaaatcttccgctggccttatttcatcaaaagaagacaagcataaaaaggaagtcatgttgcttcgtatcaatcgtgggcatccagattacatggcctttaaaccagaaaagagggtacaggagcctgttgtacagcatgataatgttgttgctgaagagcacgaagcaactggaagtagcagaaacttataagccaagctctcatgttaaccccatatttatggctgttggagcggacacgagcaagtactatagtgcatcagaggcatctgacatagtcttcagtacgttgaaaaggaaaatttggttaaacaaacagacaaggccaaagtagttttggatgttgcattatgcgacgctctctacaaaggagccatcaaaaagggttcagcatacccaaccgagatccacaagagggacctggggtcaacatttttaaaccgaatgcagattcaccatagagtagcaagagggaacgaggtggtcattcgcaagggcgccatacgaaccattcagatcatgacagagagaaggcaaggaaacaagaagatgacccggctatctggattggaatgcttcttaatggatcctgactcgttagcttctgagctgcagaagaagtttgcttgcagcaccaccacagctgagcttccaggttttccaggtaagaaaggg

SEQ ID NO: 1257 - DNA, 1338 bp, Oryza sativa
  misc_feature (642)..(642): n = any nucleotide
atgatcagacgggtggtggtgcatcgagatgcgcgtcccgattcctgtgctcgacgctcagcccttccgggtgtccggggcagtgggcttactggcttagcatcggtggccgacgatcgtgtcagcagctcccctccccctccgcgtcgcacccgtcccaagggcgacacggacggcgacaacaacctggctgctgcccctccccaccctaacccccttcgcctcgccgccgcacgagtggctcgtcggcaaagccggacggccgcaaggacggcggcggggcgctctccccacgaggaagcccagaggcgggacaccggagggccgctcggcggcggcaagacggcggccaacgcggcggctccgggcacgacggagacagatccgcaccccctagcggcggatctagcctccccgtcggcggtcgagcttgcagcgacggcgaccggaggaggccaaggggcggcgttcacggctcgacgaggaaggcgacagcggggttagcggcggcctgccccggcttgggcggccgtggacccgtccccaagcggctggatccggcctccctggctcagatctggccagggtgctgtcggtccagcggcaacgggtgcggattggaggccggcgatatggccggcntggcggtggcagtggcagacagcgacagcgactgggcagcgcccgtggtggtggcggccatcgacgacagtggccgcagctgtgtcgaggtgacggcggcggcggctgtggaggcaatggctgctgcggctggcgaggcggcgcccgtcgtcgtggctgacggcaacgatgacagtggccgcatctgcggcaaaggcggctaccgctcgcttcggtggcagatgaggaggcagggaaggcgtcgtgcagacgatcgccggcgggagtaagtggaggcgcgaccgtggccgcggtgggaggaggcatggcattctcggacggctagccagggatgtggaagacggccgcacctgaccggcgcagcagcgattggaggagggtcggaggtcagcttggcgcagagaggcgcagccaatggcgggaggccggattggcgcgagaggcgcgtccgatggaggaggtcagcacggcgcgagaggtgctgccggcggcgacggaggccggcttggcgcgagaggcgcggccagcggtggcggtggaggaggcgacctcagagcgaggaggagccgccggtggatgtggcgcggtcttcggcgcacgaaggctagctggcggggggcgccggtgcagtagtcccacatgtcggcagaggttgagtggtggtggagcatcggtgcgttagccgtggattcgtag

SEQ ID NO: 1258 - DNA, 1330 bp, Oryza sativa
ggtaccgcttcactgaacctagcagagtactctgtcattaaagcggggctgagaaatctaaaaattctcacagatctagtgtcgacacggaggtccaaaaagactaaccgagatgatgatggcagtgaggaggaaatccttcagctatggttccttgcagtctgtgaattatgccggtggcctactttatgcacatgcaaggattgatggagagcatgaggactggatatactacagtcaccggaaatctgaagcgggttattctgtagagcaagaggcctcatccactgctgaagaacctgtggtttcagtatcgcggaggagtctgcttccctggaagaagaagaggaaattgaatttacggttattgaaggtactgaagaataaaggggaacctttactgaagaaggggaatgacgaagagggaggtgatgacattgactacgatcggcgattattgaccacttctgacggaaatgctttagagtcaatatttggtgatgataattttgtagttgggaattgggagtcaaaggaagtacttagtcgtgatggccacctgaggttgtctacccaggtgttctttgcatcaattgaccagagaagcgaacgagctgcaggggagagtgcctgtacagcacttgtagctgtcattgcagattggtttgaagcaaaccaggatctgatgccaatccgctcgcagtttgatagccttatccgagaagggtctctggaatggaggaaactctgtgagaacgagacatacagagagcgatttcctgacaagcactttgatcttgaaactgtccttcatgccaagatccgcccactcacagtttcccccaacaggtcattcattgggttcttccagcctgaaagtactgaggatggaagtggattcgatttccttgatggagcaatgtcatttgacaacatatgggatgagattagccgagcagcagagtgctccactgaaaaacctactctatatattgtcagctggaatgaccatttcttcgtcctcaaggttgaggctggcgcatattacattatcgatacacttggtgagaggctgtatgaaggttgcagccaagcttacatcttgaagttttgacgaaaacactacaattcacaaatcgaagggtaaagaatcatgcaaagagtacatcaagagcttcttggctgccatcccgatccgcgagctgcaggccgacatcaagaagggtatcatagcatcgacgccactgcaccaccgtcttcagatcgagttccattacaccgaatcatgccccgaggagatcccgctgcctgctccattacctgccattga

SEQ ID NO: 1259 - DNA, 1330 bp, Oryza sativa
gccatggaagaggagtactctgccctcctctccaaccggacttgggatcttgttccctgtccctcgggcatcaacatcgtcaccggcaagtgaatcttcaagcacaagttccaatctgacggctctctcgatcggtacaaggcacggtgggttcttcggggcttcacgcagcgccccggcatcgatttcgacgagaccttcagcccggtggtgaagcctgccactgttcgcaccgtcctcagcttcgccgtctcctgcgactggccgatccatcagttggacgtcaagaacgccttcttacatagtacacttcaggagacggtctactgcatccaaccacccggcttcgtcgacaccgcccaccccgacatggtgtgccgcctcaacaagtcgttatacggcctcaagcaagcaccccgcgcctggtacagtcggttcgccaccttcctgctgaccctcgggtttgccgaggccaagtccgacacctcattcttcgtccttcggagcggcaccgacaccgtctacctcctactttacgtcgacgacatcgtcctgacggcgtcctccaccaggctccttcagtggaccatctccgcgcttcaatccgagttctccatgaaggacctgggcaccctacaccactttcttggcgtcagcgtaactcggcagccctccggactgctgctcagtcaacctagtgggggccctccagtacctcaccttcaccagaccgaacatctcctatgccgttcagcaagtgtgcctccacatgcatgatcctcgcgagcctcacctcgccgcgctcaagcggatcctccggtacattcgaggctccctggatatgggcctccacatacagcgatgtcccacgggcgacctcgttgtctactccgacgccgactgggcgggctgccccgacacatggcggtccacctcgggctacgccgtcttcctcggtgacaacctggtgtcctagtcttccaaacgccaggtcacggtgtcttgctccagcgccgaagctgagtaccgtgctgttgccaacgccgtcgctgaggtcacctggctccgtcagctacttcacgagcttcacgcacccccgcccaaggccaccctggtgtactgcgacaacgtgagtgccgtctacctctcctccaacccggtacagcatcaatggaccaagcacgtcgagatcgatcttcacttcgttcgggagaaggtcgccatcggcgccattcgagtcctccatgtacccacatcatcatagtacgccgacatcttcaccaaggggttgccgtctctggtcttcaccgaattccggtccagtctcaac

SEQ ID NO: 1260 - DNA, 1328 bp, Oryza sativa
  misc_feature (51)..(51): n = any nucleotide
gtgcgggcgaaggtgcgggagatcttcatgccggcgctgagctcgacgatnacggaggggaggatcgtctcctggacggcggcgaagggggaccgcgtcgccaagggggaccccgtggtggtggtggagtccgacaaggcggacatggacgtggagaccttctacgacgggatcgtcgccgtcgtcctcgtcccggccggtgagtccgcccccgtcggcgcccccatcgccctcctggcggagtccgaggaggaggtcgccgtcgcgcaggcgcgtgcacaggctctcccgagaggcccgggccaagaaccccttcctccccacgttcccaaggctgcgccgccgccgccgccgccaccaccaccacatgcccctcctggaccgccgccgacgaagggcgtcgccacgccgcacgccaagaagctagcgaagcagcacagggtggacatctccatggtcgtcggcaccgggccacacggccgcgtcaccggagccgacgtcgaggcggccgctggcatcaagccaaagctaaagggcccaaagggcgctccacctccgcctccgcctccacctcccgctcctcgccctccgccgccgatggcggcggcaccccggcaaccagcagcgctgccaccggtgcctggcgcgacggtggtgccgttcacgacgatgcaagccgcggtgagcaggaacatgatggagagcctgtcagtgccaacattcagagtcggctacgccgtgtgcactgacaagctcgacgcactatgcgagaaggtggagtaggttaaatcgaaaggggtcacaaagacattgttgctggtgaaggccgcggccatggcgctcacgcagcacccggttgtgaatgccagctgcagggatgggaagagcttcagttacaacagtagtatcaacattgctgtggctgtcgcgatcgagggcggccttcttacgcctgtcttggaggatgttgataagttggatgtataccttcttgcacaaaagtggagaggcctgctcaagaaggcacgcatgaagcagctccaaccagacgaatacagttcaggggacttttacgctgtctaatttgggtatgtttggtgtggatagattcgatgcaatccttccacctggtcaagcagggggctattatggctgttggaggatcgagacctactttggtggccaacaaagatggtttctttagcatcaagaacgaaatgctggtcaatgttactgctgaccacaggattatatatggtgctgatttggcagcattcctgcagacatttgcgaagatcattgaggatcctgagagcctaacattgtag

SEQ ID NO: 1261 - DNA, 1325 bp, Oryza sativa
atgatctacacggcgatagacacgttctacctgacggacgagcagctgcgggactcgccgtcgaggaaggatgggatcgacgaggccaccgagaccgccctccgcgtctacggctgcgacctcatccaggagagcggcatcctcctcaagctgaccacaagcagtgatggccacagcacaagtattgtttcatcgtttttactgcaagaaatcatttgttcggtttagcgttaagagagagttgctgcaagctgtgtttggctggcagggaagttggaggagagtccaaggagatcaaagcatataatcattgtcttccatagaatggaatgtaggagagagaacgtaccaatagaacacttagatgtgttttcaaagagaaatactcagacttgaagcatgatctggtaaggacagaacgccatctgctgaaagagatggggtttatttgccatgtagaggattcctcataagttcatatctaactaccttgcaacacttgaagcccccgaactgacgcaagaggcatggaaccttgccaacgatagagcttgcggacaactctatgtgtaagattcaagagtgaagttgtagcatgtggagttgtgtatgctgcagcaaggaggcatggcgtgcccctccctgaagatcctccctggtggaatgtgtttgatgctgatgaggcaggaattcaggaagtttgcagagttcttgctcatctctacagcctccccaagtcacaatatatacaagtgtataaggacaatgattccttcacgcataggaggacttctgatacaaatgcttcaaagaggaaagtcctgcaacgactgttgcaagcgataagggtacccctgtaccgtcaagttctagccaggaaaaggatgcactgattaaggcagggtcagataaggtgaaagaaaaaggtgacgatgatgggaagacgttaccttctgaacccaatggtaaagaaggccctgcagtgaatttgaagagtgagaagtcagaatccaatgttgatcgctctcgggaaagagaaagagatagatcaagagggcgggaccgtgatagcaggggccgggactctgatcgtgatagcaagggcagggactccgatcgggagagggagcgtgatagagaagcagacagggataggcagcggagacaccattctaaggacagaagttcagcaggatactctgacaaagagaagtcaaggcaccgctcatcaagagcagatcgtggtgatcactacagttcgcactcatctcgtgacaaagatcggcacaggcggcagtaatctagcagagctcgaaaacatgtaa

SEQ ID NO: 1262 - DNA, 1321 bp, Oryza sativa
  misc_feature (492)..(492): n = any nucleotide
  misc_feature (1239)..(1239): n = any nucleotide
  misc_feature (1255)..(1255): n = any nucleotide
atggcaaagcgcatagcctcaatgagcagcctcctccttatcgccttgctctgtctgagctctcacttggcccaagcccaggtcctcttccagtaggggttcaactgggagtcgtggaagaagcagggcgggtggtacaacttcctccatggccacgtcgacgacatcgccgcgaccggtgtcacgcacgtctggctcccaccgccgtcgcactccgtcgccccgcagggatacatgccgggccggctctacgacctggacgcttccaagtacggcacgggggcagagctcaggtcgctgatcgccgccttccacagcaaaggcatcaagtgcgtcgccgacatcgtcatcaaccaccggtgcgcggattacaaggatagccgtggcatctactgcattttcgagggtggcacgccggacagccgcctcgactggggccccgacatgatctgcagcgacgacacgcagtactccaacggccgcggtcaccgngagcaccggcgcagacttcggcgcggcgcccgacatcgaccacctcaacacgcgtgtgcagacagagctgtccgactggctcaattggctcaagtccgacgtcggcttcgacggctggcgcctcgacttcgccaagggatactcggcggccgtcgccaagacgtacgtcgacaacaccgacccgtccttcgtcgtcgccgagatatggagcaacatgcgttacgacggcaacggtgagccgtcgtggaaccaggacggtgaccggcaggagctggtgaactgggcgcaggccgtcggtggccctgcgtcagcgttcgacttcacgaccaagggcgagctgcaggcggcggtgcaaggtgagctgtggcggatgaaggacggcaacggcaaggcgccggggatgattggctggctgccagagaaggccgtcaccttcatcgacaaccatgacactggctccacacagaactcatggccgttcccctccgacaaggtcatgcagggctacgcctacatcctcacacaccctggagtaccctgcattttctacgaccatgtatttgactggaacctgaagcaggagatcagcacattagctgcagtgagatcaagaaatgagattcatcccgggagcaagctgaaaatccttgctgctgagggagacgtctatgtcgccatgatcgatgataaggtcataacaaagattgggacacggtatgacgtgggcaacttaatcccgtcagactnccatgtcgttgctcanggcaacaattactgcatttgggaaaagagcggtctcagagttcctgcagggcggcaccactattag

SEQ ID NO: 1263 - DNA, 1313 bp, Oryza sativa
ctggagcttggagtggacgagagctacacgatctatgtcgcggcggcgggcggcgtcaattcgatcgtgggtggagcaaccatagagacattcagtcaattgtgtgttttcaactacgataccaaaaatgtcgaagtgcgtcatgccccatggtacattgaagacgaaccacgctttgcttttcgtgggttgctccttggacacatcaaggcatttcctcccagtagatgtgattaaacaagtgattgactccatgtcattttctaagctgaatgttcttcattggcatatcatcgacgagcaatcttttccattagaagtaccatcatatccaaaactatggaagggttcatattcaaaattggagcgctacactgtggaagatgcacgtgatattgtcagaggtatccatgtcatggctgaaattgacgtgcctggccatgcagaatcatgggaaagggatatccaaagctctggccttctcctaagtgcagagaaccgttagatgttactagcaatttcacatttgaagttatttctggaattttgtctggatatgagaaaaatctttccatttgggctcttccacttgggtggtgatgaagtatatacagcgcaacatgactacaaaagatgcttacaaatacttcgtcctgaaggctcaagagatagcaattaaccttaattggattccaagggaagaaaccttcaactcattcaaagaaaatctcaatcctctaaccgtggtgcataactgaaagttgttgaaaagggtttcagatgtataatgagtaaccaaggtgtatggtaccttgatcatcttgatgttccctggcaagatttctacactagtgagccactcgctggaattaataacacagcacagcaaaagcttgtacttggtggagaggtttgcatgtggggtgagacagcagacacctctgatgttcagcaaacgatatggccacgagcagctgcagcagcaggagcgtatgtggagtcagttagaggccatatctgcccaagacctggaaacaaccgtcttggctcggttacactatttcagatgcctgctgaatcaccgtggaatcgctgcagctccagtcacaaactcttatgctcggcgtcccccaattggtcctggttcatgcttcattcagtaaacagggagctgcagagcaaagataggcataagaggggtatttgcctccatacaccttccacacttcagacaaaaatggtatcttgtcaattttagtgtactgtttctgtatgtttgtttgcattacattacctatcacacggatgtttga

SEQ ID NO: 1264 - DNA, 1308 bp, Oryza sativa
  misc_feature (469)..(469): n = any nucleotide
atggatcatcagctggtagctcgaggtctcttcaagcctctcctcctcttcgtcgccggcctgattgttctctacgcgctccgccgccgccgccgccaccgccggagcagcggcctgcgcctcccgccgagcccgttcgggctgcccatcctgggccacctccacctgctcgcgccgctgccgcaccaggcgctccaccgcctcgccgcgcgccacggcccgctcctcttcctccgcctcggctccgtcccctgcgtcgccgcctgctcgccggacgccgcccgcgaggtgctcaagacccacgaggccgcgttcctcgaccgccccaagcccgccgccgtccaccgcctcacctactacgggccctactggcgcttcatgaagcgcgcgtgcgtgcacgagctcctcgccggacgaacgctcgacctcatgggcctcaccggcgacatcgcggaggagatgcggagcntggtcgccgagacggcggagctcaccggcacgttcaacctgcaggactacatcggcgtcttcaagtactgggacgtgcaggggctcggcaagcgcatcaaggacctccttgacatgctcttcgacatgcacgaagacgaagccgccgagatgcgtctcaccagagacaacatcaaggcgttcatgctggacatcttcgcggcggggacggacacgacgacgatcacgctggagtgggcgctgtcagagctaatcaacaacccgcccgtcctccgcaagctacaggcggagctcgacgcggtggtcggcggcgcgcggctcgccgacgagtcggacatcccgagcctcccgtacctgcaggccgtggcgaaggagacgctgcggctgcacccgacgggcccgctcgtggtgcggcgctcgctggagcgcgccacggtggccggctacgacgtcccggcgggcgccacggtgttcgtgaacgtgtgggcgatcggccgcgacgcggcgtggtggccggagccgacggcgttccggccggagaggttcgtctccggcggcggcggcggcgggacggcggcggacgtgcgcgggcagcacttccacctgctgccgttcgggtcggggcggcggatctgccccggcgcgtcgctggcgatgctggtggtgcaggcggcgctggccgccatggtgcagtgcttcgagtggagccccgtcggcggcgcgccggtggacatggaggaggggcccgggctgacgctgccgcggaagcgcccgctcgtctgcaccgtctcgccgcggatacacccgctgccggctgctgcgtcagcatcgctgacgtga

SEQ ID NO: 1265 - DNA, 1305 bp, Oryza sativa
atggagatacaaacttcagggaagcccattgatctgctgatggagaaggttctttgtatgaacattatgtcttctgattacttcaaggagctctacaggctgaagacctatcatgaggtcattgatgaaatatacaatcaagttgatcatgtggagccttggatgactggcaattgcaggggcccctccactgcattctgtctcctctacaagttcttcaccatgaagcttactgtcaaacagatgcatggtttgttgaagcatcctgattccccatacattagagctatagggttcttgtatcttcgatatgttgcagatccgaagatcttgtggacgtggtatgagccctacttgaaggatgatgaggaattctcccctggatctaatggtcgcatgacaaccatgggtgtttatgtgcgtgatcttatacttggacagtactacttcgatagtcttcttccaagagttcctcttccagtaattcgtcaagtgacatccaatcttgagaagatgaagttgcccactaagctttctgggattactggagagtctaatcgtcatggatcagaagatactgcccgccggcctccttccgtgaaggcttctctgtcagtttcctttggacagcgtgctccgcatcgtgcatccacacgggagtcatctccagttcggaggacagtcacccatgatggccatcgtaaatcttcctcaccatctcgccgtagcggaagccgcgaggttcctgatcgtgatcgatcaagccgtgaccgttctagtcgtgactatgaccgttcaagccatgaccgtgatcgtgaccattccagtcgtgactatgaccgtccaagccatgaccgtgaccgtgatcgtgaccgttccagtcgtgactatgaccgttcaagtcgtgaccgggatcatgatagagacatcagagactatcatcggcgtgatcgtgacagcagggaccgtgactataggtctaggcattcatccgaaagacaagatgaccgaagggaccgtgaccgtgagggtagcaggcacagacggtccagctctcggcacagaagcagaagccgcagccgcagccgcagccgcagcagaagcaggagccgcagcagaaatgaggagagatccagtccttttggcaatgcaggcaaagaaaagactgctgccatctcgagcaacctagcaaagctcaaggacttgtatggtgatgtaactgagaagaaggacgacggtgaagcccctcgccgtgattcgtgcgcggaggaggttatcaggttgggtggcccgagatggagatag

SEQ ID NO: 1266 - DNA, 1296 bp, Oryza sativa
  misc_feature (880)..(885): n = any nucleotide
  misc_feature (902)..(902): n = any nucleotide
atggcatgggccgatgggcgcaacggaagtacgcaggtttggctggctaactcagcacacgtacccaaaagccaaccaagaggagaaagcaaagggaggagaaaagaagcaagcaaagcaaagcaagaagcaagaagcagctgctcagctcagctcaagcaagtaagtgaattcttgcttgatcgatccatcgatcgatcgatcggtttgctggtgatggacaagcacacttgcaagctctgcttccgccgattccacaatggccgcgctctcggcggccacatgcgctcccatgtcatggccgccgccgcggccgccgcgtactgtccgtcgtcgccggcgatgtcactggcgtccacgtcgtcgacggagatcgagatggatgagaagaaggagatgacgaagaagacggagcaggagaagacgctgacgtcgtacgtgttgcgcgagaatcccaagaggagctacaaggtgagcgccggtgaattctccggtggtggtggtggtggtggtggcggcggcgagtcgtcggtcgtgcaggacggcgagagcgacacggagtcgtccccgccgcgcggcggagcggggtcgttcttcgccgtgagccggaggcggtcgaagcgggcgcggcggcggcgtcgcgcgccggatcccgaaccggcgagcagcgtctccgacgcgacgacggaggaggacgtggccatgtcgctcttgatgctgtctcgggactcgtggacgcgttccagatccgagcacgagacccaccaccggggggcgagctcggaggccgagcagaacaacaacaacgtcgtcaacgtgttcgacgaagaagacgaggacgcccgcgacgtggccggcgaggatcacgacgaggagctcnnnnnnggcggcggcgaggccgncgcggcgcgccaccgcaccagcaggttccagtgcggcgcatgcaggaaggtgttccggtcgtaccaggcgctcggcggccaccgcgcgagcctcaagagaggcaagggcggcggctgcgtgccaccgccacgtccggcgccggcgagctccgccgccgcgccggccatccacgagtgcccattctgcttccgcgtgttcgactccggccaggccctgggcggccacaagcgcgcccacatgccatccggcggcgcgcggccctcgccctcgccgtctccggcgaaatgcggcgagagctccggctccatcgatctcaacatgccggcgacaatggaggacgacttcgagctctccgccgtgtacgacgccgagttcgccagcacgagacagtga

SEQ ID NO: 1267 - DNA, 1280 bp, Oryza sativa
gacgatggttggggatctgcacccttgaaggcagataagccggtaaaccttagaaatctgctgggtggtttaattgcaatcatcagtcgtggcggcaaaaattctgaaattcaaccgccaaaggacactaagtctagtgtcgcattcttagggtcaggtagcgatggagaaacattcttgcacgcctcagtctatgtgccaagtgctccaccattgcttgacgaagaagctctgaattacaatgtgtatagggttgtgattgaagcagaaccaccagaatggttacctgatagttatgctaactcatgcatgcaatgcgctgcttcttttactgttgttactcgtggaaggcatcattgtcgattttgtggagggatattttgtaggacatgctcaaaaggcagatgtctgttgccagccaagttccgtgagcggaatccgcaaagggtttgtgatgcttgttatgataggcttgatccgttgcagaacttattcattaattctattagcaatgccacacagactgcaaagcatgatgttatggattggactagtaccagggggtggttgaatttgcctattggattaacaatggaacatgagatttacaaggccgcaaattctgtgaggagctatagccaggtttgagcagattgcaaggctaaaccccgaaaggtctattcctcatgcagtccttagtggagcaagtgggcttgctatcctgacagttgtaaaagctggtgcacttcttacatacaaacttggaactggcctagtagttgctcgaagatcagatggatcttggtcaccaccatcagcaatcgtttcagttgggttaggatggggagcacagcaggttggtgctgagctaatggatttcatcatagtgcttcgtggtctggaagctgtcaggacttttagcagccagatgcatttttctgttggggcaggtttaagtgctgcagcagggcctgttggtagagtgctagaggctgacttgagagctggtgataaaggctcaggtgtttgttatacatatagctgcagcaaagtctgcaggtgcattcattggtgtttcgttggaagggaacttcgttgcaacccgaagggacgcaaatctgcggttttacggcgacccgtatctgacaaccagcgatattctcatgggggatatgcagagaccaaatgctgccaagtttctgtacacagcgttggatggcctgtactctgggctgagtcgttaggacgatgtaaatctcaactgtacatatttgctctga

SEQ ID NO: 1268 - DNA, 1269 bp, Oryza sativa
atggaggcaggtggtttcctcaggggcttcatcatgctatgcgtccaccttgtcctgtggtgcctggcgccgctgctgccggaagaggtgaaattgaaggtcatggtgatggtgtgcttctttgggttgaaggagaagaaggtggctagggttgcgagggcggcgctgccgaagcacttcctagagggtgtaggaatggaagggcttgaggctgtgagaggggtgaaaagtgtggtaggggtgagcagggtgatccctagggttatggtgaaaccattcctggaagattacctaggtgtggatgtggttgtggggagagaggtgaagatggtaagaggtttttatgttggtttattggagaacatgagtgatggaagttttgcccgaggtttacctggtgactccagaagaaaaacgaaaatggtcaccttgccaagagaccagtaccccaagcccttggtcttccatgatggaaggctggccttcaggccaacctttcaagccaccctagccatgttaacatggctcccattttccctccccctcaccatcttcagaacactcatctttgtcaccctcccctaccctgtttctgtggcgatcggatccgtattcggagtcagaacccgtgtcatcaactcccctgttggtcaggccaaagctgatcacccaagaaacccaaaggggcacctctacgtgtgcaaccaccggacgctgctcgacccggtctacattgcagcgatgctcaacaagaaggtctcggccgtcacctacagcgtcagccgcctcagcgagtggatatcgccgatcccgaccatccggctgacccgggatcgcgacgaggaccggaggaggatggaggaggcgctgcggcggggcgacctggtggtctgccccgaggggacgacctgccgcgagccctacctcctccggttcagcccgctgtcgctggagctcgtcgacgaggtctacctggtggctctggtgaactggtccgacatgttctacggcaactccaccggaagaagcaagtgcctggacagcttctactacttcatgaatccgcgcccggcttacgatgtcgagttcatggagaaggtgccaaccaggatggtcgtggatggcaagacctgtgagagcaaacatgtggccaacatggtgcagggtgagattggtagagtgcttgggtttgaatgcaccaagttcacccgtgagaataagtacctggcgctggcaggaaatagaggggttgttgatgcaaaccagtga

SEQ ID NO: 1269 - DNA, 1263 bp, Oryza sativa
  misc_feature (595)..(595): n = any nucleotide
atggagagggaagtcgtggtctccgaggacgcggccgcctcctcctcctcctcctcctcctccgccgccgccgcctcgttctccctcgcggaaaccagggtcatctgccgcgtgtgccagaagcagttcgcgcagtacacttgcccccgttgtaacgcccggtactgctcgctcccgtgctacaaggggcatagtgttcagtgcactgaatccttcatgcgtgagaatgttatggatgagcttaagcagatgcaacctgaagatgaatcaaagaagaagatgttagacatacttaaaaggttccacttggaagaagaagatatggattcagaaggcgaagatgagtcaattctgtcagaggagcttattcaaaaagttatgtctggagatgagatcaagcttgaagacctctctgatgatgaaatcaaacgatttcgtcaagctctggcttcaggtgaactcagcaagatgatcgagccatggacaccatggtggaaaaaaccttccgctagatcgatttccctcagtccagatggaagccagcttatcagacaagtgagtgtagaagacactgatacgtcagatccaatggctnacccagagtctagcatcagtgaaatcccagaagggccagaatctgctctcccgtcactcgaacagctaaccagagcggagccatctccgctgcttgcggttcacttggttgatatactgtacagttactgcttcacacttcgcctccacaatggcgattggcgctctgatccttttggtgcctctactgttgcgttgtctgtgtcaaaagtcatgggggaggatgctaaacctgagacagtatctgaagccctcacggcatgtatagaggagacatgctcaccggcttacaggcacaccggaggtttcaggtttgctatagctctcgtggatgatatcatcagccttctcacgttaggaggcaatgcgcttgtttgtgccctctgtgacttccgcaggctcattcatatcggtgagaggatgctcaaggcagagaaattgggcaaggcggagcgatcacggagcacccaaaagcttcgtgccgcagataggaagttgtacttcatgacatgctgggttcatgagcaaccaaatgaggcatggtcgtctttagctcgcctcgttgaggtgcagaaagcatctctggaggagttggattgcgggagtcaatttcaaagggctggtagaaagaacgatgcccaatccaaggttcttattgaggagatttga

SEQ ID NO: 1270 - DNA, 1240 bp, Oryza sativa
gtgaacaaaaccaatggcgctaatttgctgctaaatgaccagaacaagtacaagtcaatgcttattcgcacgtattcttcgctctggatgatggcaggatttgtgtttttgatatacatgggacatctatacatatgggctatggttgtcgttatccaaatctttatggcgagtgagctcttcaatctgctgaggaaggccaacgaggacaggcagcttccagggttcagactacttaactggtaaaaatggcatgcatttcttcttcactgcgatgctttttgcgtatggccgtttccttagtcggcagcttgtcaacacggtgacttcagacaagttattgtacaagcttgtgagtggcttgatcaagtaccaaatgtttatttgctactttctttatatagcaggggtttgtatggtttattctcactctaaagaaaaaggcgtacaagtatcaattcagtcaatatgcatggactcacatgatcctattgatggtatttgcacagtcatctttcactgtggccaatatatatgaaggaatgttttgtttaggttcctcctaccagcttctttgatcgctatcaacgatgttgctgcatatttcttcggcttcttctttgggaaaacacccttaattaagctctctccaaaaaaaacttgggagggctttctaggtgcatcagtgactaccatgctttctgcatttgtgtttcttttgtagcttgctaatttcatgggtcatttccagtggttaacatgccccagaaaggatttgtcgactggatggcttcattgtgatcctggctctatatttacaccagaaagttatgatttaccaggatggcctattcagtggcatgccttagctcttggcttgtttgcttcaataatagcaccatttggagggtttttcgctagtggttttaaaagagctttcaaattcaaggcatctattatcttttggaaaaaaaatatttcaatatcgaaatcttattcagtgtatacttttcaggattttggtgatagcatacctggccatggtggatttactgacaggatggattgtcaacagatggttatggctgtgtttgcttatatctattaccaatcgtttgtgatggtacaggacttatctgttgagacaatcatggagcagcagatactgagaaatctcacgttcgaggagcagcatgatctttacgagcaactaggcaagttactgacgagagggaactga

SEQ ID NO: 1271 - DNA, 1239 bp, Oryza sativa
atggcgaagcgggccgcttcgtggccacgggtcctcctcctcttccgggccttcgccgccgccgccgctgagccgaagcgggtgctcgtgccggtcgcggacggcacggagccggtggaagcggccgcaaccgccgacgtgctcaaacgcgccggcgcgcgggtcaccgtcgccacggctgaccccgcgggcgacgaccgtggcctcctggtggaggccgcgttcggggtcaagctcgtcgccgacggccgcgtcgccgacctggaaggcgaggcctttgacctcatcgccctacccggaggaatgccgggatcagctaacctcagagattgcaaggtgctggagaagatggtcaagaagcaggcagagcagggtggcctctacgccgccatctgcgccacgccggcggtgacgctggctcactggggcttgctcaaaggcttaaaggcgacttgctatccatcattcatggagaagttcaccgctgaaattatccctgtgaactctagggtggtggtagatagaaatgcagtgaccagccaagggccagcaacagcaattgaatatgctctcgctttggtggagcaactgtacggcaaagagaagtcggaggaggttgcaggacccttgtatgttcgtcctcaacctggggttgactatgtcatagatgagttcaattcagttgagtggaaatgcagtggtacacctcaggaaggaatccctggtcagggtttattaagtaagcataaggttcttgtgccagttgctaatggttcggaggaaatggaagctcttaatttaatagatatcttgcgtagagcaggagcaaatgttactgttgcatcagttgaggataagttgcaagttgtgacccgccgccacaaatttaacctgatagctgatattatgggtggtctgccaggtgctcaaaagctttctagtacaaaggtacttgtagatttactaaagaaacaggcagaatctaataaaccatatggtgcaatatgcgcttctcctgcttatgttctcgagccccatggtttactgaaggggaagaaggcaacatcatttccaccaatggcacacctgcttactgatcagagtgcatgtgacagtagggtggttgttgatggtaaccttatcactagcaaagccccaggctccgcgacagagttcgcgctagccattgttgagaagctgtttggtcgagagaaagcggtgcctgtcacctgtgagtga

SEQ ID NO: 1272 - DNA, 1231 bp, Oryza sativa
aatatgcggcgcttgagcttaggcaatagggaggcttccaattgttcagatcaggcatgaggaaatctggtttcgtggtcctacacgtgtgccaccacaacctacccgagaggaggacaaacctgtgctgactccagtaggagacagaggcaatggcgagcaaatgattatggaggcaacattagggtccccaatagcatcctgacattacttcttaaacaatggttccctggcattgtcacattgaagggtaaagaggagccagcatggagttggaaacattacaggatagcgccggatactccaagaagcaatcaaatacggctgccaagctgtctccatcgtgttgaggaagacttctggctttacttcaggtgggcagagggaaaagaacaagaagctagaaaggttgtccacaattgtgtcaagggccttgttgatcgcttgttttatgaaactcgcatcctagctgtgcttaattaccaaaggaaaatcctgaagctataggtagaaccatggtggttcctgaattcagaaaatgcatggcgggagttgatacgattgcggtggtgtaatccaaaatggcaggctgtctcacgtgctcataggatacggagggagaaaatgaaagggccatctcaccgccaaggcagtgctaacttgagccgttaccaaaaaaatttggtatgtgcatctctgtttaaacatgagaagaagaaaaagcggccagttgctccactagaggcctacacagaaggaaggagggaaaatcgagaggatggacaattcagctgtgacccgcgtgtagctgagaagcttgaggcctatgctgcagcttatgttcagttgcatgggccagaaaatgattggcgcacttctcccattgatcctgtcgctgtgcacatggctggtggtggaaagaaacatggccgtttcatgattggtgatggactcattgactcatcagcagtgtttggtgataattcgcgtgatgatccttctgcggcaactacaagaggagcgcgaggcaagggagcgagagcgtgaagagagggagcgtgagaaggagagggagcggcaggagaaggagcaggagaaggagtgtgagcgtgaagagagggcgcgagagaaggagcaggagcgtaaggagagggaggaagagcgcaaggagagggagttggaaaagatagcctctcaacagaaatcagcattctttgaagctgctttaagg

SEQ ID NO: 1273 - DNA, 1230 bp, Oryza sativa
tccagaactccacgtagaagggtgaggaaaactgagggtgccaccaagagcctggaagattcagtcaagcgaaagatggagcagttttatgaaggattggatggtccacctctccgagtccttccaataggtggccttggagaaatcggcatgaattgcatgctcgtagggaactatgaccgttacatattgatagatgcaggggtcatgtttccagagatgagttcggtgtgcaaaagattatcccagacacaacattcatcaagaaatggagtcacaaaatcgaagctgttattataacgcatggccatgaagatcacatcggtgcgttgccctggccacaggtaatcccagcgctggattcaagcacaccgattttcgcatcatcttttaccatggagctaataaagaggcgtttgaaggagtttggaatttttctctcgtcccaggcttaagaagattgacgaatcaccagtggatggaaaaatatttgatcggcaagcattggaagagctctccaaagaaggcgttacacttatgatgagtgattctacaaatgttctatcccctggaaggtccatcagcgaatctgttgttgctggttcattgttgcgacatatttcagaagcaaaaggaagagtaattaccacacagtttgcttccaatatacatcgtattgggagcatcaaagctgctgcagacttaactggtcgaaagctggtagtatttgttggaatgtcactcaggacttaccttgatgctgctttcagggatggaaagtcaccgattgatccatcaaccttgaaggtagaggacatggatgcctatgccccaaatgatcttctagttgttactacaggttcacaacaggcagagccacgtgcagctctaaatcttgcatcttttggaggaagtcatgcccttaaactatccaaagaggatgtccttctgtattctgctaaggttatccctggaaatgagtcacgtgtaatgaagatgttaaatcgccttactgagcttggtccaaaaattgtgatgggaaaggatgctggtctccatacctctgggcatgcctatcacgatgaacttgaggaagtcctacagattgtcaaaccacagcatttcttgcctgttcatggagaactcctgtttcttaaagaacatgaattacttggaagatctactggcataaggcacaccactgtaagtactctcttagcgatggtttag

SEQ ID NO: 1274 - DNA, 1224 bp, Oryza sativa
ggtgaatgttacttcagagtgcaatggtttttcacagctgaagacacgcaagcacaatcacatgacccgaggaggctcttttactcagacctgacagatgacaatttactggactgcattgtctcgaaagtgacaatcgtgcaagttcctcctagttccgactattactatgacatgaaatactctatcgactatagtacattctctaccatagaaatgggagctctctttgctagacctgtattgtggttgtggaggaatgtcaactggactatgccttggtgctcgtggtggtggtgtgaatctttcagcggatttccttgaactgttaaaagaatgggagaaattatgcaaaacatatgtgaaacatagtaggactaaggcatgtgttgacagtacaacagaatccaataatgaaactccagattgttctaccgtcccacctgaggagtttgaagtatggaagctagttgacatttgctttggtgatccaaataaagtcagcaaacacggcttgtattttaaggtccgttggaagggttatggccctcatcatgacacatgggagccagttgaaggattaagaactgcaaagaggcaattagggattttgttattgaaggccacaggcaaagaatactaccacgccctgtggacgttgtatgtgggggtccaccatgccaaggaattagtggctacaaccgcaatagagaattcgaggcaccatttaaatgtgagaaaaacaagcagatcatagtttttatggatgttgtgcaatttttgaagcccaaatatgtgtacatggaaaacgtccttgatatattgaaatttgctgatgcaacacttgcaagatatgctttaagtcggctagttgcaatgcattatcaagcaaggctagggatcatggctgctggatgttatggccttccacaatttcggatgcgtgtatttttattaggctgtcattctaaggaggaaattacccccttttccactgcctacgcatgaggcgattgtgaagaatggctgcccgttggcttttgagccttttggtcgagtatggtgggatgaggtagtgggaaccgtgctgacagttccaaatgcccgtatgcagtttcaggccttgatacatcctgcacaagacagactgcttactattcgtgaaagtgctcggttgcaaggctttcctgacaattacaggtttcgtggaacagtcaaagacag

SEQ ID NO: 1275 - DNA, 1215 bp, Oryza sativa
atgggaaaacctcggccgaataccacggcaactctcatccagtctcgtggcacagcgggcacaaaaaccgcgggcatatattacgcgcacacaaggatccaccaaaggaaaacgccatcacgtacgtattcacgatacgtacggtttgaaaccatggagctccaccctccttcatcctgcgacgacgacgccggcagctgccaaaagacgtccgtggcgtgcaaccgccagcgccacaagatcctcatcgtgaacctgctatatgaactcatgtttttcgctttcatgttcctatgcttgtatcacgcgttgtacgacttcccgtccgagttctccgtccagatcacggccatccacggcctcgaccggggattggtttggcacagggggccgtcgtttacacgtaagctacgggtgaagcatgcaaggcctggcagtccgaaacctcggccgaataccacgagtagtctcgtggcgcggcgggcacaaaatccgcgggcttattaggcacacaaggcacacaatccaccagagaaaaaggcctttcgtcacgtacgatttgaaacaatggagccccaccctccttcctcctgcgacgacaacgccggcgcctgccaaaaggcgtcagagacgtgcaaccgccagcgccgcaagatcttcgtcgtcaacctgctatatgaattcaccaatttcattttcatattcctatgcttgtatcacgcgttgtacgacttcccatccgagttctccgtccagattacggccatccgcggcctggacgacgcggcgccggcgtctccgacgatcatctcccctgctatcgacgtcacacttcacgtcaacaaccggcgcggcacggcgagatgctaccgcggcggcgaggcggtggtgagctacgagggcttcaccgtcgcgtccggcaccgtgccgggcttctgcgcgcaggggaagagggcaccggaggtgccgttcctggcgtcggccgacggcgtgggtctgcctcagcggctttgcggacgcatggccctggagcggcgtatcggcgccatgcagctggaggtcgaggtgaagctgttcgggcgcgacggcggcacggcgcccaggccgacgtggatgtcgtgcgggctgaggatggatgaagcgcaactgccgaacacggcgcattgctcggtgttggctttgcagaattggttctctcaacccttgttcggataa

SEQ ID NO: 1276 - DNA, 1213 bp, Oryza sativa
agacccaattgggaaggaggccaatatgaaggtgatgatgctacaagatttgaagcactccgtttagcaatggagctaggagtaaattatgtcgatattgaattgaaggttgctgacaaatttatcagctttatttatgggagtaagccagagaagtgcaaacttattgtctcggcacataattatgaaagtactccatcctgtgaggagcttgcagatcttgtggctagaatacaagcagttggagctgatatagtgaaaatcgcaacaacagctaatgacattgttgatgtgtcacagatgttccaagtgatggtgcactgccaaaaatgacaggtgcctatgattggactagttatgggcgaaaaaggtttaatgtcaagggtgttatcccccaagtttgggggatatctaacctttgggagtcttgatgctacaaaggtatcagcacctgggcagccaaccgtcgaagagctgatagacatttatgatataaggcgcataggacctgatacaaaggttctcggtgttatagccaacccagtaaaacagagcaagagcccagttttgcacaatacatgtcttcaatctgttggatacaatgctgtttatcttccacttttggcagacaacattgctagatttcttagcacatattcgtctccggatttttcaggattcaggccgtacagtgttgtcatgaacatgatccagttgctaagtcaataggtgccataagcactataattaggaggccagatggcaaactactgggctacaataatgactacattggagcaatttgtgccattgaggatggcataggaggttgttgtaggtgctggtggagctggcaaggcaattgcttacggggcaaaggagaagggtgcaagaattgtagtagcaaatcgtacctacgcttgctgccgcggttggtggtcatgccctgagattagccgagcttgaaactttcaggcctgaagaagggatgatccttgctaatgcaacatcgttgggaatgtaccccaatgtggatggcacccctattccaaaggtgttcgatgcggtatatgctccgaaagtcacccggcttctacgagaagcagaagaatgtggggttaaagttgtcagcggtgtggagatgtttctcagacaagccttgggtcagttcgagcgtttcacaaatggtattgaaggtattgtgtccttctaa

SEQ ID NO: 1277 - DNA, 1212 bp, Oryza sativa
atgggtatccttgagaggatcaaggagattgaagccgagatggctcggacacagaaaaataaagcaacagacagaataccatcttggacaactgaaagcaaaaatagcaaagttgaggacacaattattagagccccctaagggttccactggtggaggagatggttttgaagtcacaaagtttgggcatggtcgtgttgcacttattggatttcccagagtgttggaaagtcaactcttttgactatgttgactgggacccattctgaagctgcatcatatgagttcacaaccctcacttgcattcctggtattatccagtacaatgataccaaaatccaacttcttgatcttcctggtatcattgaaggtgcatcagaaggcaaggggcgtggtagacaggtcattgctgtcgcaaagtcatcagatcttgtgctcatggttctggatgcctcaaaaagtgaaggacaccgccaaatattaactagagaactggaagctgttggacttcgtctgaacaaaaggcctcctcagcagatatatttcaaaaagaagaagactggtggaatttctttcaacagcatgattcccttgacccatgttgatgagaagctctgctatcagatactgcatgagtacaaaattcacaacgcagaggtgttattccgcgaggatgctaccgtggatgacttcatcgatgttattgaaggaaatcggaagtacataaaatgtgtttatgtatataacaagattgatgttgttggtattgatgatgtggataagcttgctcggcaaccaaattcgcttgtgatcagctgcaatttgcagttgcagctaaacttggacaggctactagcaagaatgtgggaggaaatggggctagtgagagtgtatacaaagccacaaggacagcaacctgatttcacagatccagttgttctttctactgatagaggtggctgcacagttgaagacttctgcaaccatatccataggagtttggtcaaggatgtgaagtatgtacttgtatggggaacaagtgcgaggcattacccgcaacattgtgggcttggccatgttcttcaagacgaggatgtcgtccagatagtaaagaagaaggttgaggacggcggtcgaggccgcttcaagtcgcacacaaacgcgcccgctcgcatatccgacagggagaagaaagctcctctgaagacctga

SEQ ID NO: 1278 - DNA, 1200 bp, Oryza sativa
  misc_feature (1156)..(1156): n = any nucleotide
  misc_feature (1195)..(1195): n = any nucleotide
atggcggaaggtgccaaattccatgggatcgttggcgctgttggcgcgcatgatgttggcgggaacttctgtgacatggggtactaccagaagctaggggagggctccaacatgtcgatcgatagccttaacagcatgcagacaagcatatacggtggttcggttgcaatgtcagtggacaacagtagtgttgcatctagtgactctcgtaccgggatgcttaagcatcctggcctcaggggtccagtcattgtgtctagctattctgtcgggaacagcattttccgtccagggcgtgtgtcgcatgccttgagtgatgatgcattggcacaggctttgatggactctaggttccccactgagacactcaaggattacgaggagtggaccattgatttgggtaagctgcacatagggatgccatttgcacaaggtgcctttgggaagctctataggggaacctacaatggaggcgatgtcgcaattaagcttttggagaggccagaggctgaccctgagaaagctcagttgttggagcagcaatttgtgcaagaagtcatgatgctcgcaacgttgaggcactcaaatattgtcaagtttgttggtgcatgcaggaagccaatggtttggtgtattgtgactgagtatgcgaagggcggatccgttaggaattttttgaatagaaggcagaataggtctgtcccactgaagcttgcagtgaaacaggcattggatgttgcacgtggcatggcatatgttcatggccttggatttattcacagagatcttaagtcagacaacctattgatttctggagacaaatctatcaagattgctgactttggagtggctaggattgaagtgaagactgagggaatgacacctgaaacaggaacttaccgctggatggctccgaggtgatccagcacagaccatatgaccaaaaagtcgatgtctacagttttggcatcgtcctgtgggagctagtaactgggaaccttccttttgcaaacatgacagcagtgcaagctgcatttgcggtggtgaacaagggtgtccgcccagccataccccatgactgcctccctgccctcgcagagatcatgaccaggtgctgggatgcaaatcctgatgcccgttccccgtttacccgagntgactgtccggagggcccgcttccggtgttgcatctccnagcca

SEQ ID NO: 1279 - DNA, 1197 bp, Oryza sativa
  misc_feature (375)..(375): n = any nucleotide
  misc_feature (390)..(390): n = any nucleotide
  misc_feature (393)..(393): n = any nucleotide
  misc_feature (401)..(401): n = any nucleotide
  misc_feature (405)..(405): n = any nucleotide
  misc_feature (409)..(410): n = any nucleotide
atgaggaggagggatcacctgctgctcatggatgctgctcctcctccggcggcggtggcggcggcggtgcagacgctgatggagcccatggagttcctgtcccggtcgtggagcgtgtccgcgtcggacatatccagggtgctcaccggcggcgtcggcgcgaggcggagcaccaacttcgtggtggatcgcctctccgggatgctcatgccggagacgctcgcgctcgccgccgcctccagcacaaacctgagcccccgcaaacgctattccaggtgcaggagcgccatctccgcgcaccagcacacgatcgggagtggttccaccacagggacggagcagcagcagcagcagcagcagggtcgacaagcccgngcgagcggcgcgcgngcncgcgcgtnacgngcgnncgtggcgagccttgcggccgccgtcgcggccgtggcctccggcgcggcgaacgacccggacgacctcgacgacgccaagatggacgccgcgctggcgtccgccacacagctgctggcctcgcactgcatcgagatcgccgagctcgccggcgccgaccacgaccaggtcgcctccgcggtggaggccgccgtcgacgtgcggagccccggcgatctcatgaccctgaccgcctccgcagccacagagctctgagaggagcgacggcgctgaggctgagagcgcagcgggaggcgaggagcaaggtggcggcggtggcgccctacgagaagaccggcagctgccgcggcgacatatggtgcaaggaagggacgctcctgaaacgcagccggaaaggctttgcaccggaagcgcgtgccgtctacatcaacaagaagtcgcaggtgatcgtgaaactgaagagcaagcacatcggcggcgccttctccaagaagaagaagagcgtcgtgtacggcgtcgacgacgacgtgcagcgtgccggcgccgcacgcgtgcggcggcggcgccgtgcctcctgctccggagacggcgtcgtcggagaagtgccagttcgggctgaggacggcgcagggcgtggtcgagttccagtgcgagagcagggcgcagaagcaggactgggtggagtcggtgaagaatctgctccggcaggcggccggcgggacggctcagctcgagcactccttcgaatctctccggcttagcgcctcgtaaaacgtaaaaacccagtga

SEQ ID NO: 1280 - DNA, 1196 bp, Oryza sativa
atggagacgggacggcataggtcacagagcctgggatctgcagggctcgcgttccacgcactcctctgctcgtcgttgctgctcaacgccgtcttcttcgcgcaccacctcctcaggtcctcgccgacggcaacgccggagcggctcggcgacgggctgagctgggcgctgcaggcggccagggaggccgaggccgtggccgccgccgactgctccggccacggcaacgtgttcctggatggcgtcaccggcgaggatgggcggcccgggtccgagtgcaaccgctgcttctccgggccggactgctccgtccggacgcccaactgcaccgccgacgccgacagagcgggaacccgttgttcctggagccgtactggagacggcacgcggcagccagcgccgtggtgttctccgggtggcaccgcttgagctacatcaccaccggcggccgcttccattccgtcgagctcgatcgccacatccggctgctgcacagggccgtcggcaacgcggtcgtcgacgacaagtacttggtcttcggggccggctccatgcagctcatcaacgcgttggtgtacgcgctctcccccgacggcaacgccgactcgccgccggcaagcgtcgtcgccaccgtgccgtattacccgcaaaccgacatgtttgacggccgggagtacagatgggacggcaccaccgctacgtggtcaaacaacggctcgcgaaactccaccaaaggcttcatcgagttcgtcacctcgccgaacaaccccgacaccgcgttgcgcaagcccgtcctcgccggctcgtcggcgatcgtcgaccacgcgtactactggcctcacctgacgcacatcccggcgcccgccgacgaggacgtcatgctcttcaccgcttccaagctctccggccacgccggcagcagattcgggtgggcgctgataagggacgagaaggtggcgaaaagagcactttcgtacgtagagcagagcatcatgggcgcgtcccgggacacccagctccggatgctgaagatcctaaagtacgcgtgggtgaaatgcgagtgggaggaagacgtcgactgctacgagacgctgctggcggcggggatcatctcgcggtccggcactttatccgaggccgaagctcggtacacgcggatgagcctcctcaaggcgcaggacgacttcgacgtgctc

SEQ ID NO: 1281 - DNA, 1193 bp, Oryza sativa
cgcgcggaggccaattgcccgcgctgcgcggcccacatcccctgcgcggcgcgttcctcgagatcgtggggaggggccaccctgggagaagagcttcccacgccgcgggagatgtgccggaggctcgacgagttcgtcatcgggcaggggaaagctaaaaaggtcttgtcggtagctgtatacaatcactacaagagaatatataacgcgactgtacagaaaggaacatagaaatagataaaagcaatgtgcttctaatgggtccaactggctcagggaaaaacattactcgccaaaacactagcacgcattgtaaatgtaccattcattatagctgacgcaacatcattaacacagcaggctggatatgtaggtgaagatgtagagtcgatactgcagaagttactagtggctgaatataatgttcaagctgcccaacaagggatagtgtacatagacgaagtagataagataacaaagaagcagatagacacaaaagatattcttttcatatgtggtggcgcttttgtcgacttggagaagactatttctgaaagaggcgccaagattcatctataggttttggggcacccattcggataaacatgagaagttctgaagtgactgatccaatggtcacttcatcattgttggaatctctcctttggcaggttgagagtggcgatcttgcaagatatggtttgataccagagtttattggacgcttgcccatcctagttagtttgacagctctcaatgaagatcagcttgttcagattcaggttcttacagaaccaaagaattctctttccagacaatacaggaaaatgtttagcctgaacaaagttaagttacactttactgatggtgcacttagaatagtagccaagaaggctatagccagaaatactggtgcacgtggtctgagagccatcttggaaagccttctattggaggccatgtatgagaaaccaggaagcgaacgagtagacgctgttgtggtggatgaggaggcaataggttcaattgataggccaggatgtggagccaaaattcttcggggtgacggtgcattggagcagtacataacaaacactaacatgaagaattccatggtaggatacttgatacagttcactgaaaatctcttaatttgttatccaatagatcaaaagcaattaactcttcattaa

SEQ ID NO: 1282 - DNA, 1188 bp, Oryza sativa
atgccgacacccgagccctcgacctccgcctccgccatcgtctccggcacggtgacagggcaccacgtgctcaccatcgacggctactcccgcaccaaggcgaagctccccaccggccggttcaccgcgtctcgccctttcacggtgggaggacactcctggagcatccactactaccccagcggcgatcgctccgacaccgccggcttcatatccgtcttcctcgagctcaaccccgccgccgacgccgccgccgccgccggcagcggcggctccgagcccgtcgacgcgcgtgtcacgttcagcttgctggatcaggccgggaggtccgtgccgtcccacaccatggccacggatctgcacgacttcgccgccaccggcttcggcttcggtcgattcatcgagaggtcgtacctggagcagtcggagcatctcaagaacgatcggttcgccatccggtgcgacgtcgtcgtcttctccgacgagctccgtgcggaggcccgcaccgctgacgccgcagctctttccgtcgcggtgccgccgtcggacctgagccagcatctcggcggcctcctcgcggccaaggaactaggcgccgacgtcacgttcctggtcgccggcgagacgttcacggcgcacaggtgcgttctcgcggcccggtcgccggtgttcagggcagagctcttcggcccgatgaaagagagcgccgccacggcggtcatcaccgtcgacgacatcgagccagacgtgttcaggaacctgctcaccttcatgtacaccgacacgttgccagagacaaatccacaagagctggaggaagaagaagaagacgacgacgacgactacgaggacgatcaagctcaagctgctgcaatggtcgagcatctgctcatcgcggcggacaggtacaacctggagaggctgaagctgatctgcgaggataggctgtgcaagcacatcgacggcgagtccgtggcgacgatcttggccttggctgagcagcacagctgcgatgggttgaaggaggcgtgcttccagttcctcagctcgcgatcggctctgaattctctggtggccaccgatggcattgagcatctagctagatggtgcccctctgttctcaaccagctcatgtccaaggttgctgctcttgttcctgttgatttcgtcgtcagggaaacaagataa

SEQ ID NO: 1283 - DNA, 1188 bp, Oryza sativa
atgggtcaatgcgccatgtctcacacgcgctctaccaccgccggcgccgccggcggtaagccgccgatcgcgccgccgccgacgtcctccgcctccgccattgtcgccgacacggccagcgggtaccacctcttcaagatcaacgactactcgcgtaccagggacatcttccccaccggcagtgccctcaagtcccgcgcgttcaccattggcggccaccaatggcgcatccattactaccccaacggcaacacggaggagtgcggcgagtacatctccctgtttcttcatctcgacgagattgtcaccgacaagaacgtgtacgcgcagcacgggttccgtttattcgacgagtttgccggtgataatgatgacgatgatgaactgcagccttcctccatcgctgacctcgggcaggtcagtacctttggtggcaacaacattgggttgggacgactgaggtttatcaaaagggaagagttggagaaatcgaagtatctgaagaacgactccttcaccgtcagatgcgatgtcgtcgtcaccaagcggatccgctcggaggagacgccattggtggtgaggacctctccaaagccaaaggtggcgaggctcgtcaccgtgccgccgtccgatctgcaccggcatcttcaggacctcctctgcgccgagaagggcgccgacgtggtgttcgaggccggtggcgagacttttaccgctcaccggtgcgtgctcgcggcccggtcaccggtcttcagcgcggagctgtttggatcaatgaaggagagcgacaccacggtggtcatccgcatcgacgacatggaggcacaagtgtttagggccttgctcttcttcgtgtacaccgactcgttgccggagacgaagaaggaggacgagtatgccatgtgccagcatctactcgtcgcggcggacaggtacaacatggagaggctcaagctaatgtgcgaggagaggctatgcagctacatcggtgtgggcacggtgacgactatactggagttggccgagcaacacaattgtgatggcctaaagaaagcatgctttgattttctcagctctcaggagaatctgaaagctgtcacggccggtgagggattggagcatttgagcaggaactgcccttcccttgtgaatgagttgattggcacgctcggcaacttaattcagtga

SEQ ID NO: 1284 - DNA, 1178 bp, Oryza sativa
ttcatccgggaacacctcaggagtctcgccccgtaccagcccatcctgcccttcgaggtgttgtccgctcggcttgggcgtaaaccagaggatataatcaagttggatgcaaatgaaaatccatatggtccacctccggaggcattaggaaatttgaagtttccctatgtgtaccctgatcctgaaagccgtcagttgcgtgctgctcttgctgaagattctggtcttgaatctgagtacatacttgctggatgtggtgcagatgaattaattgatttaataatgagagatgtgtactcgaaccaggtgacaaaattgttgattgccctccaacttttacgatgtatgagtttgatgcgtcagtcaatggtgcacttgtgatcaagggtaggtaccgagacttcctgatttttctctagacgttgcacagattgtcaaagtggttgaacaggaaaagccaaaatccatatttctgacatctccgaacaacccagatggcagagcataatcaatgatgaggatcttttaaagatccttgatcttccaatacttgtagtgctggatgaagcatatattgagttttcgagtcttcaaacaaggatgtcatgggttaagaagcatgataatttgattgttcttcggacatttagcaaacgagcaggcaggtttagctggacttcgtgtgggttacggagcatttcctctaagcataatcgagtatttatggagggctaagcagccctataatgtttctgtagcagcagaagtttcagcctgtgctgccttgcagaacccgacttatttagagctactacaagagagggacaggctgtacgatcttctcaaagaaataccattcctaaagccatttcccagccactctaactttattctctgcgaggtcacatcaggcaaagatgcaaagaaaataaaggtttgcactgcttctattcatactttgaaaggaaatgctgatgatttagtttcaacaatataatgcctgcagcatcattcacataattttgttcaaaaacaattttcaggaagaccttgcgaagatgggagtaatgatccgccactatgacaagaaggaactaaagggatatattcgtatttcagtgggcaagccagagcataccgatgcactaatgaaaggcctgaaagcacttcaactgtga

SEQ ID NO: 1285 - DNA, 1164 bp, Oryza sativa
gtcgcctaacgccgcgcggggccgcgcgcgggggtcgccgtggaccccgcccgcgcgcgcgccgcggtcgtcacctgcggggggctctgcccgggcctcaacaccgtcctcagggagctcgtcgtcggcctccgggagctctacggcgtccgcgacgtcttcggcgtcgccgccggctaccgcgggttctacggccccgacgccgaccacgcccgcctggacctggccgccgtcgacgactggcacaagaagggcggcaccgtgctcaagaccacccgtggtggctttgatctcaacaagatcgttgacggcatcgtcgcgcgcgggtatacgcaggtttatgcaattggaggggatggaacaatgagaggagctgtggccatcttcaacgagtttaagcgccgtggtttgaacatttctattacagggatcccgaaaactgtggacaatgatatcggcatcatagacaggtcatttgggttccaaaccgcagtggagattgctcagcaggcaatcgacgcagcacatgtcgaggctgtgagcgccgtgaatggcattggacttgtcaaacttatgggcaggagcacaggccacattgctcttcatgccaccctgagcagccgcgatgttgactgctgtttgattcctgaggttgatttctatcttgaaggaaaggggggcctgtttgagttcttgtatgaaaggataaaacagaagggacatgctgttgtcgttgttgctgaaggtgctggtcaggaattgattccaaggactgacgatcaaaagcgggagcaggacgagtccggcaacattgtgttccttgatgtgggtccctggttaaaatctgagctgggtaaatggtggaagagagaacacccaagcgagttgttcactgtgaagtatatcgatcccacttacatgatacgagctgttccagcaaatgccactgacaatctgtactgtacattgttggcacattcggcgatccatgggatcatggctgggtacactggcttcgtccctggcccgattaatggaaactatagctacataccgctggaagatgttgctgtggcgaagaacccggtggatgtgaatgatcacaaatgggcatgggttagatcagtcacaaaccaaccagatttcatgaagccaaaatactaa

SEQ ID NO: 1286 - DNA, 1145 bp, Oryza sativa
  misc_feature (292)..(292): n = any nucleotide
atggcgaccgccgccgccgccgccgccgtgtaccttcccgaggtggatagccgcttcgccgacgccgacgaggaggaggaggaggaagcgacggtgaggccagtcgaggtggccgagagtaaggatcaggaggaggttgaggaggaggaggatgaagaggagtggtcggactccgacgtggccgatgcgctcgactggctcgacgcccggaggccgaacgcgcacggcggggtgctgtcccgcccgttccagccgatttccaaccgcacgcagaagctcgcctcgcacatcngcgcaaaacccctggagtgggaaggtagaatgaacgtggggatgtcaaattcagtgacgactgcgataagggacagcataagggagacggcaattgggaaaacaaggaacacagagaaggctgatcgtgctacagtagaacagcaggctattgatccaagaacacgcatggttctgttcaagatgttaaaccggggggtttttaataccataaatgggtgcatttctacagggaaagaggcaaatgtctatcatgcatcaaaggctgatggccaggagttagcgatcaaagtctataaaacatctgtccttgtttttaagatagagaccgatatgtccatggagattaccgctttagacatggttactgcaagcataatcctcggaaaatggtgaagacctgggctgaaaaggaaatgagaaatcttttacggcagctggaatccgatgcccaaaaccattgctcctgaggcttcatgtactggtgatggaatttatagggttgggctgctcctcgtctcaaggatgctgctttatctgatgataagttgcgtgaaagttattttgagttaattacgacaatgcggacactctaccaaaaatgcaaactggtccatggtgatctgagtgaatacaacattctttatttcgagggacacttgtatatcattgatgtttcgcagtccgttgaccttgatcatccttcagcgttggaattcttgaaggaagattgcttgcatgttactgacttctttaaaaaacgtggtgttgctgtcatgtcagtaacagaactatttaattttgtgattgatcaaaatattgctgatgaagatgttgatcattacctggaaaag

SEQ ID NO: 1287 - DNA, 1140 bp, Oryza sativa
  misc_feature (7)..(7): n = any nucleotide
  misc_feature (56)..(56): n = any nucleotide
atgagcnagaaggagacgctccaccaccaccaccaccgccgccgcctcccctccancgcgccgtcgccgtcgccgtcgccgctcgacgacgacgacctcctccaggagatcctcctccgcctcccgccggacgcctccacgctccccaccgcctccgccgtctgcaagcgctggcgccgcctcgccttcgagccgggcttccgccgccgcttcgtcgcccgccacgagccccccttcctcggcttcttcttcccctacgacttcgatccggtcttctccttcaacgccggcttccgatccaccaccgcccagcaccacctccccgcccaccggttcctccccgagagggagatcgggctgcggtgggagatcgtcaactgctgcaagggccttgccctcttcaggatcacattccgcgggggatgcaaatgcaaggaattcatggtggttgatcccatctccggcgaccgccgcctcctgcccttcccgctcgtcgacggcaagttcctctccgccacggtggttcctgccgccgccgatcgccgctcgttccgcgtggtcgccgtattcgccgagaggaacaccttcaccagcgtgttcgcctccgtttattcgtcagatgccggtgtttggagtgattatgtctcgaggttgtgtctcccatgggaggtctgggtgttgcggccgagcgttcttgccggaaatgcggttcactggtttcttgatggctataatgtgctcatgtttgatttggagagtcagaagctgggattcagtgagctaccgctggatgcgaaggatgatgaggatttccctcaccggtgccggtgtcagatcataccggcgggtgatggccggcttggcctcgcggttatagttggatccacaatgcaattgtgggagagggagattggagatggcagtgatgccacatggttgctgaggagaaccctccagctgaactttcttcccctagaagcggaggggcgtaaactgattgtgggtgttgccgaggagaatagctccatacttctttggacgcgtgttggcctgttcatggtccacctcaagtttttgcaggttaggaaggtctacggagaaatctccgtcgacaactactacccctactcaagcttctga

SEQ ID NO: 1288 - DNA, 1125 bp, Oryza sativa
atggccggagacacgacgaagcccacggagtcagccatcgtcgggagcacggtgaccgggcaccacctgctccacatcgacggctactcccacaccaaggaccgcctccccaatggctgctacatggactcccgccctttcaccgtgggaggccatctatggcgcatcggatactaccccaacggcgacgtcgccgacgcctccgcgtacatggccgtctacccttccatcgacgagaacgtcatcgtcgccgtcaaggcttttgccaagttcagcttgttcttcaacggcgagcccacgccgccggcgtttgtgcataccacagagccattcgtgttcagcaggaaggggatcgggtatggttttagcaagtatgccgagagggagttgatggagggctcgatcgtggacgacaagttcaccatcaggtgcgacgtcggcgtctccacggagctccgcgcggaggacaggccgccgtcggacttcgcggcggtggtgccgccgtccgacctgcaccggcacctcggcgaccttctggactccaagcacggcgccgacgtcacgttccaggtcggcggcgaggcgttccgcgcgcaccggtacgtcctcgcggcgcggtcgccggtcttcagggcggagctgttcggcgccatgagggaggccaccgccgcggccgccgcgtcgtcgtcggactcggaggcgatccgcgtggacgacatggaggcgccggtgttctccgctctgctccgcttcgtgtacaccgacgcgttgccggcgcccggcggagcggacgacggacaagcggcaggaggaggatcgtattcggaggaggccgccatggctcagcacctgctcgtcgcggcggacaggtacgacctgaagaggctgaagctgctctacgaagacaagctacgcaggcacatcgaagccgcctccgccgcctccatgctcgcgttggttgagcagcaccattgccgaggcctcaaggaggcgtgcttggtgttcctcagctcgccggccaaccttcacgccgccatgggaagcgatggatttgagcatttatccaggagctgccccggtgtgatcaaggagctaatatccaaacttgttccacgttgtgattag

SEQ ID NO: 1289 - DNA, 1113 bp, Oryza sativa
atggtgctcgcgcagctcggcgggagcatctcccgcgcgctggcgcagatgagcaacgccaccgtgatcgacgagaaggtgctcagcgactgcctcaacgagatctcgcgcgcgctcctgcagtccgacgtccagttcaagatggtccgcgatatgcagtccaacatcaagcgcatcgtcaacctcgagacgctcgccgccgggaccaacaagcggcgcatcatccagcaggccgtcttcacggagctctgcaacatgttggatcccgggaagccttccttcactcccaagaaggggaaaccttgcgtggtcatgttcgttggtttgcaagctttacagggttgcagcaacaaaaagtccagtgatatttattggaacaggagaacacatcgatgagtttgaagtttttgatgtgaaaccatttgtcagtcgtcttttagttgacaggcatgggagactggtcggggtttatggacaagattcatgaagtagtacccactgatcaacaacctgagcttttgcagaagctgtctgaaggaaccttcactctgagacttatgtatgagcagttccagaacatcttgaaaatgggtcctattggccagggttcatttcttttaagattatcacagcacgcttttaaatctggattggtgtgtttgcaggttttctcaatgttgcctggatttagttctgaattgatgccaaagggacatgagaaggaaagccaagctaagattaaacggtacatgacgatgatggattccatgacagatggaggagcttgacagcacaaatcctaaattgatgactgaatcgcgtattcttcggattgctcggggatctggccgacctgtcagagatgttgtcgacatgctcgaagagtacaagcggcttgctaaaatctggagcaagatgaaagggctcaagataccaaagaaaggagaaatgagtgcactgtcccgcaacatgaacgttcagcacatgagcaaagttctcccgccgcagatgctgaagcagataggcggcatgggtggcctgcaatctttgatgaaacaaatgggctcaaaagaaatgggtggcatgtttggaggcatgggtggtgataagtaa

SEQ ID NO: 1290 - DNA, 1110 bp, Oryza sativa
ggtttcataagcatcgactgtggatatatcacgaggccaagctacccagatttcaagacaaatctaacatatgtagccgatgtgggcttcacaaatacagggtttattcacactgttgatgttggcaacctgcagagggatcttgcacaacggtacacaactgtccgctactttcccaatggaactcgcaactgctatacgctcaagcagctaacacgaggtggcaagtatcttgtgagggccacctttgggtatggcaactacgatgctttcaactcacctcctgcctttgatctctatcttggggccaactactgggtcaaggtgaacattaccaactccagcagagcatatgtccatgagacgattgcagtgtctccttctgaattcttgcaggtttgcttggtaaacactgggtcaggaactcctttcatctcagggcttgacctaaggccaaggtacccagttgatcgctacgaccgcttctggcagagtctgaccttccacctttgattagtgccatggagatattcttagggcggacactgaatgagtcttccactggctcctctgatgaagtattctgtgaagaggaactgggagggtgatccttgtgctcccgaagcttttgtatgggatggattgagctgcgatctatcttacaataacctgtcaggatcaatacctgactttctgggtcaaatgccattgcttacctttctaggactggaaataaccccaacctgtgtggaaatcggaggttcaagtacaaggaactccaagtcatcacgaatgactggagaaatgtaattggggagggtggatttggtcatgtctatgctggtcaattggaggatgtaactgacgttgctgtcaaggttgaatcacaaacatctttgcgagggaatcataagcagtttctggcagagcaacacctgaccagggttcatcataagaacttggtgtccttaattggctactgtaacgacaagaaacatcgatgccttgtctatgaatacatggatgggggaaccctggagggccggctcagaggacgtgtacagcttcggagttgttcttatggtggtcatcacagggagaacagcgatc

SEQ ID NO: 1291 - DNA, 1089 bp, Oryza sativa
atgaagctcgtctaccgcaacctcgcccgcaacggccccggctccgtcaaggacgacctgtggcatgcctacaaccttattgttccgggggataccctccagtccgtcactgtgagaggaaagttctgagagagatggcatctggaggacgtgatgctgagcgtgtgaggttaaagttggaaattgtagtcgaggtagattatgataaggagggatctgtcttgcgtgtacgtggaaaaaatataactgagaacgatcatgtgaagattggacagtttcatactgtggagcttgagctgaagagacaatttactttgacgaagtgggattggttagctcttgataccatccaacaagcatgtggacccaactgcaagtgctgatctagcagttattctcatgcaagaaggacttgcacatttgttcctcattggtagaagagagcacgtattgaaacatctattcctcggaagcatggccctgcgattgctggttatgagtcggccctcaagaagttctttgaacatgttttgcaactacaggctttcctgaagcatattgattttgaagtagtccaatgtgctgtaattgcaagcccaggttttactaagcttgaagctgcacggcgagacttaagattaataattgagaacaaacagcgcattgttcttgcacatgcaccttcaggttacaaaaggcatagcctgaaggaagttttggatagcccaagtgtgatgacactaataaaagatacaaaggcggcgcaggagcgagcttgttatggacctaagcatgttgagattgcaaatgaacgtcttgctatccaaactcttttaataacagataatttgtttcgaggaactctgacattgcaacgaggcaaaattatgtgcgcttggttgaatcggtaaaaaaattcggtggcacagtgcacatcttttcttcaatgcatgtctctggtgaacgttggcgcagttgacaggaatcgcagctatacttcgatttcccttgccagatttagaggacattgagatgtgataattccaccgttcagaattggcaatatgctaacttgtaattcatgtgtaa

SEQ ID NO: 1292 - DNA, 1083 bp, Oryza sativa
atggcggcgcgcgccggcgacaccggcctgagcaaggtcaggcgctactggcccgggagggcgccggactgggcgtgggcgggcgccgctgtcgctcacgacgaggacgacgcacgtctcgtctcgacgcttgacgagatcaagcacgtggaggaggaggcgctgaggtcgccgcgccgccgccgccgccgtgtacggcagcctcccgagatcgtctcggcggcgccggcggttgactgctggcatgagcccgatcagatcgaggaggaagaagaagatgacgatgatgcccgggaggagcgcagagcgaggataagggagagggcgctgctcctgaggcagcatgaggaggagcagcttcttcttcatcatcatcaccagcggcatcaggaggatgaggcggcgtctgagtccgacgagacggcggcggaatcggactcggacgacgagcagatggccgtcgtctacatggccgcgcccctgttcgtccccaagtcacagcgcgacaccatccggctcagggaggaagaacagcatcggcagcgccggcggcttgagctggagctggacaagaagaggctcgaggacaggaaggctcagacgaggcggatcctgctccaagagatcatcaaagaagagctcctcgccgccaccacagcttcggccgaagccgaagccgccatcgacggcgtggacaccgacgacgaggtggaccaagccgaggagcacgagtcgtggcggcgccgggaggcggcgagggtcaagaggagcagggaggagagcggcatcgacgagaacccggtcgctgatgatcgtcccaagaagatgacgatcaagaagcagatgaggttcatgcggaggtactaccacaagggttgcttcttccaagacgacgccgacggcgcggcgcagacggccgccggagcatgcgaaatctaccggcgagatttctccgggccgactgggttggacaagatggacgtgagcgtcttgcccaaggtgatgcaggttgaaacacgtgtggcctgcaaatggcagaatgaagatgagcgaggtttagatttaggtgcccacgaaaactag

SEQ ID NO: 1293 - DNA, 1083 bp, Oryza sativa
  misc_feature (34)..(34): n = any nucleotide
atgaccgatgcgcctccgccgaggagccgcccgnacccacccagcagcagcgttgccgtgcccgccgccgcggcggcagtgatcgcagccgccttgggtcctccttcctcgccctgctgcagccgccccggcgcgccccggtcgccgcgggatccagggtcggcatgtcgaaggcgagggtctacgccgacgtcaacgtgctgcgccccaaggagtactgggactacgaggcgctcaccgttcaatggggcaggatgactatgaagttgtcaggaaagttggaagaggtaaatatagtgaagtctttgaaggcatcaatgttaacaacaatgagaaatgcatcatcaagatactcaagcctgtgaagaaaaagaagatcaaaagggagattaaaatacttcagaatctttgtggaggtccaaacattgtgtagcttcttgatattgtcagagatcaacattctaagactcctagcttgatctttgaatatgtcaacaatacagacttcaaagtgctgtaccccacgttgacagattatgatatccgctactacatatatgagctactcaaggcattagactactgccattcacaaggcattatgcatcgagatgtcaagccccacaatgttatgatagatcatgagctccgaaaacttcgattgatagactggggcctggctgagttctatcatccagggaaggaatataatgttcgtgttgcttcaagaggtatttcaaggggcctgagcttcttgttgatttgcaagattatgattattctttggacatgtggagccttggttgcatgtttgctgggatgatattccgcaaggagccattcttctatggtcatgataaccatgatcaacttgtcaagatcgcaaaggtacttggaacagaagcactaaatgcttatttgaacaagtaccatattgagcttgatcctcagcttgaagctcttgttgggagccatggtcgaaattcattaatgctgataaccaacatctagtatctcctgagcttgataagcttctacgttatgatcaccaagataggctcactgcacgtgaagctatggtaa

SEQ ID NO: 1294 - DNA, 1080 bp, Oryza sativa
atgctgcgctgccaaaagccgccgcaatgccgcctcggcgcgggcggcgcgggcgcgggggtgctgctgaggcagcggagcgaggtggcggtgcggtgccgcgcgcagcaggtgtccggggtcgaggcggcggcggggacaccggcggcgcgggcggcggtggagggtggggagaggacgagcctggcggagcggctgcggctggggagcctgctggaggacgggctgtcgtacaaggagagcttcatcgtgcggtgctacgaggtgggcatcaacaagacggccaccgtcgagaccatcgccaacctcctccagcaggaggtagggtgtaaccatgcacaaagtgttgggttctccactgatggttttgccacaactaccacaatgagaaaacttggtctaatttgggtgaccaaccgaatgcacattgagatctacaagtacccagcatggatgttgtggagattgaaacttggtgccaagaagatggaaagatcggtactcgtcgtgattggatccttaaggatctggctaatggtgaagttatcggcagagctaccagagcaagtgggtcatgatgaaccaaaatacacgcagacttcaaagagtgagtgatgacgtgagggatgaggtttttgtacactgtccaaagactccaagagattagcattccccgaggaaaataatggcagtttgaaaaagattccagttcttactgatcctgcacagcactcaagactaggcctagtgttgcagccaagaagagctgatctggacatgaaccaacatgtcaataatgtcacttacattggttgggtacttgaaagtatacctcaagatattattgatacacatgagttacaaacaatcactcttgactacagaagagagtgccaacatgatgacatagtagattcacttacttatatcgaggaaggagaggagaagagttccaatggatccgcatttgctgcaccgcacccagaagagcagcgacagttcttgcactgcttaagatttgctgggaacgggaacgagatcaaccgtgggcgcaccgtgtggaggaagctagctagatga

SEQ ID NO: 1295 - DNA, 1067 bp, Oryza sativa
  misc_feature (26)..(26): n = any nucleotide
atgcgacgggacgacgccggcggggnagggttcggcgacctgttcgactcgtgcgccggtccatcgccttccgcacagcacggccccggagacgccggggcctctcgggggcggggcgggatcgggttacggatcagctcgtgcctccggaagtcgagggggatgggtctgctcgggctcatctccaagagcccttcgccgccgcgccgcctgctgccgccggcgcccaggggagaggagagcccgcagatccggtggcgtaagggcgagctgatcgggagcggcgcgttcgggcaggtctacctcgggatgaacctggacaccggagaactcctcgcagtaaagcagcacataagagagctcgaggaagaagtgaagctacttaagaacctgtcacatccaacattgttcggtaccttgggacagtccgggaggaagatactctgaatattttgctcgagttcgtgccaggaggttccattcagtctctccttgggaaactaggttcatttccggaggcatacacaaagcaaattttgcaagggttggagtatttgcataacaatgcaataatacatagagacataaagggagcgaacattcttgttgataacaaaggatgcattaaacttgctgattttggggcatctaagcaagtggcaaagttggctaaaacaatgaaagggacacctcactggatggcacctgaaagctctgcagacatctggagtgtgggatgcacagttattgaaatggctactggtaaaccaccatggagccagcagtaccaggagcatgtcggaaccacaaagtcacacccgcctatacctgaacatctctcccccgaggccaaagattttctgctaaaatgcctgcagaagctcttgatctgaagaagctacaaacacctttatatgaggagttctacaacacggtgaatgctgggaattctcaggtagctgaccatacttccaacggaattttctcaaatagtcccaaattgccacctcgggagaaagtggaaagaagaattggtccaggagcttgagagggaaagaggcaagtaa

SEQ ID NO: 1296 - DNA, 1062 bp, Oryza sativa
atggcgaagctggggccggggcaggggctggggtgcgaggcggcggtggggttgctggcgccaagcaggaagagggagtacaaggcgtgcaacaagctcaccgaggggaagcggccgctctacgccatcggattcaacttcctcgacttccactactacgaggtcttcgccaccgtcggcggcaaccgcacaacctacagctgcctcaaggatggtaattttgctatcctgcaagcatatattgatgaggataaggatgaatcgttctacacactgagttgggcttgtgatcttgatggcacaccgctgttagtggctgcaggaagcaatgggatcattcgggtcatcaactgtgccactgagaagttggccatggcgattcaataaacgagataagaactcaagcattaaagccttcgctcatcatttctgcaagcaaggatgaatctgttaggctgtggaatgttcacacagggatctgcattttgatttttgctggagcaggaggtcaccggaatgaagtattgagtgttgacttccacccatctgatatctaccgcatagcaagttgtggcatggataacactgttaaaatatggtcaatgaagggaattctggccatatgttgagcaatcctttacatggactgaccttccatcaaaatttccaacaaaatatgtgcaatttccgcattctaactatgttgattgtactagatggcttggtgacttcattctgtcaaagagtgttgacaatgaaattgtgctgtgggagccaaaaacaaaagaacaaagtcccggggaggtatcctgtgccagaatgtgatatctggtttatcaaattctcatgcgattttcacttcaatcaattggcaatagggcaaccgtgaaggaaaagtctttgtctgggaagtacagtccagtcctcctgttttaactgctcgcaatgcaaatctgcgataaggcagactgccgtgtcatttgatggaagagcacaatccttgcctgcagcgaggatggcagcatatggcgatgggatgaagtggaccatccaaaagcatga

SEQ ID NO: 1297 - DNA, 1061 bp, Oryza sativa
atggcggcggcggcggcggcgcacgactacggcgaggcgctgtcgaagagcctgctctacttcgaggcgcagcggtcgggccgcctgccgtacaaccagcgcgtgcggtggcgcggccactccggcctcaccgacggcctcgagcaaggggtcggcgacggcgactcggaccactactgctggcagcggccggaggacatgacgacgtcgcggcacgcgtacaaggtggacgccgagaaccccgggtcggaggtcgccgcagagaccgccgccgccatggccgccgcatccatcgtcttccgccgcgccggcgacgcccactacgcccatctcctcctccaccacgctcagcagcagttgtttgagtttggggacaagtacagggggagatacgacgagagtgtggaggtggtaaagaactactacccatcatcaagtgggtacaaggatgagctgctgtgggcggcgctgtggctgcaccgtgccaccggccgccgcgaatacctcgactacgccgtcgacaacgccgacgacttcggcggcaccggctgggccgtctccgagttcagctgggacatcaagtacgccggactccaagtcctcgcttccaagtgctcctgcatgggccgcaaccccggcggcgccgcccacaacgccggccgcactccggcgggcctcctcttcatccgcccgtggaacaacctccagcggcggacgccggcgaggtgctggagttcgcgaagtcgcaggcggattacatactggggacgaacccgatggcgacgagctacctcgtcgggtacggcgaggcgtacccgcggcgggtgcaccaccgcgcggcgtcgagcgcgtcgtacgcgcgcgaccgcgacttcatcgggtgcctccaggggttcgactcgtggtacagcgcggcggcggagaacccgcacgacctcgtcggcgccgtcgtcggcgggcccaacggcaacgacgtgttcaccgaccaccgcggcgcgtacatgcagacggaggcctgcacgtacaacacggcgcccatggtcggcgtcttctccaggctc

SEQ ID NO: 1298 - DNA, 1061 bp, Oryza sativa
cgggggatcggcgaggagtgcatccaggaggacgagctcatgaacctgctgcagaagaagcccgtccccatctgctacgacggtttcgagccctccggccgcatgcacattgctcagaatgttaacaagatggtcagagctggatgcaaagtgaaaatttggatagcagactggtttgctcagctaaacaacaagatggggggtgatataaaaaaaatacagactgtgggacgctacatgattgagatttggagagcggctggtatgaatcttgatggtgtggaattcttgtggtcctcagaggaaatcaataagcgtgcaaatgaatattggccacttgtaatggacattgctcgtaaaaataatgtcaaaagaataatgagagatgttgtcagattatgggtcggaatgattcggatgagttgactgctgcccagatcttctatccttgcatgcagtgtgctgatatatttttcttaaagttccctttgtaggcagacatttgccagttgggcatggaccaaaggaaggtcaatatgctagccagggagtactgtgatgacatcaaaaggagaaacaaaccaattattctgtcacatcgtatccttatctgcccttccaaatatgctccctggttttaaggagggccaagaaaagatgtcaaagagtgatccatcctcagccatttttatggaagatgacgaggctcaggtaaatttgaagataaaacaagcattttgccctcccaacattgttgatggcaatccatgcttggagtacatcaagtacattgttttcccttggtttgaaacgtttgaggtggttcggaaggaagaaaatggcggtaacaagaactcatcgctgattatgagagtggtgctttgcatcctgctgatgttaaaccagctcttgcaaaagcgataaaccaaatattgcagcagcctatccgtgaccacttcaaaaacaacagtgaagcaaaagttctgctcaacactgttaaggtatatttttttttgagcaatgctacacgtactaaatttttcttactaaacttttactaa

SEQ ID NO: 1299 - DNA, 1034 bp, Oryza sativa
  misc_feature (980)..(980): n = any nucleotide
  misc_feature (1012)..(1012): n = any nucleotide
atggggaggtcggtgctggagatggtggtggcggcggcgcagggcggcggcggcgcggcgggggagtcggtgttgggcatgttcaggtacgccgtgctgcccatcgccaaggtgttcgtcgtctgcttcatggggttcctcatggcgtccaagcgcgtcggcgtgctcaagcccagcggccgcaagcttctcaatgcgcttgtgttctctctgctccttccttgcctaatatttgcgcagctcgggagatcaatcacaattgacaagatcatggagtgtggttcattccagcaaacattgctctgggtgcagtctctgcatctttggttggacttatagtggcattgattgtacggccgccttatccatacttcaagttcaccatcactcacattggaataggggaacattggaaatataccacttgtccttatctcggcattatgtcgcgaccaattaaatccgtttggtgactcgaacaaatgtactcaagatggaaatgcatacttatcatttggtcaatgggttggtgccattattgtttacacatatgtgttcaagatgcttgctccacccccccttgcaattactctcggtgttgtgccattcttgaagaatttgatcctcacagatgacgcgcctctattctttttaacagatagctgtctcattcttggggctatgattccgtgcattttgcttgccgttggtggcaatcttgttgacgggaagtaggagacttggggttcggaccaccgtcgcgattatatttgcacgcttgatattggttccaattgctggtattggcatcgtctcatttgctgacaagcttggatttattccaaaaggagacaagatgttcaagttcgtcctgttactgcagcactctatgcccacatcggtactatcagggtgctgttgcaaacctaagaggttgtggcaaggaatcagctgcaatcttgttctgggtgcacattttngctgtcttctccatggcaggatggattatctnatatcttaccatgctgttctag

SEQ ID NO: 1300 - DNA, 1030 bp, Oryza sativa
atgggaaaccccctcctcgacatctccgccgtcgtcgacgaggccttcctcgcaaatatgatatcaagccagggaatgcaattctagcagaggagaagcatttgcctatgtacaatgaattggctagcaaggtcaatgttgaatatatcgctggagggatccactcaaaattctattagggttgctcagcagtggatgctccagattcctggtgcaacaagttacatgggttgcattgggaaggacaagttcggtgaggagatgaagaaagacgcacaaaccgctggtgttaatgcccattattatgaggatgataatgctcctactggcacatgtgctgtctgcattgttggtggtgaaagaggtcacttgttgcaaacttgtctgcagcgaactgctacaggtctgaacatctgaagaggccagagaactggacacttgtagttgagaaggcaaaatatatttacattgctggctttttcctcacggtatccccggattccattcaacttgttgctgagcatgctgctgcaactaacaagaggtgtttatgatgaacctttctgctccctttatatgtgaattcttccgtgatgcccaagagaaggctcttccgtatgctgactatatttttggaaatgaaactgaagcaaggacctttgctaaagttcgtggttgggagagactgagaatactgaggagattgctttgaagatctcgcaattgcctaaggcttcaggagcacacaaggggattactgtcattactcaaggctgtgacccagtagttgtggctgatgatggaaagaggtcaaaacattccctgttatcgttttgcccaaggaaaagcttgttgacaccaatggtgcaggatgcctttgttgggggttttctctctcaattggttcaggagaagagcattgatgaatgtgtcagagctgcttgttatgctgcaaacgttatcatccaacgctcaggctgcacttaccctgagaagcctgacttcaactagagccatttcagcatattga

SEQ ID NO: 1301 - DNA, 1024 bp, Oryza sativa
  misc_feature (534)..(534): n = any nucleotide
atggtgggcggcgatgggatctcgctggactccggtggagatgtggtgggaggatcgtgggacgagtcatgcacgtggatggtgaaccgtgtgatctgcaggtggatcctggaagagattatgcgccttggcaggagctcgccacctcgaccgcccaccaccgtggacctcgcctcctcgaccgctgcctccctcgatctgctccatccacagcttcccgcgacaagcaaccgcggcgtcgcctgagaacgattcacggcggtgacaacgcagtggcgcggagatccgacatcgacgtggtgggggaggacggcgatggcggcgtggtgggggagcgacgcggtgggggagcgacggcgatggcggcgctggggtcggcggcgtggtgggcgaggacggcgatgggggacgcggtggaggaggccggcgatggcagcgctggggtcgacggcgtggtgggggagcgacgcggtgggggagcgacagcgatggcggcgctgtgtcggcgatgcggtgggggagcgagcgacgcgntgggggagcgacagcgatggcggcgctgtatgcgtggtcgcgatggtgttcctttgcgagggggcggcgggctgcaccgggtacgggtgggaggaggaaggccatgaagtcgctaagggcatggacatgttatcctccccggcccaccccctcctttcccaccccaaagccacctcgaaatccgccaccgccgcggaaccgttcccttcttcctaaacctgttgcgtgtcggcaaccgcacgctaggacaaagacggcaaaggtgtcatctgcttcattgtggcggtggaagcgaaggaagaaaattcgattcgggttgaaggaaaaaaaaaagcggagtgagccggcatgggtttggggacatcatggccgagctagctcctctcccgccagccgctgtccttctccccgccaaccactgccccgccttggagtttggataaatgagaagagaggggaggaagagagagagagagagataaggccataa

SEQ ID NO: 1302 - DNA, 1022 bp, Oryza sativa
ggagctgctggggcagtcattcattacatgggctatacgcctggtcttttcattgtaggattatttggaatattgattatgtggatgtatggctatttctggattacaggaatgcttctgattgctggagtctttgaaacatgcacgatttgtgatacctgtgttggctatgtatgctgtttattgtgtggctgttcgtgttggatcgcttggtgtcttcttgacattgaatctttctttcctgacaaatgatcttctgaataagttgctgcaaggatacgagtctgtttcattggatgagatgaagaggatcatggatggtttgacccattatgaagttttgggtattcctcggaatagaagtattgatcaaaagattctgaaaaaggagtaccacagaatgcttgtacatcctgataaaaatatgggaaatccactggcctgtgaatcattcaaaaagcttcagtcagcttatgaggtactctcagatttcacaaagaaaaacacttacgacgaccaactgaggaaagaagaatcactccgaagagtccaggcgtatacagtgcacaaaatgtggtaattttcatctgtggatatgtaccaagaaaagcaaagcaaaagcaagatggtgtcagcatccagctaaggatggagatggatgggtggaaaataaattttcgtcatccttcaaggaaatacctcgagcttttgtttgtgcggagagtaaggtatttgatgtgtctgaatgggctacttgccagggcatggagtgcaaacctaacactcacggcccatcttttatggtaaacatggttggcgcagataggatgtctcagagatcctacagttctcgctatccctttagtttgaatgctgagatgatccctgaagatgaatttgagctatggcttcaacaagcattggcatcaggtgtcttctctgacagcccgaaacgcaggaaaagctggagccccttcaaactacctcaaaaagggataaaaagttggcggcgatcctcataa

SEQ ID NO: 1303 - DNA, 1021 bp, Oryza sativa
ggatgggaggagggaggttcagctgggccctcacacgattcagacacatggagttagattggccagaaatcacctgcatgattgggtcgttcttattttacttgctgcagttgtgattgccctgcatttcgctcctccatttagccggtttgttgggaaggatatgatgacttatgttagttacccggtgaaacaaagcactgtaccagcatggggtgttcctataatatccatagtttgccctgtaattatctttctatccgtttatatcgctaggagagatgtctatgatcttcatcacgcaacattagaggtgtgctttactcggtgctgataactgcagttgtaactactgtggtaaagaatgcagtaggaagacctaggccagacttcttttggcggtgttttcctgatggaaagcagcagttatatgatcaagtgacaggtgatgtgatttgtcatggagagaaaagcttcttaaaggatggacgcaagagttttcctagtggacacacgtcgtggtcttttgctggacttggatttctgtcactctacctatctggcaaaattaaggtgtttgatcgccaaggtcatgttgccaaactttgcattatgattcttccccttcttattgcttcactcgtcgggatttctagaatagatgactatcgacaccactgggaggatgtgtttgctggcggcctactagaggatttatcatggcgatgctctgttacttgcacttctttccacctccataccatcatcaagggttggggaccgtatgcatacttccatatgcttgaggagcttcaagtggccaactcccacaatgcagaaagccagcagtcagtgtgtgggcatcatgttgagctatctagactacacaatagcaggacatcaagaaatgatctggaagctggtcgtgtgtaacatccctagcatgttgaaaaccgaggaagcggcatgtacaggttgcaccgtccaacggtgtagtgttcctaactctgtcagttcttag

SEQ ID NO: 1304 - DNA, 1019 bp, Oryza sativa
gaggcatggtacgactcgtttgccatgagcgagtcggacggggaggacgatttccacagcgtgcaagatgtgtggcctcctgccaaacaattgtttgccttgtattgcctccgctgttggtgtaaatgagaagaagagaccactttccacaagcccaactcattccatgaagatgccctccttaaagctctcattcaagaagaagtctggagaagctcatccttcttccacactatcttgaaaggcctctagcaggttctcaagttcagttatgcttactggaaaagaaaatactgaacagctggtctcatattgatcctggcactttccgagtccgtgggtcaaactattttagagggataaaaagaaagagcttgctccaaattatgcagcgtactacccatttggagttgatgtatacttgtcaccgcaaaaactcaaccatatatcccgatatgttcaacttcccgatgttcaaatctccagtaaactcccaccacttttggtggtcaatgtacagcaggttccactatatcctgcctcattatttcaaaatgaaatcgatggagaagggatgagctttgttttgtattttaggctctccgatgcttactcaaaagaactacccccatcatttatagagaatatcagaccatttcgagaacgggcttaggatacttggcccggatggcaaatctggaaggaccttcctttaagtgcggcagaaaggaagctaatgcatgcatacaatgagaagcctgtgctttctagacctcaacacgagttttacccggggtgacaactactttgaggttgacattgacatgcataggtttagctacatctcaaggaaaggtttcgaaacatttttggacaggctaaaaatatgcatgctagatgttggtctaaccattcagggaaataaagctgaagaattgcctgagcagattttatgctgtgttaggttgaatgggatagattacacacaatataagccactgatgacacatggggcctga

SEQ ID NO: 1305 - DNA, 1011 bp, Oryza sativa
gaaacggttgaacagatcttacaagaatcaaagaatagctactcgatcatctgtgacaaccttaagaaagtgtaccatggaaaagatgggaatgcaaaaaaaattgctgtcagagggctatctctttctatgccacgtgggcaatgttttggtgttcttggaccaaatggcgctggaaaaaccactcttattaacatgactggatttactaaacctacgtctggcacggcgtacattgaaggaatggacatacaattcgagatgaacaagatttatgcaggaatcggtgtttgtccacagcatttgctatgggaaacactgactggtcgcgagcatctgttgttctatggtagacttaagaatttgcggggtgcaccattatctcaggccattgagaaatctttgaaaagtgtgcgcctgtttgctggtggcattgccgataagcttgtaagcaaatacagtggtggcatgaaacgtcgtctcagtgttgcaatctctctaattggtgaccctaaggtagtttatatggatgaaccaagctcagggttggacccagcatcaaggaaagacttgtggaatgctgtcaagtctgccaagcaggacagggccataattctcacacattcgatggaagaagctgaatttctatgcgatcggataggaattatcgcaaacggcagcttgcaatgcatcgggaactctaaagagctgaaagcaaaatatggaggctcatatgtcctcacagtaacaaccgcgacaggcgaggcggaggagatgaggagactggtccagtccatctcccctaccatgaacattgtgtaccacatctccgggacgcagaagttcgagatggcgaagcaggaggtgaggatctctcaagttttccgggccatggagcatgcgaagctcaggatgaacgttcttgcctggggcttggctgacacaacgctggaggatgtcttcatcagagttgccagggagagtgacagtgcatcatcctccgtggcctga

SEQ ID NO: 1306 - DNA, 1007 bp, Oryza sativa
atgtccgcttgctgcaaaaaactttccagcctcaaagctctcctcgtcttctccgctcccgcaaaaaaccctagcttgctcatctcggtcccttctccgacgatctccggcggcaatggatctcgacaagtccacttccaccagcgcgtccctgaagaagctgcaggaggacggtgctctccctggtcgcgggaccatggagagagaaccaggagaccgtggagcgccgcgttggtcaggtgatgatcagcggccttacgacgcctctgaccgacgtcatcgggccgctcgcggaccaccagtcggcggcggcgtcgttaaaggagggcgtcgccaagtgttaacggccaaatttgtgctgccgcgacgagtggcagcaacgttccgaagagagggaggaagttctcctccgtgctcgggactcgtcggaaggcgcctaccccatcgcctcacctggggggagctccaagctgagatggagcgcatccttcaggccggcgctcgcggcataggatgcgagattgaggttgccaaggcggcggcggcgtcgtcggcaaatgaacgtgccgacaaactagcgcgtgacctagcgaaggtccgcgaggacctccagaaaatgagggagctggtggccggaaacgagagatgtcgatgtcgaggatgtccagcagcgtgggcagcctgagttgccggtggtcgttccggcagatcgtcgtatccaatattggaggacgaagttcgaggtggtcgaactcgagaggactatggtggaagtcaagaaggaccaagccgtggaagcactccaaggtcgcgaggtgtggttcaactcgtacctcaggagctgttgtacggccatggccggagtctgtagggagctccgagtacctcacgggaatcccgaggagttggcggccgcatacatctcgtggttgaatggagcctgtgctcagcttgaaggcatcggcaggcatatcgatcgagccgatatgctggagggcacatgctag

SEQ ID NO: 1307 - DNA, 988 bp, Oryza sativa
attgacgagaatgtggcgagggagatcatcaaccaccggtcgctgcggcaccccaacatcatccgcttcaaggaggtggtcacgccgacgcacctggcgatcgtgatggagtacgctgccggcggcgagttgttcgaccggatctgcaacgccgggaggttcagcgaggacgaggttcagcgatgctcgaatcgactctaatcaactccatttcttggccaggtatttcttccagcagctcatctgcggcgtgagctactgccacttcatgcaaatttgccaccgggatttgaagctggagaacacgctgctggacggcagcccggcgccccgcctcaagatctgcgacttcggttactccaagtcgcagtcgtcgctgctgcactcgaagcccaagtcgacggtcgggacgccggcgtacatcgcgccggaggtgctatcccgccgggagtacgacggcaaggccgatgtgtggtcttgtggagtgactctttatgtgatgcttgttggtgcttacccctttgaggaccctgatgaccccaagaatttcagaaagaccattgggcagtacaaaatacccgagtacgtccatgtatcccaggactgcaggcaactcctttctagaatttttgttgcaaaccctgcaaagagaataacaataagggagatcaggaaccacccatggttcctgaagaacctgccaagagagctcacagaagctgcacaggcaatgtactacaagaaggataacagtgccccgacctactccgtccagtcggtcgaggagatcatgaagattgtcgaggaagcgcggacgccgcctcggtcctccacccccgtggccggctttggctggcaagaggaggatgagcaggaggacaacagcaagaagccagaggaagaacaggaggaagaggaagatgctgaggatgagtacgacaagcaggtgaaacaagtccatgccagtggtgagtttcagctcagctga

SEQ ID NO: 1308 - DNA, 988 bp, Oryza sativa
atgtcctttctattcaagtcaagcaatggtgctacaacagagaaaaacttgaccctagaagagcagcaggagaagagataaatgacttgcgtaaggagcttggtgaacactcatcagaagaaatacaagatttcctttcagatgcctcgtgcctgagatttcttcgagcaagaaactggaacgtgcagaaagcaagtaaaatgatgaagtcagctgtaaagtggcgggtgtcatatatgccacaaaagattaactggggatgatgttgcacatgaagcagagacaggaaagatatatagggctgactacaaggacaaacatggaagaactgttcttgtcctgaggccaggcttagagagaacactacttcaggaaagggacagatcaaatatcttgtttactgtctggagaaagcaattatgagcctgacggaagatcaagagaagatggtctggctgacagacttccagagttggacattggggagcacaccgctgaaagtgacccgagagactgtgaacgtcttgcaagactgttaccctgagaggcttgggttagcaatcctttacaatcctcctaggatatttgagtccttctggaagagatagtgaagccatttttggaccatgagacctacaagaaggtgaaatttgtgtactccagcgataaagagagccagaagataatggctgacgtctttgacttggacaagctcgactcagcattcggaggaaggaatccagctaccttcgaatacaatagctatgctgagcgtatgagagccgatgacattaagatgggttcttcattcaaatcaaacggcatcaccctgcctcaggaccattcacatgtatccgctgacaaggaggctaatggtggcggttcggacgcctcaagtgaggcctccttctatagtggaactgattccccgaatcacgaagagggaggtagcatactggcttgagagctcctccctcttcgtgcttag

SEQ ID NO: 1309 - DNA, 987 bp, Oryza sativa
atgaatccggacaacttcacgcacaagaccaacgaggcgctcgtggcggcgcacgagatagcgtcggaggcggggcacgcgcagctgacgccgctgcacctggtggcggcgctggcggcggacaagggcgggatactccggcaggcgatctcgcaggcgtccggcggggacgccggcgcgccggactcgttcgagcgcgtgggacgccacctgcctgacaaagcgatcgacctcgtcgacgaggcctgcgcgaacgtgagggtgcagctggacagccagccagaggagatcgacaacctcgagaggaagaggattcagctggaggtggagcaccacgcgctggagaaggagaaggacaaggcaagcaaggcccggcttgtcgaggtcaagaaagagctggacgatctgagggacaagctgcagccattgacgatgaagtacaggaaggagaaggagaggatcgacgagatcaggaagctgaagcagcgccgcgaggagctccagttcacgctgcaggaggccgagcgccggatggacctcgcccgcgtcgccgacctcaagtgaggaggcacttccgtcctgagctcctgaaccggctcgacgagattgtgatattcgatcccctgtcccacgagcaactcaggaaggtcgcccgtctccagatgaaggacgtcgccgtccggctcgccgagaggggtgtcgccctggccgtcaccgacgccgcgctggacgtcattctgtctctgtcctatgatccggtttatggcgcgaggccgatcaggaggtggatcgagaagagggtggtgacgcagctgtccaagatgctgatccaggaggagatcgacgagaactgcacggtgtacatcgacgcggcgccgcacaaggacgagctggcctacagggtggacaaccgcgggggagcgacgccgcgcaggcggtgaagaagatgaggatcatggaggacgaggacggcatggacgaagagta

SEQ ID NO: 1310 - DNA, 984 bp, Oryza sativa
gagctcgatgccgtggccagcttcagcgagatcgtgccggataccgtcgtgttcgatgacttcgagaaaggtttgcgccgaccgccgccacggtgagctcgtcgctgctgctcggtatcgctggcctcccggatacaaagttcaaggctatagatacagcgttggcagacggtgaatgtaacacaatggagaagcccgaggaccggatgtcctgtttcctaaccaagaatgttggagctgaaatggctcatctagtccctggtcgggtgtcgactgaaatagatgctcggttggcttatgatacccaaggaattatccagagggtgcatgagcttttgaagctatacagtgatcatgatgtcttatctgaacgcctgctgttcaaaattccggctacatggcaaggtatagaggcctcgaggttgcttgaatctgaagggattcaaacacatttaacatttgtgtacagagttttgcccaagcagcagctgcagcacaagccggtgcatctgttgtacagatctttgtgggacgtgttcgggattgggcaaggactcactctggcgacccagagattgatgaagctttgaagaaaggagaagatgctgggcttgctttgtatgcctacattcacaaaaatgggtataaaacaaagttgatggctgctgccatacgcaacaagcaagatgtgtttagcctcctggggactacatcattgcacctctgaagatattgcagtctttggaagaatctgtcactgatactgacgtgaagtatggttatgtcccaaggctgactcctgctcttggcaaaacgtacaacttcactgaagaggagcttgtgaagtgggaccaattgagtctagcagctgcaatggggccagctgcggaagaactacttgcttctgggttggaaggatatgtgaaccaagcacgccgagtggaggaactcttcgggaagatctggcctcctccgaatgtttga

SEQ ID NO: 1311 - DNA, 980 bp, Oryza sativa
atgacgacggacggcgtcggtggcgaggaaacaggaagccggcggcagagcgcggccgaggagaagaaggaggcagcgaggaggcagtcgcggcggcggggcagcacgacaccgagagggcgtggccagggaaggagggagggagaggtggcgcccggagctcctcgtcacgcgttcacgcttgcaccggctcctctggtgctcggcgacggacggcgacgacgagagcgggacgggcggcaacaaagcggcgacggtggttcggcaacaatggcgcggtgggtgtgagggcggaggcgatgtcggtttgggaggggagaaccgaccttggtggtcaagcgcttggctggcggcagcggcggtttcgtgggcggtgcgaaagcggcgacggtgtggatgcgttgggcggtggaggacggtggatcgagcggcggaaactgaaacgcgagcgcgggctggtagcgtggagcggtcaagagcacaagcgaccaaggggtggagacagggcgccattgcccgggaggggaaaaaggaagggaggacggtggaaagggggacttgccccttccggtttgggagaaggaggtgggagagggagtgctctgcctccgggatttggacggacgcgggtagagcggcttgggcacgcgctgcagagctcgcggcaggcagcggggccgagcggcagcgcggcgcaggcgcggacggcggcggcgaccgggtggtcggccacgatcagcgcgtgcgtgggaaccaaaggcggtggcgggttcaaaaggcggcggcgggaatcggcgccggggagagaggaagcagagagggcgagagtgagagagagggcggcgctctctctcggctcaggcacgacgcgcgtgctcagcacgtgcgaaggggaggggaaacgggctgagaggagggatgggccgagggaaaggaattcggcccacaaaaacagagggacgcaaaatagacttttatag

SEQ ID NO: 1312 - DNA, 975 bp, Oryza sativa
atggcggccgtgcagcgactcctgcgggcgtccgcctccggtggcgcggcggcggcggcggcggcggcgaggaggcgcatgtccacggcggtggcgccggagcagacgcctgcggccgcggcgttcccgttcgcggcggcggcggggagggcgaggcagcgggtggcggaggagaggaacgtgcagtgggtgttcctcgggtgccccggcgtgggcaaggggacttatgccagccgcctctcccgcctcctcggcgtgccccacatcgccaccggggatctcgtccgcgacgagctcgcttcctccggccccctatctgtgcaggttaggccctccgtccatcgcttttcagcccggatcagaccatcctgcaagtcactgatctggatttggttttttcgttcgagtggatcgctggctgaaattgttaatcaggggaaattattttctgatgaaattatcatcaatctgttatctaaacgtcttaagaaaggagaagagcagggggaatcgggatttattctggatggttttccacgtactgtaaaacaagcgggaaattcttgatggagttactgacattgatatggtggtcaatctaaagttgagagaggatgtcctagttgagaagtgccttggcagacgtatttgtggccaatgtggaaagaacttcaatttggcctgcattgatgtgaagggtgaaaatgggctgccaccaatctacatggcaccactattgcccccaaataactgtatgtcaaagcttatcaccagagctgatgataccgaagaggtcgtgagaaatcgtcttcagatatataatgacatgagagccaacctgttgagggtttctaccggcaacaggggaagcttttagaatttgatttgcctggaggaatccctgagtcttggccaaagctgctccatgttctaaatctcgaggaccaagaagagatgaagctggccactgcgtaa

SEQ ID NO: 1313 - DNA, 960 bp, Oryza sativa
atgccggaggacgccgccgtgagggccggggagtcgcggccgcggccgcggtacccagagcgatccgtgcacctcctgtccttcgccatggtggggttgatcccgccattctctaggttcttccacgaggttttggatttctacgaaatccatgccttgcatctcgcacccaacgccgtgatgacgctggccatcttcgcgcacttgtgcgagattccgccgcatggttggcggtttcagagttgggcgaggagtacgacgcagtgcaggaccgcctcatgggcctgcgaaaccagggcctaacgggggcgatggtcttcggcgattacttccgtcactgaatcgcacctctccaggagcggtcccgtggcgcgttggagtacactgggcccaacgatcccatgcgcacccacgtgggtgtgcgttgggactggggcgaggaggacgcgaagacggtgatccggcgggtgctgggtctggacaccaccgagcaaacgctgattccagatgggatcctccccctctgcagtgaccgcgaccgggagagtatcctagctgtgatgtcggtcgtcggcgccggcaggggtcggtcccgccggagtggcgctggtggtggcggcagcagcgccggcagcagcagcgcaaccacaggtggcggttggatcggcggctccggcgggggcggcggctccagggcgcccggtccaagccgtgggcccggtggagattcggccagtgacctgaaagggaagcgaaagatgtccgaatcccgaacgccttctcccccgcatggtgggggcgccgagtgaacgacggaccgaccaccggcgggccacaagcgcccgctgtgtccgagatcgagcggaagaagaagcggctctggaagatagggcaaacagagccgtgccgggggagtttcatcgagcccccgaagtggaccttcaagtgttccccacgcag

SEQ ID NO: 1314 - DNA, 939 bp, Oryza sativa
atggtggaatggattcattgttgtgaactgatcgatgcttctaatctgcagaggttcttctttggtggtcggctaatatttggacctgatgctaaatccctgcttttttctgttgcactgatttttgtcccggttgcggtcttctgtgcgtttgtagcacggaatcttcgtcatcaatttcctgcatacaatgcagggtacgcaattcttgccgtagcaatagtgttggcaatctatgtgagtattttggtctatttcttgtaggtgctttcgttacttttcatcaccgcagctcaggatcctggtattgtacctcgtgcatctcatccaccagaagaagagtttcactatgacaatttatctcttgcggacacacctggcagactagtcttccctcgtgtaaaagatgttatggtaaatggggtgcctgtgaaggtcaagtactgtgaaacttgcatggtttttcggcctcctcggtgttcgcactgttccatttgcaacaattgcgtggaacggtttgaccatcattgcccctgggtagggcaatgcattggaaagcgcaattaccgatactttttcctatttgtttcttcggcgagtatcctatgcatttatgtatttgctatgtcagcattgtacataaagattctcatggatggagactatcccacagtgtggaaggctttgaaacactcccctgcttctcttgcattactaatatattgtttcatctgtctttggtttgttggtggactcacaggatttcatacatatctcatcagcacaaaccagcggacaaaagtggaagatgaccttgacataggtggtgatctcagtcggggtgaaagaagtcgaagttcggacctcgcatcagaaggcatcacaacaagtgctccagtctcccaacctgcattcccatttcggagagaagctctttag

SEQ ID NO: 1315 - DNA, 936 bp, Oryza sativa
  misc_feature (49)..(49): n = any nucleotide
atggagttcatcacgccaatcgtgaggccggcatcggcggcggcgggcngcggcaaggtgcaggagagtggtgggaggagcttggcggcggtggagaaggagcacatgttcgacaaggtggtgacgccgagcgacgtggggaagctgaaccggctggtgatcccgaagcagcacgcggagaagtacttcccgctggacgcggcgtccaacgagaaggggctcctgctcagcttcgaggaccgcacggggaagccatggcggttccgctactcctactggaacagcagccagagctacgtgatgaccaaggggtggagccgcttcgtcaaggagaagcgactcgacgccggggacaccgtctccttcggccgcggcgtcggcgaggccgcgcgcgggaggctcttcatcgactggcgccgccgccccgacgtcgtcgccgcgctccagccgcccacgcaccgcttcgcccaccacctcccttcctccatccccttcgctccctgggcgcaccaccacggacacggagccgccgccgccgccgccgccgccgccggcgccaggtttctcctgcctccctcctcgactcccatctacgaccaccaccgccgacacgcccacgccgtcgggtacgacgcgtacgccgcggccaccagcaggcaggtgctgttctaccggccgttgccgccgcagcagcagcatcatcccgcggtggtgctggagtcggtgccggtgcgcatgacggcggggcacgcggagccgccgtcggctccgtcgaagcgagttcggctgttcggggtgaacctcgactgcgcgaattccgaacaagaccacgccggcgtggtcgggaagacggcgccgccgccgctgccatcgccgccgtcatcatcgtcatcttcctccgggaaagcgaggtgctccttgaaccttgacttgtga

SEQ ID NO: 1316 - DNA, 935 bp, Oryza sativa
atgaagtggcaccctgacaagaaccccaacaacaagaaggaggcggagaacaagttcaagcagatctccgaggcgtacgaggtgctgagcgacccgcagaagcgagcggtgtacgaccagtacggcgaggaggggctcaaggggcaggtcccgccgccgggcgccggcggggccggcccgggaggcgcgacgttcttctccaccggcggcgacgggcccaacgtgttccggttcaacccgcgcaacgcggaggacatcttcgcggagttcttcggctcgtccagcccgttcggcggcatgggcggtggcatgggcggcggcatggggggagggcccttcggctcggcgttcggcggcggcgccgacgggcaccacgggatgcacggcggtggcgccgggagggcgttgaaggcgccggcgatcgagaggaagctgccgtgcagcctggaggagctctacaaaggcaccaccaagaagatgaagatttccagggaaatcgctgacgccagtgggaggagatcctgaccatcgatgtgaagcctgggtggaagaagggcaccaagatcaccttcccggagaaaggaaacgagcagccgaacgtgatcccggccgacctcgtcttcatcatcgacgagaagccgcacccggtgttcacccgtgacggcaacgacctcgtcgtgacgcagaagataccgctcgccgaggccctgaccggccacaccgtccacctgactacgctcgacggccgcagcctgacgatcccgatcacctccgtcatcaacccgggctacgaggaggtcgtccgcggcgagggcatgcccatccccaaggacccctccaagaagggcaatctcagggtcaagttcgacatcaagttcccggcgaggctcaccgccgaccagaagtccggcgtcaagcggctgctggggcagtag

SEQ ID NO: 1317 - DNA, 925 bp, Oryza sativa
atgcgaccatgctccatttttgtgtgcaacacgttttatttggctcgacgtacttctggtgtcggacggaccacgcgcgcggccgaattatctacaacggtgtcgcagggtcgtagccctgggaacggccgtccaccctctgttaccttttcagccgcacccgttccctcagctagacgcgcggcacttcgctgggacacgttcctcaccatctttttactgaggcaccgagccgggagacacattgcgagggtgagtgtcccttggccaccactcctacacctagagttcctcttccaccccttgcctcgtcgtcgtcctcacgactcgtgagagggcggcggcgctaggaccggcggtggaggtgacgccgggggttggcggcgtgccagaactgggagagagaggcggtgaagaggaggttcgtcggcgacggcgacgatgagctctgtcggcgacggctggaggaagagaggggagcgggaggagggcaactgggtgctgccctcgccggcgagccgccccgttgctgcccgaggccagatctagcaagcccagactggatccggccaccccgccgccactcctctcgcgtggtcgctgcttgccgccactgctcgatgtcgggggaaagggaggcaccgctgccactccgctgcactgctcgatgccaccgccgtcattcgtcgcgccgctcaacgccgcgcgccgtccgccgccgcgacctgcgaccacccagagagagaggcaacgacgagtggaaggagagttgcggagtcggtggcgggcgcgacggaggcggcgacagggagaggggcagagttggcagagagagagaggggcgagcggcgatctggatgacgtggctggggtggatgattttctcgagggcatcggtgggctggtgggaggggtatggaagtaa

SEQ ID NO: 1318 - DNA, 924 bp, Oryza sativa
atgtactctagtatttttggtggaattaccacaaatccttctgcaatggtgataccaatcgatgatcacatggtccacagaggacatggtgtttttgatactgcagctattatgaatggctctatgagttagagcagcatcttgaccgcttcctgaagtctgcatcaatggccaaaatcacgctgccttttgatcggtcaacaattcggagcatacttattcaaactgtgagtgcatcaaaatgcacccaaggatcactcaggtactggctatctgttggaccaggagacttccagctatcttcagctggttgtgcaaactcagccctgtatgctattgtcattgaaagtccatcgttaccagtaccagcaggatgcaaggtgatcacatcatcgataccgataaaatctcaacagtttgcggtcatgaaaagtgtaaactacctgccaaatgcactcactaaagtggaaggcgaagaaaatggtggattcaccggcatatggttggatgatgagggtttcgtagcagagggttccaacatgaatgttggcttcgtgacacaaagcaaggagctcctcatgccccgtttcgacaagatccttagcgggtgcacggcaaaacgggttctgacccttgccaagcagctagtggcagatggaaggctcagcgggatcagttcaaggaatgtgagtgtccaggaagggaaggcggctgatgagatgatgctcattggtagtggtattcttgtcaaacctgttgttcagtgggatgatcagataattggctcagggcaaagaaggcccaattgctcagatgcttttcaacctcattcttgaggacatgagatccggtccaccttcagtccgcatccctgtctcctattgaaactgctgacatctcaccgatctttctacagatatgtga

SEQ ID NO: 1319 - DNA, 906 bp, Oryza sativa
atggatgctccagttattacactcctcgtcttcctcgtcgccgtcgctgcggcaactgcggcggcggagatgccgcggatggagcacccgcgcaagggcgacgggtcgctgagcctcctcgccgtcggcgactgggggcgccgcggcgcgtacaaccagtcgatggtcgccgcgcagatgggaatagtaggggagaagatggacatcgacttcgtcatctccaccggcgacaacttctacaagaacggcctcaccggcgtcgatgataaggccttcgaagaatccttctccgacatctacaccgccaagagcctccacaagccatggtacaccgttcttggcaaccatgactacaggggcgacgccctcgcccagctgagccctgttcttcgcaaggtcgacagccgctggatctgcatcaagtccttcgtcgttagcgcagagatcgcggatttcttcttcgtggacacgacgccgttcgtgctcaagtactggactgatcccaagaacagcaagtacgactggagaggggtttctccccgtgaaacctacattgcaaatgtcctcaaggatctggaggatgcactggagcagtccaaagcgccgtggaagatcgtggtcggacaccacgccatcaggagcgtcagccagcacggcgataccaaggagctcctggagcatctccttccaatcctcaaacaagattcagtacctgacgagcgggccgggtcgaaggcgtggcgcggggtgcagacggcgaacacggacaaggtggagttcttctacgacgggcagggattcatgtcgctgcggctgacggcggcggaggctagcctcgccttctacgacgtcgccggcaagatcctccacacatggatggtcgccaaaccagccaccgggtactga

SEQ ID NO: 1320 - DNA, 889 bp, Oryza sativa
ggcgaggccgcgaagccggccctgcctgcgctgaagagcgccggcgagcaggcgctgaagctcgcctcgccggtggtctccggcgcctccaagcaagccacggaggcgctccagggcgccggcgtcgaccccgcccccgttctgtccgccgctaagaccgtcgcggacgcggcgcagcagggcacgaaggtcatcgacgccgcgaagcccatcgcgtcggcgacggtggagaccatcgggtcgctgggctccgcggactacgtcgtggtcgccggagcggcgttcctcgcgtacctgctcctgccgccggcatggtccctgctttctttcactctccgcggctacaaagggtgacctgaccgctgcacaagctctggacatggtgacctcgcaagattacgtgctgatcgatgtgaggaccgagaaggacaaggccaaaaccggcgtgccacagctcccctcgaacgcgaagaacaagctcatctctatcccgctggaagagcttccaagcaagacgaagagcatggtgcgcaacgcgaaacaagccgaggcggagatcgccgcgctgaagatctcctacctcaagaggatcggcaagggctccaacgtcatcatcatggactcgtattgcgacagctcgaagatcgtggcgaagacgctcaacagcgtcggattcaagaactgctgggtcatggccggcggcttctccggcaggaaagggtgggcgcagagccggctcgggacggactcgtacaacctgtcggtcgtcgaagtcgtcacgccgtcgcgggtaattcctgcggccgctgatcggctcgtgacggcttcgtcgtcggcttcacggacgaccacgagtcgtaagcttcttcccggcagcgtggacggctga

SEQ ID NO: 1321 - DNA, 881 bp, Oryza sativa
atgcagacggaggcgagagtggggatggccgccgcaacgatggacagcggcgccgccgccgcggccgctcggagctccttgccggcggcgtcgcgggcgccgtcagcaagacttgtaccgcgcctctcgcccgcctcactattctattccagcaggtgcaaggaatgcattcagatgtggctaccatgcggaagactagcatatggcgtgaggcatcccgcattgtctacgaagaaggcttccgagcattctggaaaggaaatcttgtaactattgcacaccggttaccttactcctcaattagcttttacacatatgagaggtacaagaacggtggtttgtctggaataacagcagcttcgatgacatatcccttggacttagtacggactcgtcttgctgctcagtactacaggggcatatctcatgctctttacgccatctgcagagacgagggtgtcaaggggctctacaagggccttggtgccactttgctgggagtaggtcccagcatagcaataagcttctgtgtctatgagacattgcgatctcattggcaaatagagagaccaggccatatgattcccctgttctgatcagtttggcttgtggaagtctttcaggaattgcatcctcaactaacatttccgttggatctagtaagacgccgcatgcagttggaaggcgcagctggaagggcccgtgtctaccaaactggactttttggaacatttgggcatatcgttcgcacagaaagtttaagaggattgtatagaggaattttgcccgagtactgcaaagtggtcccaagtgttggcattgtttttatgacgtatgagacgctgaagtccatcctcacggaactggcatcagatgattag

SEQ ID NO: 1322 - DNA, 869 bp, Oryza sativa
atgaagtttgccaagaagtacgagaagtacatgaaggggatggatgaggagctcccgggcgtggggctgaagcggctcaagaaattgctcaagaaatgccgcgtatgtgatgggagttttttcccatctcttctcaatgagatgtcagccgttattggctgcttcaatgaaaaggccaagaagcttctcgagttgcacctggcatcaggtttcaagaaatatacaatgtggttcaccagcaagggtcacaagagccatggggcattgatacagcaaggcaaagacttggttacttatgcaattataaatgccgtggccatgagatacattactcgaagcaagggcaggaattcaaagctcaagcccagagtctgcatattgaaatacttcaatccccatggctctgtgagctgatggctttctacatgaacttgagaagaagcaagaagaacaacggtgctatggagctctttggggattgttctctcgtattcgatgatgacaaaccaacaatttcatgcaacctctttgactctatgcgtgtcgacattagcttgacatgttcgatttgcttggataccgtgtttgatccagttgctctttcctgtggtcacatatattgctacttgtgcagctgttctgctgcatccgttacgatcgttgatgggctgaagtctgccgagcgcaaatcaaagtgcccactgtgccgacaggctgtacacttggatgagctgaacatgctactaagctatagagttgtccagagtactgggagaagagaatacagatggagcgggttgaacgtgttcgtctggctaaggaacactgggagtcacagtgcagggcattcttgggcatgtgattctaaa

SEQ ID NO: 1323 - DNA, 866 bp, Oryza sativa
ctccacttcgtcaagtaccagggccttgggaacgacttcatcatggtggtggacaatagggattcggccgtgccgaaggtgacgccggaggaggcggcgaagctgtgcgacaggaacttcggcgtcggcgccgacggtgtgatcttcgtcatgccgggggtcaatggcgcggactacaccatgaggatcttcaactcggacggcagtgagccggagatgtgtggcaatggagtccgttgctttgcccggtttatagctgagcttgaaaacctacagggaacacatagagcttcaaaattcacactggcgctgggctaatcattcctgaaatacaaaatgatggcaagcaggtaaaggttgatatgggccagcccattctctctggaccagatattccaacaaaactgccatccaccaagaatgaagccgttgtccaagctgatttggcagttgatggctcaacatggcaagtaacctgtgttagcatgggcaatccacattgtgtcacatttggcacaaaggagctcaagttgcatgttgatgatttaaagcttagtgatattgggcctaaattcgagcatcatgaaatgtttcctgcccgcaccaacacaggaatttgtagaggtcctgtctcgctcacacctcaaaatgagagtctgggagcgtggtgctgaggtgcgacgcttgcttgtggaaccggtgcttgtgcagtagttgttgcagctgtcctcgagggtcgagctgaacggaaatgtgtagttgatttgcctggtggaccattggaaatcgaatggagggaggatgacaatcatatttacatgactggtcctgcagaggctgtcttctatggatctgctgttcactag

SEQ ID NO: 1324 - DNA, 862 bp, Oryza sativa
  misc_feature (249)..(249): n = any nucleotide
  misc_feature (251)..(251): n = any nucleotide
ccgctcatgcgcctccagctcggcggcgtccccgtcgtcgtcgcgtcgtccgcggacgccgcgcgcgaggtgacgcgcacgcacgacctcgacttcgcgtcgcggccgtggccgcccaccgtgcgccggctgcgcccccaccgcgagggcgtggtgttcgccccctacggcgccatgtggcggcagctccgcaaggtgtgcgtcgtggagatgctcagcgcgcggcgcttgcggtcgttccgccgcgtncncaaggaggaggccgcccgcctctcgttccgccgcgtgcgtgaggaggaggccgccaacttcgccgcggccgtcgccgcctcgttgtcgtcgccaccggcccgccgcgacgccgtgaaccggcggcgccatggaggaggacctgctggacactctcctcaggatccagaagtatctaaagcttatcatcaaggagactctaaggttgcatcctgtggtaccattgcttcttccaagagagtgtctccatgcgtgcaaggtcatgggctacgacgtgcctaaaggcaccaccgtgtttgtgaacatatgggcaattaacagagaccccaagcattgggatgaccctgaggtgttcaagccagagcggttcgacttcaaaggtgcaaactttgagtatattccgtttggtgctggtaggaggagttgccccggggtgacattcgggcatgccaccgtggagctcatgcttgctacgctcttataccactttaaatgggagcttcttgaaggagttgcgccgaacgaactagacatgacggaggagataggcatcaacgtgggaaggaagaatccactttggttgtgtcccattgttcgtgtgcccttgcagtga

SEQ ID NO: 1325 - DNA, 862 bp, Oryza sativa
  misc_feature (33)..(33): n = any nucleotide
  misc_feature (130)..(130): n = any nucleotide
  misc_feature (136)..(136): n = any nucleotide
  misc_feature (153)..(153): n = any nucleotide
gtcatcggcagcggcaactggggcagcgtcgcntcccgcctcatcgcttctaacaccgctaagttgccctcctttcatggtagttcgtagatgaagtaaggatgtgggtgtttgaagaaatattaccaancaggcnagaagctctctgagtcnttaaccaagccaatgagaattgcaaatacttacctggtataaagctcggagctaatgtaattgctgatcctgatttggagaatgcaggtgaaagatgcaaatatgcttgtttttgtgactccccatcaatttgtggagggtatatgtaagaagcttgtgggtaaactaaggccaggaactgagggtatctccctcatcaagggcatggaggtcaagatggaaggaccatgcatgatatctaaattaattacaaacatacttggaatcaattgctgtgtccttatgggtgctaacattgcaaatgagagattgctgttgagaaattcagtgaagcgacaattggatataagaaagacaaggaagtggcaacccgatgggctaaactttttacaacaccttacttcctggtttctgttgtagaggatattgaaggagttgaattatgtggaacactgaaaaatgtcgtggccattgcagcaggttttacatgcaggtcttgttgatggtttggatatggggaacaataccaaggctgcaataatgaggattggtttgcgggaaatgcgtgctttctctaagcttctatcccctacagtcagggacaacactttctttgagagctgtggtgtggctgacctaataactacatgccgtatggtggaagaaacagaagagtcgctgaggcctttgcacgaaatggtggcaaaag

SEQ ID NO: 1326 - DNA, 858 bp, Oryza sativa
  misc_feature (18)..(18): n = any nucleotide
  misc_feature (225)..(225): n = any nucleotide
  misc_feature (228)..(228): n = any nucleotide
gggctggggctggggctnccgctggacgcggccaagaacgcggcggcgaggtaccgggaggccgtggggctgcaggtggaggcgttctggaggcgcaactacatgctgctcgtcggcgccggggcggtcgtcgtctgcatcgcgctgtggagggtcatgttcggcatcgccagcaccttcgtcgggctctccgagggcatggccaagtacggcttcctcgccctngcnaccgccatggtggcgttcgccggcatgtacacacgctcaagattcaccataaatcctgataaggtttatagaatagcaatgacaaagctcaacacatctgctgcaatccttgaagtcatgggtgcacccttagccggtactgatgtcagagcatatgtcatgtctggaggggggcctaaactcaaggacttcaaatttaggcttggtggcaaaaggtgctttctgatcttccccattaaaggatcagaaagaaaaggccttgtaagtgttgaggtcaagaagaaaaagggacagcagtacgacatgaagctactcgctgttgacataccaatggcgtcaggacctgatcagcggttattccttgtcggtgacgagcaggagtacaaggtgggtgggggtttgatatctgagctgcgggaccctatagtaaaagctatggctgcagagaaggagtttgattatcttgatgaaagagaggatgcggaggatgaagcgagggagcgtgaggaggctgagcgaagacaacaggaagaggaagctgaagcattgaggcgtgaggaggaaagattacgtgaggagtacgaagaaaggaagcggcaagaagctgagaacctggagaaaaccacttga

SEQ ID NO: 1327 - DNA, 857 bp, Oryza sativa
atggcggagtacgcgacggcgaagacgtcggtgtggtgggacatcgagaactgccaggtcccccgcgcctgcgaccccaacctcatcgcccagaacatgagctccgccctcgccgccgccggctacaccggccccgtctccatctccgcctacggcgacatcggccgcatcggcaacgccgtcacccacgccctctccagcaccggcatctccctcaaccacgtccccgccggcaggtattaaagatgcaagtgataagaagatcttagttgacatgctgttctgggctattgacaaccctccaccagcaaactatttgttaaattctggtgatcgggatttctctaatgcccttcataagcttacaatgagacggtacaatattctactagcacagcctcaaggtcttataagaaatatattaggtgctttggaagtattgaagacagagaagattccaccaatagaacagcatatttcagattgtatacgttatggagaagctaacttaccaaattttgatgttaagaaggctcttgaacttgccattcagcatcaagccatcgtcttgaaaatgttaggtcctatgtcattctatttggggaagaaccaaaatctttggaaatgtgtgaatataatggatataaatgcaaaatatccaaaagtgcaggtatcaagctgcaattgtcttaaagaatcaatgcttgaaacatcttgcccttggtgaagttcttcagattttgtatatcataatcaatacaaagaagtggtttgtgccgcattcttcagggtggcagccgttgtcgtttaacattatagtggttgatgccacgacaggtgctggtgggaaagcttag

SEQ ID NO: 1328 - DNA, 854 bp, Oryza sativa
tacacctacacatccattatcttgggtctcgcaatgcacggccaaggcgaggacgccctgtctctattcgccggcaggcaatgagccggcgtgacgccgaacaaggtgctgtcgcgccggactcgtcgaggaggggctccagcaactcaacgccaagccagaaccacgcatcgagcattacggctgcgtcgtcgacatgctcagccgcgccgggagactagaacgaggcagaggagctcgtcgcggcaatgccaatacaccctgacgcgctcatctggggctcgctgctcgccgcatgccgcgcgcatggcaaagttgagcgcgccgagcgggtgatgcggcggcgcaccaccgacgccgatgcggacgccggcgactacgtgctgatgtcgaacacttacgcgtcgaatggccggcacggcgaggcggtgaaggtgaggaggcagatgaggaggaacgagatcgacaaggtccccggctgcagcctcatcgagatcgacggcgtcgtcaacgaattcgaagcaatcccagcaaattccatccgataaaaacacaacaagattcatcaaagaacaggttatccgagtggtcgtggttttcggtgccggagatggcgccctcgtcggcggggacgaagacgccggtctcatggtcgggcacccacgcgtcctccgggcccgccctccaccgtctcctcctccgggagcgcctccacgttcttgcggttcagtgccgcctccaccaaggttctgggattcaattgcagaaaaatttcgggccttaccgaaatgggcgaaattcggaaatttcggaattttcggacaaaatttggccgaatttgttgcaaaatttga

SEQ ID NO: 1329 - DNA, 840 bp, Oryza sativa
tcgtgcccccacacctccccccaaaacggtaaggctgagcgcatgttacgttcccttaataacatagttcgctccctcctgtttcaggctagcctcctaccaccttcttgggtagaagccctccacacagccacccacctcattaaccgccatcccaccaagactctccaacaccacacaccgttcttcgccctttatggtgcccatccctcctacacacaccttagagttttcggctacaagtgttaccccaacctctccgccaccactccccacaaactcgcgcctcgctccgtcatgtgtgtgtttttaggatatcctaaggatcacaaagggtaccggtgttttgatccttcctccaacagggtctatatttcgtgtcatgtggtgtttgatgagatggaggaagagtacaatgctctcttggccaaccgcacttgggagctcgtcccgcgtcctcatggcgccaacatcgtcaccggcaagtggatctttcgacacaagtttcaggcggatggttccctcgaccgctacaaggcacgatgggttctctgcggcttcactcagcgccccggcatcgacttcgatgagaccttcagtccggttgtcaagccagccactgtccgcaccgttctgagcttggcagtctctcaggactagcccattcaccagcttgatgtcaagaatgcctttttgcatgggactttacaggagacagtgttttgctctcagcctgctgggtttgtcgatgcttccaaacctgactttgtatgccgtctaaacaagtctctttatggtttgaagcaagctccccgcgcttggtacaaccgttttgccagc

SEQ ID NO: 1330 - DNA, 837 bp, Oryza sativa
atggaggtggttctgcatgagggggatgccaaagattgggtttacaaaggagaaggtgcagcgaatctaatcctcagctacactggctcgtcaccttctatgttgggtgccaatcatgttgatggcgggaaatgtggatttcttccgtcatctgaatacatatcgaaggagaattctatcaagaaacaagtaacacggtataagatgcatcagcacctaaaatttcatctgggagagatatcgaagacaagtgaatacgatcccctagatttattttctggatcaaaagaaagaatacatatggctatcaagtcatttttttcaactcctcagaacaactttagaatttttgtggatggttctttagtttttggtggcatgggaggtggcgcagatagtgttcatcctaatgaaacagagaaatgtcttgaagatctgagcaaggttactggcttacaactatctgactttattgagctcctgtcagaggcaatctttaagtctggagtgttgggtaaacttttagccactcaaaaactggatgatcatgacatcgaaggggcgattcatctgtactataacatcatttctcagccttgtttgcattctcttccattggacaagagtgagaagattgtcagggactttcttatctctgctactgcaaaagattgtagcctaatgatcagctttcgatttattgatctggatgtgaaacccttggataagatggtacattactttaaattggatcaaaagatagtcaatttctacactagaaatggagaagttgggggagatccacgtgatcctccaaagggatgtggccctaggtga

SEQ ID NO: 1331 - DNA, 837 bp, Oryza sativa
atggcacgtgggccaatggatctttggaacgagtgggcgacccagatcctggtgctcttgagcttcactctgcagatcatcctactccagcttgccgggattcgtcgccgagaagctccagctgtgctgaggcttctcctgtggttggcataccagctggctgactccactgcgatctacgccatctgccacctctccctcggtggcacaccgcgtgagcaccagctggtggcattctgggcaccattccttctgttgcaccttggtggcccggacaacatcaccgcatattccctcgaggacagtaagctctggctccgacaccttctcactgtcgttgtgcaggtcttgggagctgcatatgtcctctacaaacaattcaggggcagtggaagcccactcctactcgccaccattttgatgtttgttgtaggtgttgtcaagtatggggaaaggacatgggcactcatgtccggcaacatcgacaccatccggagtacactcaagaaggagccgcataccaagtgccattcccacattgagtataagccccaccagatgagcttcagtaatgaagggcactttaggagggaggctaatgaagaggaattcctgatctgtaatgctcacgccctgttccacatttgcaagtatgcggttgtcgatgattcttcatatgacaatactagggatacccgtgccagtgacgccgcaatacttcgtggccttacggacgaacagaagtatgcagtgacggaaattgagctctccctctctccctcatgtacgatatgttgtacaccaaggttaagtgactctcaatttaaaacttattaa

SEQ ID NO: 1332 - DNA, 836 bp, Oryza sativa
atgcccacctgcccctgcctggcccggactccaccccgacctcctcggcatccaccgtggctcagaaccagctgcaccagtgccagatcttcctcatgcagcaggcccaggcgcaggcgcaggcgcaggggcaagggtacacaccgacgccgcagcagctgtcgcagcaggccatgtccttcttcccctccaacatcgatgcccacctgcccctgcctggcaggctactaccctaccatgtggttgctgactatgaggctgaagaagatgacagaatccttgacagtgatacaactggacagattccttcgcgcctgcagcaatgggatcataacattctggtcaaaattgctgagttcacaactacttttgagaaacaagttttggcgtacaatataatgaccaagaaaagagccatcggcgagttcagatcagaggagcggctcatgctggagcaggctttgttaatggaggaaaagcaagctatgatggggctaagagcagagatagaatcaagggagaaagcaggtcgtgaggctgctgaagctaagatgcgtatggcaatggctgaacaagctcgagcggaggcccaagcgcactcggagatgataggtcatggccctttgagggcccatgctgcagcgtcccaaggcgaagatggccctagtcatgagatgatgcaagagcaaggtgaagatggatggggaaatgctcaaagggacgatgaagatccatctgaagatttccttaatgatgaaaatgaacctgagaatgggaactctgatatgcaagaggactggcgcagatcaggagaactcgatctgaactctaggtaa

SEQ ID NO: 1333 - DNA, 822 bp, Oryza sativa
ctgcaacagcatccccactaccatggctggggtggaaacttctcgtatggtccacctacccagccgccggcgccggcgccgccgtatgttgagcaccagaaggctgtcaccatccgtaacgatgtgaatctcaagaaggagactctccgggttgagcctgatgacgagtgccctggacgattcctcatcaccttcacctttgatgccaccgtcgctggaaggtttacttctttgcaaaggaggagctgaactgtaaccttacagcaacgaaagaagatttactcaagccagtcactgtaacatttaaagagggtcttggtcaaaaatttaggcaaccttcagggacaggaattgacttctcgttgtttgaagatgctgaattatttaaggagggagagatggatgtatatccacttgcagtgaaggctgaaacaacattctcaattggtcaattctcagaaggggaagaacaaaagtcacaaactccaaattcacagatcacccaggctgtatttgagaggaaggagaatggggattaccatgttcgtgttgttaagcagatcctttgggtcaatggcacgagatatgagttgcaggagatttatggaattggaaactctgttgaaggtgacaccgaagggaatgatcctggcaaagagtgtgttatctgcctatcggagccaagggatacaactgtcctcccatgtagacatatgtgtatgtgcagcgagtgcgcaaaggttctgaggtaccagaccaaccgatgtcccatctgcaggcaacctgtggagcgtttgctcgagatcaaagtcaacaacaaag

SEQ ID NO: 1334 - DNA, 820 bp, Oryza sativa
  misc_feature (17)..(17): n = any nucleotide
  misc_feature (27)..(27): n = any nucleotide
  misc_feature (47)..(47): n = any nucleotide
  misc_feature (81)..(81): n = any nucleotide
  misc_feature (99)..(99): n = any nucleotide
  misc_feature (246)..(246): n = any nucleotide
  misc_feature (276)..(276): n = any nucleotide
  misc_feature (314)..(314): n = any nucleotide
acccacggcggcgggcncggcgcggcntgcgacaggggaaaaggggnttcagtggggagctcaccgacgagagaaacggantcggcggcgcggatggantcgcggcgaggcggacgcgacggcggggcggcgcggcaccgagagggcgcggccgggaaagaagagatggagaggcgcgaggatgggggcggcgcggagctcctcgtcgactcctcgtgctcgcaagctccccgacacgcacgacgncagaggagggcgagaacgacgacgaacggngaggcggcagtggtgtgatggaggagaggaagcgaganagctgcttctcccactcttggatgggtgcggcgtggagcggcgggggccatggatgacgtcggcgatgacggcggcggtcggtttgtcatggagcgggggcaaggcggtagcacgtggcgtcggcgacgcaagggctgatggcggcggcgttcggctagtcggccacctcgcgagcgagcgcgcgcgacgcgggggtgcggccggatttcgaacggcggcggcgggaaatcggcgccggtgggggagcttctacgggagagggagagacgagagagagagagagagagagggagcgaggatgagaagagagtgggcgatctctctctcgagcgcggcgcacgcgcaacgcacgtgcggagagaggggaggggaggaacggctgagagaggagatgggccgaggggagggggatcagtcccatccaaaattagaaggaggcaaaatagacttctgcagagagatgatttggaagggatttggatttggaatgaaatttcgaatatga

SEQ ID NO: 1335 - DNA, 810 bp, Oryza sativa
tacaaatctgttgctgagaggggcccctggagctcactttctagatgggctctggaatcttatttgaaaggtgacatagggaaagcattactcctgtattctagaatggcggatcttggatatgaggttgcacaaagcaatgctgcctggattcttgataggtatggcgatgaaagtatttgcatgggagaatctggcttctgtacagatatggaaagacatctccgtgcacatgctctgtggtggcaagcatccgagcagggtaacgaacatgctgccttgttaattggtgacgcctactactatggccgggaggcatatatgcatgcgcaatcacaatctaatgctcaggccatgtttaaccttggttatatgcatgagcatggccatggacttccccttgacttgcacctggcaaaaagatattatgatcaggctgttgaggtggatccagcagctaagctccctgtcatgcttgcactaacaagtttatggataaggaagaactatgatggaagctttttggattcactgccggaggtatatcctgtagttgaggaatgggtggaggatgttcttatggatgaggggaacgcaacaatatttactctcttcgcttgccttgtaactgtcctatatttgcgagagcgtcagaggcgtcaagctgcggccgccaaccctcaacagcctgatggtgcacccatctaatttcaacctttgcatcatgatgctgggattgaagtggacgttaagcttgaggtacatagtcatttattctcagccatatcataccatcaaagttttgtttga

SEQ ID NO: 1336 - DNA, 798 bp, Oryza sativa
ttcaccaagctgtgcaagggcctcgccgtcgtcttgttcctcggccacatcgtgatccggctgttcccttcagctgtcacctacctcgcgcttattccctccagaggacaatcccatttgcttggaacctcgtaacttcaggctatattgagcaaacaattccagggagcatagttggtcttcttgttttgggaaaagtgttggagcctttgtggggtgctaaggaattactaaagttcatttttcttgtcaatctctcaacttcggcttgtgtctttgtaacagctattattttgtactacataacacagcaggagatctacctgggttctatggagttctttcaggatttctggtgggtatcaagcaaattttacctgatcaagagattactcttttcctgctgaatattaaagcaaagagcttcttcatgaaggattcagtgtcatacatcccaatcatattatttggcatctacctgagctggatttacctgcgttacttccaaaagaggctagaagcaggcttaaagggggacccaagtgatgaattctcattctcaagcttcttccctgaatttttgagagaccagttttggacccaatagcatctgtgttccatacacttgtttgtggacgatccgaaagatctgaagccaatgatcaaacactggatgggctgttacctggttcatattctattgaggcaaaccgtagaaggtgtggattctctttcttttcctattcatcctatctagtccatttggggaaaccatcatatataatgctggccatatga

SEQ ID NO: 1337 - DNA, 783 bp, Oryza sativa
atgaaaacgacaaggactactcggattgtatccatattggtttccctagttctacttggacaaggggacacctatgggtataaatacaagacccaccatggaggatcaacacctaacacaatcgacatagaagcctacatacgccaagacacgccgccggatgtcgacttcagggataagcacgctagtaccctacggtgtctccggatactgttaggagagacgaaagcgctatctctgatctcgccgggcacggattcgaggaggaaggctaccctgttgtcgactacgagtcagatcgtcagaccgccatgtcgacaacagttatataggctaccccacatattgtactggtgtgattatcatgaataagagcaataccggcttcggccaataggatcactttaagtggtcgagttacgactactgcctggtcctcgactagcgatgtcccactacttccactttaagtggtcgagttacgactactgtctggtcctcgaccagcgatgtagcgtctctcccactacttccactttaagtgatcgagttacgactactgcctagtcctcgaccagcgatgtagcgtctctcccactacttccacttcaagtggtcgagttacaactactgcctggtcctcgaccagcgatgtagcgtttctcccactatttccacttcaagtggtcgagttacgactactgcctggtcctcgaccagcggtgtagcgatttctcctactacctctacttcaacaaagttgatagcaggtacacaatatcg

SEQ ID NO: 1338 - DNA, 777 bp, Oryza sativa
atggcgattactttgtccaatgtcaactctgaggcaggcctccagaagcttgatgagtacctccttactcgcagctacatcagtggggtaccaggcttcaaaggatgacatgactgttttcacctcacttccttctgctcccgcagcaagctatgtcaatgtcacaaggtggtatgatcacatcagtgctctcctaagatccagcagtggagttaccgcagagggtgaaggtgtgaaggttgagtcaactgcttgttctgtgtctccaactgctgaccaaaagcaggcaccagcagctgatgaagaagatgatgacgatgttgatctgtttggtgaggagactgaagaggagaagaaagcagcagaagaacgggccgcagctgtcaaggcttctggaaagaagaaagaatctgggaaatcatcggttctgctagatgtaaagccatgggatgacgaaacagacatggcaaagcttgaggaagctgtgaggaatgtgaagatggagggcctgctctggggtgcattgcagccaaacttgtaccagttggatatggcatcaagaagttgcaaattatgatgaccattgtggacgatcttgtttctgtggacagtctcattgaggattatttttacacggaaccagctaatgagtttattcagagttgtgacattgttgctttcaacaaaatctgtaagttccttggcaagtttggtgcttttagtttggatttccaaataactgaaactaatggtttgattgaatatgcaaaactctaa

SEQ ID NO: 1339 - DNA, 774 bp, Oryza sativa
gggatcgtcgggttcggcaacttcgggcagttcatcgcgggggggatccagcggcaggggcacgcggtgctggccacctccagatccgactactcgggctactgcgcccgccacgggatccgcttcttcgccaccgccgacgagctctgcgaggccgggcccgacgtcctgctcgtctgcagctccatcctctccaccgaggccgtcgtccgcgccatccccttccgcaagctccgccccggaaccctcgtcgccgacgtgctctccgtcaagcagttcccccgcaacctcctcctcgagttcgggattgtatgtacgcaccccatgtttgggccggagagtggaaagcatggctggagtgggctaccttttgtctatgacaaggtccgtgttgccaaggaaggggatcaggcggccaagtgcgaacagttcttgagcatctttgagcgggagggatgtaggatggtggagatgttgtgcgaagagcatgatcgctatgccgcgggaagtcagttcatcactcacactattgggaggtgagcaacagctaaaccttgagtccacaccaatcaacaccaagggttatgagacccttctgcaacttaacacgataagtgatagtttcgatctgtactatgggcttttcatgtacaatgtgaatgccacagaacaggacagggcatttgagaaggtgaagcagatgctctatggtaggctgcataatgtactaagaaagcagatagaagagagggtcccaatcccgtagccccttca

SEQ ID NO: 1340 - DNA, 766 bp, Oryza sativa
  misc_feature (61)..(61): n = any nucleotide
ggaagtgcgtaatcatgaaaaggaggagagagacatgaaagagccaccaattccattgttncacacttaagttcgagacaccaccatcatcatcttgaagaggacatcaaaggtaaagtaaatggtactgaaattaatcaagagagcaaccgttagtggaaccaaatgttggaattcctttgtcacaagttgatttactcgctgttccttgtgataaagaagagttgtgtgataatgcttcacttatatccatgccacaactagtgaatgaacatgctattcctagtgtttctttgtgtgctgattttaagcatgctgttcacattcctaatgaagttgaggaacgtaaattgctatcttctttaaatactttgggctatgttcagtttgatgatttttgtgcgctcgataatttgaaggagaaattatttgctaagtctgatttgccatatccaaccaatgttatatttcacatttttggcgaatataatgatcttggaatatattttgtgcatagagtttacatctgctcggatttagaacttactgtacatgtggataaaacatacaagctagagagaaatgttattgctaaccaaattgtctcgagtttgccttgttttaattggaagaaacaggttgttgtaaatggactatgcaaagagcaccatatggaaaaaccgaggacggttttctgtgaagaaggggaggatgatgtgaccatggctaccacggatgcaaccattgctcacatcatggatgaaca

SEQ ID NO: 1341 - DNA, 765 bp, Oryza sativa
  misc_feature (16)..(16): n = any nucleotide
  misc_feature (37)..(37): n = any nucleotide
  misc_feature (45)..(45): n = any nucleotide
  misc_feature (699)..(699): n = any nucleotide
atgcggcggctcgacntgcccgcgcgcgacctccgcntcctcganccgctcttcgtctacccctccgcgatcctcgggcgcgagcgcgccgtcgtctgcaacctcgagcggatacggtgcatcatcaccgccgacgaggcgctcatcctggtgcggaggtacgtcgctgagctgcagcgccgcctcgacgatctgccgttcgagttcatcgccctggaggtcgcgctcgaagctgcctgctcgttcctcgacgcacagcaggctgtcgaattggaggctgacgcttatcctttactggatgaattgacaacgaaaatcagtacccttaacttggaacgtgtgcggcgcctaaagagtaagctggttgcattgactagaagggtccaaaagaaggtcagagatgagatagagcagctgatggacgacgatggtgatatggctgaaatggttcatctttctctgctccagtttcgccagtttcctcaccccctgcttctcgaaggcttgagaaggaattgagttttgccagaagacaacgtccgaaaccaactgatccaatttgaactgctgctgaccacggctacattcgtggtggccatcttcggagttgtctcgggagtttttggcatgaactttgaggtggacttgtttaatgtaccacatgcgttcgaatggacgcttgtcattacaggcgtatgnggcttagtcatattctgctgcttcatctggtacttcaagaagagaagggtttttcccccttggtaa

SEQ ID NO: 1342 - DNA, 750 bp, Oryza sativa
  misc_feature (708)..(708): n = any nucleotide
gatccgacgaagttcagatttactcacgagacgtcgttcgtcaggcagcacatgaacgtgctgaacaagacgccggcgtcgttctacattagcaatttcttcaggcagttcttcagatcagtcaggagggccgactactgcgcgttgcgtcacagcttcgtcaacgttcatttagctcctggcagcaagttcgatttccagaagtacatcaaacggtctctcgaggacgatttcaagagccctcccctttgggcatctgctctcatcttcctgctcctcaatgtcagcgtgttccagggttgcataccatgctttggatctccatcatgccagtggtgatcctgtcggtggggacgaagctgcaggggatcatctgcaggatggcgatcgacatcacggagcggcacgcggtgatccaggggataccgctggtgcaggtcagcgactcctacttctggttcagccgaccaaccttcgtcctcttcctcatccatttcaccctcttccagcagaatggcttccagatcatctacttcctctggatactgtacgagtacggcatggactcctgcttcaatgactccaaagagttcgtctttgctcgcctctgcctcgggttgtggttcagttcttgtgtagctatgtcactctccccctctatgcactcgtctcacaacagatggggtcaacgatgaagcagtcaatctncgacgaccagacgtccaaggcgctcaagaactggcgcgccgg

SEQ ID NO: 1343 - DNA, 750 bp, Oryza sativa
tggtgcaggtgctccgccgcatcgcgcagagcggcagcgtcgtcgtcatgacccatgaccatccaccagcccagcggccgcatcctcaacatcctcgaccgcctcctcttcctctcccgcggccgcaccgtacgtctactccggcacgccgtcggggctcaagaccttcttctccgtcttcgccgcgcccgtcccggacaacgagaacccagccgagagttcgccctcgacaccatcggtgagctcgagcaccacagcacgacggcgccgccatgctcgtcgaattcaactccaagtggcaatcatcgctcggcgctttcctcatcgatgccgacgagacagcccacaacgcctaccgccgcctctcctacgtgatcgccaacaccgccgtcgcgttcccgccgctggtgtccctgtcgctggcgttcgcggcgaccacgttcttcgccgtcggtctctccggtggcggttgcttctcccgtggcgtcgagatgttcgacggcacgccgatcgtcgggttgtcgaaggccgtgaagatacgctcggcaccactttgacggcggacacctgcgtggtgaccgcgccgacgtgctggcgcagcaggctgggatggatatcggcaggtggaagtgcctgctggtcaccgtggcgtttggtttctttttccgttttctgttttatattgtcctgctctttgggagcaaaaacaagaggcgctagctaaaccttcgggtgtgtgtatgcatgtaa

SEQ ID NO: 1344 - DNA, 741 bp, Oryza sativa
atgttgctcagcgatcagaggaatggtttgctctccgcaaggacaagctcaccacaagcaccttcagcactgccttggggcttctgggctggcaacagacggtcagagctgtggagtgagaaagtatttggatcaacagaaatcaagttggaggatgcggcgaggtctgctatgaactggggcacggtgaatgaaagtgtggccatagagcagtacacaagcatcaccggacggtcagtgggttcccttggcttcgcagtgcacacagaggccaactttgggtggctcggagcttcacctgatggcgttctagggtgtgacccagatggtgggatcctagaagtcaagtgcccgtacaacaagggtaagcctgagctcgctctgccatggcgtgctatgccatactactacatgccacaggtgcagggcctgatggagataatgggcagagattgggtcgagctctactgttggactcccaacggaagcagcctgttccgagtgccccgagatcgcgggtactgggagctcatccatgaagtcctgcgtgatttctggtgggggaatgtgatgccggcccgggagctggtgctgctggggaaggaggccgaagctagatcctttgaaccacagcccaagcaccggtcgacaaacctggtgatttttagaagcaggaagctagcttctgaagccaagttgttgtgcaaggatattggcggtcatgtagaattcttcccatga

SEQ ID NO: 1345 - DNA, 737 bp, Oryza sativa
atggccgtcgcggtggccgcggttgtcctcctgctccaccctgccgcttctgcggcggcggcggggccgaagaaggtggcgacggccgcgaggaaggaggacatcccctacatccggtgccaggtctgcgagcggatcgcgcgggagatctcggcgcaggtggcgaagaagcagcaggcgctcccggcaacgaagaaggagaatgtgtgcaacctgaagaagcaggaggcagactggatgctcaagatcgatatcgtagagaaaggcgataagctcgagttacagctcgttgagcaagatgaggaagggcactgtaatgcagaatgcaaaaccattgagcgtagcatgtgatggggtatgctgataccgatgttgctgaattcgtctacaagaaaaaaccttcagctgatcagctggtcaaatttctttgcaaagatctttctgaagcatgcgttgtggatccaccaccagttccaaaatcactattgaaccatcatattcctgacatacatccattgcaaaaactgcaggatcgggtccctggcgaaccttttgctgctaagccatcaaaagatgctgagatggataggatattgaaatcgatggagcagggtattccaggagctccaagcatgaaaatgtactctagagatgatctgatgaagaacaattttggtgttgacggtgatgatgacgatgatgatgaagatgaggacgatgacttcccaaagaacttg

SEQ ID NO: 1346 - DNA, 732 bp, Oryza sativa
gttcttaacgagttcacaaaagggaagaaagaatcggtgagcaagtcagagttccagcgtgtcctctctgacatacttcttggcatggcggctggactaaagagggaccccattgtgatcttgaggattaacggtgaagatttgaatgaatttgttgagagcccaaggtacgaaccggagatggctgccatattttcgcaagttgaatcaggaaattcaaccttgcagcagtgcatgctagctgctattcgacaactgacggtcgaccacggcatgccaccggcttcagattcatggcaacctgtcactcaagaggtcttcttccaggaattcagaaagttcttggcaatcctcacgcagcgactccaagggcaccctgtgattgtagcacataccgagaacacctttgatgggaatggtatcaagaagctgctgtcaaacaagctcgaattagataagaagcagtacattcgggttgcgttcgataggatggctgactccataaatctaccaccatatggagctgttgaacaggccgaggacgggaaggcggtggatgaaacggagttcaagaaattgctcactgagatccttggggcagtgatgctgcagctagatggcaatccaatatcggtttcgaccaacagtgtactccatgagccaatgtccacttcttccaccctgctttcgccatcgccgccgtcgccaatggtgtcatcaccgagtgaatag

SEQ ID NO: 1347 - DNA, 732 bp, Oryza sativa
atgggcagcagcgctgctggtggcaccagtgccttctaccagccctacggcaccaacttacctggtgcaggggctaacagtgccatccagaactttccaggggtccgtctacgagggctcccctttgactgcgacgatcttgacatctgcaagttctttgttgggctggacatagtggactgcctcttggttcacaagaatggccgcttcaccggcgaggcttttgtcgtattcccatcagccatgcaagcagagtttgcactgcaccgcaaccggcagaacatgggcaggaggtatgttgaggtgttcagatgcaagaagcaagagtactacagtgcaatagctgctgaagtgaaccagggcggcttcttcgactcggagtaccgtcactccccacctcctccacggcccaagaaaccagctgaagacaagagcagcatggagtatactgaggtgctcaagctccgtggcctgccctactctgctaccactgaagacatcatcaagttctttgtggagtacgagctgacggacgaaaatgtgcacatcgtgtaccgtccagatggtaaggccactggagaagcctatgtggagttcccgacagcagaggttgtgaagacagccatgtgcaaggacaagatgaccattgggacaaggtacgtggagctgttcccatcaaccccagaggaggccagcagggcgaaatcgcgagtttgtgtgtgtgtgttttag

SEQ ID NO: 1348 - DNA, 731 bp, Oryza sativa
  misc_feature (131)..(131): n = any nucleotide
atgctccaccatctgcttcgttgctggtggttaggggagggcgctaccaccgctcgccgcctcccctcttgtgccgcggcctcccctcccgccggatccgatggaggggagggcaccgcctacaaccattnggagcttggcgagagggtgcaacgacgcgacgtcgacagtggccacgcccatgcggtgcctttggcggaaggaggagacagcggtggggatggaagaagttcaggtgttggctgggatccggtcgcgccggaggtggatcccccttcccccttcccctgagggcggatctggtgcggggagagctcgcggcaacggcttcggtggcaacgacgcagagctcgtggtgacggtggcgacaatggctggacgacaacgacagcgggtggctggccaacggcagcaacggctgatggctgctgtggcaacgaggtgcacccgcggcaggagcggctgtcacggcagcgacagcggctggacggtggcgataatgtggctggccgatggcagcagtggctaccgtggctgcggtgggaggaggcatggcggacttggactgctagctgggggagtggcagacggccacacctggctggcgcgacagcgattggacggtggcgacaatgtggctgggggggcgctggtgcagtggtcccacatgtcgccagaggatgagcggtggtggagcattggtgcgtcagccgtggacttgtatgtggtga

SEQ ID NO: 1349 - DNA, 728 bp, Oryza sativa
  misc_feature (328)..(328): n = any nucleotide
  misc_feature (595)..(595): n = any nucleotide
ttaagttgccggggccagaaggcaacgtttgaaccgcgggggggtgggtccggagtccggacgctgcgatctgaccctgggccggagacttctcgcgccaaacaaaccacgagctcgggctccgccaccgaaatggcgtcccacggtgagccgagccttgccctcgccaactctaccctccgaagctggagtgacaggcccgcgctaccagacccggcgaccgagtcggggatgtggccggatttatcgcgcgcgcattccgcgcgaaatggcgaggtgggactaaagagtcgccgatcgatccgctacctgaggaaggaagaaacangcacacacagggtcccgtccccgtcgtcgtcctagccctcgccaactctaccctccaaagccggagctacaggcctgcgctactaggcccggcgatcgagccggggatggagtcggatttatcgcccgcgatctgcgcacgaaatggcgaggtgggacaaaaaatggtagtccgctgggcgcgccaaacaacaaacccgatcgagctcggctccgccgccgatcaaagtggcgtcacgcgcgagccgagccttaccctcgccaactntaccctccgaagctggagtgacaggcccgcgctaccaggcccggcgaccgagccggggatggcgccggatttatcggccgcgcattccgcgtgaaatggcgaggtgggactaaagcgtcggtcgatccgctag

SEQ ID NO: 1350 - DNA, 702 bp, Oryza sativa
atggacgcatcctaccgccgcgacggccgcggaggcggcggcggcgggggcggcggcggttccgcccctcgctccgtcgaggacatcttcaaggacttccgcgcccgccgcaccgccatcctccgcgccctcacccacggagaaggagaatctgtgcctgtacgggtacgcgaacgaggcttggcagctgccggcggaggaggtgcccaccgagctgccggagccggcgctcgggatcaacttcgcccgcgacgggatgaaccgccgcgactggctcgcgctcgtcgccgtccactccgactcgtggctcgtctccgtcgccttctactacgccgcgcgcctcaaccgcaacgaccgaggaagcgtttgtttggcatgatgaatgatttgccaactgtttacgaagtcgtatctggttcaagacaatctaaggagagggacagatccggcatggacaacagcagcagaaataaaatttcatcgaaggaggaagatgaaggctacgacgaggacgatggcgaccacagtgagaccctatgcgggacttgcggtgggatatacagcgccgacgagttctggatcggctgcgacgtgtgcgagaggtggtaccacggcaagtgcgtcaagatcactccggcgaaggcggagagcataaagcagtacaagtgcccgagctgcagctccaagagacctagacagtag

SEQ ID NO: 1351 - DNA, 699 bp, Oryza sativa
  misc_feature (9)..(9): n = any nucleotide
  misc_feature (43)..(43): n = any nucleotide
  misc_feature (71)..(71): n = any nucleotide
  misc_feature (98)..(98): n = any nucleotide
  misc_feature (113)..(113): n = any nucleotide
  misc_feature (130)..(130): n = any nucleotide
  misc_feature (182)..(182): n = any nucleotide
  misc_feature (277)..(277): n = any nucleotide
aacgcggancggaagttcttcggctttggtgccccaagccgangcccttgaacgaagagcttcctgttcangggatcggccttcgccgtgcgccgcanggtcgtcatcatcantggggtcgtcttcgcantcggccgcctttcccctttcccgccggcgaagtggcccccttacccgcccangtggacggccgccttcgaggatgcgcgcgtgcgccgccgaggatgccgaggtcgacgtcaacatcgtccgcagccacggccgcggcggcgctgcntccgccgccgggctggttcctttctctccgctagtttccctcccaccggccgccgcgccgcgccccttctcccagccggacaccgtcctctccccggcgcccgtgaaccggagagaagagaaagaggagaggggagagagatgaagacagagaagatggtgaagaggagaatcagaatgacccagcgcaagagagagacgaagagaggggaggaggagagagaggaagcagaagaggaggggttaattagactgacatgtggggtccgcgtgggtcccaccattattattattattatttttattgtgtgtgaaactgacatgtgggtcccacggggtttattattttccggatcgaattgccacgtaagggccacatcagtgccacgtcagatcaaaaccgagtcaaaattagccacgtag

SEQ ID NO: 1352 - DNA, 684 bp, Oryza sativa
  misc_feature (171)..(171): n = any nucleotide
  misc_feature (186)..(186): n = any nucleotide
atgaccatgacgtcgacgacgacgaaggccatggcgatggcggcggcggtcctcgccgccgccgccgtcgcggcgacgaacgcgcagacgtgcgggaagcagaacgacggcatgatctgcccgcacaacctgtgctgcagccagttcgggtactgcggcctcggccgcgantactgcggcacgggntgccagagcggcgcctgctgctccagccagcgctgcggcagccagggcggcggcgccacctgctccaacaaccagtgctgcagccagtacggctactgcggcttcggctccgagtactgcggctccgggtgccagaacgggccgtgccgcgccgacatcaagtgcggccgcaacgccaacggcgagctctgccccaacaacatgtgctgcagccagtggggatactgcggcctcggcagcgagttctgcggcaacggatgccagagcggcgcgtgctgcccggagaagcggtgcggcaagcaggccggcggggacaagtgccccaacaacttctgctgcagtgccggcggctactgcggcctcggcggcaactactgcggctccggctgccagagcggcggctgctacaagggtggcgacggcatggcggccatcctggctaacaaccagagcgtctctttcgaagggatcatcgagtcagtggctgagcttgtgtag

SEQ ID NO: 1353 - DNA, 681 bp, Oryza sativa
cttcgtgtcttcggttgcaagtgttatccaaacctctccgccaccacaccgcacaagcttgccccccgttccaccatgtgcgttttcctaggctaccccctctaccataaaggatatcggtgttttgatcccctgtccaacagggtctgccttcacatgcatgaccctcgcgagcctcacctggcagccctcaagcggatcctccgctacatccgtggctctgtggacctgggactccacattcagcggtcctccgcctgcgacctcgccgtctactccgacgccgactgggccggctgccctgacactcgtcgctccacatctggctacgccgtcttccttggagacaacttggtgtcatggtcctccaagcgctagcacacggtctcccgctccagtgcagaggccgagtaccgcgccgttgccaatgcagtcgccgaggtcacatggctgcgccagctactccaggagctacattctccgccgtcgcgggctacactggtctactgcgacaatgtcagtgccgtctacctctcctccaacccggtgcagcatcagcgtaccaagcatgttgagatcgaccttcacttcgttcgggaacgtgtcgcggtcggcgccgtccgtgttcttcatgttcccacaacatcgcagtacgccgacatcttcaccaaggggcttcct

SEQ ID NO: 1354 - DNA, 672 bp, Oryza sativa
ttataggatctctttagtggaggtagcgagacatcggcgactacgcttcaatgggcgatgtcggagctaataaagaacccaatggttatgcaaaagacacaagccgagctacgtgacaaacttaggagaaagccaactgtgacagaggatgatttgtctggcttaaagtatgtaaagctcattattaaggagaccctaaggcttcaccctgtggtaccactgcttgtcgcaagagagtgtcgtgaatcatgtaaagtcatggggtatgatgttccaaaaggcaccactgtatttgttaacgcgtgggctatcggcagagacccaaagtactgggatgacgctgaggagtttagaccagaacggtttgaacacagtactgttgacttcaagggcatagacctcgagttcataccgtttggcgcaggacgaagaatatgtcctggtatggcattcgcagaagcaatcatggaacttctgcttgctgcgctgctctaccactttgactgggaactccctaatggaatggcagcgagcgagctggatatgacagaggagatgggcatcaccgtccggaggaagaatgaccttcacctccgcccccatcctccgtgtgttgtaaggtcaaacttccgtagttttgttgagagagagagagagaggcacttcgtgtag

SEQ ID NO: 1355 - DNA, 659 bp, Oryza sativa
ccttacaggatcttgatcctggcgcgactgatcgccatcgtagccttctaattcgcgtggcgcatacgtcacaagaaccgcgacggcgcgtggctgtggacaatgtccatggccggcgacgtctggttcggcttctcctgggtgctcaaccagctccccaaactgagccccatcaagcgcttcccggacctcgccgccctcgctgaccggcactccgacgagctccccggcgtcgacgtcttcgtcaccaccgtcgaccccgttgacgagccgatcctctacaccgtgaacaccatcctctccatcctcgccgccgactacccggtggacaggaggtcgccaagttcgccgagctgtgggtgcccttctaccggaagcactgcgtcgagccgagggcgccggagagctacttcgcgatgaagacgcaggcgtaaagaggcggcgtggccggcgagctgatgagcgatcgccgccgtgtgcgacgagagtacgaggagttcaaggtcaggatcgactcgctgtttagcaccattcgcaagcgatctgacgcgtacaacgccaagcatgccggtgaaaatgcgacatggatggctgatggcacacattgggccggcgcatggtttgaaccggctgagaaccaccggagagggcaacatcag

SEQ ID NO: 1356 - DNA, 654 bp, Oryza sativa
ggatgtgaatttgattgtcagaggtcttcagaccagatgtgctgtgagcactctgtcgctcagttctcttcagatcaacaacttaaccctgaagaaaatttagctttatactgcaagccacttgagttgtacaactttattcgacaccgagccattgaaaatcctccttatcttcaaagatgccttctttataagatacgtgcaaaacaaaaaaaaagtaggatacagataactatatcattacctggaagtaacaataaggaattgcaagcacagaatatctttcctctgtatgttctgtttgctagacctacttcaaatgttcctatagaaggacattctccaatatatcggttcagtcaggcccgtttgcttacttcctttaatgactctgggaataatgaccgtgctgaagccacatttgttattcctgatctggagactttaattgccacccaagcttatggtcttacttttatccttgttagccgcggtaccaaaaaaaataaagggcgaactggacaaaatctttgtgaaaatgactgttctgagaaacatgtggactactcttctctccgaagtaagtctgtgatcgaactgaataattggtacagtgtaataactttttgcttccttatgccatggatgatgtaa

SEQ ID NO: 1357 - DNA, 653 bp, Oryza sativa
atggcggcggcggcgcagaggctcctggcggccagcacgaagatcgtaggggtgggccgcaacttcgtcgcccacgccaaggagctcgggaaccccgtccccaaggagccggtgctgttcctgaagcccacctcgtcgttcctccacgcgggcgtggccggcgccgccatcgaggtgccggagccggtcgagtcgctgcaccacgaggtcgagcttgccgttgtcatctcccagcgcgcgcgcgacgtccccgaagcatccgccatggacttcgtaggagggttatgcacttgctttggacatgacagcaagagaacttcagtctgcggctaagggtcttccttggactttgggtaaagcacaggacaccttcactccaattagtgcagtgcctgatgatctagagctctggctaaaggttgatgatgaacttaggcagaagggatctacaagtgatatgatattcaagataccatctctaataagttatatcagttccatcatgacattaatggagggtgatgttatactgaccgggtactcctgagggtgtaggcccagtacgaccaggacagaagatcaaagctggtataaccggcctcattgatgttgagtttgatgttcagaagcgcaagcggtcattttctacttga

SEQ ID NO: 1358 - DNA, 635 bp, Oryza sativa
atggaggccacggcgaagtacaaccggggcaacccggcggtgaagcggatccttcaggaggtcaaggagatgcagtccaacccgtccccggacttcatggccatgcccctcgaggaggacatcttcgagtggcaatttgcgatcctggggccacgagacagtgagtttgagggaggaatctaccatggaaggatccagctgccatcggactatccgtttaagccaccatcattcatgctgctcacggtctccaagtggaagatttgagattcaaaagaagatttgtttgagcatatccaattaccaccctgagcactggcaaccatcatggagtggtgcgcacagctcttgtagctttgattgcattcatgccaacaccaggtggtggggcattgggttcgttggacttcaaaaaggaagatagacgggcactagctatcaaatcacgtgaaacaccaccaaagtttggctctgcagaacgccaaaaagtaattgatgaggcaatccagaagccaaagcatgacagattattgaccttggctgcatttggactcactcttgctattatggcccttgtgatcaagaagttcttcaaaatcaatggtctggccggttacattgagggcaagttttag

SEQ ID NO: 1359 - DNA, 630 bp, Oryza sativa
cctcatgtacaacagttctttgatgcaaatccaaacctagaaaaggttgtggttccacttggcgggacaatctttggtacaatgatggcttggtttgtcatgcctatcgttttaaggaggattcacaagtattcgatacagagtcctatatcagcacttttggggagctcaacaaagaatgatgtctcgtatgaaactagcctctggagtgcattggaggatcctgcgaaataccttatcacatttatggcattttcagaaatggtgcaattgttctctcttttgtctggttccttcataggtggaaaacaaacttcatcactaaagttgctgcctcaagtattgatcaaaccaggttgtcagcatttgataagatctcgtcattaggactgattgcacttggagtaatggctcttgcagaggcttgtggtgtagctgctcagtcaatactaactgttggtggtgtgggagggtgttgctactgcctttgctgctcgggatgtccttggtaacatgctcagtgggttctccttacagttttctagtccattcaaagctggagaatacataaaggtgccttcttatatatgtggtcactttttctgtatattcagggggctgtatgtataa

SEQ ID NO: 1360 - DNA, 625 bp, Oryza sativa
  misc_feature (163)..(163): n = any nucleotide
agcccaggcgacacagtaagtgtcattggagaattcactgaccatggaatatgtattattgatcatgacaaaaatcttgttatagtgcatccagaattactcatatctggaacacgggttgcttctagttttcattgtccaagaaggtctgttctcgatgacngactaaaaagcaatgaatattcaacaagtgctttgattggtactctgctgcatcaagtattccagcaggcagggctacttgaagatgttccttcaacgcaattcttagagcagcaagccaaagaagttcttttgaaaaatattgagagtttatatgcatgtggaggtaatggatattgaggagatggcctgggctccaagatatggtttgaaagggattattgatgcttctattagatcaagggtttcatgcaatggtagttcatacgacagagtaatgcctctggagttcaaaactggtaaaggaactagtggtcaggaacacactgcccaagtgatattgtacacgctattgatgacggagaggtatgatctatctatttcttccactgcaggctttccatatatatatattccttaccatgcttttccatgtcttcagatacttgaacaaggatattga

SEQ ID NO: 1361 - DNA, 617 bp, Oryza sativa
tggaggagctccctggtcgagaagctggccgggatcgagctcaacctcgagggggttaagtttcggatgagcgtcgagatcccgccctccgatgacttcagggcaatgaagaagtcttgggagaatttctacgccgacaccattcttgtccggggtgtgccatccaggtggtttgcggagacgaggatatcatcgaaagcctccacgctggtcacacacactattttctcggcacttggtaaaataagaggaaccttaatatttctagtgatgatgaatggggagcaaaacaagacggaaccaataaggagattatatctggactaaattgcaaagtgtgggtgcaatttgagaactacgacgatttcaacagtgcaatgcaggcattatgtggacgttcattagaaaaattgaaggaaggatcacggttgaaggtagactatgaagtaacttgggatcatgaaggtttcttccgcaatgcacaatacgagcctgttcgcagcaatttagaagagagaaattcatcggctcatggaaggaagaaacattacacatcgcgaattgagtcagatcatagaaagagatttagggtaggacaacatatcaaatctttctaa

SEQ ID NO: 1362 - DNA, 617 bp, Oryza sativa
atgtggcggccacgtggcagccatgcgggcaactgggttggatggcctcgatccactcggggtggatcggacggcggagggggcggcacgcggccggtgcgggcggctcaagctgacccggggccatggcgcggcagcggcgcggcaccggcagcgatcggcggacggcggcggcgattcggcagatggcgacggcgcgacaacggctatgcggcggcgctactaggggaaaagagaggaggaagaaagaaggggaaggaggggcgtcctcaccgaaggggtccgactggcgtggagggagacgacggcgaccggcgacgaggaacgacggagggaggtcgacaagcggcggacggggtccgggacggcctaaggaacaaaatgggggaaattagagacggagagagagaccataaagggcgggaacgccggccgaaggcggcggccatggcgtttcttaccggcgcacgacgggaatggggcttcggcggcgaattcggctggggaaacggcggacgaggtggtctccgggcttgcgaacccaacggcgtcgacggctaggctcggccggaggttagggatgggcccgacatttggggcccacctgtcggtgaccc

SEQ ID NO: 1363 - DNA, 614 bp, Oryza sativa
atggccgccaacttctggacgtcgtcgcactgagcaagcagctgctggaccaggaggacgtggacaaggtcccccaggcggacagcgaccggggcatcacgctggaggagttccgcctcgtcaagatccacatgtccttcatctggcgattggcacaacaggtgaaagttagacaaagagggtgatagctactgctgttacttatttcaggcgtgtatacacaagagaaagagcatgactgaatatgatcctcgtctggtagcaccaacctgtttgtatttggcatcaaaggtggaagagagcacagtgcaagcaagacttcttgtcttttacataaaaaagatgtgtggcttctgatgagaagtaccggtttgaaatcaaggatatccttgaaatggaaatgaagctcctggaggcacttgactattatttagttgtttaccacccatatcgtcctcttttacaggttattgcaggatgctggcataacagatctgacacaatttgcctggggaattgtcaatgatacttacaagatggatcttattctcatacacccaccatatatgatagcattagcctgcatccacattgcaagcgttcttaaagacaag

SEQ ID NO: 1364 - DNA, 613 bp, Oryza sativa
  misc_feature (308)..(308): n = any nucleotide
ggggagaggacggtgaggaagctgaggctgtccaaggcgctgacgataccggaggggacgacggtgtcggaggcgtgcaggaggatggcggcgaggagggtcgacgccgtgctgctcaccgacgcgcagggcctcctctccggcatcgtcactgataaggatgtagctacaagggtggttgctgaggggctgcgggtggagcaaaccatcatgtccaagatcatgacaaggaaccccacatatgccatgtctgatacgcttgccattgaagcattgcagaagatggttcaagggtaaatttagacacntcccagttgtggaaaatggtgaggttattgctatgctggacattgctaaatgcctttacgatgcaatatcaagactggaaaaggcagcagaacaagggagtgcaatagcagctgctgtagaaggggtagagcgtcaattaggaggcaacttttcaggctccttatgctttcatagaaactctaagagagaggatgttcaaaccttctttgtcaaccattgtcacggagggcacaaagtacagtagcaattgtttctccttcagacccagtgtatgtagcaacacagaaaatgcgtgaatttcgag

SEQ ID NO: 1365 - DNA, 602 bp, Oryza sativa
atatgctttttttctacttgtggacaggtttatcactctagctttgttgatgacaccgggattaccaaagcatgcggctgtcctttgcttccactaaaaactcatataaggggcccagcgccagcattcgatcaaggacaaggctgacattgttgatgaagcaattacattcttccgagcaaatgtcttcttcaaaaacttcaatgtgaaaagcccagcagacaagttactgatctatctgacattttacatcaatattgccctgaaaaggctggaaggttgccgaacactggctgttgggacaaaggcaatcattaatctgggtttggagaaagttcctgtgcctggggaaccagggtttcccttccctggtcttttcactctaccccaatctcaggaggaagcagtcagaactattgaggaattatctgaagcagataagggaggaaacaagtggaaggttgcttaactgcgcatacagagctaatggtactccaaacaaatggtggttggcttttgcaaagaggaaattcatgaacattgtcattctttgaagtataggtattttccgcgacatgtttgagcaattgagcagcttgtag

SEQ ID NO: 1366 - DNA, 595 bp, Oryza sativa
atggacgcctccgccggctcgtcggcgccgcactcgcacgggaacccggggaagcagggtggcggcggcggcggcggcggcggacgggggaaggccccggcggcggagatcagggagccgctgttcccggacgacgttggcatgatgatagaggacgccatgtccgggcaaccgagctccccagccccggcgcaaaccccggctacgagttccccgaacatggcctggccgcagcaattcgcgccgttccccgaaggaagcagaggttcacctgccggagctgaagacgagggatggtgtctccatccccatggaagacatcgggacgtctcaggtgtggaacatgcggtaccgaggttttggcccaacaacaaaagcaggatgtatcttctcgaaaacacagggtgattttgttcgttcaaacgagctgcaggagggtgatttcattgtgatctactccgatatcaagtcaggcaaatatctgatacgtggtgtgaagggcggctgcaagggcaagtccccgcacggcgtgcggcgttctcgccaggaggccgccgccgccgcctccatgagccagatggcggttagcatctga

SEQ ID NO: 1367 - DNA, 591 bp, Oryza sativa
  misc_feature (281)..(281): n = any nucleotide
atgtcggacgaccacagcggcggcggaggcgagcagcggcaatgccggcgagggttcgcggtggacgtggtggagctcggtgcggccctggctctggccgacatggccggcgccgccgtcaaaccggccatgcagctgcagctgcagccgaccgccgctcaggaggaggacgaggagatggcgaccacgaggctgagccttcagctcggcaacaacgtcggcagcatcatccagtcctcctcctgctccagcagcggctccagcgccggcttccccgcgcnaccgccgccgccgccgccggccaccgcctacggcaccaagcccctccacatgctcaccgagcaggaggagaaggaggcgaagcggctgcggcgagtgctcgccaaccgggaatccgcacgccaaaccatactccgccgtcagcaggctattagagatgaactggcaagaaaggtcgcagatctgtcaacacagaatgagagcatgaagaaggagagggagacagtgatgcaggagtacctctcactgaaggagacaaacaagcagctcaaagaacaggcacagcatcatctttcgctttccttgttctaa

SEQ ID NO: 1368 - DNA, 590 bp, Oryza sativa
atgggagacggcggcggcggcgggctcgacgtggtggtgttcccgtggcttaagccggattggatcataatcgacttcgcctaccactggctcccgcccatcgccgccgagcacaatgacttcaccgcgccgccgagctccccgacgggttcgaggagcggacgcgcgggcgcggcgtggtgtggacggggtgggtgccgcaggtggaggtgctcgcgcacgccgcggtgggcgcgttcctgacgcactgcggctggggctccaccatcgagagcctcgtgttcggccacccgctggtgatgctgccgttcgtcgtcgaccagggcctcgtcgcgcgggcgatggcggagaggggcgtcggcgtggaggtcgccagggaggacgacgacgagggctcgttcggccggcacgacgtcgccgcggcggtgcggcgcgtcatggtggaggatgaacgcaaggtgttcggcgaaaacgccaggaaaatgaaggaagcggttggggatcagcgacggcaggagcagtacttcgacgagctggtggagcgcctccacaccggaggaggggagatcaatgacgaaaaatactgttaa

SEQ ID NO: 1369 - DNA, 588 bp, Oryza sativa
atggcggcagcaaacgacggagccgacgccggcgacagcaagatccttctgatcagctcggacgggcagcacttccaggtgacggaggcggaggcgagcatgtcgaagctagtgagcaacatgatcgaggacgactgcacggagaacggcgtccctctccccaacgtcgcctccaacgtcctcgccaaggtgctcgactactgcaagaaacacgccgccgccgccgccgccgctgccgaggacgtcgccgtgaaggatcaggagctgaagagcttcgatgccagcttcatcgatgtcgacaacacgatgctgttcggcctgatcttggccgccaactacttgaacgatcttgcgtgtcaacacacggctgacttgatcaagggcaagacggtacaggagatcagggacacgttcgggatcgtcaacgacttcacaccagaggaggaggaggagatccgcaaggagaacgaatgggccttcgagaactgaaccatttccttttatcttagaagaatttccaggctagtagggaagaagtttgatcggaataaatataaaatctttttcttaatactatttaatgattga

SEQ ID NO: 1370 - DNA, 579 bp, Oryza sativa
atggccgcactggtcctcagtgtcgtcagcttcttcgtgccaaagaggtgggttcaagttcgccggagacggaatcgggaagcgcggcggtgcggagaccgaactagctgcaggcgccaccactccggccggcggtcggcagcggacagcgtcaaatgcgctctcgcgcacgccgacgtttgtgtgcgagtgcccgctcgagagcggcggcgagatagtgcggcggcgacgaggacacgcatgggaccacgctcgatccagctcaagggcctcctccgccgccgccgagccgacgccgacgccgctcgacgcggccctcagtccccgcagcgacgtgtctcgccgggaggtaccaaccaccgctcaggaagccgagcaccggcgacgcagccgatgtctgctcccgcattgcccgatgagctctggactgaccacgacttacttgagcgctgcagcaagctgctgagcagcatcgacgtttttgccgccatcttcgtcgctgccgtcgccgaagccgaagctgcctcctctgccaccgccaccaccaccgccgccgccgccgttgcaagctggggttag

SEQ ID NO: 1371 - DNA, 578 bp, Oryza sativa
atggcggcggcgcgggggcagaaggcggttgcggcgctgccgcatctggtgaaatcgctgcgcagcgagcccgtctccaacgccccgaggctccggcacctcccgtccctcagaggaccttctctctctacgatcagatcaacctcatcgatagcgtcccgaacaaagtaaagtatgaaggaagcttgttgatagtagaaaacaagataatgacatgggcacccaaatcatttgcagagataacagctgaaagagtttatcaatcttcaaagtagtgcaccctatcccagccagagattctgattcttggttgtggtagacacatccaaccaatcagtcctgagctccgcaaattcattcggtcaactgggatgaagctggaagcagttgattcgaggaatgcggcttcaacatataacattctgaatgaagaggggaggccagtcgcggctgcacttcttccttgcggagtcacttcttgaaacacgagtgttacctttgtggtggtgagcgtcttctccttccagtcgatactcgatagagttgaaatgaagcatattgtcgcatgggaacactga

SEQ ID NO: 1372 - DNA, 573 bp, Oryza sativa
atgtcgccagtcgggtggttggtcttgttgttgccggcgctgctgcggcggggcagcagcggggtggctgcggcggggaaggtgccggcggtgatcgtgttcggcgactcgtcggtggacacgggcaacaacaacttcatcccgacgatcgcgcggagcaacttctggccgtacgggcgcgactacgctgacggcctccccaccggccgcttctccaacggccgcctcgccaccgacttcatctccgaggccttcggactccctccctgcatccctgcctacctcgacaccaacctcaccatcgaccagctcgcctccggcgtctccttcgcctccgccgccaccggcctcgacaacgccaccgccggagtcctagcaggttttgaaaatgcagtgcaaggttgctgtgggacaggactcttcgaggccggttacttctgcagcttgagcacctcgttgttatgtcaaaatgccaacaaatacgtcttctttgatgcaatccatcccacggagaaaatgtacaagatcattgccgatacagtcatgaacaccacacttaatgtgttcctataa

SEQ ID NO: 1373 - DNA, 570 bp, Oryza sativa
aggggttccaagaagaaggagaagaaaaggcaagaccgagaggcccagcgtcagcaggccgaagaagcagcccgggattcgaggaggactaaacaagatcgctatgcagaaatgaggaggaagaaagacgaagagcgtgaggcacaagaggaagaagaagcaagggcgaggaaagccaaagaggaggaagctgctgccttggaatttgagaaatggaaaggagccttctcagttgatgctgaaggtacaacagagagtgacacacaagatgatggccagggtttgctccacaattttgtagagtacatcaagcagaagtgtgttcctctagaggaccttgccgcagagttcaggatgagaacacagggtgtcatggatgatcgtgggaagttcatatacatatctactgaggagatgaaggctgtcgcagattacatcaggaaacaagggagggtgagcatatcacatttggccagtaactcaaatcaatttattgatttggagccaaagccccagtacaatgaggagagcaatctcgatgagaatgccgcagcaggcaccgagctttga

SEQ ID NO: 1374 - DNA, 559 bp, Oryza sativa
gaaactgtaacacaatccgaagctacaagaaagcgctatcgttatctaagtcacttctcattgacaacaacgttccagactacgcagttctgtgaaattgacctgggtgatatgctgcctcctagctcattagctccattcatggatgaaatcaagaagcgagagaaacagaggaaacgaactgccaagaagaaagccgaagttgctgctgctgcacaggcatctgcaatgctgtttgaacatacaagcttctctcccagtagtgggccacatggcgattttatgttctctctggatgactttgaaggctcttggaaacaatgctggaccctccacgagtccaccagccagcgaaagaaagcttttctccgatgttgcacggcttggctttgcgtctgcccaagactcgcctcctctaagagttgaatctggggatttgactggcaaaagtgaaagcacggggggaacaaggtatggtgacacacgatgcacctttggacgctggcacttaccagtgtgcggcagtgcccatttttcttctagtgaaatcctggcataa

SEQ ID NO: 1375 - DNA, 552 bp, Oryza sativa
  misc_feature (62)..(62): n = any nucleotide
atgataaaaattgacccgggtcatctagtgcatgtatattgtactcgtagctatatcgagtnacgtggtgcatacatattgtactcatagctatatcaagtgacgtggtgggcacaccaagtaagaactagccgactagaatgtggcggtagatatcggccacaacgtacgacgtcacctagtggacagcgagatacactgctgttgtcggacagagagtattggaaggaagtaccaaggtcgctagcatccatgagtggcaactcctccggcggccactcgttagacacgctgctcctcctctcgaaggtgatggctggctgcatggaagcgcaagaatttttcggcaataaaacgacgcacgactggggctcattcaagtcaaaatctgcggaaaaagttgcagtttggcatgttgttgagagctgtagcgatcgacccggagaaattctgcacaaggaattaaggcctgtttattttgtgaaatgaaaatttttggtgccacgtcagacgtttgaccagatgttggaagaagttttcggacacgaatga

SEQ ID NO: 1376 - DNA, 544 bp, Oryza sativa
atggacacgggcgggtacaataatggaggtggtggtgggggtgggggtggcaatggcggcggcggcggcgaccaccaggagagcagcagcagcggctaccgcggcgggcagtcatccaggctcgcggcgcgcggccactggcgccccgccgaggacgccaagctccgcgagctcgtcgcgctctacggcccccagaactggaacctcatcgccgacaagctcgacggcagatccgcgtgcagggaagagctgcaggctgaggtggttcaaccagctggacccgaggatcagcaagaggccgttcagcgacgaggaggaggagaggctgatggcggcgcacaggttctacggcaacaagtgggcgatgatcgcgcgcctcttccccggccggaccgacaacgccgtcaagaaccactggcacgtcatcatggcgcgcaagtacagggagcagtccaccgcctaccgacgccgcaagctcaaccaggccgtccagcgcaagctcgacgccaccaccgcctccgacgtcgtcgtcgcccaccaccac

SEQ ID NO: 1377 - DNA, 543 bp, Oryza sativa
atggggagatcaccgtgttgtgagcaggacgccgacgtgaagaaagggccatggacgccggaggaagacaagcttctggtggagtacatcggcaagaacggccatggcagctggcggcgcctcccgaagctcgcccagatggtcgtccatcgcgacgaagctcaaggggaggacggacaacgagatcaagaactactggaacacgcacctccgcaagaagcttctcagccaggggatagaccccgtcacgcaccgcccgcgcaccgacctcctcgccggcctccccaacctcctggccgccgccaatctcggcggcgccgcccaccagctgcccttggacttgaacgccatcaagctccaggccgacgccgccaagttccagattctgcagggcctcctccgcgtgctcgcctccaccaccgccccgccgcccaccgccgctgtgctacctggcacagacctcatgacgtccatcctcggcgccaccctcgccgccaactccgccggcatactcggacagcagcagcagctcgccggcgttga

SEQ ID NO: 1378 - DNA, 533 bp, Oryza sativa
ttaactgaaaagtctacatttatatctccaaaattgtttggattctttcaatcttctctccctgggaccttaaagggttgtcactgggttttgctatatagttttgatttcttcattctttgttgttttggcaaatgaagtgcagcacttggaagcatggaacatcgctaagaacacttttccgtaggagtgaaaatctccagggtccatgcctattgggagacatgcggggggctgtgtttggtggcttgttaaatggtcctctcaggcctacagagaaaagaaaataccagcagggaactaatcagacatttgtattcacaacgatttatggtgaacctaggcttttcagaccaaccgggtgccaacaggtactactacttatgcttgaatgatgctttggcatttggaggaggtgggagtttcgcgttgtgcctcgatgaagatttaccagtggatcatgtcagacatttgggaactcatgcttggctcatagtccagattttgaactgaagaatgttgaggtaagatga

SEQ ID NO: 1379 - DNA, 531 bp, Oryza sativa
atgccgctgatggcgctgaaccacatctcccgcctctgcaagtccatcgacgcctccgtccgcttctacgtcaaggccctcggcttcgtcctcatccaccgccctcccgctctcgacttcaacggcgcctgcttttcaactacggagttgggatccatctcgtccagagagacgacgcgaggagagcgcccgacgtcaaccccggggacctcgaccccatggacaaccacatctccttccaagtaccagtgcgaggacatggggatgatggagaagaggctgaacgagatggggatcgagtacatgaagcggaccatcaacgaggaggagggctcgcccatcgaccagctcttcttcaaggaccccgacggcttcatgatcgagatctgcaactgcgagaacctcgagctcgtccccgctggcgccctcggccgcctcaggctgccccgagaccgccacaacccgccgctccggatggccgccgccggcaacgacgaggcgtgagaaaaacgtacatccaagtgtacgtag

SEQ ID NO: 1380 - DNA, 525 bp, Oryza sativa
gaacaatcagaaacacatgcttggtgttggtgcagcaacgccaccagaagcccgtccagccatcttcatcgcgagcggatcccatgccttgccctcagtgtcactgcaattgccagacttgtttggatacatgtcagccacggtggtggaatcggcgtcgccctttgcagccaatgccttcagacgaatgcgctcggccctcgacccgattgtctggccaataatggaggctgctatggtgaatgccatggcagtcttgggcatgttcacagatttcctcagcattccgatgaatggaacagcggcatggacagctgcaaaccactgcggggagaatttcttggtgtgctcacgccacaccccgagagggatgtttgctgccattccaagcaacgcaatggctaccatctttgcaggcaggggctggggacggagagacttcacaagttcagtccgtgcaagggctgcacgtatagcgaccacagcaggcgggcacttcagcttcacacctgctggtggttgtaa

SEQ ID NO: 1381 - DNA, 524 bp, Oryza sativa
gcggggtgggatctcatcgtgcacccgggcgtcccgctgtgccacgccggcgatgccaagttcacgctcgagtcgttcatcacgctcaatatgttcgttggcttccaccagtgggacttcggcctgagcgccctccacgaccggagctcctatgaccggcgacggttcttcgacgagttcgcggagcttaaggcggcaccagcggcagagttcctcgacgcgcggagctcgcggtggggcgcgctcgacgagttcccgtgcgacggtggttcgtcgagttcgccaagatggcgcgccacgtctggttactgcattgcctcttcctcacgttcgatggcggtgtgagcaccatcttccaggcggctgccggggggcgatatggacgccaacggtgacagtgacacagcgctgggggcggcagcggtgaccgcgctgtcgggttcaccgtcgtgctggggttcaaagttggctggatggtgatgcaatgccgtgtatacctctcacgcccggtgcgacaaccatga

SEQ ID NO: 1382 - DNA, 522 bp, Oryza sativa
ggctttgctgaacccacgtcagacaaactgctaccggatcttgatcctctaaatcagcatatcttcactctagttcttgatctgaatgaaacactcgtttactctgattggctggtatagtgaagaagcgtgaaagaggatggaggacttttaagaggccaggagttgatgcttttatagaacacatggggaaattttatgaagttgttgtgtattctgatcagatgcctatgttgtcaagacctgcaactaagtatcaagatggtaaacattatcggtaccaggatttgtcaaagttgaatagaaatcctgcacaagttatttacatcagcagccacgctcttgaatcttgcttacagccagaaaattgtgttcaaatcaaaccttggaaacttgaaactgatgacacccagctgctggatctgatcccatttctagagtgatattaggactgtgcttgcttcctatcaaggtcgtgatgttgctgcagagtttatcgagcgttcaaagggaacaccagag

SEQ ID NO: 1383 - DNA, 522 bp, Oryza sativa
  misc_feature (45)..(45): n = any nucleotide
aggggtttctctacattccatgcattggttgcagctgttgtttcnttttacctggttgtgatatctgacctcttctcgattggttactttttgacagatttggtgatgattctgtggtatttcccctctttaggtggaaaggaatataatggattggctctgtttgtcggatggctggtagttgctcgggtaatcttgttcatatatttcttcactcacatgtacttccattttgatcagcaggtgaagtccatcttccccctgggcttctacagtatactgacggtgccaccggcgctggcagtgatgaacctattttggttctggaagatattcaagggaatgttgaagaccctgtctaaaaggagacagcaaagtgaaaacggaaaggcagagtagaacttacaaggaaggtggaaggaggttttgttcacttttattgttagtgcgtctaactttcgacaaatcaaagttaaacatcctttgtacttacattacatttgggcgttttctattcattag

SEQ ID NO: 1384 - DNA, 517 bp, Oryza sativa
  misc_feature (493)..(494): n = any nucleotide
  misc_feature (496)..(496): n = any nucleotide
  misc_feature (500)..(500): n = any nucleotide
atggcatctgctccttcagctcaggaagaacccctacagccagggacgatgcaattcaggaagcagcttgctgctgccgtgaggagcatcagttggacctatgccatcttttggtccatttcaactactcgtccagggtaattaactggtcacagactctataatgagagtcctgacatggaatgacgggttctacaacggcgagataaagacaaggaagatagagaacaacctagtgacggagctcacagctgagcagctcctcctacagagaagcgagcaactgagggagctgtacaactctctcctctctgaggcctgtcactgcactatcgccggaggatctcggcaacgtagaatggtactacgttgtctgcatgacctacgccttccgccctggacaatgccaggtaaaagctttgcaagcaatggatgtgcctggctgtgcaacgctcagtctgccgatagcaaagccttcccgcgcaagctcttnncnagangtacgtacattaattaa

SEQ ID NO: 1385 - DNA, 495 bp, Oryza sativa
atggcggcagagaagaaggaggttgccgacgccgccgccggcagcggcagcgacacaatcctcctaatcagctccgacggcgagcacttcaacgtgccgtcggcggcggcgagcctgtcacagctcgtctccaacatgatcgaggacgactgcacgacgaacggggtgcctctccccaacgtcgcctccaaggtcctcgccaaggtcatcgaatactgcatcaagcacgccgccgccggggaggaggaggagaaggatctgaagagcttcgacgccgagttcatcgatgtggacaagaacatgctgtacgacctgctcctggcgtccaatttcatgaacatcaagagcttgctggatttgtgctgccagcacacggcgaacctgatcaaaggcaagtcgccggagcagatcaggaaggagtttgggatcaagaacgacttcacgccggaggaggaggaggaaatccgcaaggagaacacatgggccttcgagtag

SEQ ID NO: 1386 - DNA, 492 bp, Oryza sativa
acagtgttacagtttgggaagacaagaaagctgtctgttgaacgagctgatcccagaaacgcagtcggcagctcctacaaaaacgccagttctttcattctcacagggctcaaccaatggcattggagcaagttttctcagatcgtgatagtgaagatgaagttgatgatgacattgctgattttgaagatagaagaatgcttgatgattttgttgatgttacaaaagacgagaaacttattatgcatatgtggaattcatttgttcggaaacaaagagggtactagcggatggccatattccctgggcatgcgaagcattctcgcagtttcatggacaagaacttgtacaaaatccagctctactatgtgttggaggttttttatggtcaaactctggaaccacagtctactggatgcgcgagccatgaatgcctgcaacacaattcttgaaggctacctgaacggaagctcggatccaaagaaaaattga

SEQ ID NO: 1387 - DNA, 485 bp, Oryza sativa
  misc_feature (57)..(57): n = any nucleotide
atggccgccgccgccgccgtggtgaactacccgctcgtcgcggcgctcgtggcgttngcgctcgcgcagtcctccaaattcttcaccacctgaaagagaagcgttgggatgccaggcaacttatagcttctggggggatgccatcatcccactcagccacagtgacagcgcttgcagtggccataggaatccaagaaggctatcgtagcgccacctttgcaacttcagtaattattgcatgtgtggtgatgcatgatgcttttggagttcgcttacatgctgggaagcaggcagagttgaatcaaattgtgtacgagctaccagaagagcatccattatcagagacaaagccattgcgtgaaattcttggacacacagttcctcaggttagcttagtttgcatgattctgtcgaattttagctatttctgtggccttgtaaatactgatattcaaagcagaaagaaccgtaggaagattctctaa

SEQ ID NO: 1388 - DNA, 482 bp, Oryza sativa
tcaagacaggacctagttttactgaagctgctatgggacggcttgctcaaggaactaaagtcttagcagaaggtggctatgaaaaaatattcaggcaaacttttgaggttcttcctgaggagcagctgaaaatatcttatgcatgctatctatcaacatctgctggtcctgtcatgggagtcatgtacatttctacagctaaaattgcattctgcagcgacaatcctctctcttacaaagctggaaataaaactgaatggagttactacaaggcaagaattgttcatttccttgtggtcattcctctgcaccagctaagagcggctaatccttcagtgagcaaagtaaaccctgctgaaaagtatattcaggttgtttcagttgaaggccacgagttctggttcatgggttttctgatgtatgacaaagccgtgtgtagcctccaagaagccatgaatagtgcccgcgagatgcaaccgtag

SEQ ID NO: 1389 - DNA, 458 bp, Oryza sativa
atgggaagatcaccttgctgcgatgagagtggcctcaagaaggggccatggacaccggaggaggatgagaagctgctccactacatccagaagaatggccatggcagctggaggacactgcccaggcttgcaggtttgaacaggtgtggcaagagctgcaggctgcggtggacgaactacctgaggccggacatcaagaggggcaagttctcccaggaggaggagcagaccatcctccacctccactccatcctcggcaacaagtggtcggcgatcgcgacgcacctgccggggaggacggacaacgagatcaagaacttctggaacacgcacctcaagaagcgtctcatacagatggggttcgaccccatgacgcaccggccgcgcaccgacttcttcgccgcgctgccgcagctcatcgcgctcgccaccctccgtgaccagctcgccgcgacggc

SEQ ID NO: 1390 - DNA, 444 bp, Oryza sativa
atggcgaagtcgcggccgcccaagcggatcctcgagtcctacaccatcaagggctccgacaaagtcatcaagcattatgggagttcagtctctggggactgtgtgctaatgagggcatctgatacatcaaagccaccctatgtggcaagagttgaggctattgaggctgcagggtcacgaggcacaaatgtgagagtacgggtgcggtggtactatcggccagaggagtccatgggtggaaggcgtccatttcatggtgccaaagaggtgttcctctcggatcactatgacgtacagagtgctgacaccatagagggaaagtgcaacgttcacagcttccgtagctacacaaagcttgattctgtcaatgctgaggacttcttctgtcgctttgagtacaaatcagccacaggaagcttcgtgcccgaccgcattgctgtgtaa

SEQ ID NO: 1391 - DNA, 438 bp, Oryza sativa
atggcggaagaagatatcaacaagatgatgagctccgacggggagatatcatcaatggcagagagggcggcgagtctgttgcgggaactgcggcaactgatcgaggacggctgcgccgccgccaaacccctcgccgagatggtcgagtactgcgccaagcacgccgccggcgacgaagctgaaggcaaggaagaggaggtattagatgatggcgagtccagcgacgatgaggaggagacggacatgctcaggctggaggccagctcgatggacgtggagaacatgctcagcgtggccgcgcagcgcacggcggagctcatcaaggacaaggacaagccgccggagccagagccgtcgccggagccatcgccggagaacgaccccttccacggctttcacagtttgcattcatttactgagcactgctacacggactaa

SEQ ID NO: 1392 - DNA, 427 bp, Oryza sativa
atggggtccggatctttgctcaaggttcttgccaagaacttcgatgttcttgctggtacgcttcagttaaggcaatagaaaccaaatcccctgtggatgatcaacaatggctcacatactgggtgatgtactcattaataacactgtttgagctcacatttgcatcaattattcagtgatgaaattgatctttatttgctggcttgtcttgccatacttcaatggtgcagcctttgtgtaccaaaattatgtgagacctatgtttgtgaagcaccaaatggttaacatttggtatgtccctcagaaaaagggccttttcggtaaatccgatgacttcctcacagcacttgataaatttattgaagaaaatggacctgaagctctgaagaaactgactaacaaggtatattggtctaaatttagttaa

SEQ ID NO: 1393 - DNA, 422 bp, Oryza sativa
atgggagtgaagaaactagtcggcagtagacgtagatagcttgtgttgaagatgatgacgcctattagcggtgatggcgacgtagccagccgtgaagaagatagcatcagttggcgtcataataggccagacgtgcaggcggaaacaccagttcggcggcggacgaggcggccggcggaaacaccagtcggcggtgaacaaggtggctgggcagtgaagatgtagacgcctaacaacggtgttgtgaccaaccaaccgtataggcgaagacaccagtcggcggcgacgacggcaagccggtggtgatgttctgactgatccattcctggagcgtaagagataagcttaaagccataaatcccttttatgcatatctggatttggatcctacagaacaaacatataggatgagtagtatctga

SEQ ID NO: 1394 - DNA, 417 bp, Oryza sativa
tttgtgaacaaggatggcacagagcagacaatcagtgtccctgttggaatgtccatcttagaagctgctcatgaaaatgacatcgaacttgaagggagcatgtgaaggttcacttgcgtgttcaacctgtcatgtcatagttatgtattataataagctagaagatccaacagatgaagaaaatgatatgcttgaccttgcatttggacttacagaaactctcgtcttggctgtcaagtgatagcaaagccagaacttgatggcatgcgactggcattaccagcagctacacgaaactttgcggtggatggctttgtaccaaaaccacactaaaagactgataactgagactgagaagtgagaacacaggttcttacacagcatcatcaattttgtagcccaacacttgtaacttaa

SEQ ID NO: 1395 - DNA, 414 bp, Oryza sativa
atgcagccgcagggcggggcagcgggagcgaagcgcaaccgcggattggcggcgcgggaccgatcccggagctgtgccgcacgttggagaagcggtaccgcgacggtaccgcacattgggcgtgcggtaccgaggcgcacgcgcataactgccgtgcggcaccggggtggattgcgggaccgggcgtgcggcaccggcggattgcgggaccggccgtgcggcaccgcggtggactgcgggactggccgggggaaactcggtcccgcacgttgggtgtgcggcaccgttgcagtcccagaacagggggcggtcgcgcgcgctggttctgcggaaccggggcggtcgcgcgcgctggttctgcgaaaccgtggcggtcgcgcgcgctggttctgcgaaaccgtggctaccgtctag

SEQ ID NO: 1396 - DNA, 413 bp, Oryza sativa
atgggatcgaggcaacccgcaggaagtagcctcgtcgcgcctcctcctccggtcaccgccgccattgccgcgaaatggaatcggttgctcgccgccgccgccgccgccgcctccatagtcccacacggccaccacctgccgccgccgccgaagccccccgacccgacctccatctccgacgaagctcctcattgccatcgcgcggcccaactgccgccgcggcgagcccgcgagagcccaataagtgtcagttcgatctctcccgttcttcaccggctccgtgcaaagggacaaacaggagaagttgcagcatcaataatgaggcgtttgtacgcatccaatccacaacgatatatcttaatatctatatcccggctatgatgcatataagggagatcgagagagatcgatag

SEQ ID NO: 1397 - DNA, 405 bp, Oryza sativa
  misc_feature (72)..(72): n = any nucleotide
atgcagttcttggggcagcagaacgcggcgagggcggcgatggggttgccggcgctggtgtgggacgagcgngtggccgggtacgcgcggtggtacgcggagtcgcggcgcggcgactgcgcgctggtgcactcgtcggggccgtacggggagaacctgttctgggggagcggcacgggttggtcgccggcgcaggccgtgggcgcgtggctcgccgagcagccgcggtacaactactggagcaacagctgctacggcggcatgtgcgggcactacacccagatcatgtggcgcgccacgcgccgcgtcggctgcgccatggtcgcctgctacaacggcaggggcaccttcatcacctgcaactacgacccgcccggcaactacgtcggcatgcgcccctactga

SEQ ID NO: 1398 - DNA, 386 bp, Oryza sativa
atggccgccgccagccagtggaccaccttcttggtccccctacgacctgcgcgcgtcgatctactaccggggaacgccggatgcaggccgtcgtggctggatctaccagcgctggtgtacgacggcacgaagttttgcaatggcgtcgtgcttgggacaataggagttggtgcgattttgcgccttttgccacaaccaacctcaacatgggctagcgtgaaggttctcaaggaggtgaccaagacgaggaaggtgcctgtgctggaggtgcccttggcgttgaccaagatcaagaaggcaaatcttgagacatcctcattctttgagactcttagagggacagagttcccggtcaggacatggatgcgcatctttgtgaaggttag

SEQ ID NO: 1399 - DNA, 385 bp, Oryza sativa
gtggaagtgtgccttcagacatttggtccaggccaaaggacacccatccacaggcactcatgtgaggaagtttttgttgtgttgaaagggaaaggcacactctttctgggatcaagctcaatgaagtaccctggccagcctcaggagatccctgtctttcagaacagcacatttactatccctgtaaatgatcctcaccagcatgaggatttgcaggttattgtggtcatatcgcgcccgcctatcaaagttttttctacgatgactggaatatgcctcacacggctgcaaaactgcagttccccatcttctgggacgaggaatgcttaattgcacctaaagatgaactccattataggcatagtttctgtgttgaactttattc

SEQ ID NO: 1400 - DNA, 385 bp, Oryza sativa
ccccctagttgatattgggcttgcggggaaggaggctgatattgataattcaagttgccctcttactgctgccttggtggtgtttgctgaactggttgcacaacctgttgctggattggttgtacaacctgttgaactgggagtgtctgttgaatcggttgctgctgtattggatcgacagcaggttgaggttgcagaaacgtggcaacaacctgatattgggtcagccgattcgcaacctgcccactatgctatggctgctctctcattaacaaccgagggttcaccagctggcctggtgccatcgctgacggagcaggcaagggagtcgatgccggcgccatcggctgagctgatggtgcaatggagggaaccgcctgaatag

SEQ ID NO: 1401 - DNA, 381 bp, Oryza sativa
cacgcgaagctcggggagagggaccagcaggagtggctgagcggcgagaggttcctcactgattgcaagcggcgggagtcgccgttcctcaccagacgggagaggttccgcaacgagttcatgcgccgcgtcgtgccgtgggagaaggggaacctcacgtggcagaatttcccttactacgtcaagagtgtacggcgtcccacctgcggcacaatggtgtcacatctgagtatggttctcgtttgcaatcctctggggggaggatattgctccagagcttaccagggaactgagctttacagggagagattagtaagagctctcgcacacgagttgcaggtgccgctgctggtcctggacagcagcgttctagctccatat

SEQ ID NO: 1402 - DNA, 367 bp, Oryza sativa
  misc_feature (342)..(342): n = any nucleotide
atgtacgattttttttcatttcatatagatggatcgacaatggatgtacgctgaccggcggtccaaagagtttatcgacggcgtgcattattttttgagaggccgaagctaacaagtggaacggttttatttgttgtccatgcaataagtgtaagaaccagaaggagtattctgcatccaggactattcatttccgcttgtttgagtcggggttcatgccaagctataattattggacatcccacggtgagcaaggggttgaaatggaagaagatgaagcggaggacgagaacattcctgactgggctcaatacgctggatttgaaggaaatcaaacgggtnaggtggacagggatgctggcgataa

SEQ ID NO: 1403 - DNA, 366 bp, Oryza sativa
aagcaaatatctacaccagtgcgggtgcaaggccttgagaatgtaaaggtgattgctgtaggtgcattccataatttggctctaacagaagatggaattttgtgggcatggggtaacaatgagtatggtcaactgggcactggagatactcaaccaagatcgcaaccaatccgtgttgaaggattatctgacctttcattggttgacattgctgctggaggttggcattcaactgcattaactaaagagggagaggtgtatgcttgggggagaggagagcatgggaggcttggatttggagatgataaaagtagtcacatggttccccaaaaggttgagcttcttgctggagaggatattattcag

SEQ ID NO: 1404 - DNA, 358 bp, Oryza sativa
  misc_feature (160)..(160): n = any nucleotide
gtcaaaggccactggacagtggaagaagacagttagtggaacaatttggactgaagaagtggtctctgataggggggatgctgcctggaagagtaggaaagcaatgcagagaaagatggttcaaccatttgaggcctaacatcaagaaagatacttggancgaggaggaagacatggttctgatacagatacacaaggaagttggcaacagatgggcagagatagcaaaatgcctacctggaagaactgaaaactccatcaaaaaccactggaatgcaacaaaaagacggcaatttctgcaaaactacatcaaaagtcttgccatttctccacaagaatcacagatgaacaatgagag

SEQ ID NO: 1405 - DNA, 356 bp, Oryza sativa
cgcgtcgccgccctcctcggcggccgcgtgcgcgccagccaccgcctcctctcctcctcgagattaaaagaattacatgctaaagaaccaccttctgaaggtaagatgctgcgattaagtgttgaagctggtggatgttctggattgcaatattctttctctcttgacgtcaagaaaaactcagatgatcgaggatctttgagaaagatggtgttaaattggttgtggacgatgtctcatatgactttgtgaaaggtgccactgtggattatgaggaagaacttatacactccacgttcgtgaatccaagtgcagttgggggctgcagttgcaagagttcttttatggtcaattag

SEQ ID NO: 1406 - DNA, 351 bp, Oryza sativa
gttattaagaaccatcctagttcattaaagctttatgaacagaaactgctaggaacaggcgaagtctcaaaagaagacgttcagaagatccacgagaaagtcaacagaatcctgaatgaagagtttgcaaaaagcaaagattatgttcccaataagagggactggctttcggcttactggactggcttcaagtctcctgagcagatttcacgcgtccgcaacactgggtgtactatgagcttgatgaagaacggaagaagactgaacgcagtgatgttgcaatttgcagagttgaacaactttgtccattcccatatgatcttatccagagagagctaaaaagatatccaa

SEQ ID NO: 1407 - DNA, 348 bp, Oryza sativa
  misc_feature (92)..(92): n = any nucleotide
atgacggcgcgatttgcggaggtgggagaacggagggaggcgcctgcggggaggtcgatggaagaaggcggcggcggcgcgcataggaggangggggcttcgccggcggcggccgcgacgcgcatcggcggcgcgcggcggaatttcggaagagaggggaagatgagaagaggagtggatggctatttggcgatttttccagggtggtttctgcaaaaaggacggggacgcgagggggcgcgggggtgtgaaatggacggcggggagatggcccgcgtgggatccgcgcgatctgggccgtccgtttccacgtcggccgcctttgtgtcccgcttcggcaatttttga

SEQ ID NO: 1408 - DNA, 334 bp, Oryza sativa
  misc_feature (326)..(326): n = any nucleotide
gggtacattaaaaagtttgaggtcatcgatccccatagagttggaaaaatcaatgtagagcttcatggaaggattaaagattcaggatattagagccaaggaaatagaacaatacagagttcggatgcttccaacacggcagcagtggggctatgtcgtgatcacaactccaaatggtgtactggatcatgaggaagcaattaagcagaatgtgggcgggcaagtgcttggttattttcattgagaagtaacattgttttcctgtcttgttatgtctggccttgttctcctgtgtgttatcactgaactcttttttttttttttgnacttttga

SEQ ID NO: 1409 - DNA, 333 bp, Oryza sativa
atgggcgatgtgtgcgtcagagccggcgccagccctctctcccccttgtcctccctctccccctccgcacgccggcaatgggacctacggcggcggcgacggacttggctgcgagcgccagtcgtccctccggtcgcatgggcaccggcgccgcatcgacctttgccccacgtcgcatggagacgacgacaacagtgtggtttcggcgcgatggagctaatggccctcaacggtgacggccacgctgcggggttcgctagcgcggggagcagcaagcgacgtcgactggtgtcatttctgcatcgcgggcaaatcggaggacttggaccttag

SEQ ID NO: 1410 - DNA, 330 bp, Oryza sativa
tatcggttaagatccaaggttgagatagacaatgttagtaaggaattcctgtgttggcaaagatttggacgcaatgcaccgctagttgagtctgacaaagaagccgatgagcgccattacttgctctggcggatagagaatggagttgcagaaggctcaactgagatcccgaaagtgctccaggctcagaagtcgtggacaaggagtctggcaagaaaatcggtacagttaacactgctcttggcagccgtggtatgggcctgctgagacttgaagaagccctgaagcaaaattcaagccttgccatcaaggataatagggatgtgagag

SEQ ID NO: 1411 - DNA, 326 bp, Oryza sativa
  misc_feature (60)..(60): n = any nucleotide
  misc_feature (87)..(87): n = any nucleotide
tctccaagacgcaatcgtctgcacggcgtggtggtgggcctgaagattcgcgtaggggcncggtggccagcggacgatgacatcgangcgagcccgcggccggcgtttccaggcatgtccgcgacggggcgaggagggccgatgacggatcctcgtcggggggcggcggcgcggcgcggtgagcctgcgggcggtgcttgcacggcggatccatgtcggcgaggcgtccacgtcgacgaggcgaggaggatccgcgtcggtgcgaggcgcggcggcgaggcgaggcggatctacgtcggtgcgaggcgcggcggatgcgcgtcgac

SEQ ID NO: 1412 - DNA, 322 bp, Oryza sativa
aagaactggatggtcgacctcggccacccgctcctcaaccgcgtcgccgagagcttcgtcaaggccgccggcgtagtgaaaagcgtgagcaaagagtctctccagtggggggctcgcggccgggttgcactcggggctgacctacggcctgacggaggcgcgcgggacgcacgactggaagaacagcgtggtggcgggcgccctcaccggcgcggccgtcgcgctcacctcggaccgcgcgtcgcacgagcgggtggtgcagtgcgccatcgccggcgccgcgctgtccacggccgccaacgtgctctccggcatattgtga

SEQ ID NO: 1413 - DNA, 321 bp, Oryza sativa
gttatgacagacccagatgtgccaggaccaagtgatccatatctaagggaacacctacattgattgtaactgatatacctggaacaacggatgcctcttttgggacgggaaatcataagctatgagagcccaaagcccagcattggtatccacaggttcgtttttgtgctcttcaagcagaagcgtaggcaggctgtagttgtgccatcctctagggatcatttcaatacacgccagtttgctgaggagaacgaacttggccttcctgtcgctgctgtctacttcaatgctcagagagagactgctgccaggagacgctaa

SEQ ID NO: 1414 - DNA, 303 bp, Oryza sativa
aaaaaaatcaggaagcctaagccctggaagcacccccaaccgataacgatggtccagctcacgaagatgcgcgaggagttttgggacacagctcctcactatggtggtcggaaaggaaatctgggatgccctgcgtgttgcggcagagtctgaagtgtcccttgcacaggcaattgtggaaagtgcagccataattgtttctaatactgatctgactctctgctatgatgaaagagaggtgcgaagtatgaactgcccaagtatgtcttgagtgaaccaaccaacctgattcaagacagctga

SEQ ID NO: 1415 - DNA, 3165 bp, Oryza sativa
atggccgacgtcacgtttggcgccgtgaaattggtgctgggcctcatccaggatgaggcccggctgctcagcggcgtccgtgaggacctgcgcttcatcatgcaagagatggagagcatgaacaacgtgctccgccacctcgtggcaaacaaggggagtgccgccgctgactaccagctccgtccgtggatgaagcagatcatggaactcgccttcgactccaaaaactgcgtcgagctctacacgcagtccggtggcgggcactgtggttggcagccctggacaatggtagctcgccaccgggtcgtcacccggatccgcgagctcaagatccaggcgcgcgaaatcagcgagcggcaggcaaggtaccacattgctggtgttgctcatgcccagcagatggacgcgaccaccacaatagagcgctgggatgctagtgtgcccaaccagagtcgcgcctgggccggcagctctaacaacccatcccggcgtgccatactccacgacggctggtttggcgactacatcagcgtggatgaggctctctcgcggctcaacccgttcacgctagaccgttatgaggtagagccaccggcgcggttggacagcgatgacgagcagcagccacggcctcagttgaacagcgacggtggcaaggagcagcccctagcgccgcagtcggatggcagaaacaaggagcagctgccgcctccccaatccggaggcggcaatggcatcaagcagcagcagccactgcctccgcagtcagatggaggcgacaaggagcagccgcctccttcgctgtcggatggtggcgacaaggaccagccgcttcctcccgactgcggcgtcaagcggcagctgccgccccagtcggacggtgatgacaagcagcagccgccgccccagtcagacggcagcgatcagccgccgccgccgcagccggatggaggcgacacggagcagcagccgcctcagtcagacggcggcgacaagaagcagaagcatattagagtcgtcacaatcagtgtgcaagacggcacggatgaagctgttgctgcagaggccgtgatcgagcgtttcaagagccgctgggcacggcggggactctggtcgcagcagctctgcctccacgtttctgtccatcggcctccgattctctcggagattacaaaggtcatggttgaaaagctgaaagagaaggaggatgatgagaagaatgaggcggaagacagggagtggcttggccataaattgaaagatgaagatgtgctgcttgttctttccggttttaattacccagcgttatggaaccaggttctggatttgctgacctcgatgagctgctctgactgtgcagtagtactctgcacaaacgatagtaagatggcaaaatattgctgcagcaatgactctgccaacgatgggcctcagataatctactctctcgttgatatttacctcaacagagcgctcgccctgctttcccacagctacggatacgaggaaggacacttgaaagaaattctgcgcaacatcctcgccaagtgttgccttgatgtcttctgcatgaagatgctcctccatgccctctactacaatcctgacatgacgaaacaccaactgcagttcctgaatataagccttggtaaagaatttacagatcatgggagacaggaccgaataatggccttctgctaccaagcactgccaaatagttacaagaactgcttatggtattcaaccattttcgcccgtggaagcggcgtccgaagggcaagtttaataagacgatggattgcccaaggcttgatagcccaagtgaaccagtcaagtgcagaggacgaagccgggcactgtttcgaagccatgcacagccagaagcttattgtttcttctggtcttagtggtacacgcaaggtaaagagctgcaccgtgcatccagtagtttctggcttgatcagcagggagtcttcgacagttgaggacctattgctcaacaaccagctgccacttgacttggatctcctctactcaatccggcacggcatgcaactccatccggcaaactctaatatcaaaaagttcttgaactcactttccagcagttcaaggttgctgctgacagtacttgatttggaaggtcgcaagggcctcaaggcaggcgacctccataccgtatgcaagattcataaactcaagtatctaagtctccggaacacagatattgcccaactgcccaaggaaataggtcagctcaagctcttagagacacttgacatccgaggaacaagggtacaagtgttccacacggcgctaccaatgctaaagcacctgcttgctggttgcattattgactacccaaaggaagacatcatcaagtccaaggaatcattctccacggtttccatgcctcgtgctgttgcaactatggaaaagatggagatattgtcccgtgtcaaggtttcgaacagtgctaaagaactgaacaacattggtgacaagctcgagcacctaaagaagttgggtgtggttctatctggcaagaaagctagcttgatagatttgttccttcaggttgacaaactccacagatgtcttcggtccttatcaatccgaatggatccaccaggtaactgggattctattgatgttattttattgagacctccaaagcttctggagagcctacacatctgcagcatcagaagcgggttgcctcccaggatcaaggagctccatcagcttgccaagataactctacgtgacacctttttgaatcagggtgccctcgatatacttagcatgctcaaaggcctacgctatctcaggctttgctaccattcattcgcagaaggcgctctgagcttcgtgaagtttgtggaacttgtggatcttgtcattgaagatgatattgttaacagtgtcgccttgggtaataatacttatggtggagaccctgataaacttgaaaagatagtttggtccttcactcacatggaggagctttcaggggtcagtacgctgcagagtctgacacacatcgaactcaatgggagaacatggcacctacagaatctggaaaaactgaaaagagaagtagatgaatgtgggattactttcacgctcaatccacctgagaatggccaaggatcaaggctgtag

SEQ ID NO: 1416 - DNA, 2703 bp, Oryza sativa
atggacgatgagcctgttcttgttgatttcttgtcgatgaccctggtcaacctaaaatctagaaagcagcggtctgtggcatggtttgatgacactgggaagtgcttttatccttctctattctttgatgaggaagctgatgaagtggctaaagtaggcggtgattttgagggcgccacacagggaataatgttggataaggttgcaaattctccaccagaagtggtgaagcaagttgtccttgaatctagtcctccagttccacagaagcctgccactgcagacatattacgcaaaaagatcgcatctgtggaacgaggcagtgaaggctttctttttgcgcaggaccttttcctctctggcatgggtccatttgcaacgccaaataatatactgcacatccaccgctactctccgaatgatatcactgcacagtgtagacttcaagcttttgaaaaacaaatgatgtccaccaaggaagaacgtggtgatgcaaatgtaaggtatggatggctgggatctaggaagaatgacatagttaggatcctaattaatggttttggtaacaatggaaaacctgctgagaaggcaggcttgagtgctggtgtttatctttcaccagaagaccgagcattttccagtgttggtctttgtgatgttgacgaaaaaggagtgcaatatatgttgctctgccggttgattttggggaacatggaggctgtcatgcctggatcacaagattcttttccaagcagtgacatatatgattctggtgttgatgattgctcaaatccaaagtgctacgtcatgtggccatctcatcttagcacccatattcgtttagaatatcttgttagtttcaggctttcctcgaaagttcgaaattatttacttggtttgaagggtttatggtttcacccatcaccaaaggaagttgcggtggatatttctactcttgtacctataatgagtggaaatgctgagggaccaacttccccttggatatccttcagagttctttttgccatgattcaagaaaatatatcatcggtagcaagggaattgctcttccatcattatgaagagctgaaggaaaacaaaataactcgtgaggagatggtaaagcaaatgataatattagttggagagaagttgcttttggaaaccttgaagaggcttcattactgtccatcattatggtataaatctgctggcaaaatagcatcttctgatcctgcgaggacagctgcagaagacaggtctttggatcaaactgggaattgttcattaattgttagtgttgcgcatggtgattctcatgccccaaatgcagtagctgaaaacagcaccagtctttgcaccaaaggatgtgatactcctgcaacaggcatgatttccaagggctatgattctctggcaccaaaaggtgtgccggaaacttctacttctgtcggccccgtacatggggcttctccaagtgtggaacccaaagtgagggattctcctatacaaaccgttttatcaggaaacattgctactgattgtgccaaaaggcaagatccattggtatcaagagtggcacctgtagctcataatggccttttaaggatgccatctggaaaatcagcatctctcgcagcgcaagtttgcaattctgttagaccaagcacaggaccttcaggtcgtgcttctacagaaccaaataatgcctctaaaagttgtgggatttttgctccgggtgtagaaggtctcaattctgcaccaagagcgacacctccgggtattaggccaaagggcggtgaatctcttgttcatggtttggcattgggaaattccaaatgtgcaggagcagaaggtatcaattctgcaccaagagtgactccactgggtatcaggccaaagggcggtgaatctattgctcctagtttggcattgggaaattccaaatgtgcaggtgcagaaggtatcaattctgcaccaagagtgactcctccgggtatcaggccaaagggcggtgaatctattgctcctagtttggcactggggaattccaaatgtgcaggtgcagaaggtctcaattctgcaccaagagtgacacctcccggtatcaggccaaagggcggtgaatcttttgttcctagtttggcattgggaaattccaaatgtgcaggtgcagaaggtctcaattctgcaccaagagtgacacctaaagacaaggagtttctttcattgagtatttcatcacaacaaagcccagttcttaattcagggcatggaaatcctaaagctttggccactgaggcccgtggttctctatctctgagtattgcaccgaatgtccatgaccctccagcatcaagtaaggagcctaaggacgatgcatctccaatagcaggcatggtctcagaaagccagcactctcaagcacctaatgacagtcaccaagggtacctaaggagtcaaaaggccagcatttacagagtggagtgcacagtcaatcgtctgggccagacgatgctagcagcagcaatgtcgctcgggcagctgataccatcgtcgccctatcaactcttcgagagaagggcagtaaactttgtcatggctggtatcttcggtgtccgtatgggttgtgttgcctcggtgtccgtatgggttgtgttgcttcggtgtccatatgggttgtgttgccggttttccagttag

SEQ ID NO: 1417 - DNA, 2138 bp, Oryza sativa
  misc_feature (159)..(159): n = any nucleotide
  misc_feature (628)..(628): n = any nucleotide
atgaaggagtattggaagcggcgtgatagggagcacctcgtccttccaggctcaactatctccttcgactacaacacgtacacccctcgccagcagagcacgtgggagtcatgcctccacctatctgcggtaggagggtcgtctgactacaacaacaanaggccagccttccactggtacagtcgccttcccatgggatccattggaaactgggcaaccatgaaggaagtattcaagaagcactttgttgctatgaagaaagatttctctattgttgaactatcacaagttcgacaacggagagatgaagccatcgacgactatgtcatccgcttccagaatagcttcgtgcgtctcacaagggagatgcatcttgaagacgcaatcgagatgtatgtcggccatgctattgaagattgcatcgccttcaaagaatggctccaaagggcagtcaacgagaaaagaatcaatcttgatgcagatgccatcaacccagactaccatgccgtcaatatggtgtccgttgagcctttccctcaaaaacaaagagaagaaaacaagcaacaacttgggcgaacagcaccggcagccgacatcattattgaacccggcaccgagacaacccctnaggcaagatggattccaagcaaggaagccgcgcttgcacaacagggagtggtcaagaagagagttgcagagatagaggaggttataaaccagatcaagatggatccccttgatgccttcgacacggcgtttagaacccctaaagggaacttctactacactgtcatgctgttcgggttgaagaacgccggtgccacataccagcgtgccatgcagttcgtcctcgacgatttaatccatcattcagtggaatgttatgtcgatgacatgaaagcaattaagggccaagccttggcagaatttcttgctgtacatccagtgccagatgactccccactcatcaccaatctaacggatgaagagattttcaccgcagagcttcaggaacagtgggagctttactttgacggagcctcacgtaaggacgtcaaccccgacggcacccctcgacggagagctggggcgggattggtgttcaaaactccacaaagaggtgtgatctaccactcgttctctcttctcaaggaggagtgttctaacaacgaggcggaatatgaggctctcatctttggtcttctcttggcgctctctatggagaggaagactggcgtcaacccttcctcgattacttcaagcacggctctctacctgaagatcctgtcgagagacgccaactacagtgatgacttccctcatacatctacaaggccggtgtcctctacaagcggtcttacgggcaagaggtcttacttcggtgcgttgatcggaatgaagccaatcaagttctccaagaagtccaccatggagtatgcgatccatgacaatttcaagcaccaaccgccggctctgcttcacccgacggtcccttcttggccgttcgatgcctggggaatcgacgtcatcggcctcatcgatccaccttcttcaagggggcatcgcttcatcctcgctgcaacagactacttctccaagtgggcggaagctgtgcctctgcgtgaagtgaagagcagtgacgtcatcaacttcctcgaacgacacaacatctaccgcttcggggtaccacatcgcattacctccgacaacgccaaagcctttaagtcccagaagatctataggtttatggagaaatacaagatcaaatggaactactccaccggttattaccctcaagcaaatgggatggccgaagccttcaacaagaccctcggcaagatcttaaagaagacggagcttgatgccgtggaggaagagcgcctaggcacccttcaaaatttggagttgtatcgccaaaacatggtgagagcctatgataagctcgtcaagcaacgagtcttcaagaagggcgagctcgtactcgttctgcgacatcccatcgtcgttacacacaagacgaagggaaagttcgagccaaaatgggaggggccatacgtcattgagcaagcatatgacggaggtgcttaccagctgattgatcatcaaggatcacgaccaatgccgccaatcaacgggag

SEQ ID NO: 1418 - DNA, 2097 bp, Oryza sativa
  misc_feature (2064)..(2064): n = any nucleotide
atgagtgaccaagagtgcttggaggccaatcataggctagaggagaagatcgatctgattttgaagaagttgaatgagatagaagctaacaggagcaagttcttcgaggagatgagcgcctccatcaaggcgaccactactgtcctcacggctgcatcacatcctccactccaggcaccaccttcttcgacgcccaccacctgtttgatgaagtgctccaacgacgatcgtccttgggcgacgtcgagctcaggccacatcgacaaggagactgctccgacagttgccctagaccttggggatggcgaggacaaggttcatgacccctgcatcgtcaccaaggactcatccaaggtcacgcccaccatgtgttcgatgaaatgctccagccccgatactaagcccgatctcaccatggttgcggaggttacctacgccagcgcagccactgcctctatggagttggtaactgctcaggaaaccattggtgccatgtacagcgacacctctgaccattccaaggtgatgcacaccaagtgtttgacggttgtcctcgatgccattggtgacaccggtcaagctatggttgtgttccagacctggacagatgcatttaaggacgatccaacctccgttcagttcatggactttttctcatcaagtatgatggctaacatcaagtggaacacaccaatgcccactaagtgttcggtacagtgccttgggcatggcagcatggcattgatgcctacaaacccttttgatgttaatccatggccacctcctactctagaaaaatatagaagtcaagcagttgtgcatatgttgttatttgagacactattcaatgaggagctaaggttggagagaattgaattgaagccatggccacctccaacctacgatggagtaattagtggatgggattcacagcctatggctggtccaaaattcaaactctattgggcaagagtacgtcgtttgccaccttggccgccacctatcgaagtaagttgtcttgcattggtgtgtcatgacaatgtaatgattttcactgagctgaaggatattaatttgcattggggtgagctgaaaccatggcccccaccaagtcaaacaaacttcaaaaatattatggttcagcccgagcaatgcaagtattggaaaattagagtagaaatgagtatatttgctaggaaggagaagtggaatttacttaatcagaaaagttgcacaatggttgcaatatctagcttgaaggagcatgtcaatgggcaagaacagatctggtgtagaccttggaatcctagtgactacaaggtctcccctgacataattatgttgattacttcgtccgtactgcacccctatcatttggaccatattgttagccttacatatcctgaaggtttggacactctagttagtcataaggtggttcagtttgggagggctgatactgcatgcagtcatcaaaatagacatacaattgttaggacaacagggacatttgttaggcctgagcttggtactgggaatggtacacacatattacttgtttcagaggcagaagctggatatgtgtccataaggaatttgcttgaactgacaaggaatgctaggcagtggcataattccatggttgagtatttgtcatggtttgtggatgcatggatggcaaatagggccagcaattttgacacttctatacttgagatgaacacacatgttcagaaacattcagcttatactcaagtgcatagcagagctgagtcctttgctatgcttgtcagcaacaagattgaggacaatgattttgtattgctgcttctgaaacatctcacttccttaagattgatagctaagattgcattgatcatgccatgggatctagctgaaagcgaaggacaaatttataaagcttttgggacagtacaagggattgttaggatccgtgggctgcagcagcaacaagcttccaagatcgatcaaatcagttggcaagacggcgaacggcgacagcgtcctggttctgggcttggaaccttggcgatctccttcccnacctctcctcctacctccaaatcctttgcttag

SEQ ID NO: 1419 - DNA, 1980 bp, Oryza sativa
atgctcctcctccctggccctgtggtcccgccgtccctctcaaccctcgtcctcccccacacctcatcggcatcttcttacgccaccgtcgccgcatccacatcctcggacaacaccacagcctcgtcctcattctccgtggaagactacctcgtgaacaggtcaccttccaggcccgacgccgtgcttgcattcctcgccgaagagctcgggctctctccgcccctcatcgccatcaccgtggctcgcgaccccaagattctcacctgcagtgtcgccattctggctcgggtacctccgcggctgcgtcgactgggaggcctcaccaacgacgacatcggctggttctgcgtctcctacgcctccaagctgctcgtggcagcaccagatgtagccaaggctgtcctagtgatcgccgacgagttcggggatgcgaccattcaaggacgtcattgtcgcagcgttcctcttgaaaccggagcatctcgcctggaaggcggccttcttcagggacgagcagagctcgggtggacggaggcgcaggtgaagacggcggcagccaagataccgacggtgctgatgctgtccgtggagcggctgaggaagaactgggagttcctgaccaaggaggtcgggatggacgccgagcgcgtcgccaacttcccgtgcaagcgcggccgcacggtcggcgccgttgccccaaatggtgccgcgccctggatggagtctccctgggcgtcactggatggagatatcatccgccttgtcgccgagcacgcgctggctggcgacgtggcggattacctccggctccgcgctgtttgccgccattggcggtccagcaccgtcagcccgcgcggccgcagcgtcgtggacccgcgcttccatccgcgccgccatggcctcttccctggccaccgcaagctccacgggagggttcgcttcttcaacgtctccacgggcgccttcgcgcgtctcctcctcccgttcttcccggatcacttcgtcatcgactcggtcgatggcctcctcctcttgcagcgggatcgggacagtgctatccgtatcctccaccctttcaccggtgacattgttgagttatcatccctggagaccctacggccgcaggttgagcccttcttcaccagcactgagttggcttatatgagagccatggagcgaaaagagatgggcatattctcatatttcaatcgtatttgcgctgctcttagcttcggccctgacggagtcatcactatcatgttcgttgttaccagagtacagcgcgttgcctttgccacctctgcggatcagcaatggaccttgtcaaattggcagaccaacctctcatggaaatacatggcattccagggcaagatttatgcagcatcaatatgggtaaacttctctccaaacagaattttcgtgatagacccaccccgggtggaggcgaatggctctgcttcgtctttttccctaccagaaccaaaattgtttgctacatgtccagtagaaaagctgtttgggttcgcttatctggtgaactgtgaatcagaggtcttgctgatcggtcacactgatcgctcgtactcgcaggccgtggtttacagacttgctgacattatcttgggaaggttcatcccgttaacaagatttggggactacaccattttcatggatgaaaggagcctgtgtgtctcctcgaaggctgttcctggcattgcagatggctctctcatctacaggcaccacgggaaattccttgcacaataccatgttagaagtggcaccctgtcgacagctgctgagggtagaatcgaggaaggctacagactggctccgtacagcctcatccaccatctttttgcttgctgtcttatgacttttgctcttatatgttcatcttacgactttgattatgcgttgataaccaatttactgatcaccatgactcgcatgaaaaaaatatgtactacttag

SEQ ID NO: 1420 - DNA, 1821 bp, Oryza sativa
atggatgctaaaaagaagaggaacaagaagaagaaggggaaccaagggaagaacactggtgatgtaacgtccagcactgcagaggctgccattcggtcccacaatcatgagacagcccctaatgaccatcataatggcactgatgctgatgatgcaatgtccactgttggagaggaagctcctcagtaccagaatcatgagccagatcgacaggcaaatcatgatagcacaaacactgatgatgtcatgtcctctgttggagaggggattccatttcagaaccttgaccctgccatgacacatgaaaatcacaaagtcagtagtacagcccatgctgatcagaggagtgttgagatgtcagattccaccgtggagcttgacatgcacagactatatgaagcaaagcttatattgccaatgcaggataaattacatgatacgataaagaagttggaagatgagaagagtttgtggcatcaaaaaatgagctccatggagattgaggttgaaaagttgcataacaaagtggattatcatgcacagaatgaggtccgtttggaggaaaagctcaataatttacagaatgggtatgatgtgctgattaagaaggaggtagctttggataacaaagtcaggtccatagaggtcatcaatgatgccttaactcatcaggagacgtctcttaaagagagattaagtggactggaggagacaaataaagtactgcttgtacaggtgaaggtgctggaggaagcttcaaacaatactgttgaggaaagccagaggttggtaaaaggttttgatgaactggcatcaagattaggagtctttgaagcaaagtctgctcttactgaagcctccgtgactaaaaagggtaatgaactgattgttgatagaagtgtaaacagttctgcagcaattacttctgtggataactatagtccaatcaacagcagtcctagcaacgcctatgttagtaatcatctagaagaagctccaatgcaacttccagaaacaacaatcaatgatgtttcttccgagggcctcattgacatgaatgcacatcaaaggtcaaagcaagattttgatgaaccaagaacaagcgaagaaattctgccagttgcattagatgatatacagattcatgaggaagacccacaaccaccggtagccgatgatgaggcagaggaggttccattttctgatgctccaatcgtcggtgctccattccggttgatttcattcgttgctagttatctcgctaagattgtgaggatgtatacgatggatgcactgaattcaacagagatatggaacctctgttcagttcttggtagtgtgctcgtgtcactaccagtttttcttcctcccctgtcaatttttcaggggcagcagaagctcttgttccccagttatagtgttatacacacaagaggccttcctgaccataaagttgaccatttggatttgatgtattgcattgattggatggttgctatacaatgttgttttgtcaaattggaaccttttggtgtccccgatttaatgtttgcccctggtattgctgatctctgcggtgccgcattgttgctccatttgtttgtcctagtgttggacctatggatgtcaactgttacttggctttctcgtttgcaatttttcatagcgaagacagacaaccgcaaaaccatgaacagaaaggaactaaactgccaatcacgttgtctcctctaccttgatttttctttccccatagaaaaagactccctagtgacaatttctaatgaacgcaagttaccaacaccggagcacagcatgtaa

SEQ ID NO: 1421 - DNA, 1770 bp, Oryza sativa
atggcgtacaacgacgacgagcagactgctccgacgagcaccgccaccgagccggcgaggccgacggtggggatcacgggccaactggtgaagcaagtgcgtctcaacaagtaccacaacgacgtcgcgtccatggcaccccatgaccaggagctgctgctcgagctcaggggctcctcctcgtccaccgacagggcgggcctggacctcgtcgccgtcatcgacgtcagcggcagcatggacggggacaggatcgacaaggtgaagaccgccctgcagttcgtcatccgcaagctcagcgacctcgaccgcctctgcatcgtcaccttctgcaccaacgccacccgcctctgcccgctgcgcttcgtcacggcggccgcgcaggccgagctcaaggccctcgtcgacggcctcaaggcctacggcgacaccaacatgaagggcggcctcgagaccggcatgagcgttgtcgacggccgcagtctggccgccggccgcgccgtcagcgtcatgctcatgtccgacggctaccagaaccacggcggcgacgccagggacgtccatctcaagaacgtccccgtctacaccttcagcttcggcgcgagccacgactccaacctgctggaagcgatcgcgcgcaagagccttggcgggacgttcaactacgtcgccgacagcgccaacctcacggggcccttctcccagctccttggcggcctcctcaccatcatcgcccaggacctcgagctcaccgtcacgcggttccatggcgaggtcaccatcaagagggtggtctgggtggacgcggggacctacccgcagaccaccgccagcgacggctcctccgtcacagtcagcttcggcaccctttacagcgcagaggcgcgcagggtcatcgtctacctcgcgcttgctgacaagaccgcctcccctccgtacgacgccaatgtctgcttggcacagtacagattcaccttccaggcccagcaggtgacctccaaccccgatctcatcaccataaaacgcagaccgagtgctgcaccaggcgcggcgaggaagccacagccggtggagaacgagctggcccggcggcagcacgccgacatgatcagggcagccagggacatggccgaggccaacaagatggaggacgcgcggaacaagctggaggaggcgcggaaggcactggaggagaatttcaaccaggcggcgaacccgacggtggccatgctcctggaggagctgcggcagctgcgggggctcatggagaggcagtacctctacaacaaggagggccgcccctacgccgcctcctcgctcgcctcccacgaccgccagcgcgtcgccaccaggggccaagccgacggcgtccggctctacaccacgccgcacatggacacctacctcaagcaggccgagcagttcgagaagaaccccgacgaggcgccgccgcccgccacgaagcacgtcccggagccggatcaggtggtcgatcaagagccgccggcgccgcccgccgaggccgacgtcgtcccggacgtgccgcgagacatggcggcgggggacaggaggacgctgtcggcggcgctgcgggtggcggcggcggtgctgagcctggcggcgttcgtgctcatggctagtgtccggacgtccgggtgggacagcgaccgctacgacctctacgaacagtactacaggttattgcatgatcacttgcctgttgcgtctaaacatcatgcattcttaacatgcaacaagtctagatgctag

SEQ ID NO: 1422 - DNA, 1713 bp, Oryza sativa
atgtctgtggagtgtcatatccgactagttagaggaacagttggtcacgccttttgtcaggtttccacagttcatgtcaccaagaaagataaacgcagaagatggagcactttcaccaagaaagacaaattaattgagcacgacgagggagccggtctggcgccgtcgtcggggacggtggaggagacggcgaatttgcgaaaatccaaagttcgcaaatacaaactgcaactccaggttcttgctgaacagagtgatcctgaacagatccggcgacggggagagagggatgcgatgggcggcgatgagagagagagggaggtggccctactcgtcctcctcgtggccacaggcgacagagaggcgattgacggcggcggcgagagggagagagagagaggcgaagaaaaagagaagtggaggggcggcggcgaaaaaagagagattttgtgcgggagggagagattagggggaactcaaacagagagtcggaatccactgcggaacggattggcggccgccacgctgatgtcgcattttcgccgtctccaccgattcatcagggcagggcagatggaatcaggcggcgcaagcgagcagcagcgtaagaagagcaaggggaggaggagaaatcgcatatttttcgtggtggatgagaagaggctggatactggtggcaacggcatatacttcgtcttcaccctaaatctcaagcccatgttcgccgacgccggcgacgacgacgattgggcaacgatgagggccttacctcctccaatcgcgccgttcgattcgctggagcggtgcgccgagcgcctcgacttcgccctggtcggatccaacgtcgtcgctgtcagcacgcagaagcgcaccctcctctacgacaccgccgccgccgtggtgtcgaacggtccggagctccggcacgcgacgatcggcggcacggccctcatcctgctggggacccgactctacgccatggacaaccgcccgtgcgagcccgacccctgcttccaggtcctcctcccgcccgccacccctgtcgccgggtccggcggccggcgccggcgccattggtcgtggcgcgcgctgcccgatccaccggccgacttctccatggtccgtccggcccccgcgatgatcttctgcaacaccacggccttcgtggccgccggcgcgcgcatctgggtgtccgcgccggacaggggcacctactccttcgacaccaccgcccatgggaatgccatggcgtggcgcaaggtaggcgactgggagcttccatgggtgcggcgcgccgtgttcgtgcccgaactcaacctttgcttcgccatgtgccggacaaggtactgcctctgcgccttcgacgtcccctccgccgagccggcggcggcggcgccggtgaccaggtacgcgtgggtggaggagacgtaccctcgcgagtgcctggagcggggatatttcccgcatgggccggcgagcctggcctacctgggagatggcaggttgtgcatcggctggaccatcatcgtcgagttcggcgagcaatacggctattctaatatgcccacgcgcttcgccctcctcctcatggctgtccaagtcgtcgccgtcgccggagaagaaggacagctgcgccttgtgaagcacaaggcgcgctgctacctcatgtcaaaccgagcacaagagatcttcctcctccagccctctttgtga

SEQ ID NO: 1423 - DNA, 1638 bp, Oryza sativa
atggcagaggctgagctgggaagggcgacccacgagaagttcatccccgacctcgctgtcgtcgagtctgccaggtggatgagccaagcccagaccgtgccactgcattcccactttactttccccccctttttccgctctgtggatggcggggagggtgctgtacgaggtatgggaggcttggacaccgccatccggtggtggtccttatcggaagcaacaatggaagaggggttcacaaaagatttactgggatgggagtgcaaagagatcatcccgccagtccattccgagcaaagtgtgcaacagacgcctaataagttttctgtccttgccgagcgaggtgataaagatggaagtacacctcttcattttgctgtctcagtggaagaccgttcatttatcaacatatgttggttccccttttaccggacgatcaacgtcccaatatgtgatctgttggaggttaaacaatctgtggcgtttcaacctgatataactggatctttccccatacacattgctgcttcgatgggtgtcctgaatgccatctccattctactcgagaaatgccacgattgcggtggtttgcccgacgctaagggaaggaccttcctccatgttgctgtggagaagaagaggtgcaacgtagtcaagtttgcttgcagaaacacaaagttgtcatggatgctgaatatgcaagacagcgatgggaacactgctcttcacctagccatccaagcaggcgatcttgggattttcggctggctgatggggaaccagcaagtttgcttgaatttagccaacaaaaatgggcttactcctctagatctcgcggagagtaagattcctccgcagttcagttataaatggactgcacggaacttgatgtacgaaacactgaaatgtgccaaggccgaacacggtaacattcgccgggaccgctttgaaaaggactacacttttcaagcagatgttgagaatgaatccgagaggatgacaaagctagcgcaggctgccatcgtcgggtcggtgctcatcgccacggtcacgtttgctgcggccttcacgctacctggaggctaccgtcaggacgacagtggcacaccgacactcgccgggagctacaccttccacgcgttcgtcatcgccatggcgttcgcctacgtctactcctcgctcgcaacatttgggctcatctactcggcgatgccattcatggacatgagcgtccgtcgcatgtacttccgaggctctctgcaattgatcgcatgctcgttgagaaccttggcggtttcgtttgcgttggccgtctatacggtggttgctccggtcgatcgctggactgctctcgttgtgtgcctgactgcttctgtcgtgatgggcttcgggcatgctaacgttctgcaaacccttgctcttgcatggaagttgctcgcaagaatggggtatcggttgtcggcgatgttactggcaaggataattatgcagttggcgttggcatattggtcatatatacccatttttggtttgccggcgtatctaaagtcacgcagcatcggcggacatgacccttatagccaaatagccgcctacaaaaatgcaaatcggggtgaagttcactgtcggaccacttaa

SEQ ID NO: 1424 - DNA, 1632 bp, Oryza sativa
atggcggaggaagatggagtggagagaggggaggaggagttggccaccgacgaggtccactctggtggcggcggagaagaggggtatcaggctggtctaggtaccaggtatatgatacctaggtacccaacgtactcagatggtaccaggtatctgataccccaggtactcgatgccctataccagatctggtacctatgggattcatgccgatctaggtaccaggtacccgatgcccagtaccagatctggtacctatgggattcatgccgatctaggtaccaggccctcatgccgatgggagctatgagaaaaagggaaaagagacgaggcaagcacaaaaataagatggctatcttccttggaggtggaagaacactattccttcttgttgccatccttgattcggatcgccgctgctacatcctcgacacgcatgtgaccatgatgtacacgagagttcccatgaccaccatcaacgatgtgatgttccgcacaacgagagctaacaccgctctgggagagaggcgtagaggaggagaggcgaaggaggaggacgaccaagcaaagctccgggagagagagagctccacctcgacggcggtgaacaccacgaacagctccgggccatcacggtgttcgtcgtcggtctccaagaacctggcgatgcaggaacctgccgacgaggtccgtggcagagagaggaccatgccactgccatcactagccggtgagaggccgtgctccgggacgtactcggcgaggccgccgatcgaacggcagcgtccagtcgtcggcggcgcgccgtgtcgaagcgcgctagtcctcgccgccgtggtcatcgtaggcgtagatgagcccatggaagcaaccaccggcgaccggcgaatccgaggcgttgaggcagattgtttatctggcatcctggccccgcctgccatagactcatcggtctctggccccacctgtcatagactcatccgcttctctctgctcgttagttgccttcgtcctcctgccgcctcgggtgttcttccttcctccatcgccatggcggcggcggcggcttcccaccgcgtgttcgtctacgggacgctaatggcggaggaggtggtgcgcgtcctcatcggccgctcgccgtcctcctccccggccgtcctcccaaaccagtccgtccacgagacatctgtttcttcttcttcttcttgccaagaatcccctcctctctgctgcgaaattctgatcggccaccgtctcctgcagccagaggttcagcatcaaggggcgcgtttacccggcgattcttcccgtcgacggcaaggaggtctcagggaaggtaagcccctcttgcttcctctctcggttttcaagggcatcactgacagggagctcaatgtgctggatatatttgaagatgaggagtatgtcaagagaaccgttgagatatcactaactgacacatcggagaaattgcttgcttatgcatacatttggggcaatcaggatgatcctgacctctatggtgaatgggactttgaggaatggaaaagggtgcacttggaggattatgtcaagatgacacaagagttcatggaggaactggaacagctcgaaccaaagaccgagacctga

SEQ ID NO: 1425 - DNA, 1614 bp, Oryza sativa
  misc_feature (836)..(836): n = any nucleotide
atggcgttcgacggcgcactcaacagccaaggagcaggggcaggattcatcttgacatcaccttttggagatcaattcaatcatgcaattcacctcaacttcagggcgaccaataacacagccgagtacgaaggactactcgccgggataagagctgcagccacactcagagtaaggcgactgatcgtgaaaggggattccgaactagtcacgaaccaggtgcataaagattacaagtgctctagccccgagttagccaagtatctcgcagaagtcaggaagctggagaaaaggttcgatgggatcgaggtccgacatgtatactgcaaagacaacatcgaaccagacgatctagcacggcgtgcgtccagacgagagccactcgaacctggcacctttctggacgtcctgactaggccatcaggaaaagaggcaagcggcgaagatagcccgcacgccgttgccgatatcgagaccacggacgactggcgcaccccactcattaaattcataggcagcgaagagttgcccgaggacgacgcagaagccaagaaaatatctcgtaaagcaaaagtctactgtatgatcggcaacgatctatacaagaaggcaccaaacggggtactcctaaaatgcgtctcgtccgacgacgccagacacctcctcctcgatatacatgaagggatctgtgggtcacatgccgccggtcggacattagtcggaaaagctttccgacgggtttttctggccaaccaccctcaaagacgcctgcgacatggttcagcgatatactcgggccattcccacgaggaccagggcggctacgaggttcctanttgtagccgatcgacaaattcacccaagtggattgaagcgacacccatgggggaaatcatggccgacaatgccatcaaattcatcaaagggatattctgcagattcggattgccccaccgtatcataatagacaacggctcccatgtcatcagtgccgatttccaggattactgcatcaggctgggagtcaagatctacttcacctcggtttctcaccctcagagaaatggacaagtcgacagggcaaacggcatagtactacaagtaatcaagacccgcgtctacgacaggctcatgtcacatgacaagaagtgggtcgaggaacttccatcagtactatgggccgtgcgtaccacactgacaacgtccaacaaggagacacccttcttcctcgtgtacggctcagaggcgatgctccccaccaagctacgacatcaaagtacacgagtacagaagtattccgatgaggatcaagaggagcagcgatacgatgatccagctaccaacatgcccttcgccgttaccacgagaagcgcatccgagcacgcacactttcgatcggcgactacgtcctccgacgggttcaaagccaagcagggcgaaacaagctctcacccaaatgggaaggaccgtacacgatcacacaagttctgcggccaggcgcattcaaaattgcagacggcgatggtcgcgagttggcaaattcttggaacattgatcaattacgtcaagaccacaatcaaagtgttccttcccgatgatcccttacccagatga

SEQ ID NO: 1426 - DNA, 1542 bp, Oryza sativa
atggcaacagctcgacacaagcgccacctcactcctcccttctcttaccgacacctccctctccccaccgcctcaaactccaaccgccgccgccaccgcctatcggctcttcaagacgatgaagccttcccactccccggctctgtcaccgtcccgctcctcatcgttgatgtggcacgagcacggctttctttgacaatgcctctcactccttggagacacatttttcgcagggatgcaccagttgcctatatggaggggaatcttctagatgcgatccacgccgcgcccccgccgccggagccgacgacgagtcggctgacgccgccgccattccctgcttccgattctgccccgcgcgccgccggttcgatgggctcccgcaggttcgccgcggttgtcgtcgtgctcctcctggctttggccctgattcccggccccgcggcggcggcgggtggatcacataaagaatcggcgaaatcgtcaaatggccagaatcctgtgaccaaggagacgcaccaccaaacgccaccgccggcaaagccgccgaaggatcaaacaccaccgccgccaccagctgtgtcggagagcaaggggcagaagggggatgccggtaataactctgggcacccggtgccaccgacggatgcgcataagacgagtcccccgcctgaaggtcccgggccaactggtgggaaggagcaggaaggaggagcgggtggggagaagaagaatccgacagaagaaattaagaaggtgttgagttgtgaggatgcagcggagaaatgttctgttccaggagaaattaccgcttgccttcaggtttttaaggatggttcaattaggccatttgttgtagtccagaatgaagggcagaatgatgttaaggtcgatgttgttattgatggtaaaatgctgccattacagctggccaagggcttctccagacaggtaaacataacctatagcaatccaaatggtgtagaaattacagtaaaatctgggaaggggcagtgttccttacacaccaagcaaacagtttttgattggcaacaacagtttcagcagtttgcagcttatgcaacacgcgcgaatccaatctacggagcctccttccttgttttcactgttgtcttggtgggagtggtctgtgcttgttgcaagtttgcaagaaggcgtgctagtggagtcccatatcagcaacttgagatgggagaccaagcccccaactcatcaggcgtggaaaacactacaagcactgtggatggttgggaagatggctgggatgatgactgggatgatgaagaagcggcagcaaaaccttcagataagaaaccatctggaatgcttcaccggcacaagtttgatcttatcgccggagacgatttcaaatcagaagttgttctgaaactgaacagaaacactgtatgttcggacaaaacaatgcggggctctgtttgcccatttgccaagcagagcatgcatgccactgtgaaagattccgttcttcattgctctcatacggttagcagtgtgaaataa

SEQ ID NO: 1427 - DNA, 1383 bp, Oryza sativa
atggcgacaacgggcggcggcctccccttcaccagatctggagggaggggaggccgggcgacgaccgtggcagcggcgcatgaggcagcagcggcggcaaggccgcggcaggcgggtagcagcggtggtggcgctgcacatgaaacggagaatgttccagctgtgtccccggcagcaccaaccaaaaaacttgacgagattcttgtgcttagcttcgctgatagtgctgacttcggcgaagaagtctttatgctcttggctggactccctcactattttcttcacagcaacttcacgctccaaccgcttcaggaatccgctgtacactaccccaaaggccccctctccgagcttgcgatcatcagagaaattgccagtcgcgatggccaaatcgtcgtattcgaatcgcctggcgccgcctgtgccctttccaaaggaggtggggcccatgttttcaccagctcgccagagaagtcacttccgcgccgaagaagctcgctagagagggagaggagtaggggcgctgaatccgagccagatccgcgccgagcttgccatcctatctggcggcgacgagaggagctagcccgcggaggtggtgaagcgacggcgccctcgccagccgacgccgagctcctccgccgcccgcttccgagtgccgacctcgctgttgtttcggggagagggtggaagagggagaggagtgtggtgcaccggcaagctccaagccctgccacccctcccatcggcggtggaggagctcggcccggctcggcactatgtggtggggaaaagtacaaatgcatgtggcgcactatgaacgcccttacagtgatgcactcgcgtggtgccaacgctcatgtcacccgctctcgcatactcgctgtcctctccactgccaactgctttcccctctcctcttttcgtcacttgcctcttgaggaagggcctggtgccgctgcttatactccctgctatctcacaattgatggttcgctctcggtgtcacgtcgccaccacgaagctcttgattccaaacgagcactcagcccaactcgccccaaacctgacccgttgccaaccctaataaggccttatatatttgcacaactcttgctcaactatctcctagtcctcctgccccataccccacggcgtgcagtccgtgtgaaactgggactccgatatggtgctctgcggctgacgtaccacatcttggggtgccgtggtatccaaccagatattcgtccacccttctctgacctgcgaggacgccacataatccttactgggtcagcaaggggttctcacaagatgatgcttgggtgtgggatccgacacctttccgagcttaaccatacggcgtgctctgggaagaggtga

SEQ ID NO: 1428 - DNA, 1362 bp, Oryza sativa
atggacgtgaagacgaggagcaggaataggaagaggaagaggactgtagtaccacctgcagcagctacttttcctgatctgctgccggaggagattgtggtggagattctggctcggctgcccgtcaaatccctgctacgcttcaagtccgtctgcagagggtggcgtgcaatcatctccgagccatccttcatccgaacgcaactccagtgctcggcttctaaacaggagccatccatcctcatcagcccccacaccctccttgggcgttgcgatattcaacccccagttggaggactaggtgattggcccaacaacttctccacccaaatcagcttctaccaatggcagcgaggtgcctccattgccaggttcatggatgccacggccttccctgccaacgagttccacctcgtctgccacttcgcccactgcgatggcctagtgctcgcccccacagacaccaacctctacctcttcaacccggccacgagggacaccatcactctccctgacggccatggtgataaccaccaccatggcacggaaatggaagcttgctacgctgcagggctaggcctagatcctgtcacacgcaagtacaaggtggttcgagcattctaccgttcaatggaccccatccgcatggggatggaggtgttcaccgtcggtgaaacgggcgcaggctgtggctggagggagaccgtcactgatcctccctaccctgtcagtagatggctcactgccttcactgtcaatggtggctacttgttctggtacatggatcggtttcgctaccctaatgacactctccatggtggcctcctttggtttagcctgcaagaccaagcgttccgcgtcactcttcttcctcattcactggaccctgccctagatgacaaggtcaggccggacgtgctacacggcgaattgtgcgtccttcatgccaacagtgacaccatgcctgtgacgatttggacgacaaattcgccgtcttttgatgattgggagcggcgatactgcatctatgtctcgagactttgccatccaatgggccttcttggtgatggcgggatgttgctgtgggcaaaacacaccatccaccgctacgacctgtggagcgatgagctgacggccgtgtgcgagctgggtggcatcagtgagagtctggtcagaattactgcgcgctgcttaaggcttttacgccatgagaagcaacttgtatttgatgtatatcaacctattaattttatcactaaaaatagtgcaaatgatcgaagagatctggtactgagtactgactattgctacttgtttgtgtgtgagagaagcaaagaacagattgcagatgcagagagctga

SEQ ID NO: 1429 - DNA, 1266 bp, Oryza sativa
atggccgacgcaaacatggcgtgggcggagctccccgaagagtgcgtcgccggcatcctccaccacctcctttgcctccctgaccactccatgttctccggtgtctgcacaaggtggcgcaccatcgccatgcggcatctgccgcctatgcaaccgtggttgttcatgccgtccaccaacgcgacctccttcttctgcgtcgcctgcgagcgcacccaccaggggccctgcctgccggacaacgcccgcggcgcgcgcttctgcggcgcccaccttgaaggttgggtcgccgccgccgagattccgcatgatgaccgctctgtcccggggaatcgtgcccccgctctgctcaacctctgcaccggcgagtgcgtcctcctcccgagatccctccgcaacaacaaccctgataccaccttcatcaaccacatccaagccgtcatcctctcctataccccatgtcaggctcacccgtactacgccgccgccatagtttccggcaagcccaacatcatgttctggcgtcccggcatgagcgattgggtgccgcagatgctcaagtgggactcggggttcaaaatgtggcagaagcagctatccaaggacccaatcgaggacgccaactacatcttcttcggcccgctcggcgggggattctatgtcctcaacaacaaggaggacctcctggtgtacgcccccaaggccaacgacaggcacggcgagctcacgatgtcatccgtgaacaagtaccagctccgcagaaatccccgacccaccatgccggagccaggggaggtgctcgcccgctacctcgtggaatcccgcgggcatctgctcatggtcgtcaggttcgtctccacggagaaggccacggtggcgttcgacgtcttcaagctggagctgaagccgccgtcctggaagaaactcaccttggacaccctcgcagaccagacgatcttcctcgggcgaggctgctccttcgccgtcgagatgaggaaatccagccagtgccctcccaacatctacttcctggatgactccgtgagtttcagcggcgcagggagctcgacctcgcaggcgcagcaggtccaggggccgttcccctgcggcgacacgggcagatgctgcgagcagggcatcgtccgctgcccgccgcgagagccgccatcagactcctcgccgtggacttggttctatctgcccccatacgtcgcctttcttgaatggtttaagacgcaagcaatcaaacaactggaacagttctga

SEQ ID NO: 1430 - DNA, 1251 bp, Oryza sativa
atggaccgcaatgagcagacataccatgagaattcttctgcttctgaggatgaggacgatgatgaggaagaggctgtagagtggagcaaagatgagcttgatgccatctcggcactctttgaccggccgatgcgccagaagccaccaaagccgccaaacccggtgaggcagcgacctctcccgctgccactgcctcacaagacacgactgcccaatgctcctgcaccaaagcagcatatcaggctggcagcaagggctgcactttcttcacgctcttcattcagtgaccaggtgtgcaagaacccggaggtcctcattgggattgcccgggagattgcagcgctgccaccggagtctgacgtgtccattgtgctcgatcggtgggttcggttcctccggaaaggatccttgtcaatgaccattcgggagcttgggcacatggggctcccagagagggcattgcagacactttgctgggctcagaggcagactgtcgtgccactcttccccgacgaccggattctcgcttcgacaattgaggtcttggcacgcttcgaccagctgaagatggaggatgcgctagagcagtgcgtcccttcagcgagccgtgctgttcttgaagccatggtcagtgggttcatcagggcaggtaaagtaggccttgcccgaaaactcctcgagttcgccacgatcaacaagaggacactgagcccgagcgtccacgtgaagctgatgctggaggccgtccgtacgcctgagggctacgggctcgccgcggcgctgctggacgagctcggcgagaggccggagctgcacgttcggcagcaggactgcacggccgtgatgaaggtgtgcgtgaagctccggcggtacgccgccgtggagagcctgttcggctggttcagggacaccggcgggaggcccacggtggtgatgtacacggcggtgatccacagccggtgccgcgacgggcggcaccgggaggcgctgtccctggcgtgggagatggagcggcacgccggcggcctcctcgacctgccggcgtaccgggtgctggtgaagctgtgcgtggcgttgcgcgaccacgagaggggcgtccggtacttggcgaggatgaaggacgccgggttcgtcccgaccggcgacatgctacgcggcggaggggaggatgggcaggtgccggaggctgatcagggaggcggagttggccggcgtgaagctggagaggaggctgctttcgcgcttgtctga

SEQ ID NO: 1431 - DNA, 1218 bp, Oryza sativa
atggcaggcaattcatgcgcggaaacattccctgctctctctgacgaccacctcatctccgccctcacctactccaccgccgaccaccacgacctcgtcgacgctgctcctgcggttgcctcccaacccaacgaggacgtctgggatggcccctgcaccgccaccggcgccgcctgcgagccctgctccctcacgctccacttcctccgcaacacctgcggcctctcggaggatgaggcggccgcggccgccgcgcgcgtccgcctgcgctccaccaagaaggcgcacgccatcgtcgccctcttccgcggcatcggcttctcggccgccgacatcgcccgcctcgtcacctcgaacccgtccttgctctcttaccgggccgacgccaccctcatgcccaagatcgagttcttccgccgcgagctcggcctcaccgacgccgagatccgccgcctcgtcctcgccaacccctaccgcgtcctccgttacagcctcaagcgctgcatccgccccaactacctcatcctcagagacctcctcggcagcgacaagaacgtgaccgctgccgtcttgcagtccacggatctcatccacggggacgttcgtggcatcctcctccccaagatcaagatcctccaggactacggcgccacgaacgatgtcatcgtcaagctggtcaccacgcaccccagggcactcatgcatagggcctcccgcttcgaggagagcttggctgccatgaaggagctcggggtcagaccttcctctggaatgttcccctattccttcgggctctttgccagattgcatccaaggaaatggaagggcaggatggacaatttcttgagcttgggatggacaaaggagcaagtgattgaggcgtttgtgaggcacccgtactgcatgtccgtgtcgaatgacaaggtgaagctcatctggcagtttctcgcgaagaagctcaggtggaccaccgattatgtcgcaaggagcccgatggttctctccttcagctacgataagcgaatcttgccaaggtgcacggtgctgaacttgttggcatcgaggggcatattcaacagggacatcaagacatcccatctggtactgggggagaagaagtttaaggagaagtatgtcaccccttaccaggatgaaattcctgaggtactggaagcttattcttctgtggcagaaagtcgagtccccgtgtataagtag

SEQ ID NO: 1432 - DNA, 1215 bp, Oryza sativa
  misc_feature (29)..(29): n = any nucleotide
  misc_feature (35)..(35): n = any nucleotide
  misc_feature (214)..(214): n = any nucleotide
atggcgccgcccgggacgagcaggagganggggcngcgtggtcgtcgggcggcgggccggtgcgcggggctgcccctcgacgcgctgttcgagatcatgctgcggctgccggcgagggacgtctgccgcctccgcgccgtctgccggtcgtggcgcgccgtggcctccgaccgggccttcgtcgacgcgcacgcctcccgccacccgggcccgnacgtcgccgcgtgcttctccgatgaagccgacggcggcgacggcgacgagtcctgcggcggcgtcgacatcgtcgacctgtcctccggcgacatcgtcaagactatttacaccgaagtcagtggatccagagtgcagcgcacgcgcctcgacctcgtctgcctcgttgaagggcctagccccttggatgtcaccgtgctggatccggtcaccggtgctacctacatcccggcaaagagtatctctgcggataataaggatttgctgagttcaggccgtctcataatggaatcctgtgcttttgggaaggtcccctctacaggagagtacaaggtggtccgtctccttggttctggtaatccatgtgagctatacgagtgcgagatcatgaccgtgaacagtgctggcgctttgcaatggagggcgatacaaggacctcagttgcctgtttgttcaagtaacaatatgagaagtgtggtcatcaatggggttgcgtatttcctgttagattattcgaggctctattgctcaaatgatggcttgcttattcgaccaggtaacatagttccatttgaccttgagacggaggaatggatgggtattctaaacggaccgaaaccagtcgccaggggacgggatatgattgttatctcctcaaccttggaaattatggagcccctctcgctagccgacttgaatgggtccttagtgatggtgcatgctgtatacggttcccccatggacctgtggtttctgtcagatcttgagcaaggactctgggttaagaagtacagcatagatttcgaatactataataacaatgcttatcctttgctgctgttagacgatgagaagattgtcttcctactgcggggaactaatgttctacaaagttatgatctaaaggatgacacatacactgatatattggtggtgccagatttcagatccgttggcatttatactggagatctattgagcttggagggtggtctgaactga

SEQ ID NO: 1433 - DNA, 1173 bp, Oryza sativa
atggctactgcatcggtggttacctatcttcagaggccgagagagcttccggtgccggagttccgggcaccgccgccgtctccggtcaccggcgtcctcacgagcagtagctccggctctcttgcatacggcgagtgccccgatagcaacgaagacgacgagatcggcaggttcttgcgccgctccgccagagtcccggtgctgcggctgccggagagggccgtcccgcggaagaagaaagcggcgtgggcacctccggtcatcgacgtgcgcctgctggccttgccggaggccggcggtccggtggcggaggcgctgaggtcggcagccgtcgcgtttggctgcttccaggtggtcggccatggggtcgaccggagcttggtctcagcagcgttgcgtcatgtggcagctgcaactgcaagggcagcgacgccggagccggaggaggtggaggtcaacggagacgatgagaacggtgaggagatgtggtggtcgcctggtgacggaggccaagaaatggcgggaaattgggcgctccaaagtggcgccagccacttcaggaacacagcagacgctttgttcattcagctggagcaaaccgcaaccaaaataatggacgtcctgcagcgaggcggcgccgttgccacgcaatccatcgccggagctgacacaaacggctcgctcctctgcatccgcaagcaccgccgcaggcaagacgaccgcagcggcggcgcctctggcccgatccgccacgacgacatcctgaggatgctggtccggagctcgcggtgctcgcgggccctcgccctccacctctgccccggcgcctcggcgttccacatcttctcccggcgaggctggtccagattcaggcccatggacggcgccgtcgtcgtcaccgtcggcgaccagctccaggcatgcaacggtgggctctacaagagcgtggccgggaagccagcgtacagcaatgacgacctccgaggaaacggcggcgacaccggtgtcgcctccgcggagttgttctactgcttcccttcggccggcacggcggctggcaaggcgagcgaggtgttgagcgcggatgccggcaagatcatcccgttgaacctgcagttcatgtctaatgtagaaattttaaacaacctggcatcccaggttccactagcctag

SEQ ID NO: 1434 - DNA, 1163 bp, Oryza sativa
ttctcctttttgcccgcacaagcagcagtgcagcagcagcatacgcagtcacaaacaccggttattattggtcgatgcgtgtttcctgcttcctttcctagccaatcagccaccttctcccaaaccagtacaggcgctatccggttgaccaaaccagcctaccaacccgtcaagtcatcgacacagggatcagatcgatcaggagggcctctcatctttgccaattccatctttcttctcatcccgtctctctcctcctctgtttccatcatcatcatcatccagaggccaccaaccctcctcgattattcagagcagccaattagtcttggcgtcttgacgtgttcggagaatttcctctcatttatatgcaggttgcttcggctcggggtgggttgggttgggttgggttcgatggagaagtggagcagggggctctcctgccgggccgccatctgcggcatcgtcgtcctgctctgcgccaccgcgttctcctgctccctcgccgccgaattccgcaaagtcaaggagaaggacatgaagctggacggtagcctctgctccctgcccaagagctccgccttcgaattgggcgtcgcggccatcgcgttcctctccgtggcgcagctggtgggcaccacggcggcggcgaccaccatgtgcgccgcgtccaagcgcagcaagtcgtccaccaccaggcgccgcgcggcgtccgtcgccatcctcgtcctctcatgggtgagcttcgcgctggccgtcgtcctgctggcgaccgcggcgagcatgaaccacgggcagcggtacggccggggctggatggacggcgactgctacgtcgccaggaacggcgtgttcggcggggccgccgcgctggtcgtcgtcacggcgctcctcatcctcggcctcacctccaccaccaaatcatcctcatgcgccacctcggcagcatccgccacaacgacaatccgtctcgacgcggcggccacggacgccgagcaggcgagcgggcgatcgaagcagcgggtggacggtgctccgcgctgttcgtcccgcaaaggccaagcggcgtgggggcaatctccgcttgctggcaaaggccaacggctggtgatgggtgggggcgggtataccggtgggttagaagatattttagctggacaaag

SEQ ID NO: 1435 - DNA, 1131 bp, Oryza sativa
  misc_feature (451)..(451): n = any nucleotide
  misc_feature (477)..(477): n = any nucleotide
atggcggcgcagaggaggaggaggaggagagcccccgaggagagtagggttttgcggattggtggtggtggggaaagcgaggagcagcgagcagaggacgatgaggagggcagcggcagcaggatcgctactgtttctttcccccttcgcttgctgtttgcagctttatttgagggagaaactttcccggaaatacccctgcactttcggcaaatcttcatcaactactcctcctctctacgaaatacgtcttcggagaacaaattacgccttcagtgctcgcgcgacaagtccgaccaccgcggcgatggatttctccggcggcggaggcggcggcggcggcgcaacgctgtcggagatgtaccagagcgcgcggcggctgctgctctcggcccgggacggcttggcccgcttcgagcgcctcgcgtcggcgcccacctcgtcttcctantcctcggcgccgctcgtcgggggcgncggcggttcccggggattcggcaagccgccgaggaggtgcggcggaaggtggcccagatccaggggctgtgcgcgcagatggaccggctctggcgatccatccccgccaagggccagcgtgatctctggaagagaaaagtggagcagttgtctgaagaggttgattcgctaaaggaaacccttgacagacattctctgcggcaaaaaaagagggttctagaagcaaaagaaagggcagagctatttgagagagctaatggtgagtcttcacatgtccttcggatatttgatgatgaagcccaggcaatgcaatcagctcgtagctcctctcgtatgcttgatgaagcatatgaaacaggagtagctatccttcacaagtatgctgaccagagggatcgtctaaagcttattgagaggcggcaccgtgtggacaagtggattgcatatgctggtatgatgatcacagtggtgcgttacaagggctttctctgggggggcataaaagctgcttttctttttcaacgcgggtttccggcatgccagtatatatgccactatgtctatgtggatcaaattcttttctgtatgcacatcacaatatatatactgcacatgtacagaaaaactgatagggttactgtctgcggattctag

SEQ ID NO: 1436 - DNA, 1119 bp, Oryza sativa
atggcggcccgagcgggctcccggccgtggtgggaggcgttcacgacgaacgtgaagaaccaggggtcgctggtcatcgacatgctcaagcagcttgttcatcgggaggaatcggagtcgcgagacgaggagaagctcaaggaggtgatcctcgagatgaaggagcagagcaacaagagattcgcgggatggtttcgctcagagctggccaaggagtgctggagggagcacctccatggcgcttctatcccgttcgagaccttccatgtcgagcccccggccgctgacttctcctcgtcgtcgtcctcctccgccgccgccgatcaccgtggcggatcggtccttccgggcgaccttgaggttatgcatgcggagagcaccgccaggctcgaggcctgggggttcgaagtcctcgagaagatgaggagggagcagctggtcgagtcggtttctgggttccaggattacttcgacaccgcgccctccaccggcacgaacgacgacgcctcctccgtcgaccactgcgtcggcccgatcctcatggcgctccagagcaacctcaggtccgcccgcttcgcggcgtgggcaaactcggcatgggctctcgcggcggcggcagcggcggtcgacgacgacgacgaggggagttggatggagccccgcatcgagccggtgctggcttgcgagccccccgactacttcgactccgacccagctccccccacgccgcctccttcctcgacgccgaccaccgccaggccgcctcgtcctcttcctcccgcgttgccgccgccaccctacgcctccacctccttccccgacgcccatcagcgcgaccccgccgccaccatcgccgccgaccacagcgaggccaccgcctcctcctcccgcatcgcctccgcctccgcctccgcctccgcctgccacagcgaccccgccgccaccatcgccgccgaccacagcgagccaccgcctcctcctcccgcatcgcctccgcctccgcctgccacagcgaccccgcctccgcctccctcgaccagcactacgtccatcgacatcgagacgtgggtttccattggggtcctcgctgtggtactgatcgttttgattcgcacctga

SEQ ID NO: 1437 - DNA, 1113 bp, Oryza sativa
atgcagtgggttggcggacaagggtggacggtgaggccgcggcggcgctgccggagccgcggggtcggcagtgggcggtggccggtgttggtggcgggcacaaagcatggtgaaggggagggggaggaagtcagccaagcggggccacgccagcacattgacgcctattggaaggcggggcaacgacatgggacggcgctagggctgccgcccacagtggcgcgcgccgccagagggtggtgcggtcggcgcgagctagccggcctccccgctcccctcgtgtgggccgccggcggggcgaggcaggaaacgagcggcaaggtggcatcgcgacgcggcggcgatgggccagttcaagtattcaaccatgaagaatatatgctcaaattagaaggtatcgcatttgttcttacatggcttggggatgtgctcctcgaggtcgtcgtggacggggcactcgacggtgactggcgactgcagcgtgacgatggtcagggagtccttggcctccacacccgacatgccgcgcatgtcccgaccttgcgggctgccacggtggcgtcgcccctccagtcagtcgccctcgtcacgctggggccttccacgccggcgccgggtgcccgtggcggcgacaatggcggtggagggaggaagcggaagggcgtggtggccggaccgcgacctctgcgccagggcagcgctgtgcgcgagcggcgtcgctgggacacgtggacgcgctccgggagctcgggcactgcctgcaagagggctacagcgtgcgctgcttcgtgctcgacggtcagtcgccgcctcctcatccaggccaacgcccgtgagctcgccgccacggtcatcgcgtcggcctcgctcctccacgccaccgacaagctggctgcctcccgcgtggcactcgtgcctcctctgcgacttcggctgccacgccgcggcgaacgcacccagctgctcccctgtcgccaggtggagaggatcagaggagaggagagaggtggaggggggaggaataagaggctaacgtgtgggacccacactgagtcagctgccacgtcggataaaaccggagtcaaaaccgccaagagacctagtttgcactga

SEQ ID NO: 1438 - DNA, 1092 bp, Oryza sativa
atggccggcggccgacagagctcgtcacggtggaggcagaggccggcgtttctctgggaaacgatagacgccggacaacggcaaggtctctcttccggttcagcgaactccggcaatagaatttggtgtcaagtcaatatcgaggcaatagaattggggtctaatagtccccagatcttggttgatcagaaccaaattaagaccaaatctgcagaagccgccgtgggtcaagtcagcttagattgtacaggggaagctgtaggagataacgatcctaagaacacctccaaaatttaccgttgtttgaagtttcaacgcgcagagagacgagagattctagctagatacgggcaaaacgtcagagaaaggcaaggcgatttgccatttgtagataaaagagtatggtgcaaattgccaaatattactcgtttccatgaccaaaaggcacaggtatataatggtattattgctcatgcgaatagcatgtatacgcacccctgtttctccggcgtgttcgcggcgtgcgtattagtgcttagccatcagttctacctgcttcgttgcacaagaacccatgcaggcttcctgccggcgtcgaggcgctgcagcacgccggattatgttgccatctgcaaatctctgcgcaatccctgtgcttcggaagatggcatgagacggcagccgtcgcggaggagtcctccacggtgcaagctggagactgcctcgacggagcttgaccttgccatcgccaacatgggcacgaccctccacctctcgctgaggcatatcgcccagagagtgttggtctgctccattgacgatggcccccatgtgttctcgtcttggtccggcccatctgcggatggggacgacaccacggcggcgacggccagccaaggtcacacaacggcggcgacggcacgcatctggccatctggagaggaaagacgtcgatccgatcgagttcccaaaattttctatgcgaaaagaccaccttacccttccacccgtgcggtaccacccaaacgactaagcgataccgggtggtaccgatcaatttcagccgttggatccaattcatctgatggttag

SEQ ID NO: 1439 - DNA, 1062 bp, Oryza sativa
atggatcggctgctgaacctaccaggaccacctctgggcagtatcaacaatatcaaattgaggatgttgagaagtgcagcatttgaccaacggtgggtagaatggaaaaaacatttgttccaccaatcggcttcaatgtacctgacagatctgttccctgaagccatccctcaaacaacagaatcttctcctactcatcacagtaatagcggcgtagaaatccaatatgctctagggctactgcccaatggtggtggtctatctcctccagtcatcggctacaatgcccccaagacctcaacactgttgcacgaaaaaatcgaagaaacaaaaaatgctgccaatgatctgcaggccatagatccagatgtagcagaattcctggaggacgaagaaatggcagaagatgtggatgaagcggctgagcaccctattcatcctccaactccgatttctgaatctaccgatgatgtgaaaacaaccctcctggatatttcaacatggctagaaggttctttggaaactctggtaaccaactgtggatctattagagatagattccatgaaatccacgacaaaatcctagacgagttagccgaagctatcactccagcggcatacctcgagcaacatcggctcaagctcgaaaaagccaaacaaaggattgttgatcgacgtgagagaagagaccttgaagcaaccatccaagttagcaggacttctatcaatgaagagaaagctaaactagacgagttagtagctggcccaaattccactcaagccaatatcgatcggctgaatgctcggaagataaaactctcggctgagttggagcagtgcaatgcacagatcgctcttgaacaacaaaaacttgccgacttgccaaaagccattgaggatcagaagtcgaagttgaaagcatctgtcaagcacatgactgatctgaccaaatctttgaaggtgatcccaagcactgatgcagccgatgcccaaataatagatgaagtagagcagatttggcaaagggcaatatcggctatccaaaaatatgtatctggatga

SEQ ID NO: 1440 - DNA, 1017 bp, Oryza sativa
  misc_feature (304)..(304): n = any nucleotide
  misc_feature (357)..(357): n = any nucleotide
  misc_feature (452)..(452): n = any nucleotide
  misc_feature (609)..(609): n = any nucleotide
  misc_feature (613)..(613): n = any nucleotide
atggcagattcggattcacccgctacctgggagttgagcttacctcaatcagaggggtatgtcattgagctgcatcggatgttgaggcgtctgcgataccctgggttcccgtcataccgagtgagacagtgtggctcagtttgggaggctcgggtcgagattcacccccgagtcccttccaagttggactacagcttccagacacgtcaccaccgagacctgccagagaccgcgatgcaggatgccgcccgggaggccttcctccgactcagctctattcaccgagctgagttagtgagtaccnagtttgctcatcacccgttccgggaggagggcaactcagtttgcacagttcangacacgccctgctgctacaacccgatagtgactcggttgtcacgatgggctgaggcagtagatgactactacgaggaggctctgttggagattgncgaccaccagagacgtgtgggggagttagagactgaggtgaccgacctcacagcacagcagcttcagttggaggaggagcaccaggcttggggcagtgagatagactcactgaaggcacagctccaggtccacggagatcagttccagcagttatcngacnagtacaacgatcgccgcgggatgatggatactcttgaggagcagctgagagagagtcaggagcacgtcagccagctggaggagccgcttcgagcagccaagatcagcactacaggggcctctacttccacagcagtaggccgtgaccgctacttcttcctcaccccgccgtacccaccggcgttccacgctcttctgggagaggctagtatgctagctaccgagtcaacgccctacctagtggacccgacagcggcacagccacctgttccggagtttggtgcacactccactgatccctacaccttctccacagctgggttccagtttggagactccgatccaggtcgactccgagacagagggaaccgacaccgagccagagatcgagccagacatcactga

SEQ ID NO: 1441 - DNA, 1014 bp, Oryza sativa
atgacccccacaagacgcgtgaagcgtacaaggataaacttagagatgaaggggctgcggattttgaaaggcaaattgatggatttctgcgtcaagcacatgcttttgcctccccccgaaatcaaagaacctgagccagattaccccttcgatgacctcaagaatgacatatcctttggattgggcaccgacgccacgcaaaaacctgtggtgccaaaaccggggttgggaaaaccttcgagacctcctaagaggaaggtgactgataaggtggaggaacccgagatgcataaggaaaatcctatgccgaaagtgccaccggagattgcagtgccggaggtgcccgtggagattgtagtgccggatgtgcccatggagattacagtggcagaaccagaactgcaacttgtggcattagtcgggatagaaatagaagaagtaccaggattggaatgggacggtacagagccagaaatattggaagacgcttctccgtcgaaagaccccgaggtgcaaaagaccacgatccctgagaaggccactaccagttctgaggtgcctagagtgcttaggagccacgactccaagtccaaagatgagaacaaggagaagttcatggtaaccatcttcagtgggggaccatgggagatgagaaggttacataccttctacatggaggccagcaagaaaggcttgggcaatataacagctcgatcgccggcagattgtttcggcatcgaaggttacgtatggctagatttctcagatctccacagcatatatcgtcgggataagatggatgtcaactttgtcggtgtttggtgcatgatgcaatacatagatgctaagaagaaaaaagaacctatcggcttcttagatccaactcggatctgtaaaacacagcataccgtgaggctagcaccagggtcagacgagctgaagggcaagactccaaaagagatagctgaatacaagaagggcttgcacaaagagaaattgattaccgtcgcatag

SEQ ID NO: 1442 - DNA, 960 bp, Oryza sativa
gtaacaaattcttcaaaaacaaaaggtgtgagaaatggagatccttctggtcccatcaaggcacatcaatcattaataccgtccacaaatggctctgctcgagctccagttaaaactgatctttcaaaggtatctcacgcaggaaatctaaaaatcctcacccgagagcaaaactgtactatacacactgccaaagactgtcctgacaatcctatgagtcctcctccagctcctgttgcttcagtggaaccactgaaaaagccatgtgttagccaaaagcttaaggttgccacccatgacattcctctctctatactgcaaagtgcttatgtagataaaaaattaaatgcaagagataagcatagattctttgagtcgttgaggatcaagtcttcaaatggttcaagctcaactgctgagtcaggttgtccatcaccatccagtgtagctgatgtgaaacaagattcttgtcttaatgttggaaaagatgtatccttgtatcattctggaaaagatatatccttatatcattctggaacaaaatgtatgggaaatggaaagtgttcctgtgaagaagcaaattcttctgatggatctcagaggcatctgtctgataatgagaacaattcatccttggatcacactgcagatggggtttctcagaatcttctagtagaaagcaggtccatctcatcatctgaaccttctgataggggagatgaattccgggtgtcctatcaaacaataccgaaggcagttcatcatcagcacctgctgattcagatgatgggtacaagagatcccagtctggcagtgagggctaatgaggagctagagcagaaacttttgtccatggaagacaatgccaacatcaagatcgttctcctgtatatctattcgggcagagggctggataaggagctgatgaagcctaacgcaggggataaaaacaatgcttga

SEQ ID NO: 1443 - DNA, 936 bp, Oryza sativa
atgcttgggccgggccaaaatgccgtgccgtgggccggaccttgggcctctggccttatggccatctatatccctaatgacgtgatgcttcttatttgctgggtcgattatttagaatacttggacaaaattaagtatgaaaccctgcttatcgatcttaactactacgcgcagattgatcgatcagcagcgaaacaacgatttgctctatgtgatcaccgcttctccccgaagcaaccgacaccattgctccccgcgaaagccgccatctccaatcaccggagtcagcccgcgtcgaatcccgtcagcacctacacgacgaccacaccaagccgtgttcctacccccaaagttcgtcgcaaacaattccgctctgaccaccgattcaccatctgtcaatctagccccgagccgaagccgacaaatcacatgccatcttcccagccactgaatgacccgagcgctacgtctagccatctctctgttaaacgcagctcatcgaaaggcccgagccaccctgcccgaagtgttcgattccaccacggagaacaccgatcacctccagcttcaatcaaccccgagcatgaggcctcacgtttccctgttgaaaatagctcaccggaaaggttgggccacccactcaaagggtcgaacccaccgattggatcgccaatcgcttttgtcgccatcaacccgagcatcacgtccgccccgaaaacgacatcattgctaagcgcagaagaaaaacgccataggagatccaaacacgatgacgacaccgaggcacgatatttgataatgaagttcagccgaggcctacatctccggggcactgattacgggcgctcctccccaatccagcatataacagcgtatcagaattacaacgactcacggccggtcgccgccagcagctgctccctcttgctatgctaa

SEQ ID NO: 1444 - DNA, 921 bp, Oryza sativa
atggtagggatcaagaaagacggctgtgctttggcagaagtgaagttggggttggcacacgtacgcgaggccgttgtcagagatgggaagttcagagaaagaaatggagaaacgcaccaggcaggaattgcagagtttccgaagaaatgtgagactggccagtctaaccaccgtgtttgggccggacgtggaggagggcctgtaaaggacaagaccaacccctatttaagagataaggccggttcaattaaagttaccaatacgatttttggcgactccgctggggacgtcttcatcatgaccaagccggagattgatccttccaatgtcctgccaatctcattggaggatttggacgaggagcaatgtcgggagattgaacaacatctcaaggcgacgcaagaggcgtttttgataggatgcttcatcaagacccatcaaggagttgttcggaagccagtatttagtaaaaccgatggggcgaccatgaaatcaaccagggaggaaaaccctagattccctactggtctgtccgtgccttcgtccggtctgaccagcggtttccacaccggtccaaccgctttgcctcacggtctgaccagcaatcctctggccggtcagactgcacaaacctatatcggtcagaccggccaaccggccagtccgaccacacctctggccactggtcagatcgggctctgggccggtcagactggcgcaatcgtaccgatacaggaagttgatcctatgactaataacggtctcttatctcatattcatgtacatgatcctcctgtagctactattaatcctcaagttcctctacatatacctaatgcttacaatgatcctaataggggataccctcaggatgttaggtatggccaatataacaatattgagccaccgctaccactttag

SEQ ID NO: 1445 - DNA, 906 bp, Oryza sativa
atggcggaaagatcagaggaccgaggaagaagaggggagaggagactggaaaagctgacctggaacccttggcgatggcggcggcggtgcatccatcccgccatgatgtcctcaccgccggcgtcctccaccgtctcggtcgatcgagatccagcgcgcgcggcggcttggacgtggccggagccatggagacctatcagcagccagggcgccgccgcctcgccgccgacgaccaccaccgtggtctcgaccgagggacctacagcgtggcggcgaacctgccggtgttcaccgagacgaccaacaacggcggcggcgacgccagactcctacggcatcggcccgagcttgagcttgagcttgcaccagcaccacaccggtgtgggcggcgccggcgaccagaccacggtgttcgccggcggcgacacgctcgccgcgaactacctatacagctacgcgacaccggttgcttactctgctcaagattggcaccgcatcgatgcggggggcggccagaacacggtgttccccaacgtcgatcacgctttcggcgtgctcgccccttactttgctacggcggatctccatcacatcggtggaggtggcgaccacaacacggtgttcttccccaacatcgacgcccgcgccatgaacgctttcagccgcgccgcaccaaaccagtactctgctgcggaattcgactacaacggtgtaggcagcgagcagaattacgaggaattctactacaacggtgtgagcggtgtgcagaacatagtgccgcacaacatggacaacctcaccgcgaatgctttcagcttcgccacaccggcccattactctgctgtggaattctactacaatggtgtagggggtgagcagaatattgaggaattctactacaactag

SEQ ID NO: 1446 - DNA, 864 bp, Oryza sativa
  misc_feature (74)..(74): n = any nucleotide
atggaagttgcggccgaaacggccgcggacgagcctgctgatgaccgcaccgagacatgcggctacacccccantccaagcccggaccatgtcgaaactggggtggagtcgaacagcttccccttccgccgaaaggatttggagggggcaaaggcgctggttttgattgcagcggccaaggtggcgaatggagggtcagttaaggaaagctccaagaagaaagggctcgtggatgtcgcctgtgtcttcagcgacgacgagtcttcggatgagacccctacttcgcctgctgggcggagcctgggtctttcaaccgctcccggtgctacgaccgacacgggggaagcaggagggagtgctgcggccggtacttcagcttctgctgaccgggttttgcaggccactgtcaagctcttcggaagccttcttcgccatacaccggcttcgccgcccgccatccagaaagggaagaaggtggccgttgaggcatcggcttcggattactcgctggcggcaccccgcttcgcccctggggatttcgagacctgggcagatcttatccccttcgtcgagggggtaagtcatctcgtttctccggctgggagcccgagccagttcaccgagttgaacgagttcgacgagggctattctgccatcaagagcttagctgattggggtattaccgaccattccaacaatcacaaccgtcattacctgcctataaaaggagctcctcttctcacttcactcacacaccttgagcatctagctggtggaataggaatagagcagaaatcaggagtccggaagccttcgaaagtgttcgggggtagcttctcgaagtaccaggagggcatcggatag

SEQ ID NO: 1447 - DNA, 840 bp, Oryza sativa
atggccttgtcctcctcttcgcacctcctccccttctcccggcctcccgcgaccttcccacgagcacgccacgccggcggcgggaggggccgagccggcgccacggggaggttcatagcgtgctcctcgccccctcctcccgacgtcgtggtcacccgcgagcgcgggaagaacgccaagctcatcgccgcgctggaaaaacataatgtacaaagtcttgagcttcctcttattaaacatgttgaagggccagatacagataggctttctgctgtcctgcgcggtactgaaagagtttttgacgaagtaattcaatacaatgatggatcccttgaggttgcattttctccttctaaagctatgggtaaatttttggcctcagagcttccaaggaccactgaaactacttgtaaagtgttatatcctgcatctgcaaaggctggccatgaaatccagaatgggctatcaaatcgaggatttgaggtgacaagactgaacacatatacaactgtatctgtacaggatgtcgatccgctaatattaaagcctgctctttcagctccagttgttgcagtagcttctcccttctgctctccgtactccctaattagatggttcagagcttggctaaatcttgcttcacaagttgacaactggggcaacgccattgcctgcataggcgagacgactgcctcagcagctaagaaatttggcctgaagagcatatattatcctaccaccccgggacttgacgggtgggttgaaagcatccttgaagcgctcagagcccatgggcaatcgaaagaggtcctctctcgtcctcgtggatactttccttga

SEQ ID NO: 1448 - DNA, 822 bp, Oryza sativa
atggatgccaatagggatggcaatttccccggtggggacggggatccagcggatacccacccctatggggccggggacgaggctgttttttgccctgcgggcgcggcccaagggaaagtgcgcggtgcggccaagcctattgggccggcgcgcggggagagaagggcggtagtccgggtggacgcggtccaccacgcgggtctcgggtggggcccgcatgtcggggacatggttcacggcgggacgagttctcacggaggggctctagggttttgtgggattggctcacgggtgcggtgcgccgggtggaccggatggcgacgggcccacgtgcagccgctcggctcacagtggaccacgtgcacggggagaaggggacggctgacaggcttgaccgggcggcgctccagggacggcgcgacaccgagaacgtgcggccaagaagaggagagggagtgcacggaagaggcggtcagcaccacggagtgcctcggcttctcgcgcttgtcggcagaagtagcggcgacggcggcgagcagccgggcggcaacaatggcgcggcagcgatggagagtgaagcgggagggattgagaggaggggctcggcattatagtggaggcgatgtcggtttgggaggcgtgggcgagctggttggtgctcagctggagatcacgtgcggcgcgagaatggcggacgatgaggatgtaaggagcggtgaaggcggcgaggcgcggaaaggcggtcacgcgaggcaggcgacgaccgggtggacggcctccatgcgagcgcgcgcgggaaaggcgaaggcggcgcgggtttga

SEQ ID NO: 1449 - DNA, 795 bp, Oryza sativa
  misc_feature (178)..(179): n = any nucleotide
  misc_feature (185)..(185): n = any nucleotide
  misc_feature (187)..(187): n = any nucleotide
  misc_feature (189)..(191): n = any nucleotide
  misc_feature (195)..(195): n = any nucleotide
  misc_feature (199)..(199): n = any nucleotide
  misc_feature (203)..(203): n = any nucleotide
  misc_feature (206)..(206): n = any nucleotide
  misc_feature (212)..(212): n = any nucleotide
  misc_feature (328)..(328): n = any nucleotide
  misc_feature (363)..(363): n = any nucleotide
  misc_feature (597)..(597): n = any nucleotide
atggccaagaacacaacaacgcagcagcagcagacgacgaggtcgtcgaaagaggcgggcggcggcgccgcggcgaggtcgagaggggtgtcgtcgaagaagtcgccgtggtaccagcgggcggttgaggtgttgctgctgatatggaagcagccgacgggggcggggacggggacgnngacgangncnnnggcngcgncggngangggggntcggctgcggaagtcgtcgtcgctgaacgtggcggcgtcgttcacgcgggtctgcctgtgcgcgcctatctcgtcgtacaatgagcaggcgctctacttccaggcgggcgacgtgncgccgcgccggagctacagctacccgcgggcgtcntcggcgtcggcgtccgggtgcagcggaggcggaaacagcaacccgctggtggcaccgccgcccgcggccgagcagagggcgctgatgaggacgcctggccccggcggggagagcgcgaggcggccggtgttccgcggcaagtcgctgacggacgacatcctgatgcggcggttcgtcgtcgacgaggaggccacgcggcggcgcaacgagatggaggtgatccggagccgccangcggccgccgccaagcggcggcgcctcggccccagcccgctccgccggatggccctagcggaatcggagtcggaggccgacgacgatgaggaggagacgacgacgacggaagcagcggagccgacgtcacggtctcacggaggaaaccccaagccgtaccagtcgcagcgcggattttcgcaggcggacattggctag

SEQ ID NO: 1450 - DNA, 745 bp, Oryza sativa
cgcgcgttcgatctggggattacgcatttcgaccttgccaacaactatggcccgcctccgggatccgccgaacgtaattttggccgtattttgcaggaggatttcctgccctggcgcgatgagctgatcgtctcgaccaaagcgggttataccatgtgggagggcccgtacggcgactgggggtcacgcaaatatctgctggcaagcctcgatcaaagcctgaagcgtatggggctggagtatgtggatatcttttatcatcaccgtccagacccgcatacgccgctgctggaaaccatgaaagcgcttgaccatgtggtgcgccaggggaaagcgctgtacgtcgggttatccaactacccggctgttctggcccgccaggcgattgatatccttaacgacctcggtacgccctgccttatccaccagccgaagtactccctctttgaacgtgcgccggaagcggggctgctggaggtgttgcaggaaaaaggggttggctgcattcccttctcgccgctggccggcgggcaactgaccaaccgctatctgaacggcattcccgcagactcccgcgcggcaagcggcagtcaattccttaaccctgaccagatcaccgaagaaaagctggagaaggtaagaaagctgaacgccatggcggaagcgcgcggccagaagctgtcgcagatggcgctggcctgggtattacgccatgagaacgtgacgtcggtgctgattggggcaa

SEQ ID NO: 1451 - DNA, 732 bp, Oryza sativa
  misc_feature (26)..(26): n = any nucleotide
  misc_feature (32)..(32): n = any nucleotide
  misc_feature (180)..(180): n = any nucleotide
atgtcgtcttcaacgacgcccctgtnagcctngctccagttcgcgctggcctgcttcgaggagcttctcgagaccgcggtggtggacgtggcctccgagtgccaccgcatcgcgcgcctgggcctcgaccgcggcgtcgacgccgaggaggaggagctccgcgcctgggccgcccgcgancacccgggggccgaggagggcggcggcgccttcggcgttggcggagggaacaagggggtggtcgatgtatttggccaggtgctccccgccgtggccgccgacctcgtcgactgcatgaactgcggacgccccgtcgccgccggccgcttcgcccctcacctcgagaagtgcatgggcaagcttgtcatgtttactccatgtgagatatacacaatgtgcaggcctatgccatttgacatttctgacaaatgttgcactttcagggacgcaaagctcgcacaaaaacaacaagaagtagtaccgctggacgaactaggaacaacaatggtagcgcggcttcttcatactccccgtattccagcccagctatcgctaacagagcaagccttcctaacggtgtcactgatggcagtgccagtgtcacaggagaggatcacagcaatcacatattgccggagccctgagcacctgactgtaacaccgtgtttcagccaccttaccaaataccagtgtttgggcaccatggccggtctgcaacacattccttggtaa

SEQ ID NO: 1452 - DNA, 696 bp, Oryza sativa
  misc_feature (107)..(107): n = any nucleotide
  misc_feature (400)..(400): n = any nucleotide
  misc_feature (444)..(444): n = any nucleotide
atgaaggaagagccaggcggcggcggcggcggccgacggcgacgctggttcgccgtactgctgtgcttcggaggagacggtaacgacaaggatgaggcggcggggangccgccgcggaggaggaagcgcaccgtgccggtggacggcgccggaaacgacgacggggcgcgtaatgtcaggagaaacagcaacagcagcaacgacgtccatggcgggcagcggcagcagcacgagcccaccgcgccgccactgccgcgaccggccgagctgccgccgccaccgccaccgcctcgacgacgccacgacgtcgtcgctccggccacgacgcgcggcgccggcgccggcgccggcgccatcgccgacgccgagacggccgaatcaaaaggcgacgtcgtcgtcntggcgagctcgcgcgaacgcgcgagcagctgcggccacggcganttcgggccggcgatgggggtgtgcgtggtggcggcggtgtcgatggcggggctgctcggcggccggctctgggccgtcgtctgcgtgtgcgcgtggctcgccgcggtgtacgggctccagctcaatcggcgccgggcgaagccgccgccggcggctgacggcggaggcgaggaggtcgtcggcgacgtgaactcgaaggattacaagaagctggttgtgctcaaggggcttctccagcgtgatcgcagatag

SEQ ID NO: 1453 - DNA, 693 bp, Oryza sativa
atgaaggatcttggcagcttgcatcacttgttgggcatctctgtttctcggcaatcctctggcctacatctcagtcaacgccagtactatctcgaggttttggaacatgctggcatggcagattgcaagccgtgtgctactcctgttgacaccaacgccaagctgtctgccaccgatggtgccccggccagacatctcctatgctgtttagcaggtttgccttcacatgcacgatccacgggagccacatatgtccgtggaacggttgattatggtcttcacatccgctgctcttccactgttgacttgagtgcatactctgacgccgactgggcaggttgtccggacaccaggaaatccacctcggattatgctgtgttccttggcgacaacttggtctcctggtcctccaaacgtcagcttactgtatcgtgctctagtgccaaggcagaatatggggcagtggccaatgcagtggctgaaacttgctggcttcgacagcttctccatgagctccatacccctccgagccgatccacactggtttactgtgacaatgtgagtgctgtatatctctcctctaacccagtgcaacatcaacgtaccaagcatgtggagatcgatctacacttcgttcgagatcgcgtcgctgccggatctgttcgcgtgttgcatgtacctactacatcatag

SEQ ID NO: 1454 - DNA, 663 bp, Oryza sativa
  misc_feature (414)..(414): n = any nucleotide
  misc_feature (425)..(425): n = any nucleotide
atgggtctcttatcggccaaaaacctcacccatcggccgccgcccccgcgactcccacctacgccagcgtcgccacgcgccaccaccgagctcactcgtgccacctgcgccgccgcacgccagccccgtgctcgctgcgcgcactccacctgcgctgtcgcgccgccgcacgtcacccatgccgccgcatgcagtaggaggctaggggccgctctccgactcgccgaggcaggaccacagggcgcagccactgaggctgcagccgcgtcgccatctcgccttcttcagccttcatacccaaaaattccagacacctccctcttcccaactccacagcagcatggcgatggtctttggatgcattgtaggatggctggatctccaatgagtatgggtacccaatgggtacccgtnacccgtgcggntgtgggtatgggggaatttttcacccgtgagcgggtgtgggtattggagtggggacatttgatttccatgggtgtgggtatgggggtgacgactgatggggaaaagggcagcgtgtggctggcaagaaggagttgggtagcggcgtcgaaccagggaagttgttgggaggttgggagcatcagacaagaacctcgtcacgtcgctgtcactagtggcgcgcacacaagccaaatgtga

SEQ ID NO: 1455 - DNA, 633 bp, Oryza sativa
atgcggggagaactctgcgtggcccagttgtcttccgtggcccaacagcggtggcgatgtcggtcaccgccgccgcgcggcgccttcttgaaccgcacccacatccgcttcaggtcgctcgccgacgggcgggagaaaccaatcgatagacctttcataatgcttcagcttggttcaaatcataatgtatactccaatagaatctggatgagggagggggcggttgaggccggcatggcgctagggttcccagctccggcgtggctggcgcgtgggggatgggggaggcagtgcgacgcggggaggggaagcggctgcatccgcggcaggtccaggacgcagctcgcgcacgcgtgcatggggggagaagcaagcgtggcagaaggagatggaaggggaagcgagtgggggaagtcgaagggagggggaagcgatggcgggcccgcggcgcagctcgcgcgcgcgcacggggcggagaagcgagcggggccgctcaagaatgtttttgctcgtcgtctcaatgacatgaacaagaatgtttttgcatttatttcatgctcgctagatgatggaaggttgctactgcgcaaatgtgagctcatctatgtaccacgccgctacatctttccatga

SEQ ID NO: 1456 - DNA, 621 bp, Oryza sativa
atgggcgcgaacggccacccgccgccggcgagcgccgccgcgcagaacgggtcccattccagtggcggcggcggaggaggagatggtggaggagggggagcaaaccctagccccggcggcacggtggcggcgctccggcacgaccccggcctggcgcgggagtggtcgccggaagagcagtccaccctcgacgagttgctcgtcaagtatgcatctgatgctcctgtaattcgttatgcaaagatagccatgaagttgccagacaaaacagttcgagacgtggccttgcgttgtagatggatgaataaaaaggaaagtggaaagagaaagaaagaggaccacagctcctcgaagaaaagcaaagataaaaagcacttactatgccccacaaaagcatctgtgaatttaatctgtttcaaccatattgtccgtaatataaatgggttcttttgcaaacaagctgttagcttggcggtagtgcttccacttgagaagccgctggtcctgggctcgaacccaggatttgccccaaaaaaaaagagccctcgtcagcttttccgtgttccacccgtaaccattgtggttgccttcagtgaaatgtatgaggccaatatgccctga

SEQ ID NO: 1457 - DNA, 603 bp, Oryza sativa
  misc_feature (184)..(184): n = any nucleotide
atggagcacaaggacaggcagcggcatgcagcggcggcggtggctaagccgcggcagcggtcggcgtcgttccacgggcgcggcgaggcggagcagcgacactcgctgctgaagcagcggccgcggacgcagcccgacctgcttgccggcctcagggggcagagcttccggcgaggcggcggcnaggggcgggcgccggcggggccgagcagggtgctgctgaccgtggcggtgcggcagagcatgtggccgctgcacgtgatggcgcgcgcggagtggagcgtggccgacctggtcgccgccgccgtggagctctacatccgggaggggcgccggccgctgctgccgtccgccgaccccgccgccttcggactccacttctcccagttcagcttgcagagtttgaacccggaggagaagctcatggagctcggcagcaggagcttcttcctctgccccaaggccgccgccgccgccgtggctgccgtctcgtcgggcgaagacaccggcggcttgtccggggaagacgaggccaactctgccaagaagcccagcgtgttggctccatggctagggttccttcacttctggccgctgctgtag

SEQ ID NO: 1458 - DNA, 597 bp, Oryza sativa
atgttggtcactgtcattgtgacaatggtagaagtaaatttagtgaaggtgcaaaagatcagaaacccttgtcgacatcatccacatcctcgagctagcccggatagcggcctcaatgaaccacaccccaccaccaccaccaccgcaatccaccaacagctcgccggaatccatggagactgcaagcctcccggccgtcttcgccacgcgttgcgcctccagcatgctctcgggccatcaccacggcttcgccaccctgtcctagaactcggggaggaggccgtcgatgaacgtagacttgaggaacaagtcagggacgtccgcgcagctgccgccagggaactgtcgaggacgggtgaaaacggtacggaaacggacggaaacaacctttatcgttttcgtttccatatttttttcgtaatcggaaaccccggaaacgaaaacggaagaatgttatcgaaaccaaaaatggagcgaaaacgaaccggcgcagatacggtaaagaaaatttatcggaatacaaaaacccctcaaactgagcttcaaacttttgtcaagatcaattctcaagccttaggagtcaacaattcatcataa

SEQ ID NO: 1459 - DNA, 597 bp, Oryza sativa
atggccgataagacactccgcgaattcactgccccctctgctgacaatgtgccccacttacgggtcagtccagacgccgttaggctccgtctgtttcctttctcactcctgggaaaggcaaaacagtggttctatgcgaaccgggcaactgtcaatacctgggacaagtgctccacggcgttcctctcgaagttcttcccgatgggcaagaccaacgcccttcgtggaaggatttcaagtttccagcagacaagggatgagactattcccaaagcatgggaacgtctgcaggagtatgtggccgcctgtcctcacaacgggatggacaactggctcatcctacagagtttctacaatgggctcactctctcgtccatggatcacctggacgttgttgctggaggaaccttcttctcgaagatggtccgagcggccattgatcttatcaagaagatggtgtccaacatgggctggagcgaagaacgactccagacccgccagcgtggtatgcataccgtcaagaagacggacatgttggccgccaagctggatctcctgatgaagaagctggacgatcaggagaaggccaaaccgtag

SEQ ID NO: 1460 - DNA, 594 bp, Oryza sativa
atgtcccaagttggatccgcccctgctttcaggactgggtcacctaagaagcatgaactgaagtccaaacagaagcttgagaagaagctcagcttctacacaaaagtgaaagatgcagtaacctccctaaatgctacaaagactatctgcaagcttgtttttactgttattgttttgctccatgagtggcgtgggcgtataacgcaaccaatgcttagatatttcaaggataaattccaaattaaatctaaacagaggagccgccagaagaaactgaaagcatatgatctctcaatgctctctgagttccttcctgaaacagatgcctcaaatctgcacaccgaagcaaaactgaactgcaaatcgaagcaagctttagtgcaacgggaggctgcccaactgaatgctgtgctgaccaatccgcagttccagctcgacccgtttgcggcgatccatcagcacctgttgtcaacacagccaccctctgcgagaaaggagagcaattccgccaagcaggggaaggaccctaaggacaagaaaagaaagaacaagaagaagaatgcttcatcggcctccgaggcaatggatatctga

SEQ ID NO: 1461 - DNA, 585 bp, Oryza sativa
atggccgcgcccttcttctccacgcctttccagccctacgtctaccagagccaggaaggatctgtgacggcgttccagatatccggcggcgatgtgcaggtcctgcaggtgatggttaagtcacaggaaaagttgaccgtgaaaccaggtacaatgtgctacatgtctggtaatattcaaacggacaacaactacttgcctgaaaatgatggaggtgtgtggcagtggatttttgggaaaagcataagcagcagtgttttcttcaaccctggctctgatgatggatatgttgggatttctgcaccatttcctgggagaatactgcctatggatctagcaaactttggtggagaacttctttgccaggcagatgcttttctctgctcagttaatgatgtgtcagtcacaagtacagttgagcagaggccgcgaaacattgaaattggtgcagaggtgatcctcaaacagaagcttaggggtcaagggatggctttccttgttggtggtggatcaggatgcattgaggatatatactatctagtgctaaaggaacataatatggtgccacagtttatgctggcatga

SEQ ID NO: 1462 - DNA, 559 bp, Oryza sativa
ccttgccggcggcggcggcggagggcagcggcggaacatacaggccgactcatcttcatccgcgaggacatggagaaagccggaagccgggtggataaagctcaacttcgatgggtcgtctaagcacgcgaccaagatcgcgagcatcggcggcgtgtaccgcgaccacgagggcgcattcgtgctcggctacgcggagcggatcggcagagcgacgagctccgtcgcggagctcgcggcgctcaggcgcggcctcgagctggtggtgcggaacgggtggcggcgcgtctgggcggagggcgactccaagacggtggtcgacgtggtgtgcgaccgcgccaacgtgcggtcggaggaggacctgagacagtgcagggagatcgccgcgctgctcccgctgatcgatgacatggccgtgtcacacgtgtaccgcagcgggaacaaggtggcgcacggcttcgccaggctcggacacaaggcggtgcgcccgcgggtgtggcgcgccgcgccgcccgaggaggtgctccggttcctccaacaagacgccgatcaacgataa

SEQ ID NO: 1463 - DNA, 558 bp, Oryza sativa
atgggcgaagaggaatcctcggaggaagaggaggaaggagacgacggcgaggatgatgcagatggagaagatgatgcaggatcaggagacgatctcttcgccatgatctctcgcgttggtgcaggtgcagccactaacccacgttcccacgattccctccgcaacagcgcttccacgttctttctcctgatagataaggaggccgcgatgcctccgaaaccacaccttcgcctgagatctgcaccgggtaggcgggtgatcaggtttttggggagtgcctcccgcacgactgctcatcaccatgtctggagttgccaccgccactgctggcggaggtggtacgccgccgacaggagctcgatccggagctggtgcgccaggaggtgccgtgaacgacaacaacaacggaggcaattctgcctcaccatccagcggagggagtgcctcccgtacgactgctcatcgccatgtctggagttgccaccgccactgctggcggaggtggtacgccgccgacaggagctggatccggagctggtgcgccaggaggtgccgtga

SEQ ID NO: 1464 - DNA, 552 bp, Oryza sativa
  misc_feature (381)..(381): n = any nucleotide
  misc_feature (389)..(389): n = any nucleotide
  misc_feature (399)..(399): n = any nucleotide
  misc_feature (489)..(489): n = any nucleotide
  misc_feature (499)..(499): n = any nucleotide
atgcccgcagatatcccgaatcacacagattcgtttctgaccactcaggtcatccatctgccacataggctgattctggttacgattcccacaccacaacaacttttcacaaagcactggggtacactttacccacaagacacgaacttactccagacactggccgggtgtcccattccaccttgtggttgtactttgattatgctcgatgagtttcccacaggaatcggcccttatatgcgaatacgggacagcgccacgcttctcaaacccatttcccaattttcgacaatcaacggtgtatgtgggataattggtatacacgctcaaagagcacggataccgaagtaccacaagggtggagcgacaaggaatcagggngcaattgntcaaagggtnacttgccttgctcaaggtcttcacggagcttcacgaatcttcgagaaaaccacgattgacgaaaatccgagatctcaactttacgggaantactggaagntgaacgggagtccgatcgaagttaccggatcggagatatatgaattttggaag

SEQ ID NO: 1465 - DNA, 546 bp, Oryza sativa
atgaaaaagttcaaaaagcatcaaaacatgattttttggacatactggagtgtattgggtgcgtttgtggcaaaaactcacttcgtgattcgcatgcagaacttttctcaattagtgccgatattggcacacgatggtgcgatgtttctggccggaatgaaaaagttcaaaaaacgtcagaacatgacttttggacatattggagtctattggggaagccccttcaccagcttcgcccaggtgttcgtcgccgccgcccgcaagaggcgcctccttgctccagcgtctcctcccgacgaactcttcgacccgccgtactggagcaagctggtggccaagatcaagcacacagacccgttctggtggctggacaaggccgcggtggtgacgccggaggacgtggtggtggtggggcccgccgcaggtggaggaggtgaacttgcttgctggatcatcccggtgtggtcgtcgtcgatcgtgtactacgtcatgctgacgcagctaggcacgtacacggtgtcaggtgatgtagtcggaccgacgtga

SEQ ID NO: 1466 - DNA, 516 bp, Oryza sativa
atgccgattggtggttccaccacgtcagccagccgctgtcagcttgcggtgtgtgtggatgtgcagcagcgaattattgcccaggccgggacttcgatcgatcgatcgatcgcaacatgcaatgcgtacgctacgccgtaccagatccaacttatcaattcggagctcgggaagaatgctgcgcccatgtggcacatagcggtgcacggtttcgccgctttgattgataccccaaagttaccaaacggggtttacacctcgagaagaattccgtgtgcgcgagaagaaaaccgtcagcaacaggacactgaaagccaccggaggagacgcatcatcagcagcgccgagagagacagacagcgacgcttgctgtgctacccaaaaccgcatcatccaacggaacggaacacgcgtgttttgccgatcgccacgctggattggatccgggaacgatccaagttcatcgcccacggcaagaaacagattcaacacgttgtaatccccgaaccatcataa

SEQ ID NO: 1467 - DNA, 513 bp, Oryza sativa
atgagcagtttactgcagggcactagattgtccgtggggtttttgtacgatgccactcgtcagcaaaatcaagaggagcatgaaccattgtcttcagcctatgatggatcatctccagcttctgctatagttgctgttgacacaaatctggatacatccactcctgatacttaccgagcaccacctgcaccattgccttatgatgttagtttgccagtcccagaaaaccctgatttggagaagtcagacctgaagagcaaaaccgatgaccaacaggaggaatctttagaggtggatgagttcaaatcatgtgaaaaatgtgtcgctgaagataagcctgatgaggaggatgtttgcccaatctgtcttgaagaatatgatgcagaaaatcctcgctctttaactaaatgtgagcatcatttccatctttgttgcatacttgaatggatggagcgaagtgatacctgcccagtttgtgaccagattactttgatagatgatatgtatgaatag

SEQ ID NO: 1468 - DNA, 495 bp, Oryza sativa
  misc_feature (318)..(318): n = any nucleotide
atgcagaggagcgcagcggcctcggggatgagcggcagcggcggcggcatcagggatgagcggcggagcttggcgtcgaccttgatttgtgttgccgcgatgttagcgatttttccaaatctcctcggggccgagcggcaagcggtcacgagcgggcgggggcgcggggcaacgcgctctatagcgcttctctccgtgggagcgagtgtctcttctgaggcgcggaacctagcgccacgcaagctcgattccgacgtggtgcatcatagcaccgatccacggtgttgcactgtgaagggccttagccactcattcccngccctcgcagtcggacgggctgccatgagaaatcatcatgggaactgcaggggcattcgcctccttgtccgattactccatgccatggactccctccctggcttccttctacgtaggattgcaatcaacgctcttctccctcttcttaccctttctgcagccttaagtctgagctaa

SEQ ID NO: 1469 - DNA, 495 bp, Oryza sativa
  misc_feature (15)..(15): n = any nucleotide
atggctgcggcggcnaggaaggggacggcgacgccgctgggcgcggtgttctcgccggaggagacgaggagggccgtggcgcgggttgccgaggccgtcgccgaccgccgcgccgagctcggccgcctccagggcttctccgccgacaacgccgccctcgtctccctcgtccagaggctccccgacgaggtctcccacgacatcatggttcccttcggtggcgcggcatttttccccggccgtttaatccacacgaatgaactactggtgcttctaggggaggggtactatgtggagagatccgccaagcagaccaccgagatattgcacaggagggggatggagctggaagctcaagtggaagcgatgaaggcaactatctctgaccttgaagctgaggcgaagttcttcgaatcaactgccgccgaggcttctgtaaggctttcttttcttgtgttgtatgtttcgggcaggcagtggtatgttagtgtttaa

SEQ ID NO: 1470 - DNA, 493 bp, Oryza sativa
  misc_feature (3)..(4): n = any nucleotide
  misc_feature (7)..(7): n = any nucleotide
  misc_feature (14)..(21): n = any nucleotide
  misc_feature (23)..(23): n = any nucleotide
  misc_feature (30)..(30): n = any nucleotide
  misc_feature (33)..(33): n = any nucleotide
  misc_feature (36)..(36): n = any nucleotide
  misc_feature (40)..(40): n = any nucleotide
  misc_feature (46)..(46): n = any nucleotide
  misc_feature (50)..(50): n = any nucleotide
  misc_feature (59)..(59): n = any nucleotide
  misc_feature (62)..(63): n = any nucleotide
  misc_feature (66)..(69): n = any nucleotide
  misc_feature (72)..(72): n = any nucleotide
  misc_feature (75)..(75): n = any nucleotide
  misc_feature (77)..(80): n = any nucleotide
  misc_feature (92)..(93): n = any nucleotide
  misc_feature (100)..(100): n = any nucleotide
  misc_feature (103)..(103): n = any nucleotide
  misc_feature (140)..(140): n = any nucleotide
  misc_feature (284)..(284): n = any nucleotide
  misc_feature (377)..(378): n = any nucleotide
ggnnaanaaccctnnnnnnnngnccggggngancgntaancgcctnaccnctgggaatntanncannnnggnaancnnnnggacaagggaannggttctnagncccttttcaagggtggggttcaaaggaccgacattangactcaactggagctttccaagaaatagcttagtagccacattagcagcgcttgggatgattttaggcgcggcgtattccctttggctatataatcgtgtggtttctggaaatttaaaacctgatttcctctataaattctccnatctaaatggcagagaagtttccatatttctacctccaacagaccgacaaggaatgaagtcaaccttagaaagtagccgatgggagtatcccnnaagccccggactcatctgccacaatgtcgggagcatacctcatcaagttgtcgcatttcatattgtagtcctgaaacagtaccactcccttgttttgaggctaaacggaattgct

SEQ ID NO: 1471 - DNA, 486 bp, Oryza sativa
atgacgtccggggcggcggccgcggcggcggggaggaagccgacgtggaaggagagggagaacaacaagaggcgggagcggcggcggcgggccatcgccgccaagatcttcatggggctccgagcactcgggaactgtcgtcgttgtcgatctggtctcgaactggtactcggcgtggtcggagaggtcggcggtgacgactacgaggaggagatggagggggcgggcagcagccggacgcagcgcagcacgtcgtcgtccggccatggacgtcacgggagctggtcaggccatggaggagcagtgagcggaggggtcgatggcggcgttgggacggggcgatgcgctcggagccgagggcgccgtggggagcaacgcggcggagggggcccggcgacgctggccgtggacctcggcgcagagggcggccgtggacctcgacgcaaagggcgccagggcggaggagatccagcggagaccgaataa

SEQ ID NO: 1472 - DNA, 479 bp, Oryza sativa
  misc_feature (69)..(69): n = any nucleotide
  misc_feature (74)..(74): n = any nucleotide
atgcatgcaggcgccgatattagcttcattgtcctttcatatggaatgtactaccatgattacaatgcnaacantcttgttgcgaggatcagattgagtgaacggccggacgttgtggggcccgtgaacaagaagattgcccatggtgagccttccacggcgccgagcttgcactcggcagctactggcactggcagtgcagtgcagagcaaaaaagaagaagcaaaagacacagatgacccgctcgatggaaagaaagaaaccagctacgactgttcattctcagtcagggcatttgcattgtgctgtgtttcatctgcttctcctccgtccgcctcttccaccaccgcaccgcaccgccaccgcaccatgacgccggcgagaggtcccaggctggactgccatttcgcgtgggacggcaacgacgcgcatggcgtcccgttccttccgccggttacgggacagcccgtggacagcac

SEQ ID NO: 1473 - DNA, 471 bp, Oryza sativa
  misc_feature (3)..(3): n = any nucleotide
  misc_feature (7)..(7): n = any nucleotide
  misc_feature (29)..(29): n = any nucleotide
  misc_feature (35)..(35): n = any nucleotide
  misc_feature (37)..(37): n = any nucleotide
atngcanggggaaaatgccttgaggaatngcaagntnccccttggggaagggcctttgtcctcgggcaaccggatctaggtcccgctccggatttcgctaggagcggcgggatgtcgccacggccggtgactgcgggtgcggcgacgacaaggagggcagcgtggctggcaatggttggagtgagggacgagtggatctccttctctctcgccctctccctctcctcaacccctctacatgaggataatccagagctcatcgatgatcttctgtgtggagtcgatgttcggtgggttgtttgcgactaccttataggtttagcggtgattggcttggtgctagcttgttctcctaggatgtgcaaagagctaccagcttgcagtggccgtccaaaagctgttgagagtgcatctgtgcatggaaaggcatcgaagagaagtatggccgatatatcgatcgatcaggacgat

SEQ ID NO: 1474 - DNA, 453 bp, Oryza sativa
atggaaaagggattatatggcgtgctgggctggatgaaagaagcaactacgcccctggtacatttcaacgcccatgaattctatatttcagcagtatctgaggccatagctctcaactcagcttcagcactcgagcgggacactgcagtctgcttcttggttttccaaaggtccggaggagcggaagagtttatagtcgagaaggggctttcgggcatgccacatcgcattccagattatccagatgcttacgccggatggaatgctctgagcactctcaacggatcctccacgcgctgcgctgggcataccatagttcttccgtgcgtctttatcgtggcggaaacagaacaagagggaaagacccggctggctcattccattgataagctcatcgggctgctcgtcgttaggaagagaaagtcctactgctgtaaccgcaacatcaagcaa

SEQ ID NO: 1475 - DNA, 438 bp, Oryza sativa
atgaaccatcaggagcgcatgagcggcaggcacagggaccagtgggagcaacctcccgcggcgcaggatggcggcgatgacgagcaaatccacccgccggtcaactgctccatccgtcgctggctatcagcgtcagctccttgccgagctcagcctcctctcccctccactctcgccctcgatcgacatcccctgaagcgaggaggcggccggctcgagcacatcgaggaggcgcaagggggcttccatccccctccgccggcgtcgcctctccctcccccaggtggtgcatgtccaggcggagcagtccacgagtgtcgtagccccataactcagattggtcctttcaccagttacccaagaatcgccggtgaaatgcaactggatggccatatgtttggcaacatcgaaacaagcctcatcattggcagaatctag

SEQ ID NO: 1476 - DNA, 427 bp, Oryza sativa
  misc_feature (6)..(6): n = any nucleotide
  misc_feature (27)..(27): n = any nucleotide
  misc_feature (42)..(42): n = any nucleotide
  misc_feature (45)..(45): n = any nucleotide
  misc_feature (50)..(50): n = any nucleotide
atgcangcctgcggacacgatatccanaccagcgtgatcctnggngccgngctaaagctgaaagagcgggaggcctcgcttaatggtcgggtgcggatcctgtttcagcctgccgaagagaactttggcggcgcgaagagcatggtgcgggccggtgccctgcgtgacgttagcgccatcttcggtatgcataacgaacccggcctgccggtcggcgagttcgccacccgcggcgggccgttctatgccaacgtcgaccgctttgtgatccgcattaccggcaaaggggcgcacgccgcacgtccgcacgaaggcaacgacgccatcgtgctggcgagccagctggtgacggcgctgcaaagcgtcgccagccgcaacgtcaatacgctggattcggtggtgctgagcgtgacgcgtattgcaggcg

SEQ ID NO: 1477 - DNA, 417 bp, Oryza sativa
atgattcagcaaatgctcatcaactttgaagatcagctggagaagaactcagagtcattctctgaccctagcctgagtaccagcacaacgctcaaatttatgcagtaccaagagaagtacatgcttgcctcctgggaacctgttctgtattgcctacaggataagatgccgctgtggtttcctaaacactcctcacagctgtcaagattcaagtcagaatttcagaaaacatgtactccacatcagaagctatggaaggtccccaacccaaggctcaggcagaaactgcgagaagccatcactgataaggtcattactggatacaaaaggtacctggaggaccatccggagctggagaaatgcagcagtgatctacaggacatggaagacatggtcaacgagctatttgaaggatga

SEQ ID NO: 1478 - DNA, 387 bp, Oryza sativa
  misc_feature (42)..(42): n = any nucleotide
  misc_feature (51)..(51): n = any nucleotide
atggaaagggtgggtgagaatgtgttgtgcaggcgacggctnacggttgcngccggagtccgcgggagaggtggagccgtgcagcggctgcggtccccacctcacttcttctcccccgccttctctcacgctctctcttcttctcccttaatcactacccttctctctggccctctctccggcgccactgtcatcgcctccctccacgaccaagctgtcatcgttgagggcaacactgccgcatcggccgacggcgaggccgagccaccggctgaatctagtgaccccgggctctccgctggtcgatctgactggccagagatggcatgcggctcgaagaagaggtggagcgggaagacgaccggcggcaggactcaagacctttag

SEQ ID NO: 1479 - DNA, 384 bp, Oryza sativa
  misc_feature (17)..(17): n = any nucleotide
atgtgcctccccccaancctcacctcttctcactcgctctccccgagccgatcgagccctcgacgaacacggcgactccgcgagacgcccacccacccccagagcagatcagagaccaccacagcacgtcacgatccaccgaccagagcgcgggcggtgggcgttcgcggcggcggcggcggcaactgcgagagcgccggcgtacgagggaggcgtcgtcgcgaggaggaggaaaaggaggggttttgcagcagcagcagcatcaacacgacgacgcgagctgggcttggtcagatgggcctccgcggcgcgagcccagctaactcagattcggctcggcccataagaaacccgtgggggagacgagtcggcccggcccagtag

SEQ ID NO: 1480 - DNA, 381 bp, Oryza sativa
ggtttccccaggtccgacatcgacatcccggccgtcctcgcccagcgccgcaagctcgccgaattgcggaatgatcacaaggatattacgaacaaaattgagaagaatctggaagttttgcactcaacaaaattgtcaagaaatgaagcgtcaatccctgcaagttctggcacacctgcttcattgcacagtgggttatctcaaaatgatcctatggaagaagatgctgtgaccagacttccttttgccataattgatgaactgacagatggttctcctgctgctgtggatggcttgcagctttgggatgagatagtaaagtttggaaatgtggaagcagacagagctcttgcagaatcagcgataacattcaacatctaa

SEQ ID NO: 1481 - DNA, 375 bp, Oryza sativa
atggtgagaaaatcatttaatgatggtagttttatccccaatgatatttttcagatggtgccgcatggtgcatcgccggggttaggggggcaatacatgtcgcaggtgccaatgttcccccccaggacccctctaacgccccagcagatgcaggagcagcagctgcagcaacagcaagcccagctgctctcgttcggcggtcagatggttatgaggcctggcgttgtgaatggcattcctcagcttctgcaaggcgaaatgcaccgcggagcagatcaccagaacgctggcggggccacctcggagccttccgagagccacaggagcaccggcaccgaaaatgacggtggaagcgacttcggcgatcaatcctaa

SEQ ID NO: 1482 - DNA, 372 bp, Oryza sativa
atggacgagggggaagaacaagatggggaagagatcaaccatggtatagttagtggccttacaaaggcaagaagcatcgagttgattgctcccctaagagaggaagtgtgcgaatattgcctccaagagccacccacggcacccccgctggttaaagaatttaccgctgattaccttaagaagatcacaatctatttctggttaggtgatgaaaggaagggggattgtccgaagtaccctccaaccgtcattggggtgcaatcttggacgtccatgccgaaccttggcctcaacggtggagatgggggttcggccgaaccccctggtttggccgaaccatgggctggcccaaaccagcccatcttcggctga

SEQ ID NO: 1483 - DNA, 369 bp, Oryza sativa
atggagctatcgatcttggtggctcttgcactgccgatcgaacgcaagcgcctaattaagctggccgggatgtttgacggactggtcatcagccaaaagttccaagatcaaggtcgtcgttggaaaaaaaaaggttgggtggaagcttcgattattggtagcttaattcgcgttaagcaagcgatcgaagtacggcagaggaatggcggcatcgatcaccatcaccaagtctttgctgggaagagtacgtccgtgcaatgcgcgtcgtggaatagtttgagtagtagcctcgatcaccatctgtttttgctcgcccttttccccgttgaaatccaacctaggcctggtttagggtgtgttcgggagtga

SEQ ID NO: 1484 - DNA, 369 bp, Oryza sativa
atgtcgcaaatccagagcttctcgcggcagaactgcgtgctcctcgcggtgctgtgtgggaagcacgctgagaagcgtgcccaggcgaggtcggggctggaggcgaagcggctgcggccgtcgtacccgttcccggagctcagctcgtcggggagattggaggtgcacacgctgttcaacccgacaccagagcagttcctcgaggcgcagcgcgtggttcagcccaacttcttgtacatccaggggcaacagcttgaggatgagaaggagattggctcgctcgtctggggggacaatgacgtatctgatccgcaggcgtttagttgtctcatcagcccgccatttccgaccatattgaaagagcagtag

SEQ ID NO: 1485 - DNA, 354 bp, Oryza sativa
  misc_feature (3)..(3): n = any nucleotide
  misc_feature (9)..(9): n = any nucleotide
  misc_feature (15)..(15): n = any nucleotide
  misc_feature (18)..(18): n = any nucleotide
gcnaaggcnagggtngcngcgggtagaggagagctcggggaaccttttaaaggggctcggaggcggcggcgaaggcccacggcgaccggcgacgagaaggaaaattcgggctcggagagagaaaagccgatccgattcgaactcgaatccaacactttccaagccgatttagccgaagattccaaaggggaaaaggtggaggagatcccggagattgtttcccctcttaagattcggccggaaacggaaaggaacggccggattggaaagcggcggcggcggcacgaaactagacatcatcaccagcacctctgcttcatcggccctgacatctccgctgttgctaatggatga

SEQ ID NO: 1486 - DNA, 351 bp, Oryza sativa
atgaataagcccgaagttgttgtccctgaaatagctgaagccttggcgattagacgtgcgctgatcctggcacggggaggagggataccagcaggttatcatggcctcggactgcctctcattcatccaacgcttccagtctccaacgagatcgttctgctgctggttgcgtgcatatacaacgtattagagttacaacgactcacggctggtcgacgccggcagccgctccctctcgctatgctaagtcgctatgcggttacaacagacatgcccctatttatgagagatcctaggatagagtccgactcatactctagtcctaatacctattacaactccaagtcttaa

SEQ ID NO: 1487 - DNA, 334 bp, Oryza sativa
  misc_feature (124)..(124): n = any nucleotide
agccgaggccgcttgggcagacccggatgcgttggcggcggcggcggagaaggcgatggacgacagttcggggaagttggccgtggcgctcgacgggtcggcggacagctcggcgacgcagagngccgccggcgctggtggcggcggcggcggcggcggtaccgacgccggtggcggcacgcgcttggcgtggccaccgccatggccgtgcttggaagaaggccccgcccgtgagcacagagtgctcgacgggagaaccaccaggacgaggaggacgatgagcaccattgccgatggcgccattgatgccattggtgtttctctccttgtgcct

SEQ ID NO: 1488 - DNA, 321 bp, Oryza sativa
atgcctcgagatagaggagcgtcatcaaaaaccctcgccgagctcggatacgtggtcggcatggagctccaggctggatcaggacccggggccgtttacgagtgctccttttattctgaagaagagattgtagggagtcgtcacggccagttgctcgatcgggtgattaagccgatgatgtgggggctaaacgcatacaatcttcacaccgcacaggacgtagagctcatagccatttcagctaaaactatgagcaactatgagctcatagtctatgattttggaggcaccggccgcatcatccctgcgcttcaagaatag

SEQ ID NO: 1489 - DNA, 300 bp, Oryza sativa
  misc_feature (45)..(45): n = any nucleotide
atggagggtctaatccgcgcggcagcggcacggctcgaggccgcnatggaaagcgcacgcggcgacgggatggcgacggcgaccggcgcggcagtggtggcgcgcggcgcgaggcggcgatgggatgcacgcgcggcgcggggcaggacgcgacggcgacggcgcggccgcggcgatgagatggcgatggcgacggtggcgcggcggcaggcgacggcgcgcggcggctcggggcgcgaggcggcgacgcacggtgacggtggcgacagagagagggggaaaaaggaggagctgggttag

SEQ ID NO: 1490 - DNA, 11919 bp, Oryza sativa
  misc_feature (4425)..(4425): n = any nucleotide
  misc_feature (8000)..(8000): n = any nucleotide
atgtcgataatgcggagcagtgactgggaagtgctttgcagatcgaaagtatcttgtcaagctgtgctggtatcagcacctcagcagttcatacaagtgctttttggcgactgtgagagtacacatcttgatgctgttactcgacactacaagagcatagcgctcagagttgcaactgtaattcagaatttagggaatttatcggtttggacaatttacttctgcttatcactgacagttatggcctggaagcctggaatgtggtgtatggctaaaaatatgcaaggtgatgtagaactcacgaacatgcagttgaagcctgaggctctcaattcattaaagttacctgtgagggtgaaagctggttttcttggttcagtgaagctcaaggtcccgtggagcaggcttggtcaagagccagttttggtttatcttgatcgaatatttatattagctgaaccagcaacacaagttgaaggttgcagtgaggatgccgttcaagaggcaaaaagaagtagagtcagggaaatggaaatgaagttattggagagccaacaacagctgaaatctgaactgaattcgtcatggcttgggtctttcattagcactgtaattggaaatattaagttgtcaattagcaatattcatatcagatatgaggacacagagagcaatccaggccacccttttgcagcaggtttggcactctcaaagctttcagcatttactgtggatgatcgtggaaaggagacttttgccacaggcggggatttggaccgagttaagaagtcagtcgaacttgagagcctggcattgtattttgattctgatagcagtccttggagtgtggataagtcctgggaagatctattaccttcagaatggagtcagatttttgagttcagaaagcaggacagttctaatcctccttcaaaaacacacacttacattttacgacctatctctggcaaagccaaatatacgaagatacaacttgatgaagcaaagaaaaccggacaggctttgcaaaatgcagctgttgatttggatgacgttactttgtctttgtctaaggatggctacagggacgtcttgaagatggctgataatttttcttcttttaatcaacgtctcaaatatgctcactaccggccatctttgccagtcaaatctgacccaaggtcttggtggaagtatgcatacaaggtggtggttcatgaaacaaagaaagcaagtggaaatctatcatgggagcaactactgaaaaatgcaagacttagaaagacatatgtatctgtatatgcatccttattgaaatctgacatgagccgattggttgttgatgataacgaggatataaagaaacttgatcgtgaactagatatagaagtcattttacaatggaggatgttggcccacaagtttgtagagcagtcagcagaaacacatcaatatgctcaacaaaataagcagcagtcctggtggtcatttggatggactggctcttcaaaggatgagggagactcaaagagttttagtgatgaagattgggaaagattgaataggattattggctacaaagaaaatgatgactatattcctgttcaacaggatatgaaattgatgcagttctattttgaaatacgcatgaagcataatgcatcgaagcttatcatcgataactcagagtatcttgctgatctgtcatgtgaagatttctgttggtgcttttacctgaaaattgaaattcatttgacaccaagagtagcccttaccattagccagactctggcgatagagactgctgctgctgtgcaggagatatgggattcccgtgcttcagaagagcaggatatgtatctgaatttcaatctagtgctaagtgatgtatctgcatttttagtggatggtgattaccattggaatgaaagatccaatgaagtaaatttattgtcagttatcgacaagtgtggaattgctttaaagcttcagcagatccagttagaaagtgcactatacccttctacaagaatggcagtacgggttccatccctgggttttcatttctctccagcacgttatcataggttaatggaaattttcaagatttttcaagataatgatagcgacaaaaacagttcagatcttgcacatttgtgggatcaggctgactttgagggatgtaaaactgttaatatctatgaatgtttttgttatgagccactagtagttttcagcgtatatttgcggagaggatctttatcgcaacttttaattcttgaagacactggcgctttgattatgttgtttgacaatgaggaagcacgaaggatatggcagaaccgcttgcagggtgctatataccgtgcatcgggttctgccgcactttccagctttcctgaagttgcattcccatcagagacccattccttcaagggcagctttcaagatgttagcattgaaaaattgttcgttgctggcattcttgatgagctaaagatctgcttctcatgtggctatgagagcaaccacaaactcaaaaaagttctgctagctaaggagagcagcttgtttgaatttcgggcagttggtggccaggttgaactctcaatgaagggtggcaatctactaatcggtactatcttgcgatctctggaaattgaagatcagtataactaccctggtagtcctgtaccaaggtatttggcgagatcctttatcaatagcgtgcaaaccaacgaagtcccaactcctagtcgaaagaatagtgcaggacctagaggtactgcactgaagaaaagtgacagtgaagaaaggttttttgaagcatcagatgattttgatgaatttgaaacacctatgctgcatgagaggagtatatcagattatttcagcacacagaactttttgcctactagcctcccttctttgcagccacctgcattcagtcgaattcctggtttgctgccagatattgagcttcaatctgccggattcacttcaggggacattacttttgaaagttttgtgaaagctcagattgtgatttatgatcagcagtcccctcaatacaacaacttggataacagggttgtgataagtgttgctactctgacctttttctgtcatcgaccaactgttattgcaatcatggaatttatgaatgccatcaaccttgcaaatgtccctgatgctgataaaaataaagatacaacatcggatcctgtagaacataatatggttgaggaacctaagtctgatctggaagcaggaccagtcataaaaagattactggctaaaggtaaaagcagaacagtttttcatctaacatcaagcatggcagaggcacaaatattattaatgaatgaaaatggtgaccggcttgctactttatcacaaaataacctctcaactgatataaaggtgttcacatcgtcgttcagtatagaggctgcacttggaaaccttaaaataagcgatgacagtctttcttgcaatcatccctacttttgggtttgtgatatgcgtaatccaggaggaagttcttttgtggagattgactttagttcatacaatgttgatgacgaagactatagtgggtatgactatagtctatcagcgcagctttcagaagttagaattgtttatctcaaccgttttgttcaagagattatcaattatttcatgggccttgttcctaagagctctgatagtgttgtaaagctaaaagacaatgtaactaactcagagaagtgggttagcaaaactgatatggaaggatcacctgctctcaaattggatgtctctttcagtaggcctataattgttatgcctcgtgaaactaatagttctgatttcttggagcttgatgttctatacataaagatccaaaataaattccaatggatcggtggtgacaagaatgagatgagcgctattcatctagaaattttaacggttacgagcagaaaaataagtgggattctgggaattgtacttccttatgatgattacgctgtattccttatatctgttgagaacatatattttttggacaagaaagtaaaggacataaatctaactattggtatgaatatggtgtgtggtgaaactataattcaagatgtggaaggtctctccttcgagatccatagatcattacgtgacctgatgcatcagttaccagcggtggaggcttcaattaaggtggatgttctgaaagcagcgttatccaatcgagaatatgaaattatatctgaatgtgcattgtcaaacttctccgagacaccacatgttgtgcctgctcttgatgatcctcgatatggaactactacagctgaatctcatgtatcttcatcttcttcatctgaaagtattcaagatttgtctcaagatgcggagacatggataactaataaaatatcngtttcgataaatctggttgagctttctcttcattcaggatcgacaagggactcacctatggctagcatgcaggcaagtggcgcatggcttctgtataaatcaaatacgagggaggagagctttctttttgctactctcaaaggcttttctgtttttgatgaccgtgaaggaacaaaagatgagttaaggcttgccattgggaaatcagcaacagttagagacacatcatctgctgatggctatgataatcctaatgaacttgattcaggtgaacgaagaatacaaaaagatctaggccttgagccaatcccctcaatgctcatttttgatgctatcctgcgaaaatcttcgtcaactgtgtctgtgtgtgttcagcgtcccaagtttcttgtggcacttgatttcttgctagcaattgtcgagttctttgtgccatctgctcgtagtctgttatctaatgatgaagataaggaccttctgcacatgacttctccactggtattcagtgatcaagtttactatcaggagcgttccactatgagtatttcacctcagaaacctctgattgttgataatgagaagttcgactactatatatatgacggaaaaggtggcaaaatatatttgcgggatagggagggaaaaattctgtcaggccctagtgctgaaagattcattcatgtgctctgtgaatggtattgctctgaacatctagctatacctgaggctattggaccagagcttactttctacagcacatcaagaaattctggtgaaaatttagcactatcaactaaggttattcatgcccgtacagatgcattttgcaggcttataatgaagggtgacagtatggagatgagtggaaacatactcggtttaaagatggagagtaatggcatcagagttatagaaccgtttgacatgtctgtgaaatattcaaacgcatctgggaagacaaatttgcatctgctggtttctgagatttatatgaatttctccttcagtattctgaggctgtttttagctgttgaggaagaaatttcagcatttctcaggatgtcatctaagaaaatgtcactgatgcctcaagttttaaggagattgattcttttttctaggtggaatgactctcctactaaaggagttcttgctttgaacacaaacattgtaagggtcaaaaggcctttgtcatacaaactagtttggcgatctggacctccacaaacaaatgaacttcaacacagtgagaaagatttgaagaacaagccttctaatgttgaccggttctgctcagtttggttacctgtagcacctgtgggctatgttgcattgggttgtgtttcttcaactggaactgctgaaccacctttatcgtcagttttttgtttgtctgcttccttggtttcttcatgtggcctaagggattgcattccactgagcggtaatgccaatatgtcattctggcgggttgataatgcttttggttcctttttacccggagatccagcacatatgcgtgtagatggaaatgcatatgatcttcgccatatgctgttcaatgatgcggactcttccaagactagctctatagggcaagatagtcacaatgatgcttcgcagatagagagatcagcattgacctcaggtcggctatttgaagcagtagcaagctttaaactaatttggtctaataatggcatgtcttcaccaaagaaactatctatatggcgtccaatgttgtctgaaggaatgttttactttggtgacattgctgttaacgggtatgagccaccaaattcagctgttgtacttcgaaattctggcgatgatacctttctcagagctcctgaaggttatcagcttgttggtagaattaagaagcacaggggtactgagggtgtatcgttttggtttcctcaagctccaccaggttttgttgctttaggatgtgttgcatctaaaagttcaccagcgaaagaggacttgcatttcttaagatgtattagaagtgacatggtgaagggaggccaattttcggaggaaagcgtgtgggactcatctggtgctagaacatctgaaagttttagcttatggaccgttgataatgatgttggtacatttcttgttagaagtggatttagaaaacctccaagaagacttgccctgaagcttgctggtccacctacatccagcagttcagatagcataattattgatgctgaaatcaaatcattttctgcagtttcatttgatgattatggaggaatgatggtaccattatttggaatatcatttaatagtgtggggtttagttatcatggtggtcctcaacatctaaatgctactgtgggtttgtcatttgcggcaagatcttataatgacaagtataattcatgggagcccttcattgaaccaactgatggctttcttaggtaccaatatgacatgaacacaccaggttctccagggcaacttcgtattgcctcaacacgagatctgaatatgaacatatcagtttccaatacaaacatgttatcacaagcttatgctagctggaacaatattagccttggcaatgagttatacaggatggaaacgtcttctactagtgaaaggtcgattcttgatgtgcacgaaagaagaagttattatgttatcccacaaaacaaacttggccaagacatatacattagaaccactgaatataggagttcagatgttacacttctgtcatctggggatgataggtctataaaagttccagcttcaagggatcttctggattctcatttaaaggggagatctgttaggttatatcgcttgatggttactgctattattgccaatgctgagattaaggttggtgaaggactagccactggtgaatatatggtagcactacggatctattcagaagattgtattgcatctggtgttcagcaacaaagtgctcgtacctgtgctgctgctggagaccaatcttcacaaaacataagaaaggtggaatggaatgaaatgttcttctttaaagttgaaagcgaggataattatgttctggaatttgttgttcttgatgctggtggaggccaaccagttggtatttactctactccattgaagcaagtggtgcagaagcttccttctgcctctggttctaactatgcaaaatttgatttgactttaggaggtcttacttcaaccaaaacagtggaacatgaaactgttaaatctagtggaaaaataagatttgcagtgcttatttctggtagggctagcacaaaacaggggtgtagagccaatcaggccagaagcaaggctggatacattcaaattagtccctccaaagaagggccttggacaaatatgaagctaaactatgctgtaccagcagcatgttggaggtttggcaattgtgtgattgctagtgaagctacagtcaaggagggcaatagatatattagcatgcgctcccttgtatcaattactaacacgactgattttattgtcgacttgcgcctaaaaggacgatattctcgaagttctcaatcagatggacagggtgagaattctantaaagatgatcacatttctgttggacttctagagcctggttctactgctccaatccccctgtcaggtatctcaaatcctgttgtgctttatacgctgcaactaagaccaacaaatcatcatgagctagtgcagtactcctggagtgatgttcaggagagacgcagccaaactgagtaccgcaatgaggagatccttgacatatttgtatctgatctgtatgaatcagagaacttactgttctgtgcgcaatcagatggcacttccagtacttctcaagggctatggttttgcttaagtatagaagccaaggaaataggcaaagatgttcacacaaatccaatatatgactggagcatcattatcagatcaccattgtctttatcatactatcttcccatttctgcacattatgttcttagtgctagccaccttgatgaggaagatacaagttgttcgcagggtaccttaaatcctggtgaggtggttagggtccaaaatgttgatccaaggaatcctttgtacttgtcacttgttccacatgggggatggacatcacatgaacctgttcctatatcacatcccaccgtagctccatcaaaatttattaatctaagaagttctctatctgaaaggattgtacagattgtacttgaacaaagcagcgataaggactatttgatggcaagagctatcagaatatatgttccctattggatatcttttgcaagactgcctccgattaacctgcaattaattgatatctctggaagaaaagacaagaggcgttttcttgcacgccctcgttcagaaaggagcgagaaaatactttatgaaataaaccatgaagaattggttgaaggatacactatagcatctggtttgaacttcaaaggcttagggctctcagcaagtgcctgcagacatgggagtggacagtttggattgctcaaagaactatcacctcttggcgacatggatggtgctgttgatatttctgcctatgatgacgatggaaaatgcacacatattcttctttgctcaaaaccatcctcatatcaggctgttccaacaaaggttatctatgtacgcccatacataacattcacaaacagggctggacaagatttttacataaaacttagtgctgaagatgagccaaaggtgctacatgcacatgactggagggtttcttttatgcactcagaaggaggaactgaaaaattgcagcttagatttggttatgcaaaccactgttatttgaaaatgtgtggctgtatggtccggcttgtggatactgactggtgtcagcctctggatatagtaaaagaagacaccattgttatagtaatgagaaagcaggatggtacccagaaatttataaaagctgagatacgtggctatgaggaaggttcaagattcttgattgtatttcgtttggggccatcagatggaccaatcaggattgagaaccggacaagtagtacaactatcagtgctcgacagtctggtttgggagaggattcttggatacaagtgaaaccactttcaaccaaaaaatattcttgggatgacccatatggacatacaacttttgatgttagcatccagcaaggagatgttactttctttcagtgtgttgacctggaaaaccctgatgaatgttccgctggttttagagaacatcacctcaagctcagtatagttgagactgctgatgttaagattttgaagtttgctgattacccaagaagacaagagggagggtacagatctgatctgggtgatcaccaagcctcgccagttatgcaaaatgatacagatacaggtgctggactattggaacttattgttgaacttggagttgttggagtctctttgattgatcataaaccgagagagcttttgtacttacatctgcagaagctttttatttcatacatgactggttacaattctggtaccactagcaggtttaagttaattattggccatatgcaactagataatcagttgccattgtctataatgcctgttgctttggcaactgagagcatgcctgactcaaaccatcctgtatttaaagcaaacatcgccgtaactgatcaaacatggaggttgaatattcatgaacctattatttgggcattggttgatttctacagcaatcttcgttttgtcagcaccaacaacatctcaactgtaacagaagtggatcctgagatacgaatagagcttgttgatatatcggagataaggttgaaaatatctctggaaactgcgcctactcaaagaccacgtggtgtccttggcatatggagccctgtcctatcagctgtaggcaatgcacttaagattcaggtgcatctgcgtaaggtcatgcacagaagtcgttacatgcggaagagttccatcattcccgcaatcacgaaccgaatcaagagagatctgatccacaatcctctgcacctaatattttcagtagattttcttggagtgacaaaatcaactttgtcatcacttagtaaagggtttgcagagctctctactgatgggcaatttcttcagctgagatcaaagcaggtttggtcaaggagaataactggtgttggtgatggactagttcaagggactgaagcatttgctcagggtttggcttttggggtttctggtgttctaagaaagccagtcgagagtgcccgacagtatggtgcaattggcattgcacatggtcttggccgtgcttttgtggggtttattgtccaacccttaagtggggcctttgatttcttctcattgacagttgatggaattagtgccagctttatgagatgcgtggatattctgaataataaacatgtccctcagaggattagagatcctcgtgctatacaccgagatggtataataagagagtacgacaaagtacaagctgcgggccagatggccctttacctagcagaggctagcagatattttgcatgcacagatttatttcgggaaccttcaaagtatgcatggtcagattactatgaagatcattttatcgtacaaaatcagaaggttgctttggtaacaaacaaacgagtgatactgcttcagtgcgtggatctagataaaatggataagaagccttcgaaaatactttgggacgttccttgggaagatgtgcttgcattggagctggcaaaagctgggtatcaaaggccttctcacgttcctgggggccagcacgatgtatatttcgcatttgatgaagatatgagggagttccacagttttgctaggcctttgctaagcccaaggggagcagcaagtaatgttgaggagcgactcattaacgatacagttaacttccagaacatgtggagcagtgaacaagaaattcgaagcagatgcaaactactttcaaagcaggttgcagatgatggaagggtgtttagtatctggaggcctctctgccctagtgggtatgtctcaatcggagatattgctcatgttggcattcatccaccacatgttgctgctgtctacaaaaatgtgggtggaaatttcgctctgccacttggctatgacctggtttggagaaactgtggtgaggattacaggaatcctgtatcaatatggtttccacggccacctgaaggatacgtagctctcggatgcgtggctgtatctgcttttgaggagccccctctcgactctgccttctgtgttagtgagagatttgcggaagatgcagtatacgaggagcaaattgtatgggcttcgtcagatgcctacccatggggatgctatgtttaccaagttcagagcaagtcactgcaattcatggcgatgcggcggccaaaagaagagtgtgagctaaaacctaagaaggtatcagagtcttatgcccagcaagcattggagaggtcctga

SEQ ID NO: 1491 - DNA, 5514 bp, Oryza sativa
atggacccccccgcccgcagccgcaggtgcactctcctcacgcgggccctcctcctcgccgtcgccgccctcgccctccgcctcatctacgccgccttcctcgccggcatggcgctctacccgcccctccccgccgccgccgtccttggctccaagacctacctccactccgccgtcgccacccccgacgcctggcgcacccgcgactggcggaaggccgtcgactaccacgccaccctcctcgccccccacctcgccgacggcatcctctccccgacctcccgcgccgtctgcctcggcgccgtgcaggaggccctcgccatgcgcgagctcggcgtctccaccgccgtcgccgtcgccaggaagcgctcccccccgctcgccgtcgccgggaacgaccgccgcctccccttccaggactcctccgtcgacttcgtcttcgccgcccgcgccctcgactcctccaagcgcccggctgacctcgccgccgagtccgcgcggatcttgaagccagatggacatctcgtcgtcctcactaccagcgccgccgacgcattcagcctccgcgcgctccaggcactcctcccctctctccgcttgctccgatctcgccagatcaaaggccccgacgactccaccctgcgggagctcgtcttccagaagatccaggactccactgacgatcctgtaaacaagtgcacaattggggatcacaagctccaactcctcacacatgcggagccactcatccaagaggagccgcgcaagccatggatcacgctaaagcggaacatcaagaacataaagtatctcccaactctcgcagacatcagcttcaagcgcaactatgtgtatgttgatgttggcgcccgtagctatggctccagtatcggcagctggttccggaagcactaccccaagcagaaccatacattccaggtgtttgccattgaggccgacccggccttccactctgagtacgccgcaaagaaggctgtcacgttgcttccatatgctgcttgggtcaagaatgagaccctcaattttgagatcaatgctgatcccgggaaggaggatgaggccaaggctaatggccgcggcatgggccgcatccgccccatggctggcaagaagatgtccggtgaggtgcggagtgtcccggcattcgactttgccgagtggctcaagcgcacggtgtcggagcaggactatgtggtgatgaagatggatgtggaggggacagaattcgacttgatcccaaggctgtttgatacaggcgcaatctgcttgatcgatgagctgttcctcgagtgccattacaaccgatggcagaaatgctgccctgatagagctgaagcatttgagatggcaaaaggggtctcatgcttctactggagtattcagtttccaaatttcaaagaccacctctgtttcagaaactgcagcaatgctagtagtacaaggcacttcagttacaggtctcttttgatccgaacagaaaagccagttactactagaaaccatgcatatgcagaagtagttgtatttgtcttggatcagaatcctatgtttttcctattcctccgttttttctaccctgcgattcaaaggggccctaactgctggtcatctgctaactccacagtgatgaggcaagcatttgaggtgttttatgatggatcatggcatggggtaaattgtataaggataaggaacggcaacctgtttgttaaatttatctactctggatcaacagtcgagcataatgttgatggggattgtctacgcttacggtcgagaagggcgacttgttctgattgttcaaatgttctcaagccaggtgttgatgtctgtgtgcagtcatctcatacacccgaagcaagttcacaaggaggaacaaacgcttctgtgttactgcgtcatgatgcaaggcttatcacaatcaagaagaatcatcaagaagataagtgtctctgcttgtttgttgttatactctacaagaaccagtgtcctggcaatgcagaaaaagtgataactgatagaagagcagaggtagtaaccataaacgatattttcctcctgcaaaagcttcaacctgaggtccatgaaggaagcatgaaatggagtttttcaaaggatcgcctctctcttaataaaggcaggctaataagtgctagattctcctcagaaattacacatctgatagtcttgtcgatcttgaggggaatggaattcaacatcaaattggtagaaggccagatcgtttatcaaataatcaaaggagatcaagcacaatggaatcttgattccatggccatccctccaggcttcgggaatacaatggagataatatcattccaattgcgtgatgaggccttgcgcccaacaatcacaaatatccctatcactcatgtgaaaaagaacaatatcacagaagacatgagattcactgtgaagagtgaaatggatagtgaactggatagggcattagatgttgagatcttgtatgagcatgtggatctgaggcgttcaaagcgcttgaagactcagccagatcgctttacaagttacgatacacctaggttccttagtggctacaagaagaaagaagcaagttcatcacccaccaagcatgtaaggggagctgtgcattgtgattcaccggtagacgattccaaaaaagaagtagaatcatgctgtgtagagattccagggaatgttacacagaagcaaacaggtgtacactctcccatggtcgatgaaaagtcaaactctccagaaggacagcataagaacacaactaagagaactacatgctctcttgtgaaggaaaaagcaagctctccagaaggacagcatgagaaaacaacaaagagaactacatgcgctttgcctgtgaaggaaaaagcaagctctccagaaggacagcataagaacacaataaagagaactacgtgctctttgcctgtgaaggaagagccaagctcagtggaaatagaggagaaaagctcaaaagagcaaagcacccttggtgttaactgtgaaccagcattctgccaaaaggtgggcgggaaaagaaagaggcacatgtgcgagagagaatacaaacaaatgattgaccaatgcataggaaacattgagagtgaaatggagagggactctatgtttaacttcgatgccaatatgatgaattacgttcagcattcttatcgagaagaggattttacatggccaccttctgctgataaccaagaggtggaggaggatgagcttgaagaactgtggaaagaaatggattattcactgacgacattagcacttcttgagcaaaagcaggtgatggctcaaagtaggataaacatgctggtggataattttgatgggttgaggctggattgtttaactttgacggatgattacagatgctattatcaaaaaaaagaaaagtttgcagagtcaggatcagttaatgagagcaccgattattttggaaaagttggaggaataccatgccatcatgaatgcatactggatgaggagcttggactagcatgcagattatgcaatgttgtatgcactgaggcaaaggatatatttccagaaatgttcaatggaaatgactacaaggacagacctggatgcagcaatatttgccttgatgatgatatacttgatccttctcttcttgcaaacttggcaccagagttgtcagaattgaagaactcagggagcgtgtggagtgcaatatctgatcttgatccaaagctgcttcctcaccagagaaaagcactagattttctgtggaaaaatttggcggggtcgatacaggttgaaggaatggataactcaaatgtcagtacaggtggctgtgtgatagcacacactcctggatctgggaaaacactgctgcttatctcatttctggtgagttacatgaaagctcacccaagaagccggccattggtccttactccaaaagctgcaattcatacatggaagagagaatttgagaaatggggcatttcacttcctttacatgtgttccaccatgctaacagaagtggcaagccgttgggggcaatggattctaaactgcggtcgttattaaataattttcacagaccaacctggacaaatatgcgccttatggattctttggacaaactattcaagtggcatgcacatccaagcgtcctcctcatgacatactcatctttcttagggatgacgaaacaagactcaaaagtgcgaaaccgataccgagaatttatcgcagaggtcctgatgaacaaccctggactcttgattcttgacgaggggcacaacccaagaagcaacaagtccaagttgaggaagctgctgatgaaggtgaagactgagttcagaatcctcttatctggcacggccttccagaacaactttgaagagtacttcaacaccctatgtttggccagacctcggtttatcggtgatatcatgagtgaactagtgccagagaggaaaagagaaacagttggcaggagagccaaacatcaagaagcagtggcacgccgcgcctttgtggagaaagtgggccagaagattgagtctgacaacaaacatatcagaagtgatggtatcagtttgctaaacaagcttactcgtggattcatagattcattcgagggagcgaagctgatcaaccttccagggatacatgtgtataccgtgttcatgaagcccacggacattcaggaggagatgctggcaaaggtaacaatgcccaagctcgggtcgtcccggttccctctagaggttgagctgctcatcacgattggctccatccatccttggctcataaaaacgacgaaggccgtcagcaccttcttcagtccagccgaagtgaagaaggttgagaggtacaagcgagacttcgcggcggggtgcaaggccaaatttgtgatcgatctgctgcacaagtcgtcgttcagaggggagagggtgctgatattctgccacaacgtgtccccgatcacgttcctggtgaagctgatagagatggtgtttgggtggcggctcggggaggaggtgctggtgcttcagggtgatcaggagctgcctgtccggtccgatgtgatggacaagttcaacggcgacagcgcggggaagaggaaggtgctgatcgcgtcgacaacggcatgcgcggaggggatcagcttgacaggcgcgtcgaggctggtgatgctggactcggagtggaaccactccaagacgaggcaggcgatcgcgcgggcgttccggcgtgggcaggagaggacggtgtacgtctacctcctggtggcatctgggacatgggaggaggagaagtacaacagcaacaggaggaaagcttggatgtccaaaatggtgttcctgggacgctatgttgatgattcctcgcaaaaccgtgtcactgacatcgatgatgaggtcttgaaggagcttgccgatgaagatcacaccggcaccttccatatgattgtcaagcaagactga

SEQ ID NO: 1492 - DNA, 5241 bp, Oryza sativa
  misc_feature (2310)..(2310): n = any nucleotide
  misc_feature (2392)..(2392): n = any nucleotide
  misc_feature (2525)..(2525): n = any nucleotide
  misc_feature (3097)..(3097): n = any nucleotide
  misc_feature (3167)..(3167): n = any nucleotide
  misc_feature (3378)..(3378): n = any nucleotide
  misc_feature (3765)..(3765): n = any nucleotide
atggacacacctctgcactgcgcggcgagggcagggcacgccggcaccgtgacgatccttgtaaatctggcccaggactgcgaggagaatatcctgggatgccagaacgcggccggggacacggccctacacatggcagcgaggcacgggcatggcgccaccgtggaggctcttgtcgtggcacttgttgagagcgttgatcaattccctaagagatcaatactcatggcctcgtcgtccagtacggctgccacaaatccgttccaaggccacccaatctcagagaagcttgggaaggcaaatcatgcgctctggaaggtgcaagtaagcgccgcagttagaggagcgcggcttcaggggcatctcaccggtgcaaccaagcggccgccggcagagatcgctgtcacaaaagatggcgccaccaagaaggagccgaacccagcccatgaagactgggaagccaccgaccagcaagttctggggtaccttctctcgtcgctgacaagagaggtgctgatgcaggtcgctacatgcgacaccgcggctgaagtgtggagcgccatcgagcagatgtactccacccacacacgagcaagagcgattaacactcggtttgctctcaccaatacaaagaaaggagatgagatggctactgccggaggtcgcccgatcgatgaagaggagctgattcagtatatcatcaccggccttggcgagggctacagcgaggtggtgtcggctgtctgcgctcgggttgaaccaatctctgtgagtgatctgtactctcaagtgttgaactttgaagctcgccaagccatctaccgcggcgcacaggaggtcaccgtcaatgttgccaaccgtggaggcttcagccacggggggcgtggcaacagcaatggtggccaaggaggttcgcgcggcggcggcgacggcggcggccatggtcgcggcaacggaggaggtggccgtggtcgaggccgcacaccaggaggcgttgataaaagaccaatctgccaagtgtgtttcaaacgggggcacacggcagcagattgttggtataggtacgacgaggattacgttcctgacgccaagcatgttgcagctgcagcggttaactcctatggagttgacacaaattggtacatcgacactggtgctacagatcatgtcacgggagagctggacaagctcactatgaaggaaaaatacaacggtggtgaacaaatccacacagcaagtggtgcaggaaaaactctccttaagggaagatcatggcgcaggctatatcctctaccacactcctccttgaagcaagcctacagtgccatcaaactatctttggaccggtggcatcatcgtcttggtcatccttccattaccacgcataagtctcaagtgtttgacaagtttcaggagtttcaagtcatggtagaacgtcaatttgatagaaaaattctagccatgcaaactgactggggaggcgaatatcaatcccttaactcttttttttctaagattggcattgttcatcatgtttcctgtcctcatactcaccaacagaatgggtcggctgagagaaaacatcgtcatatagttgagatcggtttatctctcctatctcatgcatccatgccattaaagttttgggatgaagcctttcaggcggcaacttatcttattaaccgtgtgcctagcagagttatccataatattagtccccttgaaaaactgttcaaacaaaaacccgattactcctccttgagaatttttggttgtgcctgttggcctaatcttcgcccctacaataaccacaaattacaatttcgctctaagcgttgtgtttttcttgggtttagcactatgcataaagggttcaagtgtcttgaggtctctacaggacgcatctatatttctcgcgatgttgtctttgatgagaatatttttcccttcactgaacttcatgccaatgctggtgcccgtcttcgttctgagattgatattctcactcctgaactgctaggacccatacggtctgttgggaatgaacaatgcatgcatccagtgactaatccattatctgctgatgtttctgctgctttatctaatcgtgctaatgagccacatagagatggtgcagtacatcccgctgatgcagaagatccgccggcgacgcctcctctggatgccagttctggtccagaaccagaccgtgtcgtccaccactcccctgcggccacgtcatcaggccgtcatccgggtcccacacctggttctgtgccacggggggcagcatcatcgctagcagagganacagcagaagactcagtgtcgcaggcggtgcaggagcaggagtcgcaggtggtgcaggagcaggagcagtcctcaccagcgnaggaacatgcacaggctgtcacagatgagactaatacattacagcatgcagatgtgactgacacaggttcagaggcaccggcaggaccgcgcaccaggttgcaaagtggagttcgcaaagaaaaggtatatantgatggtactattaaatataagcattcttggtttactgcttcaggtgaacctacaaatgatttagaagccttaaaggataaaaattggaaactagcaatggattcagagtatgatgctttagttaagaataaaacttggcatcttgttcctcctcagagagggagaaatattattggctgtaagtgggtgtataaaattaaaaggaaagctgatggtaccctagataggtataaggcaaggttagtagcaaaaggatttaaacagaggtatggtattgattatgaagatacctttagccctgttgttaaagctgccactatcagaataatattgtctttagcagtgtctaaaggttggagtcttagacagctagatgttcaaaatgcctttctgcatgggtacctagaagaagaagtttatatgctacagccaccaggttttgaggatcctactaagccacatcatgtgtgtaaacttgataaagctctgtatgggttaaaacaggcacctagagcctggttctctagactaagtaaaaagttgatggaccttggttttaaaggatcaaaanctgatacgtctctgttctttctgaataaaggtgatataactatgtttgttcctgccagctcttcagaganggccactgcagctttacttcaggatctaaaaggggaatttgcactcaaagatcttggtgagctgcattattttctcggaatagaggtaagcaaggttcagaatggcattgtactgaatcaagacaagtatgccaatgatttattgaagaaagtgggcatgatagattgtaaacctgctaatacacctctttcagtaagtgagaaactctcncttcatgaaggctcattgttagggcctgaagatgcaagtcactatcgcagtgttgttggtgctttgcaatatttgactcttactagacctgacatagctttctctgttaataaagtttgccaattcttgcatgctcccacaactgtacattggattgctgtgaaaaggattcttaggtacttaaagcaatgcactcggttaggacttgaaattcataagtcaggatctactttaactttacttgcagagttagagattaaaagtccaaaagctgctaaaatatggtgtgataatcttggagctaagtatttgtcagctaatccagtgtttcatgccagaacgaaacacatagaagttgactatcactttgtcagagaacggttgttnagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacagaccgagctaaacaaagccggtgtgtcaccgttgtacttggcaagtgatgagcaggctcagtgcctgccatctcaagcacaaaacaagaatgtgtttgtcaactcgattgataaatttgtgtctttggcagagatggttcacttattattgcaatggaagccagaactggctagccaggtcgactgcaatggcagcaccccactccatttcgcggcatccgacggcaaccgcaaaatcgtacatgcaatcctagccatcgtgccaactggcacagtgtacatgaaggactcggatggcctctccgctcttcatgtcgcggctaggttgggacatgccaatgttgtcaagcaactaattgggatctgccctgatgctgttgagctccgtgacggccatggagagaccttcctgcacaccgcggtcagggagaagcagtcctcgatcgtgtccctcgctatcaagaaacacaagcaggtcggtggccttctggacgcgcaggacggggttgggaacacgccgctccacatcgccgtggttgccggctcgcctgacattgtgaatgccttactccataaggggaaagtgcaaagcgatgtcttgaacgacgatggacactcgccgcttgatctcgcttcgacatcgaccaatttgttcaacatggtaagctttgtggtgatattagttgcttttggggcacaaggccgaccacaaaggaatgaccatctaaagccgtggagcggccgcgacataggtaaagggatagagaggacaactgacagccttgcggtggtggccgtgctcatcgccaccgtcgcctttgccgccggattcaacatgccaggcagctacggagacgacggcacggcgaacctcaagggcaggttctcattcaaatggttcatggtcctcgacaccgtcgccgtagcggcatcggtggtcgccgtgatcctactcgtctacgggaaggcatcgcgctccgccggctcgtggaagagcttcgtggcggcgttgcactttatctgggtctcgctcgtcagcctgatcctggccttctttgcggcttttcgcgccacgatgagaacctcgagggcagtctccatcgtgttcatggttatctacgtgtgcctcatcgttttggttgtcaatgtcggaacatgggttgaacctgtaacgacgatgcgtatattctggaggtttgtgtggcgcagtcaccggactaatgccgtcaagaggcagtatccattggccgtcgctaccgtctacaactgtcttctcttttcggttataaattttataatatttgccggtttgggagtggtaccgtcctag

SEQ ID NO: 1493 - DNA, 5012 bp, Oryza sativa
  misc_feature (4618)..(4618): n = any nucleotide
  misc_feature (4842)..(4842): n = any nucleotide
acaagcaaggactggatactgagatgcctctttctcctcaatggcttatgaaggtgggagaaaacaaggaacccagtttactgggtgttcgttcagatggttcaaagataccaggaaatgatgaggacacaagcttcagtgtgaaaagaaaggatgttttcagggcctctgtgcttgatggtgaaactgggtgtcgtgaacgctggcgtgatgatgaaagagaaccaaattcagcccctcggtggaatcgctggagggagacagacaaggaacatggtgatacacgcaaactggaaaggtggtcagatgactcctccaagtactctgtggatggtcgtcgtcctccacaggaacgttggagtgactccggtaacaaggagggaaactatgatcaacgccgtgataacaaatggagtgctcgtaggggccctaatgataaggagtctgagaattggcgtgacagatggggtgattcaggcaaagatggtgatgctgcccgtgaaaaaggtttctctcactacatagctcatggaaaagacggcaacagtcatgagaaggatgctgaaagagatgataatatttctagatcatggaaatctagttatcctgtgggccgtggacggggagattcatctcatcatccctcacagaatacacaaaaatcatctgcaacatatggatatggtagagggaagccagacaatgaaattgcaagttttccaggttctcgtggaaaatttacatctggaagtacaaacacagccagttcaggatcatcacgtccattccatcttggcctactttctgacaggcctggtggtacatcaggagatcgcacagcatttagatatagtagaatgaaactgcttgacatatacagaacttctcatgttactgacttcaagatgccccttggtggctgtgaggaactctctgcatttatgcaagaagaaactttggaacctttagcattgtctgctcctactactgatgaagcggccatcttaaaagcaattgataaaggggatatcataaacagtggcgtccatcaggcttccaaagatggcccggttggaaaaaatggtagagaagatcaacaaggaggcatggaagatgtcaagggagaaacagctgcaagtctcagggtgtctgttaaatcattttcccatgctaaaggttgccactgttggtttataataggttttcctggtaatactgatttgccggccagagcggattccttgcggccagaaacatctgcttatgttgttccacaaagatctaggctcattggagaacataggcctggaccaactgctgactatatacagcaaatgccctttgcattagatcaggaaagtaaagtcgctgttattacaggtgttgatggatttgccactccaacttatcctaatccagaaagcttatctttatattacaaagatccacaaggtcaggttcaaggccctttttctggagctgacatcattggctggttcgaggctggttactttggtatcgatttgttagttcgtgttgcaaatgcaccccctgatgcgcctttcttattgcttggggatgttatgcctcatctacgagcaaaggcaagaccacctccagggttcgctgcaacaaaacccagtgacatgctaatgccagaaactctatcaactgggaattttgtcagctcgagtaacacacatgcaggatcagccagtgttggagcatttgacagtgggctaagcaggaaagatggtgcagttgaagctcaaaatcgctttttggagtcgcttatgtctaatagtgttcgtgatccttcagctgaaatgcttgctatgactgcaggtatgactgaatatggcagcagtggcattggtaacattactgtgtctggaggagagactgggaacagcatgacttaccttttggtacagaaaagattgttggagaggcaaaaatctttgcaaaatcctggttcattttggtcaggagacagtattccagctgcacaagtgcaaaacaaagatatagaagcatctgctctacacactaaattgcaccctcccatggctgatccacctcgccaagctttgcaatctcagaatgttgatttgcttgcgatgctgcattctgcagagaaacctcaagcacctgcttctaattctggattgccagcatggtcaaactaccctgaagctaagaatcttgatcctcgtgggcatggtgtggatctcactcaagggtcacttaacatgcatggtgcaagtgtgcagagttcccaacaagccactactgctattcaacagcaaaacttcatgccactgaacatgtcacaaatagctcatttgggacctgagaagttacgtgctgaaatatcccaagacccacagcttttaactaggttgcagcaccagtatctactgtcacagctacaattgcaaccacagctacctgtgacgcctcagcctcaacctcaacctcaactctctatgttggacaagatgatgttgctcaaacagcagcagcagcagcaaatgcaacaacagatgcaacagcaacaacaaatgcaacaacaaatgcaacaacaacagaagcaacgattgcaactgctgcaacttgagcagcagcagcagcagcagctgttgttgcagcaacagcacctgctttctcaagttatacctcatgggcattccagtcagcaacctgatgatctttatgggtcacaacgtacttcattgccaactggtgattcttcgaatcttggccttcagaaaatgaaagaggttcttgaggcagaccgcgttttgactgcccatggtacacaggaggggcagcaacctagtgatccaagtattatgaataagaagggtatggagggtgtaggtccatctcaaagctctgtaccttctttattgccccatgaaatttttggtggtgtaccttcaaaagatcgctactctcacccccagaagttggaagataaggtcaatgtcaatacacaattaaaagccagtatagtgaacccgatgctaacagaagttgcaaataggcgtgaagatgattctgatcaacaggaggttagatctcatgaaaggggcattggaataggaaaaacaggaatcatgtctgaaaatattttgggctctggatcttctgaggtcataggggcagctccaagtgcacctaaggagtttcctgaggcaccgtttgatccaaaacctgaaacattgtcatctcatatttccaatcaggtgcaagatttgaaaatatcttcagaaaatatcctcggtggtagtgaaccaactgtggcaactgaagttaaagcctctgatacacaggacacaaaaaaatcagaaaagaaaaagaagcagaagaagaaacaggcaggtgcggatgtagccaaaggagctacaaagacggttacttctcaacagccaaggcaggaaactctagttggttcagatcagggtggagctaagcatgacttgcaagatgatgcagaggagctattttggggttcccccatccaagtggaaagttcttctaaatctgctgacccaccgctaggattggaatcatctctggttctacctgcgaaaagtttttccgaggattatgatactaacaaaggtgaatgggaacctaatgctgccgcagtaaaccagcgtgggtggaaacctactcagggacctagacctaaatcacttctggaaattcaagctgaggaacagcttagagcacagaggggattagcaatggagaatgctaagccagctgtttctgcagcttcagtgccatcaattccttggaatggcatgctgaccacttcggaccagcagttgatggctcctgatgctcctgcttttgatgatactgacttcattgaggccaaggactctaagaagagcaagaaaaaggcgacaaaagcaaaaggatctgcagtcaaagccccagcacctgttgtttcctttgattcatcgactgtatctgtacctactgaaaagggaaagccttcaaagcaatcacatcaagagaaagaaatactaccggctccaccaagtggtccgtcttttggagattttgttccctggaagagtgatcaggcaagtgcagtacctgctccagcatggtctagtgagtcagcaaaggtgcaaaggcctctgtctttgagagatatccaaagagagcaagaaagaagatctgctgttgcccagcagcaaccaccctcgccaaccccagcaaaggtatctatcaaccaaaggaatcatgcaaatgttccttcctggcaagcttctggctcatctccatcaaaggctgttgctcctgtccagatgagctctaatgcttccagtcgttccaaatccaatgctgaagatgatttgttttggggcccttctgagcatgctaaacaagataagaaacagtcagaattcccaactctttcaagtcagactagaagctccagtattaaagaccagtccccaatgaaccgtcaaaaatcccaggccagcagactgcccctttctactgctcctactgccaaccacgctggtaaagggaaagcagaggcagcaaacaggcaaacagaggcaatggacttcagggattggtgcgagantgagtgggccagactcactggaacaaatgatacaagcttcctcgagttttgcatcaagcaaccaactgttgaggcagaaatgctcctccgggagaaccttggctcttttgaccgcaatggcgagttcatcgataagttcctcaactacaaggccttcctgtcaactgatgtgatcgagatggccttccagctacctgcccgtgctgtccgtggggacggtgcanggcgtgcaaaccatgcctctgcagccaaaggagcctccagcaccgagacggagctggacggaggaaagaagaaagggaagaaggggaagaaggtgagtgcagcagttttaggattcaatgtagtcagcaaccgtataatgatgggtgagatccagaacgtggaagattag

SEQ ID NO: 1494 - DNA, 4986 bp, Oryza sativa
  misc_feature (4750)..(4750): n = any nucleotide
  misc_feature (4764)..(4764): n = any nucleotide
  misc_feature (4781)..(4781): n = any nucleotide
  misc_feature (4787)..(4787): n = any nucleotide
atggcctccgacgccgacgccgacgagctccgcctcgcccgcgtctccttccgcggatggctcggcggcccccgccactgggacctctgggtcgccaagctccgccccctccacgaccgcctctggcgccacctcgggatcctcgacgccatcgtcgcctccacctacaggttcaagcgggacgccgcactcgtcctccacctcgcctccttctggtcgccggcgaccagctccttcgccttcccgtggggcgaggccaccgtctcgctcctcgacgtcgccctcctcggcggcctccccgcgaacggcggcccggtcctggcgccgctgccgagccactggcgcgccgacgaggccgcgctcaacgccgtccgcctcggcttcaaccgcagcgcctgcaagaaggcgcaccactccgcctggatcagccacttcctcaccggcccggccgccgaccccgtcgtcgagcacgccgccttcctctcgctctggctcacgcgcttcgtcctcccggggcacccggagtccaccatgcgccagtcgctcttcccgctcgccgtccgcatggcgcgcggcgaccgcgtcgcgctcgcgcccgccgtgctcgcctccatttaccgggacctgcgcgagctgaaggccttcctgtcatcctccagcgccgccgccaccggcgaattgctctcgccattgtcagtctacgcgccattctaccttctccagctctgggcgtgggagcgattcccggcgatcaggcccgcaaaggcgaaccccatcaaggccggcgagcctagggccgctcgctggaatgatgtcagcaataagatcgacccggcggtgctccgcaaggcgctcaactccgggagcagctttgtgtggcagccgtatacaatctctgtgcagccgtgcggctgggttcgtggctgccatgtctccgggaacgacgagctcacatcgctcgcgcattgcttgcgtgcttgcgagcttgtggggatggattgcattgagcagtatctcccgcaccgtgtcgcgatgcagtttggactggatcaagatgtgcccggggatgttcaacgagccaacgacgattgcagggttgcgtgggagacctaccatttggaggggaagaatgtagctttcttcatcccccagtccgagccaggggtcactgcgcgatatgcagagtggtggaggcagcccttgccacattctcatcttgatgttggtgcagcgagcacagtggtagaatcgaaggtttccaagcgtaaggtgaagaagacactagtagccattgaggccgaggaggagaaggagcggaagctgaagaaggctcgagtcttacctagtaacaatgataaaaagcgcaagctgcaagagttgtatgatgcgaagctgtcagattgccttgcagctgcaagggatgagggtgctggcagctgcgatagggggtccttgccattatctgacatggaatcagaaaaggccttgttgtctcatgttgaaactatcaatgatgatattgtgctacttgtgcccaggaagcagacagcagctcctgatgtaaatttgatcaaggataacatgaatctggctacaggagatagagggagcctcgaagccacaccaccagttggaatggaggagaaggatgagatgccgaaagcccagcagacatgtaatgtagagcatccaacgcaccaaccatattgtcaggagacaaaagcagccccatcaacagaaatcactaagggtgaatcaagtggcattgttttggcaaatgttaatgaactggatagggggagaacacccgatgtccctaattggcatgaagaggctgtaccttcagaggctatggagaaagaagaatccagatatcatttgagtgatgttgtttgtaatgatgaaagcattaaggaagttgtaacagttgataaacctctagatgtctccagtgaacctgaaggaggtgctaccgcaatgccggaggagaaaatgcttaatgtctctgtagacatgtctcttgatgccacagataggccagaagaaggtaccaccattatgctggagttggagaacgaagccaacctttcagttgatgaatcatgtcgtgtgtcaaacagtcctgaagaagtttctgcaacggttggaggagataaagaagaaaaggttgccattgatgaagcggatgaaggaaatggaacttcagaagatgtaggaacagctgcattgggatcaatctgttctattgaagttgcgcctgggagcaaacaggaagttgatacaggtgttattaatatttctcatgatgcagtgactttacctgatgaggtgcttccagttcagcagccaaatgatggagaaaccactcgtcgtgattttgtcactgaggaacagaggaaggcctgttgcatcgaagagattggaggagaaaacagccagatggttgagaaagctagcaagcagaagccccacgaagctcaccaggttaacatggtagaatgtggagaagatattaatcccatgaaaaatgacaatgaggatgagcatgataaaattcctcaaccactggagaatgccatctcggacagcaatatgactagtgtattttcaggtgttcctgaagcagagaatgcagatacggataaaggtctgttcctagcaaagaaagactctgaagacatgcccaaggaagttgtaggagcagagggctcacagcaggatcaatttactacttcaacacatgaagttgtagatgagcacaacgaagttgctgaagtagagccagtcttggcagaaccaaatatgcatggccagtgtgatggtgagaagcccgatgaaggcaaggttttaagggagaaagacactgaggagaatgccaagaatgctcttggagtagaacagatagaaagacaagacaaggcactgacagagagctgcatacatgaagtggagcaggtggatggacaaagcgagagactcacaaggacaggtgttgaggaaaagcatgcagaaatcactcaagaacaagaaaatgaatttgataacggtgtgatggaaacttcaaaggtttcagtcaatggtgcgatgccttatagtacagctagtatacaatcagaaggagagcagaaggaagcttctgataaagatatggcggagaagcaaagcaatcaggatattgagtccattgatgagagggattcattgtctgatgcagctgctacggtttttgaaggagcagatgaccacataactttggacacgaatgaggaagcgactaggaaacatacgcatgactgtggaagcatatgtgagaacaaggggacacaaatgtttcaagaaggctgtaagctggacagcggggtgaaatcggatattgatattatggagattgaaactcaagctacagaaggaattcagaaccaagaaactatggagttggacaagcaagaaatggaggaagaacagaatccaggaacaacaattgaaaacaacaaaatgaaaataccggaagaagatgccagtacatttagctgtggtgaaattcaaactgatccacatagcacagatgttaatgaggttgagttcaccacaggaacgcagaacgacgaacatttggacatcaaggaagaactgattatggacagaaggttagattgtgaaattaaatatggaaacgaaagacccttggaagaggccaacacatttggtggttgtgatggtggggtggataacattggtgttgctttggatgttaatgaggaaaattctattaaagaaatgcaaaaccaggaaattcgcagcacagaggaggcaagtgaagtttcaggatatccatatgatcgactattatttaatctgacaaagttgttttacagttccaggctggggagacccaatttgaacaatggagctgaaaatgtggatgagaagaggattttggaagacgcaagtacacttgatattcgtgattcaactaatgcggtagttaatggggctgaatcaacagaaggaactcagatcctgtgtgcttttaacacggagaaggagctagaagttcaggagaagcaggaccagggaacagaaaatgagaacagaaaccaaaatttggtcaacacagattcgtttgaatgtggggtggaacctcatgggaccctgaaaactactcatgagactcttcctacagtgcaagttgttagcacatcaggagatacattttcttcgaagaatgagcagaacgatgtaccctgggaggaccagaacaaatcagatgctgaagtgtctgaatcaaaccaaactgcaccaaaggagtccgaaaggactattccaccagagcatgaagaccgggaagaagagaaagaagaaaatatggagaataagatagaaatatccataggtagagagaatgatgaagtatctgaacaagagacctccacagaggaatgtatcgttgctccttcaggtatggatgaccgggacgagaataacaaaggatgggctgaagaatctgtacaaacctatgggtactattctcgacatgccgttcctgaaccagtttcagtcaccagggaaatcaaagtgccgttgtatgacagtacaagggcctctggaagagatcgtggaccagagctagtggtgacaggtccaccagaagagacttctcgatggcgacaagaacaatacgcacttcaaattttagaagacgtgcaaaatgctcgcgttgcagagaaaactaggatggagatggagatcngaatactgaaggcncaggtttctagcatgcngagacnagcgatgaacttggatcgtgttggtgattttgcagtacagagaaggttccagaaaagagttcacctgaagaaatttcgtgctatacagccaagttcctcaaccatttcatatgtggaagacaatctactaggtcttaggcgcctaaacacactaccgcagatggaagactccataccagattgtattgaacaagactga

SEQ ID NO: 1495 - DNA, 4797 bp, Oryza sativa
  misc_feature (2883)..(2883): n = any nucleotide
  misc_feature (2887)..(2887): n = any nucleotide
  misc_feature (2915)..(2915): n = any nucleotide
  misc_feature (2920)..(2920): n = any nucleotide
  misc_feature (2930)..(2930): n = any nucleotide
  misc_feature (2933)..(2933): n = any nucleotide
  misc_feature (2969)..(2969): n = any nucleotide
atgacgaagccatcatccaagacggaggtggagccatctcatgtgataccagtcacattagatgactttgaaggagaggatcgcaaagccatggaggagtatatcaacgagctcacacgggaggcgttgatgagagcaactactaggactcgtcaaggcgtgatcatcaagcccgggccacgtcctaagctcgctcccgacgtggtaagtaataatgaggtatcacaatctatcgaccaacaaattgcaaatacaatagattcatctatggctaattttaaagatagattagatatgatgtttaaggaaaaagttgatgggtttttaaggagtaggctaggttcttttatggatgattacacattaaaggataaagcctataccactgctgatcaacctcctgtagatccaatagggtctaaaaccgacggggcggtgttcacggccggtccgaccagccagatggccggtccgaccgggtattatcccgtcggtccgaccggccagatggccggtccgaccgggtattatcccaccggtcagaccggccctcaggccggtccgacagcgcaacctgacgccggtcagaccgcgccctggaccggtcagaccggcgcaattgtcccaatacaggggattgacccaatgactaatgctagttatttgtatcactttagaacatttgattcccctgtatctacaaccaccactagtcctcaaattcccccgcatattcctaatgtttacaatgatgtctctaggggatatcctcccgatactaggcaaggccaatataatcatattgcgtcgcaaacccaacctattaggccaccaaacccaccaccaaatccacaagggcctaataacatggaaaacatgatttgtgatattatgaggactaaattcgggatcgaaactaggaatcgtgctagagcttacaaaagaccatatccggattattatgataatgtgcagtttcctagaaattatagagttcccgaatttaccaaatttagtggtgaggatggtaagcccacatgggaacatgtaggtcaatttttagcgcaatgtggtgaggctaatagtgatacttttaaattgcgcttattttctttatctttatccggtaatgcttttacatggtttacttctttgccggcaaattctattcatacttgggctcaattagaagaacaatttcatgattatttctatactggagaaactgagcttaggttatgtgatttaacatcggttaagcaaaagtataatgaatctgttgttgattacattaagaggtttagagatgttagaaaccgatgttatactttgagtataactgatagagatttggccgggcttgcttttaatggtttagttgctcctcttagagagaaattagatggccaacaatttcttgatgttagtcaactcatgcaaagggctctggctcaagaaagccaggttaaagataataaaaaatttgttagaccattagacaaaaatcctaatgttaatgtagttgattactctgatgttagtgatagtgaggaggagggtgatcatgatattatatgttgccgaatggttcaatcggccatagatgagggacgattgaaattcaccgatggctccaagatgaagcttgatcatgatccttttccagtaaatacaattaattttaatgataagaaggtgttgattcggtcggagcaagccgaatctactaaaggaaaggaagtggtcattggtaagccaaggcctaagatgatggtgccaaagaagccggaagttggtgtttggaaggaaaataaaagtggagcttcaacttccaaagcccctaggaagaccaaggtgacttttaatatgcttttggaaaagtatgagaagcaaggtgagaagagggaaggaaagcgcgtcaagatagaagagaggacttcggaggtgattaccatcaagatagggtcccatgatgtgcctataccttttggagatggagttggaaagtccccaaacaagaaatccgaagccggtaccagctcctcgcagtcggccggtctgaccaggccctctggccggtctgaccgcggccatgtagccggtctgatcgggccatcaagccggtctgaccgccgacctgacgacggtctgaccgatgcctcaggccggtccgaccgtgcgccacacgtcggtctgaccgacgcgtctggccggtctgaccggtggtctgcagccggtcagaccgggctccagcgtcggtttgatgagagggctgcaaagggcgatgtgagggcttcatcgtcttcaaacaaggttaatagaggatactatttgcctcctggaacagagccgaatcctgggtggatgcctaaggatttgacggctacacaaaagagaaggttgcaacgtcttcgagcccaaaaattaagggagaaaaaggccgaagaacaaagggataaaaggttcaatgagttgcgaccacctccggtatggaggcctaaatccatagagaaggcaaaaccgattgatgtagagaagaaggaagaacaatcggttgacgaaggtgaatcatctccaaaggaggacatggatatcaatatggtgtgtatgttgccaatggagttttgtgctatggatgaagccgaggttgcccaattctcattaggtcctaaagacgcggtttttgagaagcccgatgagtcaaaccgtcacatgaagcctctctatctcaaaggccatgttgatggaaaaccggtctctaggatgctagtggatggaggtgccgccgtgaacttgatgccgtattcgctattcaagaagttggggcgtgaggatgatgagttgaagaagaccaagatgattctcaatggcttcaatggtganccancggaggcgagaggtatcttttcggcggngctcnccgtgggaancangacgctaccaaccgctttcttcatcgtcgatgtgcnagattttgatgaagtggagaagcttggacaaggatttacatcggccgatccattggaagaagtagatataggtgatggaactaaaccaaggccgacttttttaaacaaaaacatgaaagccgattataaggttaaggatggtatggaaggccatatagccgatttgagattggcttttgagaggatgcgccggtatggtttgaagatgaacccacttaaatgtgcttttggtgtgtcggcggggaagttcttaggattcatggtgcatgagagaggagttgagattgatcctaagaagatagaaaaaattcgtgatttcaaagcgccgagatgcaagaaagaggtccaaaagttgctagataaggtgaattatttgaggaggtttatttctaacctagcgggtaaaatcgatgcttttgttcctatacttcgcttgaaaaaggaagccgattttacttgggggacaaaacaacaagatgcgtttgaagagttgaagagatatttgtctactccacccgttgtgcgagcgcctaaagccggaaagccttttcggttatatattgcctccgaagacaaagtcattggtgccgttttgacgcaagaggaagatggcaaggaatatatcattacatatttgagccgccgtcttttagatgccgaaacaagacatattgctaggcatgataattctagagcaaatgacttagcacaacaagcatctggttataatgtgaagaagggattatttctgatattagaagagccggtgcttgattttaaatctttgtgcgaaattggtaaaattggagaccaggggcggtctgaccggcgttgcacggccggtctgaccggtgaccaggggcggtctgaccggccgcatgccgccggtctgaccggtgaccccgagcggtctgaccggccctgcgtggccggtctgaccggtgttgggcagaaagctggggggcacgcttcaatcaatttggaggccgaattaattgagaattcggacatttgtgcccagaatgcagaagaggattggagaattcctttgattcaatatctaaaagatcccacacttaaggggcataggttcgtgctagtcgctacggattacttcaccaagtgggccgaagccgtgcctttgaagaatatgactcatacggagcatattattcatagattcggtattccgcaaacattaactacggaccaaggagcttcttttatgtctaagctaatggacaagccgagtccaagtaataagacattgttaaagctagtaaaaaagaagattgaggaacacccgaagaggtggcatgaggtgctttccgaagcattgtgggcacataggatatctaaacatggtgccactaaagtcactccttttgagttggtttatggtcaagaagccgttttaccggtggaggtaaatcttgattctcttcgttatatcaagcaagatgatttgtcaagtgaagattacaagacgttgatgggagacaaccttgatgaagtcattgacaagcgcttgaaggcattggacgagatagagaaagagaagaagagggtggccaaggcgtacaacaagagggtgaaagcaaaattgtttcaagttggagacttggtttggaagacaattttgccttcgggtactcgatccaaggagttcggtaagtggtctcctagttgggaaggtccttatcgaatatgtggcattgttcgagggaacgcatactttttggagacacttcagggggagcgttttcagcgagcaataaccgggaaatacttgaagaaatacttcccgagcgtttggcaagacgcttaa

SEQ ID NO: 1496 - DNA, 4536 bp, Oryza sativa
  misc_feature (661)..(661): n = any nucleotide
atggcgagacgcgcgcccctacgctgtctcttcctctccctcgtcgcgctcttcgctttgctgccattcccgcccgctgcggcggcgccatgccacccggaagacctcctcgcgctgcgggcatttgcggggaatctctctgcgggtgggggcggcgccggactccgcgccgcgtggtcgggtgacgcctgctgcgcctgggacggcgtcgcctgcgacgccgccgcccgagtcacggcgctgcgcctccccgggcgaggtctcgaggggcccatcccgccctccctcgccgccctcgcgcgcctccaggacctcgacctcagccacaacgcgctcaccggcggcatctccgccctcctcgccgccgtctccctccgcaccgccaacctctcctccaacctgctcaacgacacgctcctcgacctcgccgcgctgccgcacctgtccgcgttcaacgccagcaacaactcgctgtccggcgcgctcgcccccgacctctgcgccggcgcgccggcgctgcgggtgctcgacctctccgccaacctcctcgccgggacgctctcgccgtccccgtcgccgccgccctgcgccgccacgctccaggagctctacctcgcatccaattccttccatggcgccctaccgcccacgctcttcggcntcgccgcgctgcagaagctctcccttgcctccaatggcctcaccggccagcatctcaccgcgcactccaatggcttctccggcttgctgccgcgctcgctctcgtcgctctcatctctccgtgacctcaacctccggaacaactccttttccggcccaattgctcgtgtcaacttctcctccatgccgttcctcgtgtccattgaccttgccactaaccacttgaatggctctctcccgcttagcctcgccgattgcggcgacctcaagtcactcagcattgccaagaacagcctcaccggccaattgcccgaggagtacggccgcctcggctcgctctccgtgctctcgctgtccaacaacaccatgcgcaacatctcgggggcgctcaccgtgctccgcgcctgcaagaacctcaccacactgatcctcaccaagaatttcgtcggcgaggatctccccgacgacggcattgctggattcgacaatcttgaggtgttggcccttggtgattgtgctctcaggggaagggtcccggaatggctgcatcagtgcaagagactggaggtgcttgatttgtcctggaaccaattggttggcaccatccctgaatggatcggtcaacttgataacctgacctacttggatctttcaaacaattccttagtcggcgagataccgaagagtttgacgcagctcaagagccttgtcaccgcccgacgttcgccgggtatggcgttcactaacatgccgttgtatgtgaagcataacaagagcacaagtggccggcaatacaaccagctctcaaacttcccaccgtcgttgttcttgaatgataatggtctgaatgggactatctggcccgagtttgggaacttgaaagagctacatgtgctggatttgagcaacaatgccatatctgggagcattcctgatgtgctgtcccggatggagaatttggaggttcttgatctgtcatccaataatctcagtggatcgattccatcgtcgctgacggacctgaccttcttgtcaaagttcagtgtggctcacaatcacttggtggggccgatcccaaatggaggacagttcttcaccttctcaaactcaagttttgaaggtaaccctggtctgtgcaggtcaagttcttgtgaccagaatcagcctggggaaactcctaccgacaatgacatacagcggagcggcagaaacaggaaaaacaaaattcttggagtggccatctgcatcggtttggtacttgtagtactgttggctgttatcttggttaacatctcaaagagggaggtcagcattattgacgacgaagaaattaatggctcctgtcatgactcgtatgattactggaagccagtgctattctttcaggattctgccaaggagctaactgtcagcgatctcatcaagtcaacaaacaactttgatcaggccaacataataggatgtggcggttttggccttgtgtacaaggcctacctcccagatggaacaaaggcggcggtgaagaggctatctggagattgcgggcagatggagagggagttccgtgctgaggtggaagcgctgtcgcaggctcaacacaaaaatcttgtttcactgagagggtactgccgctatggaaatgataggctgctaatctactcatacatggagaacaatagcctggactactggctgcatgagagatcagatggaggctacatgctgaaatgggagtcaaggctcaaaattgcacagggttccgcaaggggactggcttatctgcacaaggactgtgagcccaacatcatccaccgagatgtgaagtccagcaacattcttctgaacgaaaatttcgaagcgcacctggctgattttgggctagcaagactgatacagccatatgacactcatgtcacaactgatctggttggtacattgggatacataccgccggagtacagccagtcggtgatcgccactccaaaaggggatgtctacagcttcggcgttgtcttgctggaacttctgacaggcagacggcccatggatgtgtccaaagccaagggatcaagggacttggtctcctatgttcttcagatgaagtccgaaaagaaggaagagcagatctttgacaccctgatatggagcaaaacacatgagaagcaactgttttcggctaggcctgacatgagaagtagacagaggcagcagcagaagcagtgtattaatccgttgttaggagagaagttcagagaagatgaggccaagtccaagaagctccgatcctcccgcggcaagcagcggcctaagcagcgccggcgaggccgctgcagcagcacctcctcccgctctgaatccccaccccgcaagcgctccaagaagctcaaggtctctgacaagaagagcaccaagaacaagggccgcagacgccaccacagtcttagccccagccccagcccttcatcgtcgtccgtgagttactcaacgcgcagcagcagcggtggcggcggcggcgcttctgagaggtcggtgagcccaccgcgtaggagccgctctagagatgttaggaagaagaagaaggagagggggagggacagcaagagggtgaggaggtcaagaagatctacaagctattcaaccagtggagagagtaattccagtagtcgcagcaggagtaggagcaataatagtaagagcaggaatcgcaagtccggtggcaataaggatcatgcaagcaggaataagattgtgcaggattatgacaatggccatgctcatcgggctgagaatgtgaaatctgttgagattgcggatagggatgagaaagccatggctgataccagcaaggggagctctattgagatatctcactcaattattgatcatgagaagaatgagtccgttgagaagatggagagcgctcctaccaaggatgctgatgaaacacaagacatcttacctgctggtagtggaagccctgatgctcaggatctggagctgattctcaggcagaaagctcttgagaacttcagaaaatttagaggagcagcgctcatggcaggcaagccgcaaaccaatggtacagggaaggaagtggtaacggatagccccaagagcagtgacacgaaaattgctgaagcgagttctgttgacaaaccttttcagaggcaaagaagtggtctttcagtgaactgctctgttggatcccctagattggaggatttcgggaaccatataactcctcgaaagcaggaaagctccgctggcaagagcgttggcgttgaatcacctggaacatttgaggccggcagcaccagcgggcgaactgagcagaaaggaagcagtctagaacctactcgatcaaattcacagattaggctacaggatggtaggagtagttccagcataatgcataggttgggaagccctccaaggagctctgccagcgtgattcgaaggttaggaagcagcgcaggggtgaattatgtgaatggaaatcccagagttagatcagttgtgagcatacccactaaggaagggcttgatagtggtacatctatcactacccctagtgcttgtgataattctccccctgttgaaaacattagtgaagtcaggcatcctcctattgatactaacaaaattgaaggaactaaaggggatgaaagaaattcaggtgaagcttcagctcctaatgtttctactttgtcaactggtgaggtcaaggatcagcctgggactgaggtcaaagatggttctcagtttgagaaaaagacattctctagaatgcatgagggagaaactgtgcaggtcagttacaaagtctacataccaaagaaaagtccagcacttgcaaggaggaagctacagcgctga

SEQ ID NO: 1497 - DNA, 4269 bp, Oryza sativa
tttagatttggtgcagctagcagtgggtttcatagaggtagttcttcgcggtcacacaaggatcatgctgaggctttaaaggcatcataccctaggaggtcttattatggtgcaccaacatacgagtgcccatactgtggtgccgtgttttggtaccaggagagagttaagggcgcttctgctatttcaaaacgaaagatagtttacaatctgtgttgcaaaagtggtaaaatacagttgcccaaactatgtaaaccccctgagcctcttgctacactgctaaaatttaatggcgatgcacgctcaaaaagattccttaggcagatacggtcctacaactctatgtttgcttttacttcaatgggtgcagctgttgataaatcaattaacactggaaattcaccttatgtcttcaaaattaacggtgttgttcatcacagaattgaaaatgagacacaaaatcgaatgaacatatatgaaaatgatggtagtaacgctgatcaagctgagcctgttgtagttgatgctctctgcactatgctagattgtcataatacacttgtgcaaaaatttcgctacgctagggagcgtctttctgagcatgggaaccatagtttgacgttgaggcttatgggatgcaatgccaaaagtgatgtgcagtacaatttaccaagtagtggcgaactagctgcgattatagtgggtgattactcagcagctgaatacacttttgatatacttgtgcatgagagcgatattgggctgcgacgtgtcttccttgcacccatgttatatggctttgcaatatccattgttttttccttatggcgagcgaggattccatcttggtatcgaagtgttgtcgatgtattctcaactattgaaagcagtaggttgaaatatatagctgatcatcagtcagacttgcgatctgaatgcgtacaaggtatagctgatgctattgatagaggtataaccaacggtgattctgtaggcaagcgagctatccttcctgctagctttacgggaggtagaagggagggtaagacatttgggcctgtgcttgcagttctctacactgttgagttccagaaatgtggtttgccgcacatacactgcttagtatggcttgctgctagcagtgctcaagtatcagtagctgttatagatggatttatcttagctgagataccagactttgaaaccgatgaattaggttatgagtcggtaagcgagttcatgatgcatggtccctgcggtgagcataacaaacaatgtccttgcatgaaaaatggcaaatgttcaaagcactttcctaaagattttcatgatgaaacatttgttgatgaatatggttttacaatctataggcgcagaaatgatgggcgatatatcacaaaaaatggtgtgcgtctagataacagatcagttgtcccatataacattggtttgcttaaaacataccaggcacatataaatgttgagtggtgtaataaatccaacatgattaaatatcgttttaagtatgtgatgaaagtccatgatcgatcaaaaatatattttgaaaccactgctgcaaatggtaatatgtcacctaaccatgaccttgcccctctagatgagatactagaatacatggatgctaggtttttatccacctgtgaggcactgcatagaatttatgaatttgacatacattatagggtttcacctgttgaaaggttggctgtgcatttgcctggtatgaactatgttcgatacgagacagggtcagacttaagagcattgcttaatagtcctgctgcgaaacgtacgatgctgactgagtggtttgaaacaaatgcaaaggatgaggatgcacgtagcctaacatactgtgattttccaacaaaatggacatgggattccacatcgagatcttggcacaaaagaacaccagctcctaaaattggtagaatgtattatgttcatccagctgctgattccttggttgcacagattaatactgatcaaaaaacaatctttgacaccattgtaggccgagttgtagcagaacagccaggctttttctttgtatgtggtcatggtggtactgggaaaacatttatgtggaatgctttgattgcgaaaataagatctagaaataaaatagttcttgctgtagcttcgtctggtgtggcttctctactgttgccaaaaggaaggactgctcattcacgcttcaaaatacctattgaaattaatgaaaccagtctttgcaatgtaaagagaggaacgatgcttgctgaactacttgaaaacactttgctcatcatctgggatgaagctccaatgacacataggcgttgctttgaagcactagatcgcacactgcgtgatatcctttctgaaacatgcccttcaaatggtgttgttccctttggcggtaaaattgttgtgctaggtggcgactttcgacaaattctaccggttgtgcctaaaggttcacggtcaacaattattgacgcatctattacaaattcaaaactatggaaacatgttgttatgcttaggttgaatgtaaacatgagattgcttaacccttcacttccaaacacacaaaaagaagagcttaagcaatttagcgaatgggttttagccgttggtgatggcactttgcctaaaaaaaaagatggtttaattccaggagatggaaaagaatacctcagttgtgatacaatctcaaagtgttctgaacaaataccagattttgacatgttatatcccactgaactcctcaactcaattgatgcgaacaattttccaacacatagacttgtacttaaagaagtgcaccgtgtgaagaatgcaaacaggagctacaagccagttgccaatgaactaatgatcactttcactaggtggacaactgttgaggagtgcattgaagttcctattgatttccctactgtggttttctccctgacacctttcgatgatgttgctaagtttgtggacaataatgatttttttattgatgttatgggtgtcattactgacatatctacacccacaatgcttcgtcctagatcaagggatgctgacagcttgaaaagaactattcagatacgcgatgcaaacaattctaccttgaatgtgtctctctgggctgaacaagcatctgcgtttgaggctgacgctatacacaaggctggtaagagtgaacctcagattattctgtttgttggaactcttgcgaagaactacccaggcataggattggcactatctggaggttctgcttgcaaatggtacattaacattgatgtacctgcgatagttgaattaaaggacaagactgggacaaacttccagccaatcaattggattgaggctccagccagagcagctgttgaggaagtcgctgagaacaagactgtgcgtgaacttctagagatcaatcctcacaagtgcaagaaggttcgatttcaagctcatgtaaccgttcgaaggatctgcaatgataagtgttggtggttgcaaaaccttatgggtccacctataaatgcactagctgttccaacatcgcagtggcagtaccaagcccagcgcattgtgcgaaggccagttgaagctcttattgaggaagcaccagctgacagtgattttatccctgatgaaataacggctttagttgggaagtcgtttgtgtggaatgtcagcttcacagaaaatacgcttaagtttggggatatctcattccaggtcaacagcattgtctccattgatgctcctggtgaacctcttatgttgatgtccccaggtgcttcccagagttcttcagccatgatttcacctggaccaagtggctcattgatgtcaccatcaaggggaagtgaacttggcatagcttcacccggttcaactgcagccagctctccactgccaaggcgtgttattaccacggacaaaagccaagttgtgcacacaccaaccagcaagtgctctgtcagcatagatcaggatgacatttctgctgctttttctccaccaatgtcccagaaagtgcaagctccagctattcctgatgatgatacactactggctcatgcatctggctcaaagagcaagtctaggaagagaggtcctccttctcaagcaccaccagcagttaagaaactatcaaggaaggtgacagcgatgagaaagaaaccactgttagcctgtcagctgacgcttgatccagtatacatgcatgcccactcaagcattttggccaccaagttgtag

SEQ ID NO: 1498 - DNA, 4179 bp, Oryza sativa
  misc_feature (3828)..(3828): n = any nucleotide
  misc_feature (3906)..(3906): n = any nucleotide
atggcagacggtgccaacaacgacgacgtttggcgccggcgtttcgaggaagtcctggaacgcctcgaagcgcttagcggccaaatcactgatctcgatcagcagcagcgcgatcagaacatggtcatcaatcgtctggagcgtggggctcgcgcacagtcccctcatttcgacgacgtaggtggcggtggcggcctcggcggaggccgtggcggcaactacttcggccgcggcgatccctttgctcgcggcggtgatggctttggcccggacggcggtcggagcggcttccacggtcgattcggtcaccgctatgatggtgatggcgagcgacccccacgctaccacaagctcgacttccccaagtacgacggccgcgacgatccacttccttttctcaaccggtgtgagcaattaatctggggacaacgcacgccggaagatgacaaggtgtggctggcctcctaccacttgctcgacggagcgcagcagtggtatacgtgtctggagcgtgaccatgggccgccctcgtggcaccgtttttcggagctcctcaacatgcgctacggccccctactccgttcagcaccgctgggcgagctcgcggcctaccggcgcacgtctacggtggacgactacaccgaccacttcctcgacctgctggctcgcgcgggctacctctccgaagatcagcaggtacaactgtttacgattggattacaagagccaatgagtttagatgtgcagatgcaaaatccgacgacattggaagcggcaatgagcctcgcccgctcgttcgaacgccgcgaacaagctgcgcgtccacctcgcccaccgcggcacgccggccgcggcctcttgccgctgccaccagcggccaacccgccggcaccggctccagagccggccgtcgctgccaaaccagcaggcacgccccccgcggttaaccgcgccatccgccgtctatcgccgttggagatggacgagcgccgccgccaaggcctgtgcttcaattgcgacgagccgtactcccgcggtcacaaccgcgtgtgccgccgcctcttcttcctggagatgggggaggacgacgccgacactgactccaccgatgacccggcggccgcacccgcaaccctccggatttctctgcatgtggcgaccggagttcgcgtgtccgacgcgatgcacatcatggtccacctcggcgacactgacctctatgccctcatcgactccggttccacgcctacgttcctgtctcaggatgcggcggcgcgtgtcggccgggatcctcaacctcgttcgggcctcaacgtcacggtggcgaacggcgacaaggtggcgtgccccggcgtcttccccgacatgccgttccagatcgccggcgaggaattcgccacggacgtgtacgtcctaactctgggcggctatgatctggtactgggaacacagtggctcgcgacactgggcccgatcctttgggacttcacggcactgacaatgtcgttctggcaccgcgaccactgcgtcaccctccacggactgccggggcaccagcggccacgcgccctagcgtgcggtccctcggcgcacttggactcgctgctagaggagttcacggacgttttcgccgagcccacgggcctttcaccgcacgtcggcattctcctcgccggtgctgctggtgaagaaagcggatgggtcgtggcacttttgcgtcgattatcaggctctcaacgagcgcacaaggacaaataccccatccctgtcgtcgacgagctcctagacgaactacacggcgccaccatcttctccaagctcgacttgcggtccggctaccaccaggtccgaatgcactccgatgatgtccacaagacggcctttctcacacatgatgggctctacgagtttctcgtcatgccgttcggcctgacgaacgcgccggcaacgtttcaatcactcatgaacgatgtgctctggccgttcctccgccgtttcgtcctcgtcttcttcgacgacatcctcatctacagcccgtcttggacgtcgcatctacagcacctgcgcaccatcttcaccgcgctccgagcggcccgactcttcgtcaagcgcgccaagtgttcgttcggggacgccagcatcgcatacctggggcatatcgtgtcgctccatggcgtcgccatggacgcgtccaagattcaggccgttgtcgagtggccgcgcctgcgatcgcccaaggatcttcgtggcttcctcggcctggcagggtactaccgcaaattcatcccggacttcttcacagttgcggcgccactcacacagctcctccgcaaggatcgattcacctggtcgccgccggccgacgacgcgttccagcggctcaagctcgccctcaccaccgtgccctgcgacgcatcgggcatggggttcgaggccgtgcttctccaaggggctgggccgatcgcctacttcagccgaccagtcgccacacgtcatcaagctcttgccgcctatgaacgtgaactgatcgggttggtgcaagcgatccgacattggcggccgtacctctgggggcggcaattcacggtgaagaccgaccactatagcctcaagttcctccttgatcaacgcttgtcgacgatcccacaacatcattggggagaactcctcgctctcacgacgccggtgttcgacctactccatgacctgcgcacggcgacgtcgtccgacccggtgttgctagctctccgtgacgagatcgccgccggtacacgtggcgcaccgtggacggtcactgatggcttcgtcacctacaagcggcgcatctacgtcccaccgggctcgccatggctctcgacgatcgtggcggccgcccacgaggaagggcacgaggggatccagaagacgctgcaccgcctccgccgcgacttccacacgcccaacgaccgccacctcgtcagcgacttcgttcagggctgcatcacatgccagcgcaacaagacggagcacctgcatccagcgggattactgcgtcctctcccgattctgatggccgtctggtccgatgtcgccatggatttcgtcgaggggttgccgcgcgttgccggcaagaccgtcatcttgacggtcgtggatcgcttctccaaatatgcccacttcatcgccctcgcacacccctacacggcggagacggtggcacgcgcgttcttcgcagacatcgttcggctacatggtgttcccgtgtcaattgtctctgatcgggatccagtgttcacttcggcgttctggacggctctcttcacggcgaccggcaccaagcttcatcacagttcggtgtttcacccccagtcagatggccatttggaggcgtggctccattggttaccgtgggcggaatatgtctacaacaccgcctttcatgcggcgctccgcacgacgcccttcaacctcgtctatggccggtatcccccgtccgtccgtgcatatgacaccagcgagactcgtgtggtggcggtggccaagtcaatggaggaccatgatgccttcctggcagatgttcgtgtatgcctggagcaagctcagcaacacgccaagcaatattatgataagaagcaccgggacatttcatttgccatcggggactgggtatggctccgcgttcgtcaccgtttgccagcctcgttgctggacgctacaaaaggaaagctgcgtcctcgctactatggaccatacaagatcatcgccgttgtcaacgaggtggcctatcacttggagttgccgcccgggacccggctgcacgacgtctttcatgtgggcttgctgaagccnttcgtcgggacgccgctcatgtcgccaccgcattgccaccagtccagcatggagcagtccttccgtctccacgccagntcttgcgcgccaggctcgcccgtggcgtccgccagctgttggtccagtgggaagggttgccatcttcggcgacctcgtgggaagaccttgaagagttccagcagcgttacccagcgttccagctcgcggacgagctgcttgtcgaggcggagagagatgttatgtggggaattccattccaccgccgacgtcgggacgaatagcgtgccggccgtgctacagtaccgcgcgaggagaataattaggcacgcagttatcaggttgttaggatag

SEQ ID NO: 1499 - DNA, 3951 bp, Oryza sativa
atggtgaggactaagtgcctcttaaattatcaccaaccaagcctcagcatcgtcgcgggatccagtcgcaggagcagggaccatggcaaacgatctgtctactcgcctcctgactggcacaaggagcatcaagccgaacatccccgctccccacgtcgcaggcgtcccgtcgatcttcgtgaaactatcaaccagtgctgcgcggcaagaggctacatcccccgccattcaccagatcgttacgacgaagacgtagatggagttgctgccttcacaagcgacctgcatcgagtagattggccagccggcttcaaaccgactggaatcgagaagtatgacggcacgacaaatcgtgagtcttggctcaccgtctacagtctcgcaatccgcgcagcaggaggagacagcaaagccatggcaaactatatgcccgtggctctagcggattctgcccggtcctggcttcacgggctaccccgtggcacaatcggatcttgggcggagctttgtgaccacttcagcgccaacttccagggcacctttgaatgctctggcacccaatttgatctctacaatgttgtccagaagtccggagaatcccttcgagattacatccggcgttttaccgagcaaagcaacaagatttccgacatcaccgacgacgtcatcatcgccgccgtcaccaagggcattcgccatgatctcttagtcggtaagtttggccgcaaaactcccaggacggtcaagcagatgtttgaaaaagccaatgagtacgcaaaagccgaagatgccgtcatcgcatccaagcagtcaggcaccacctggaagctgaagaaagatacgccgactgcagggggagcggtagtaccaatcacaaggatcgcaagctttgcagagcaatacgccaagaacgcacgcaaaccgactgacggagatcaaagcaagtccaagaagaaggatgatgaagatgccaagacccttgcaaggaactcaaccatatcttcggcggacccctggcttatgaatctaaagacagctatcaagtttgaccgctcggatcatcccgaccgagtggtccacccggggcgtgcactcaacatccatttcaccaagactctggacgacatgcagatccctcgcacagaattgaagccgagtaatgcgccctttcacggagtcatccccgggctatcttctactccactcggccagatcaccttgccggttactttcggcactcgggagaactttcgcacggagaacatttgcttcgaagttgctgattttgagacagcgaaccacgctatactcggacgcccggcgttagcaaagttcatggctgtcccgcattatacctacatgatgatgaaaatgccaggtcctcaaggagtcatatccctacgaagcgacatcaagcaagccgtcacttgtgacaaggaaagctgcgagctgtcccagacccacgagatcactctggctcgagaggaaatccgactggctgcgtccacagcaaccaaaggagaagtgcttgcaaccaagatgccaaagaacggagaaggcgacgccaagaccaagaaaattcctctagatccctctgatcccactaaaactgctgtaataggcgctgagaagacgctaaacgtattaatcaacgaccgccgtttcgaacaggatagaaaggatgcgatcaaggaggaattgaccaagctgttagcagcaggcttcatcaaggaagtcctacatcccgactggctggccaacccagtcctggttcagaagaagacggggcaatggcgtatgtgtgttgattacaccgacctcaacaagtcttgtcccaaaaatcccttcgggttacctcgcattgaccagacttcattcatcacacccttcggggcctactgctacatcaccatgccttttggattaaagaatgcaggagcaacttatcaacgcatgatccagagatgcttttcaactcagattggttgcaacgttgaagcttatgttgatgatgtagtcgtcaagaccaagcagaaggatgatttgattacggatctacaagagacctttgcgagcatccgcgctttcaagatgaaattaaaccctgaaaagtgcatcttcggagtaccgtcaaggaagctgcttggctttatgtggggacctgaagcacaaaaagcctttgaagacttcaagaaacttctcactactccaccagtcttagcttcgccacatccgcaagagccgctgttgttatacgtgtcggcaacttcccaggttgtaagcacggtcctggttatcgagcgtgaggaagaaggccatgttcaaaaagtccaacaaccaatctatttcgtcagcgaggttttggccgactccaagtcaagatatcctcaggttcaaaagttgctatgtggtgttttaattactgttaggaaattatctcactattttcaaggtcactcggttacggtggttacatcgtttccacttggggatatacttcacaatcgcgaagcaaatgggcggattgcaaagtgggccttagagttgatgtctttggatctatccttcaagccgcgaacttcgatcaagttccaagctttagctgacttcgtcgccgagtggaccgtatgccaagaagacacgtctacggagaagatggagtactggacaatgcattttgacgagtcaaagaggctatcaggcactgtagcgggggttgttctaatttccccgactggagagagactaagctacgtattgtggatacatttttctgcgtctcacaacgtggcggaatatgaggcgcttcttcatggattaaggattgcgatttctgtaggaattcggcgtcttatagttcgtggagattctcagttggttgttaatcaagtcatgaaagagtggtcctgccttgatgataacatgaccgcctatcgtcaggaggtatgcaagttagaagataaattcaatggccttgagctaacccacgtccttcgacataataatgaggcagccgacagactggctaattttggtacaaaacgaaaagcagcttcttccgacgtgtttgttgaacatctttatgagccaaccgtactaaggaaagaaataatcgagaccacggacactcaagaagtaagcacgattgaagccgactggagagagcccctcatcagatttttggctaaacaagagctccactactggagagggagaagctccctggtgctaaaaacacccggcaacaatggaaaaacacccgccaacgatgccgatgcggatctggtgcggcgaggagaggagaggcttctcatcgagcctacatggtttagagagattaatatgatggatgaaattgagttctatgataactatggaaggcacaaacaaacgaatttaatactactccctcaagataaagacgaagccgagcggatctccagacgcagcaaactttatgtcatacatgagaccgagctgtacaagaaaagtccatcagggattttgcaacgctctgttgacaaattttccaagtggatcgaagccaaaccagtcatcacaatcacggcagacaaggctagagcttttttcatcaacattgtgcaccggtttggggtacccaatcgaatcatcactgataacggcactcaattcactagcggagtatttcaagatttttgcgaggacttcggcatcaaaatttgttatgcctccgtagcgcaccccatgagcaatggacaagttgaacgtgctaatgtatatggtgcggaagcaatgttgccaagtgaggtagaattcgaatctttgcgatttcgtaatttcagcgaggagcgctatggagaagaccgagtagatgatctcaaccgactggaagaagcccgtgaagcagtgctaattcagtcggctcggtatttacaggggatgcgccgttatcacaatcgcaatgtttga

SEQ ID NO: 1500 - DNA, 3864 bp, Oryza sativa
  misc_feature (216)..(216): n = any nucleotide
  misc_feature (253)..(253): n = any nucleotide
  misc_feature (345)..(345): n = any nucleotide
atgtcgctgcagccgccggcggtggagccgccggagtggctgcggacgctgcccgtggcgccggagtaccacccgacgctggcggagttcgccgaccccatcgcctacatcctcaggatcgagccggaggcgtcccgctacggcatctgcaagatcgtgcccccgctcccgcggccccccgaggacgacaccttccgccgcctccaggccgccttngccgccgcggcctcctccaatggcgacccttcccgancttccccacgcggctccagcaggcccttcagcgtcgagtacggcaacgacatgcccggctccggcttcgcctcccccgacgagctccccgangccgccaatgccaccgacgtcggggagacggagtggaacatgcgggtggcgccccgcgcccgggggtcgctgctccgcgccatggcccgcgacgtggcgggcgtcaccaccccgatgctgtacgtggccatgctctacagctggttcgcctggcacgtggaggaccacgagctccacagcctcaacttcctccacttcggcaaggccaagacctggtacggcgtcccccgcgacgccatgctcgccttcgaggagacggtgcgcgtccacggctacgccgacgacctcaacgccatcagagtggcctttcaaacgttaaatgagaagacaactgtcttatctcctgaggtgcttctttctgctggtgttccctgctgcagattggttcaaaaagcgggagaatttgttatcacattccctggagcttatcattcaggctttagccatggatttaattgtggggaagcatcaaatattgcaactccccattggttacaagtggctaaagaagctgcaatccggagggcttcaactaattgtggtccgatggtgtctcattatcagctgctttatgagctagcactctcattgcgtccaagggagcctaagaatttctattctgttccaagaagctcacgtttaagggacaagaataagaatgaaggtgatataatggtcaaagaaaattttgttggaagtgtaaccgaaaacaacaatttgcttagcgcccttctggataagaattcttgtataattgttccaaacgctgatttcttcgttccatcctttcctgttgcactggaatctgaagttactgttaaacaaaggtttacagctggtccctgcagtattagccagcaaggagcagaaaatatggctgctgatcatgtggctgtagacaaggttacagagattcaggacatgagtggatccttatatccttgtgaaaccagtcttgtgggctgtagcaatagaaaactttatgaaacaaaatatggccaacgggatgctgctgctttgtgcttatctacttcagagattcagagcagaggaattgatacagcaagatcacatccagcaggcgggatcttagatcaaggacggttgccatgtgtacagtgcggaatactaagctttgcatgtgtagccatcattcaacctagagaagcagcagtacagtttatcatgtctaaagagtgcatctcatcgagtgcaaaacaaggaggaattggtgcatctgatgatacctcaaactggattgaccagagtcatgagattagtcctccaccaggtccagcatctggaacagatgataatgtaaagcatgccgtaagtttggcccatgtctctgatcggtgtagagaactatatgccagcaatacagatggatgcacctctgctcttgggcttctagcttctgcatatgactcatcagactctgatgatgaaacaactgaggatgtttcaaaacatagcaagaaaaatgattcagtaaaccaaagcacggatcctcaaatcttggaaacatcagctagctgttccagtacagttcagtgtcaaaagacaaattcacacttgcatgaagaggaatgtgaggcaagagccacatcattgatgaaacctgtaagccataatagtaggcccattagtcagtctaacagggatacagatatcgaccattttatagaactgggaaagtcaggaacacagtgttcaggttatcttgatttggttgatgatctaactacatcagttttaaaatcctcttcagatacttgtgtaagtgcagctaaagcctcaatggatccagatgttttgaccatgctcagagaaaaaaaaacatgtgtttacaactacatgagcaactacaccaagggcataaactgcaaataccctagagcagagtcagcagcaaaagtcatagcagaagaacttggtatcaagcatgattggaaagatatcactttcaaagaagcaactgaagaggacgttaaaaagattcagttggctttacaggatgaagatgctgaacccactggcagtgactgggcagtcaaaatgggtatcaacatatattacagtgccaaacagagcaaatcaccactttacagcaagcagataccatacaattccatcatttataaggcatttggccaagaaaacccagacagtttgacagattatggatgtcaaaagtcaggctcaacaaagaaaaaggtggctgggtggtggtgtgggaaagtttggatgtcaaatcaagttcatccacttctagctcgtgagcgtgaagaacagaacagtagcgtagtgtacggcaaagcaatgttcactactatttcccatggcaaagtacaagatgaagcgtcaacaagatgcaatacaagcaaccgaaccccatcaagaagaacatcaagaagaaaaaagggggtatctgctgagaaatctaaaccaaaaaacaagagatccactgcttctgatgaagctagtatgctttgcagtggccttggaatgaactctggagttatccatgaccaaactgaaaactctgatgattatgacaaacatggcaatggagatgaaattgaggaaggaacaaatcctcagaaatatcaacaacgtaaattgcaaaacgtgaccaggaaatcaagttctaagaagcggaaggatgagaaaagaacagatagttttcatgaactatatgacgaggataatggtgtggattattggcttaacatgggtagtggagatgatgccacactaggtaactctcgacaacaaagtcctgatccagtgaaagtgaaatctggaggcaaattgcaaggtaagagaaaatctagcaagtacaagtccaatgatgatttgttgaatgaagaaaataagttacaaaagatgaacaaaaaatcaagctctaagaagcaaaagaatgataagataaatagacaacttcaagaagatcaaaccgaagatgaccatatggaccacttagttgacgtagcggttgcagatgaagtcacactagacaatgaggataaaattacagaagacaaaattgatgacgtgaaagtgaaatctagaggaaaatcgcaaaatggtaagagaaaaggcagcaaacatcaggctaccgatggtttgcgcgctggaaataaagtggccaaatttccgtgtgatatagaaggatgtgacatgagcttcagtacccagcaggacttgttattgcataagcgtgacatttgtcctgtcaaaggatgcaagaagaagttcttctgccacaagtacttgcttcagcaccggaaggtgcatatagatgaaaggccacttaagtgtacatggaaggggtgtaagaaggcattcaagtggccatgggcgaggacggagcacatgagagtccatacgggggtaagaccttacgagtgccaggaacctggctgtggtcagacattccgattcgtttcagatttcagccgccacaagagaaagactggccattcctctgataagagaagaaagaacagtacataa

SEQ ID NO: 1501 - DNA, 3624 bp, Oryza sativa
atgtcaacgtgtcctgtgctgaatgaccgaccaattgatgagtggaaggttactgaattgaaggatgagctccgtaggagggatctatctattaaaggtttgaaggatgatcttgtgaagaggcttgctgaggcccttcagggggaggttattgatggcggggaagaaacagtcaatggaactccccctgtggagaatcagacacaagacggagctcttgttttagatgatgcatctggtttccaggcttcagcagaacaaaatgttgatgaaggccctgctgaggttgctgcaaagaatgaaggccttgtctctgttatagaagctagtacagagggcggaactcttgttttagatgatggatctggtttccaggcttcaacggaacaaaatgttgatgaaggtcctgctgaggttgctgcaaagaatgaaggccttgcctctgttacagaagctagtacagaggacggaactcttgttttagctgatgcatctggtatccaggcttcaacggaacaaaatgttgatgaaggtccttctgaggttgctgcaaagaatgaaggccttgtctctgttacagaagctagtaaagatagtgcaattgctactacagaagttagtcaggaagcagttgttgccgctgcagaggttagtccggaggctctagttgctgttacagaggtcagtgaggcccctctagttgatgtggccggaactaatgaaaattctctaggtgatgcagaagcaactaaagaaggtgatccagaatctgttccaagtgacagtaatgtggtgaaggaagtatgttcacatgctgaaattcattgtgaggtcattgcagagaagactccagacaatggcagcagcaagaaaatgactgttgatgacatatcatctgatgataccagtactaataccaagttggaggaatcatctgctaaaggtgaaccatgtgtcagtataggctgtgagattctagaacaggaaacgaaatcatcacatcttgatgttattttgtcacatgctgacgctgttgcaagtgcagaggaaatgattacagagagcctgattcttaagaaagattccaatgagaatgatttaatgtatgagaaggaccaaaaggattctgaccacataagcactgactgcaaacccgagcagtctggaccaaaggatcaggtatctgaagtcaaccaagatctagagtctcaaattaagtgtgtgtcaatttctcctgatgatatactagtcaataaaaacgacaatgtagaaggcaacatgaacgctgacaattttgatttaggactagagtctaagcaggatattgtcaagccatcatccagcaatccctcctccgttggtgatgatttgcagacaccagatgatgacaaagagatatctctgatcgacatgtctctgcaagatactgatatgagcttgaaaaagaaagaaggcagtcctgatagtatttatcctgaaaaactaaatttggataggagttcaggagatgaatcaatggaggaggatgcgatggaaactaagcacatggattccaaaacaatacctgattatctcgaaggaaagagtgaggtcaccttagagcatgtgagttcaggagatgaatcaatggaggaggatgtgatggaaactaagcacgtggattccaatacaaaagttgaacatgtgagttcaggagatgaatcaatggaggaggatgtgatggaaactaagcacgtggattccaatacaaaacctgattatctcgaaggaaagaatgatgtcaccttagagcatgtggtaaaagaggtgatcctccttgatactgtcactgagggttcatctgtagatcaaaaggaagctataagtcaagagaagccagtaatgccgactgaaaagaggaaagctgaagatcaagaagttgttgcaaataatgagccaatcaaacgtcagcgcctatggaatgtggatgatgtcaaacctgagcaagcaacttccaaactaagtggttctgatgcttctaaagttgtacacccgcctgctcgaagacgttcttttggcaggtctgattcaacagcacgtggaaattctccgaaggagaggatggtaccaccgcctcagaaacctgcaacaacttccttgagaatcgatcgatttgtgcgcccgttcactttgaaagctgtgcaagagcttcttggtaaaactggatctgtttgtagcttttggatggatcctatcaagactcattgctatgtcacattctcttcggtggaggaagctctggctaccaggaatgctgtttacaatctccaatggcctccaaacaatggcagttccttagttgctgaattcgttgatccacatgaggctggcggaataccacgcgaagctgcggatgatgaagaatctccgcgactccctcaacgcccgtatagccacgcgcctcgatgccaagagaagaagaaagctgagcaggcatcacgtgatctcagagagagaacggcattgttgaatttggcttttgtcacgctgaaaaagaagcgaaatgattcatcggtgatgcacaccaatgccatgaaagcagcacagatgggtcttatggcaactacctcagagcatttaaaaatgcagtcaaaagctatgaagcaactttgcagattgttcccattgcgacgagttattaaggatggcgaacagaatgatggctacaatggtccatatgatgtaatatgcaacgctcgtctacctcgtggtctcgacccacattcagttccatccgaagaattatcagcttctttggggtacatgttacagctcctcagtattgtagttcctatcctagccgcacctgtcctccacatatctggctttggggcttcgtgttcacgtgtatggcagcgtagttcctactggagcacacgacagtcccaaagcaaagtctacccactttttatacctaggaaaaataattgctctgttggtgaggataattcatggacggaaagtggttcgggtaactttggtgttcaatctgttgattcagacaacaaatcggttcttgactccaagagaagcaatagctttaacttctctattgcatcttctcactccatggagaggcaccaagatttgcaaagaggaatatcattactaaagacaagtgttactgccattactacctattactataactcattgggtatggatgtgccatccaatctttctacttttgaagcatttgcaaagttgctccatatgctatcatcattaaaggtccttcgcacaactcttcaatcgaacgttgcttcaaggtcagagaagcaaggacagcaactaaatagatctatatggaaagcgagctccgctatctcatctaacagcagcctgatggacagtgtgaacacagctataatgcctagttctctggacaacctcctgctgaactccaacacgagcttcctgtatagcggtaaaccgacgaagcatggtggagttccagacaacattttagaaggctgggatatggtagagcgcgacgtcctaccaccaccaccgtcgcgggttgaagacgttgcgcaatgggaaagagcccacaccttcaatcgcactggctccaaaaagaagtga

SEQ ID NO: 1502 - DNA, 3600 bp, Oryza sativa
  misc_feature (3501)..(3501): n = any nucleotide
  misc_feature (3517)..(3517): n = any nucleotide
  misc_feature (3557)..(3557): n = any nucleotide
  misc_feature (3571)..(3571): n = any nucleotide
atggccgccgaggagggagcagagccttcggcgcccgtggccgaagatggaggaggaccatctgcttccacatctgcgccatcactattgccttcggcccctgccacctcagtgcaggtgccgaacgcggccgacgtggcgaaggcggctgtggcggcgagggcactccagaccagggcggagatcctttcgacaagccaacaattggtgccccaagccgctccatcgcagccggcagcggccccaaccgcgctcgccgttgcgcaggctcaaaggaagttcagaaccgaccatgcgagcaaggctgtgatggctgtcgaagaggtgcaagccctccgcaaggagttcgacgcccagcaagcaagcaaccatcagcagccagtccgcaagaaggtccgaaaagacctctactgcgccttccacggccgctcttcgcacaccacggagcaatgccaaaacattaggcaatgtggcaacgtgcaagatccaaggccgcagcagggagcaacggtcgaagcacctcgtgaagcagttcaggagcaaacacccccagccgaacaaagccaagatacacagcgaagggtaatccaagtgattacaagggctgacccgccaagccagttgtccaaacggcagaagaagatgcagatccgaatggtccacagcatcacttcggcggggagttcggccgatgttatcttcgtcgaagcatacaccaagatggggttgctcacccaagcccttaccccggcaccagcatctctccgcggtttcggcggagaagcagttcaagttcttggccaagcacttttgctggtagcttttggctcgagagagaacagacgcgaagagcaagtactgttcgacgttgtcgacatcccgtacaactacaacgccatcttcggccgtgcgaccctgaacaaattcgacgccatttcccatcacaattatctcaagctcaagatgcccggcccgacaggggtgatagtagtcaaggggcttctgacttcggccggttcaaaaggcgatctagccataatcaacagagcagtgcacagtgttgaggccgaaccgcatgaccggccgaagcactcgccaaagcccacccctcacggcaagataataatggtgcagattgatgatgccgaccccgcaaagctcgtatcactggggggcgacatgggcgaagaagaagctgagagcatcctagaggtgctcaagaagaacattgatatcttcgcctggagccccgatgaggtgggaggtgtttcgacagatctcatcatgcatcacctggtagtcaaaccgaataccaagccaaaaaaacagaagctacgcaagatgtccgccgatcgccaagaagcggcaaaagccgaagtccagaaacagctcagagccggggtcattcaagagattgaccatccggagtggctggcgaatctagtgctggtgcggaagtcaaacggcaaatggcgcatgatgcctttcggcctgaggaatgtaggagcaaccttcgccaggctggtgtataaggtcctttgcaagcagttggggcgaaacgtggaagcctatgtcgatgacatcgtcgtaaaaagccgcaaggcttttgaccatgcgtccgacctacaggagaccttcgataacttgcgtgcagcgggcataaaactgaatcctgagaagtgcattttcggcgttcgcgcagttagcgctgccctcgtccaggaaacaaagttcggccaaaaaccggtctatttcatctccgaagcattgcaaggagcgaagacaagatacattgaaatggaaaagctcgcttatgccctggtgatggcttcgcgcaagcttaagcactacttccaggcccacaaagtcatagtgccaccacagtaccctttgggcgaaatactccgaggcaaggaagtcaccggccggctcagcaagtgggcggcagagttatccccgttcgacttgcattttgttgcacgcactgctatcaagtctcaagtgctagctgacttcgtagctgaatggacactggtattcgcccctgagaccgagctcgtcgaacaattatgggtgatgtcctccgacggttcgtggtcgcacaagggggcaggcattgcggcagtgctcatttcaccgaatggtgtgccgattcggtacgctgcaaggctgcagttcaacacaaccaacaacgcagcggaatacgaagctattctcctgggcctaagaagggcgaaagcactgggggtccggcgcttgctaatccgaaccgactccaagttggtggcaggccatgttgacaaatccttcgaggcaaaagaagaagggatgaagaggtatttggaggccgttcggtccacggaaaagtgcttcaccggcataacggtcgaacacttacctagaggccagaacgaggaagcagacgccttggcgaaatctgctgcttgtggtggcccacattcgcctggcatctttttcgaagtcctgcatgcaccaagtgtgcccatggatagcttggagatcatggcaatcgaccagcttccggaagacgaagcagaagcaaagcgcttgcaactcggagccacgaagtataagatggtctcgggccagctctatcgctccggggtacttcaacccttacttcgttgcatctctttcgccgaaggcaaggaaatggcaaaggagatacaccaggggctatgtggcgtgcaccaggccgcaagaacagtggcctccaaagtgtttagacaaggagtttattggcccactgtgttgaaagtctgtgttgagcaaatcaagaagtgcgaaagttgccagcgtcatggtcgaagccaaaccgcgccccagtatgatttgcagcccattgcgccagtctggctcttcgccagttggggactagacatcattgggccattcccagtggcgcgaaacgggtataagttcacaattgtggcggtggaatatttctctcgatggattgaagccgaacctctcggggcaatcacttcggcaacagtacagaagtttgtgtggaaaaacattgtctgccgtttcggagtaccaaaagagttcatcaccgacaacggcaagcagttcgactctgacaagttcagagaaatgtgcgaaggactgaacctggaaatcaggttcgcgtcggtcgcgcacccgcagtcaaatgggggcggccgaacgtacaaatgcccgttcatgcttttttatggcgacgaagcaatgaccccagcagagctaggggctaactcaccaagggtgatgttctctagacgcgaagaggggcgcgaagtgtcgctcgaactcttggagggggtaagagtcgaagcacttgagcacatgcgcaagtatgccacaagcacttcggcaacttacaacaaaaaagttcgaccgacggaactgatgcctggtcatcttgtcctaaggaataaagcgaacccgattgctgttggcaagcttgaatcaaagtgggaaggaccatacctcatcaancacaagtctaggacgngatcttttcgattggcgacactagaaggtgacgagttcgnccattcctggaacnccgcctctctcaagcgcttctatgtctaa

SEQ ID NO: 1503 - DNA, 3531 bp, Oryza sativa
  misc_feature (6)..(6): n = any nucleotide
  misc_feature (96)..(96): n = any nucleotide
atggtnaaggcgcggatgacgacggcggacgtggcgtcggaggtcaagtgcctccgccgcctcatcggcatgcgcctctccaacgtctacggcatnacccccaagacatatcttttcaagctgatgaacagcagtggaatcactgagtcaggggaaagcgagaaggttttgttgctgatggaaagtggtgttaggctgcataccacccaatatgtccgtgacaagagcaccacaccatctggtttcactctcaagctacgaaaacacattcgaagcaagagacttgaagatgtccgtatgcttggatacgataggattatcctgtttcagtttggacttggcagtaacgcgcattttgtcattttagaactatacgcacaaggaaatatacttcttacagattccgaatacacagtgctgacactactccgttcacacagagatgataacaagggattggctatcatgtcgcgtcaccgctacccagtagaagcatgccgtgtttttgaaaggactgactttacaaagttaaaagacacgctgatgatgaatgcagttgatgataaagaatcttctcaagttacacccggttcaattgatgctcaagaaccttctgtaacccccagtgatggagtgccggttactgataaatctgaagaaccatctacaacaacaggaaagaagtcagcttcaaaaaacaagcagtcaagttcaaatgcaaaagctagtaataatgctccatcaaataaatcaactctaaagacacttcttggggaagcattggcttatgggcctgcattagctgagcatatcatattggatgctggattgcttccaagtacaaaggttgggaaagacccagagagcagtattgatgatcacactattcagtccctagtagaatccatttcaaagtttgaggattggcttgtagatgtcatgtctggtcaaaggatccctgaggggtacatcctcatgcagaataaggcggctgcaaagaagaacctcacacctttggaggggtctagtgctagtcagaagatatatgatgaatattgccctgtcctgttgaatcaatttaagtcaagggaattcaatgaatttgagacatttgatgctgctctagatgagttctacagcaaaatagagagtcaaagggtgaatcaacagcaaaaatcaaaagaggactcagcggcacaaaggcttaataaaattaaattggatcaggaaaatcgtgtacatacattgagaaaggaggttgaccattccatcaaaatggcagaattaattgagtataatttagaggatgtggatgctgcaattgtagctgtccgcgtttcccttgcaaatggaatgagttgggatgcccttgctcgcatgattaaagaagagaaaaaggctggaaacccagtagcaggtctaatcgataagcttagttttgaaagaaattgcatcactctacttctaagcaataatcttgatgacatggatgaggaggagaaaactgcacctgttgaaaaggtagaggttgacctatcactttctgcgcatgcaaatgccaggcggtggtatgaactaaagaaaaaacaggaaagcaaacaagagaagactgtcacagcacatgagaaagcattcaaagcagcagagaagaagacacgtcttcagcttgctcaggaaaaaactgtcgctgcaatcactcatatgcgcaaagttcactggtttgagaagttcaattggttcatcagcagtgaaaattacctgattattagtggccgcgatgctcaacaaaatgagttgattgtcaagcggtacatgtcgaaaggagatctttccttgaggttctcacggaagttgcttgtttactttgcatctttggatagctacgtgcatgctgagttacatggagcttccagtacaatcatcaagaatcacaaacctgataatcccattccaccattgacattaaaccaagcaggatctttcactgtttgccacagcaaagcatgggattcaaaaattgttaccagtgcttggtgggtgtatccttatcaagttagcaaaacagctcccactggcgagtacctaacagtgggtagttttatgatccgtggcaagaaaaattttctcccacctcacccccttgttatgggatttggtattctattccgtttggatgagagctccttggcatctcatctaaatgaaaggagggtcaggggtgaagacgaggaggcccttcctgatgttgagtctcagaagctggaaagtaatgctgaattggatggtgaacttgacagtgatagtgagactggcaaggagaaacatgatgatgaatcaagcttggataatatcaatgttaaaaaaattgacaatcccatcccttctaatgcaccttatgttaaggataatgctgattcatctgagcagctttctgaaatccgaactgtggtaaacagcactacttccacttccaagggacaaacaagtgatcgcactgtttcatcacaacttgaggatctgcttgataagaatcttggtcttgggccaactaaggtgttaggcagaagctctttgctcagcagtaattctgcaagcgtggcagatgacattgatgatcttgatacgaagaaaacatcagtaagagataaaccatacatatctaaagcagatagaagaaaactgaagaaaggtcagaatgttggtgattctaccagtgactctccaaatggtgaagctgccaaaaagcctgttaactcacagcaagaaaaaggaaagacaatcgaaaagcctgctaatcctaaagtaagtcgtggacagaagggcaagcttaagaagattaaagagaagtatggagagcaggatgaagaagaaagagaaatccggatggctttacttgcgtcctctggaagggcctcacaaaaggataaaccttcagaagatgtagatggagccactgcagctcaatcaaaaccatcgactggtgaagatgacagatcaaaaatttgttataaatgcaaaaaatctggacatctttctcgtgattgccctgaaagtacatctgaggtggatcctgctgatgtcaatgttggtagagccaaagatggtatggatagaagcagcgcccctgctggtagcagcgttaccatggatgaagatgacatccatgagctcggtgatgaagagaaagagaagttaattgatttggactacctaactggaaatccactgccaagtgatattttgctatatgctgtaccagtttgtgccccttacaacgcattgcaggcatacaaatatcgtgtgaagattaccccgggaactgcaaagaaaggaaaagctgccaaaactgcaatgagtttgttcctgcacactgctgacgccacaaaccgtgagaaggagctaatgaaggcatgcacggaccctgaattggttgctgccattgtagggaatgccaagatcaccgcacctggcctcactcaactgaagcagaagcagaaacagaaggggaaaaaatctgcaaaagaaaactag

SEQ ID NO: 1504 - DNA, 3429 bp, Oryza sativa
atgggtttcgataatgagtgtgttctgaatattcaaactcttcctggtgaatatttctgtcctgtttgtcggacgctcatatgtcccaacgaagctctgcaaactcagtgcacacatctctactgcaaaccctgcttggcttacatagtggcaacaacacaagcctgcccttatgatggctatttggttacagaagctgattccaagggtttgcaacctcaggcgcaagcacaacacactgacagtagtatgatgcagtcatcagcaacaggaacccaggcagccgtgcaaggtccttctgcagtggcctcagcagtccctatgacgcctgttacagcagctcctacaacagtaccatccacaactacagccagagctggaacagattctgctatcgcagttgcttcagctggttcaaccactgtaagcaccgtggctgtggctccttcacttccggtggcacctactgctgctagtcaaggtcaagcacttgctcctcaaactccaacagctgagcaataccagcagcagctccagtaccagcagtactaccagcaacattaccctggatataacccctacatgcagcagtatcaacagtatggtcagtaccaacagtacacacaacctcagacgcaaattgcaccccagaatgtggctcaagctcctgcgcaatctgctccatatgctcagcctcaagttctacagcccaatcagccccaacacatggtgccattccaacctcagaatcagccccaccttacacaactccaagcaccagcagctcagtcacagtctcagcagcatccaccattgcagtctgcagctcaaactcaaattgtacaagcacaaccacaaagccaagtatctttccaacagcctcaaccccatgcacaacctacaacccatacaccagtccctacacaacttggtagccaaccatttgcaatgcctcctactcaagcaacaccatctgaacaccatcaggttatggctcagcaacaacagccacaactgcagcatttacctcagcagcaacatccaaatgcacagcagcaatcttatccacaaatgcaggcatatcatcagcctcctccaatgtctcatgcacaacctcagaatccttcagttcatgcagtaacaggtcatcaatcattttcacagcctcagccagcacatcagatgcaacaaggtgctccactgcaacgttccctacatgtatctcagcagcaaatgcctagtgctcagcatcatgcacttgcacatactccacagggccaacaaccaactatgatggctcaagggattcagcagacaccacaacatcagcatgttgggcatcatgccctgcggccagaaatatatgctagcattcctccacaggcagcaccacaaggattccctctaaacgcacctgctccctcacaaacaggtcaatcataccaacaaggaatgccctcatcacaacaactgatgcatgcacctctccaatcccaaggccaacaatttatgcaacagcaccctactcatacttctgctggtcggtctatgaattatgttgcaccacaagagcagttccaaaatcaatctggtggtccagttaaaggtttacaggcaggtgtgatgaatcaacaaccaccaatgcgtatggcctctgataatgtaggagcaacatctgaattgcatggtgctggacaatcttttgggcagggctcttcgtctttaaaaaaacctacttcggaatctgagaaatcagaaaatgcaactaatggtactggtaatacagaagtaagtgggaaaaatggaagtgctgaatcagctcttgtaaatcctatttcattggatgggtcagatggttcagacaaggggaaggggaaaggaaaagttgacttttcagcttgggaaagtaattcacatgatccagatgctcggggaggcaaagggactaggtctggtatatcaaatgatcttgtgaaaggtggatcattacagcaggcaccacaacatccttatggacctgattcaatgcttcctcaacatatgcgtcagcctgggcatatgccgtatatgcaggggctgccaaatcaaatgaggccacctaaacattcctttcctgaaaatagtcggcctccaatgcaacaaccatttgaaatggcacctagggtgcctggtccaaaccaaaatcagatgcaaatttcacagtccatcagacctgatggtgctatagttcggccaccgatgggggcaccaatgcctgggctgcatgattcaacagttcctccttttgctcctgaatatgttggaactaaaaagaacaatagtgttggcaatggaccacatggaggctcaagggctttatttgaaggtggattcaattcttcacagaaacattccaagtcatgtgcagcaaatcctggcagaaacaacgttagccacaaagattttgaagataatatgaagcagtttccagtgcctactcaccttgacggtgaaggtcatcaaaggggtcctagaccttttgaaggaggtttaggtagacctgatggttttgctgatatattacctggaaggcctccattgacaaatcatcctggtccatttcctataggcttcggagaagattacccaaggaaacccaattcgactgttagttatcctgactttatttcgcctggtgcagaatttggtcatcgtggtattgatggaatacctactcttagaaatgcagggatgacaggcgggcctggaggtttgcataaagatcagctaggctctagtaactttcctgggagtggacaccatgattttgacaactcagagttccctcgtactcgattccatcctggtgatgcttttgtgccaagaaatctgcacggtggtggttggggtggtggccaattgcatggcattgagccttctgactatggctacagaggtcacatgcatgcagatgatccaaatattccaattgattattctcggcatggttttccaaaagaatctgcccactttggttcgggtggacacttgagagatggagatgtcagttggtgccgtatatgcaatattagctgtggtacagtagagaacctgaatatacatgtagagaccagggaacaccatcaacatgcaatggacattgttctgaaaatgaagcaagatgttgcaaaggggagaaagaagttgctggtaatgcttctggaactatctgagaccattgaaattgggtcttgtccatacattttggttaaggaacagagagaccaaatgtcaagccgtcgaggtgcagatggcggcggtcgcagccgtctgccggtgccggagcgggcctcatgggcgacgacgtggctggctgtggctctgttcttgcacggcacaaccgcctgggccgttggtgctgcccgtgggcaggcccaacccgatgtgtag

SEQ ID NO: 1505 - DNA, 3405 bp, Oryza sativa
atgtcctttaatggaactgtcatgtcacagattgcagcaaaattgagttatttccctgatgtcaagcttggtgtcaacatccctacacggagagaaagccatgatttgcttgacgttgatggtgacaaaaatgattatgagtggttgttgactcctccagagaccccacttttccgttcattggatgatgaagaagaacagtctgctggtcaggattctaggggcagaactaagagtaagcccatacgaatttcggggtcatccacagtggacaatactcaaaggtctagtagaagcagtgcaagccctattaggcttagtccatcaccacgctccatgtcaaggacaagaccctctagtgcagcttctcgctctagtccaccatttgcattgcaaccaccaacaccatcatggagaccttcaactcctccatctgcaaaaacattaacacctccacggagatctccaagtcctgcctcaacattaacacctccacggaggtctcctagtcctgcctcaaggaggatgagtactggttcaaccccagcgttaaataggacaaggggtccttctccagttaaaactaaccgcatatcttcttcaccaaaacttcaaggatggcattcaaatgttcctggattttctcatgatgcacctgcaaatcttcgaacttctctgccagatcatccattatcccattcaaggggtggatccccttctcctcctatcagtggaagggacatgggttccagaggcagacgccaatcactatcgcctactccatctagaagagcaagttcatctcatagtattgaacgagatcgtttaagctcgtatagcaaagcttctgcaacatcttctggtgaagatgatctggattccatgcagtctctaccagttgcctattccaccagcccagctgtaaaaaagagcttgtctatgatgaagaccagaactattgcttcatcaaagaagccgtccacaactttttccactagttctgtcccaaagcggtcatttgattctgcagtttggttgatggatcatcgcaaagctcccaataatatgttccggccactgctatcaagtgtccctactacgacatttaatgctggcaaaggaaatgttgtgcagcggcctatgttttctcataattcttatatgacaactagcagcaatgcaagctctgagcatagtgccagtttcggcccatatgtggataacgaccaagagcagcatgatcagattagtgaatgggatgataaccatcaagttcatggtgatatatttatgtttgataaattggatgaattgaatgaagaaaccagtcatgaggagactacaaaatttgtggaaagtgatagacaggacattgacatggaaaagggttgggcagctagtcagacttctggtacaaacagttctcatgttggatatggtgaaatggctacttgcaccaggtgcgggaacgttttcaaggttatggatgtggatagacaaggtgactattgtgaagaatgtggtttattgcttagcatatgttctgcaggccctgtgacacaaactttacaagaagcacaccaacaggacgaaataactgcaaattgtaaatcatatgctgaatctggaacttctatagcctcggattgtgtagagtatagggaagaagcatctcttggtcatcaatttaatgatgaacctccagctgattgtataaaagcatgttccccacttcagtcaatggtggacacaaatgaggaaatgctgctggctcatgaggtaatgaatcataccaaaaatataaagccatatcatgttgatgactctctaagaaataacaatgatatttcatttcatccatttaaggtaagtgataaccaacaagcatctgcagaacacgagcatttcagggaccaaattaacagccacagtgaaagcttgccacaatgccttcctgagctaaaccgccagcataatgattccatctctcaaactgcctctggtgataattatcaactgggatcaacagcatattcaagtcctaaggtagaaaacactgatgccactgggatatcggtactcttactccagaagtcaagtagcaataaatggcctgttgtggaaggaaggactctgtctgcaacaaatattctttgttcagaaccctattatacaagggatagtatcagtgctatgaggcgtagctttggacgggatagctcttcagcaacttcttccattgatctagggtcatcaaggcaatcagatgtacgttttgagcgtctcaggagtggcaagaggggtgatttcgagaaggctcgaatgagcagtaccatgagccatcaaagtgttgcttcagtgtcagatatgtcaattagtggttcatcagcttcactttgccctcagagtgatgttattggtgacacttgtttcccaattgacacgctggaaaggagtgcatcgagaacaacagtctctattgaagaacatgacagctcttgtatggatgctttatcaagtggtatggagtgttcatctgctgtgcagccgataatcaatgatgaaatccttgttgacttgaacacctcaggttttcataggttaagtgaaacagaagatatacttattaagaaccataatatggaaatggtggctgacaatgatcatttgagcactaacttgtgtttatcagatattgaaatgccaagtgatgccctagaatcttcagctgctgaggaaagttatataccaaaaactgaggaagatacttccaccaaagcacactgctatacaatcagcaccctagagcatccaagcgatgagaacaactttgatgatcttcaaatgcagtctgaagcagttcagtcttcaaatgaggaaaataaatccaatggctgttgcacgcttgctgtctctgaggatgacgtgttggtttctggaacagatactaacataaaggaacttcctaatgatgcagaatcacccgaggcagttgaaggatcgaggaaagaaattcagagatgcttcactttggaagaagctaccgatacaattctcctctgcagttctattgttcatgaccttgcatacaaggcagcgacaattgcactggaccatgagcaggaacgagtacacgcagagcctactcgcccatctgttaccatcgttggaaagtctattccaaaggaggatggtttacttaagctgactcacagacgaacgcctaaccgtaaggttaaaaggaaaagattggaaggtgaaacaaccataaccgaaaatgctgaaaagaaagatgatatctctacagaccactcacccgtgcgttcctcttctggaattacaaggacatctgagagcatgaagcctccaaaactggaatccaagtgcaactgtataattatgtaa

SEQ ID NO: 1506 - DNA, 3309 bp, Oryza sativa
atgtcgcggcgcgcggcgccgatgatgctagcgctgccggcgccgccgcggctggggtggggagggaggacggtggtggtggtcggtgtacgggacgacgcggaggggagggagctgctcacctgggcgctcgccatggtcgcctccgccggcgaccgcgtcgtcgcgctgcacgtcgccacaccccctgccgccgccgatcaagaaggcgccatgagaatggcggcgaggaggatcagagccacggaatcgctcgccgcattgctccgcgcgtaccatgacttctgcgatctcaaccaggttccagctcatcgcccacacatcagcctggagctcagaatctgccatggatcatccatcaagaaggctctcgtgaacgaggcgagctcctatggcgcggcgcacctcatccttggcgtcacaaacaactcccgtagccatctccggccatcgtcgtcgtcctccgccaccatcgcgaagtactgcgcgaagagagtgcctccgagctgctcggtcctcgccgtcggcaatggcagggtcgtgtacaggcgagacgccgcgcagcagcaactcaaccagtgcatcagcccactggtggagacgccgaggaggatttaccggaagatttaccggaagctcgtcagagcggcgacgacgatcacccgcgagaaatcccaggacgacgcggcgatcgccggcggcggccggcaccttcgccggaacatctcgacgccgacgagcgcccccgtctcgccggtcgtagcgttcacgccacgtcaggcggaggtcgccgccggctggccgctcctctcgccggacctgaagtccgccttgccagagtggacggagatgtcggtggcgcggtgggcaatgcagctgccgagccggtgtccggcgccatcgccgctaaatccacgcaataactccggcgaccaagcgacctcaccggccatcaccgcatcggaaactccatctccggcgaccgatgaagcggcggagcaagttgcacaagagcttgcctcgctgagaaacaagtactcatccaaagctgctcggttcgtgggatttctcgtcattgaggtcttgggaaggcagcagtgcaaggtggaagaagaattgggcaagggaggtgttcaagaatctagcgcacacaacctgttcgacagaatgacaagccaacataaggtgtttaaggatgatgaaaggatagcagagcccgttcccatcaagtccaccatgaacaaggagggaatatccatggatgaagctttagatcggattcttgagaagtttgagttgatggaggccaaccgtagacaagaggagaagttcaatcaaatactacagaagttggaggaggtagaagctcgtaggagcaaggctgccgaggagacaattgcatccatcagggcaaccactgctattctcaaggctacatcacctacagcacccatggcaccacctactctagcgcctaccaagtgtttgacagaatgccccaacaacaacctcacttgggcgacggctagttcaagtcacattagtgaggatactgctacaacagttccctgggagctaggagacaacaaggacaagggccacgccccctgcgtcatcaccaaggactcacccgaggtcacgcccaccatgtgttcgacgaaatgctccggtcctaccgtcgagcctgatctcactgtggctgcagtggttacgtccgccaccactgccgcggcctctatggagttggtagctgctgggaacacaatcggtgccacttacatcaacaatcttgaccaccccaaggtgacgcacgccaagtgtttgatgttggaccttagctccaatagtggcgccgaccaaactgtggtcacgttcgagaccttagtggacatgactaaaggcgtttttgcacctgatgcaacaattgaaggcagctcaccaaggaagatcgttgaaatagacttggtcatagtgatgcctacagggtgttcaatgctattctttgacaaaggtgccagtgagttgttgcctgtaaggggacacgttatgtggcaattgttattggagcagtgcaagcgaaacccttggtcgcctcctaactcagtttatcaagttaatggaatatgggagttgtggcatgtgccctggctggacttcaactattttaggacaagattatctttgatgccaccttggccaccatcgactcaaattggaaccataatgctttggctggtggcaaactcatggctgagggtggtagagctgaaaccgtggcctgacccacaatcaagtcaatgtagcacaggcgggaggtggactgaactgaaagtcccatggtcagcaccagattgtgaatgttctatgggagatgatttttgcagtgccaattgcataagaaacgaagcactttctgttgcattatcttgtgcacctaaaggagatttaaatcatgaaaaaattgatggatcacagaaggataccttggtggcattacttatcttggaacatttccattatgtgggtgatgaagaaaaagttacacagggaatgctaaatggtctaattgcagtgggctgcaactacttgatcctgatcatgtgtgctgctataatcacaacaacatttcatcttgctatgattacaactcagggcaacaacgtatatgggccaaatcaattgcatgagaagctcattcccagattgattcctttgaccatgagaggattgcccctgccaattcatgcttttgaggtggttcttcacaagggtcaggtcggccatgtgtatcatatcggtactgcgaaggaaagaagggtgattgatgaggctacggacatatcggtacgggattctatcctttggccaaaactgaagcatgttgatgtactggaggatggaaacaacaggtggactagagatttttcaagtagaagcattgtattgaaagggcgacaagattgtggactttgttggtgtgcactggatgttatcagggatgtgaaagttgatctggtcctgcaacttttgaagcaatatggttcagcaaaattggtgatcattaattccttgagtataccatgggatccaggcggctctcgtgtgacactggctgggcattcttcttgtcacattggctacattacaagagaagcattaacagaggaaatcaagtataaatcattgcatcaaacatatccgttggtgaagtttccacatttaaggtcatcggcttggggacaaaccaaatttcaagaaatggggattgttaggaaatcttgtgggctgcaatgtgggccagttcagtga

SEQ ID NO: 1507 - DNA, 2826 bp, Oryza sativa
  misc_feature (908)..(908): n = any nucleotide
atggccggcggggagcatcgactgcagatagcggccaagtccgacgggcaaggcagggcagccgcgccggagaagtgggtgaattgcttcgttcgcgtggtggcgctgatggagaggacgggcaacgcgctcggcacgctggccttcacctgggccaccgtcgtcctcctcggcggataccccacggtgctccgctcgcaggacgatttttggtacgccacagccatattcttcctagaagccgccaggatgttcagtggcagcaacaacaggcacgattaccaattgttcttccgaaccagaggtgctttcagacctcttggctggaatggtctaatcgccatcgtctgcattttagatgtttgggtgttgttggttctccagaagaaaatagttatggcagctgtagtggtttacgctatgataattctgcttgcacttggccagaatatatctcctgagtttcaaccactatgcaatccattccgccgtgccatatctctatggagccccttagctgcaatactgttgctaactccaaccatgcagcatcactcaagggaacttgtttggaataccacaggaggcagattaacaccgaaaataacggctgaaattaacttcatcccaagtaggttcacagttgccaaatggacagcgtttttcatattgctcgtagttgtgctcatggtaacaatcagcaggttgcggttcccaatagtcatcaaactagtagatagtgctctgtgcagaaaactattagtttggggtcaaactatccagaacatgtgcatgcttgctgcgctagtgatgttggtactgactagtgatgggtcctttcggtttgtaacaatcttgtcactagtcagcattacattgatggtgtcatctggcaacttccagatacnagcagcagccatgcgtgctgaaatcgcaaacttcgcactgcaccgccttatcatgccacataacggctacagagaacatggagaggatccagacagcaagactaacctggtaccatctctcattatcttctatgggatggtgatggcccaaggaatactctacattgtggcatgcttcctcgatatcttttcattcatcccccggagattcctcatccggcgtgctggattgagaggtcagctgggagtggaatatgtcaatctatattatgcatatgccttcgagaaatgcatgggaggggctgtgtttgttccaaagaaaatcagcctgagtaactttgccataaattccctgaactcagattctcctaagaatcatttctatgggattcaactgatgcatagccttctggagaatgaaatgacaagggttcggatccttgacaaactcatcacttctacaaagaccatcgatagaataatcagtatgttgggctggactagtccaaataatacgacggtcagattatatgcagctaaggtgactgctgagcttgcaaaggacctccaaatcatcactgttcctacggcactgcagcttgtatctgcacttctggacaccaatgccaaacttaaaaagggaaatccacttctgcaggtagatgatgaacaagaggagaggcaagaccccattctcaacacagcaaatagccaagaggaaagaccggatgcaattaggaatccagatgatgacccaaagcaaagacaagagccagttgaaggcactgataacctgccggagacacaaacttgttcagcccacatccatgaacagaactgcatactcagacgaagatggcagcagatttcagagtactggaaagttcccaaagagcattcattgacatactatgatcatcttcctgcacttggcatgttgattattgacaagcttgctagctgtggtcaaaataactgtgtggaaatcgatagagtagctgacctcattccgaagatcataggatttacaagcttcagaggtgacatgacgaacagcgaggcacaacaaatggtcctggtaaagtcatcgctgaaggtgttgcagaggctcacaagcattggaggagagatcggcataacactgcggcagaagattgggcacatgcaggtgctcataaccaggctgacgaaggcattcctcaatttagatagaacctcaagcacaaatgttgattgcttgctaacaaaggtagccgggcaagaactggcaatgctggcaacagataatgtgcacaactgcttggttatgttgaaagaaccagagtttatcaataaactcaaacatatgatcctgatccatgatgaaaagtatatatatgtggcggcaaccctattgtgtcgtatgtgccagcacgccctagccaagctcacagaatcagacctgaaggaactatgtgagaccttacatgaggtcttggagagaataatgaatgcagaaggggcagaactagagatcctcattggcctaagttcacagatatgcaaagtcattcctgaagaattttcccaagaactagatgacgaacagattaagcaaagattcataaagaggctagttgacgtactgaatgcaaatatgaacccaggtgctcactgtcctgggattaggagggtgatacttgagcaatctatatacatgatggagggcaattctcactataccagttgtttcaatgaattccgaatgatagaagcactgtggatggtagaagagatgccctcaggggttgagaactacaggattttcttgggtgacgcaggttttatggaatacagcacacctctctttgctcttgtggacagagcaaaagaactgatgggccgtcagtgcctgcaaggagacagtagagttaactga

SEQ ID NO: 1508 - DNA, 2607 bp, Oryza sativa
  misc_feature (2142)..(2142): n = any nucleotide
atggctccccgcaaaccgaatccagcctccgcgacgggcctcgatcccggccaaattgacgacgacaccaccgcctttttaggggtttcgcttgtggacagggaggagctggcgaagttggtcagctctggcgcggtggtggaggggcaggctttcgccccggggaaggccgttgtgccgaagcctggcgacaaccggacggttgtgttcaccgtcttctgcgaggcagggcttcttcgatttccgtgcaacatactgttgccggagatccttctcatcttctgggtggagcttccccagctgagcccgtcggcgctcgtccacatcgccatctttgactgggcgtgtcggaccgccaggttcaaaccgagcgccgagctcttcggcgcggtattcttcaccactatgaactcaaagacggtggtcaccccagccgggacgaagaagactgtattcggcagcgtgaacttcaatgttcgtcccgagcgctccgatctctggccagtgaacgccgccatgtcgaagctagatcgccattggatggcgaagtggttctaccactccattcccttcgaggatggatctgatgctgtaaatgccctcaggtggcggcgtgggacaatctcgccgaacaggaagcccaaggttgccattgatggcgccatggaggcctggttcactctgctacgcaatatatgctctcgcctcagttaccgcgacctggtggaggagttctgcatgcttggcatcttccccctttccaagtcgtggcaagtcgaaatcgaccaaggcagggaggtcgacggcctgccaaagctcgtcatgcctgcggaggcgagcgttttgactcttgcacaggccgagaccaaagctcgaaagatgatcggcgacgtgtcggtcactgagttcagccagctgctcacacggcaggcggccggccgggcgaaccgggttcatgatggcgaactgcctccccgtgcgacctccctcaagggcgatgacgatgcggggccttcgcgcaggcggatgcgcgggcaggtgaaaaaggccccttgtaagcgaagggaacccgactccgacgccgatgacgaggagactgcggaagaaaacaacgacgaagatgagggggaggatgtgaaggaaacggaggctgtgggcgaaaaggccacgggcgatgccgccaacaatcgcgccgagacgcccggctacaccccaacctcgagccccgaacccgtcgagaccggggtggagtcgaactgctcccccctccgcccaaaggatgtggagggggcgatggcgctggtcgtgatcacggcggccaaagtggggtcgattaaaaagacttccaggaaggggctcgtcgatgtcggtcgcgtctttagtgacgacaagtcctcgaacgagacccctactttgcctgccggccggagcttggatctttcgacgggcgtgcatggctggcgggagtgttgccggtacttcggcttcaaccgatcagagtgcgaagaccgcagccagggtcttcggcagcccggtccgccggccggttgtttctccgctcacccttgggaaggggaagaaaacggcgctcgaaacatccgtttcggattattcccttgcggcgccacacttcgcccatggcgatttcgaaacccggcggaacatatcccctttgtcgagggggtgagcaaactcgtttctccggctgggagttcgagtctgttcacagagcagaacgagttcgacgagggctgctctgccgtcaagagcttggcggtccggatcctcgctgcccactgttcaaccgagcgaaccatgcgggctcgtcttgacggtttgaagaactgtcttcgagccaaagatgacgaactgggccgcaagaggctggaaatggaaggcctcacccacgccctcaaagagacgaaggccgagaacaagcggctccaggctgaattggagaaggggagcgaggcgaaggcggagattgagcgcctcaaggccgagctcaaaaaagagcagggtcattccgccgttctgaccgactactacaaccttaccgagccaaagatggaggctcttcgccaagaggtcgtcaaagcggagacgaacgccaggaaggaggcacagcggttcgcgtggganatggcgaaagcgactgagtccgcgaagaccgcttgccaaacgcttcgccttgcccattctgatatgggggcgagagtgcatggagtccctggcgaaggtgcttccgcattcgacttctccgagtggactcaacaagccggcggtgtagtctcagactgtgccactgcgtatggcgacagctgtgcgcgcgtgtcagcgtctttcgccctgggtcttctgcaacagttcggctgcgagcacgtcgccgagttccccaactttgcgaaaggggactgggagattagtgtgcaggacatttcgcctgctctgcgagcttggcgtaagcagttctggcagaaggatggccgctccgttgctaaggcgcgcctgcttgagcagctggcgaaggcggaggcggcggatcggggcgaggagccggcggccggcgggggcggaggcgatgccgaggatcacccagaggtgtga

SEQ ID NO: 1509 - DNA, 2556 bp, Oryza sativa
atggagaatagcgagcaagagaggacggactcaccattggagtatgatttgaggaagtacctccttctgttggccacccttgtggccacggtgacatatggtgcaggattcagcccgccggggggtgtctggcaggacaccgaggccgggcacctcgctggtgactccatcatccgggatagccagtatcgccgataccttatgttcttctactgcaacgcgactgcattcgcgctgtccatcgtggtcatcatcctcatcttcatccttgctatcctgcatgagaaggggaagttacagatccccatgcttccactgcgagcagccatggtgctggacctgctaagcctcattggggcctatgctgcagggaccagtcggggtgttctcacagccggcaacgtctctgcacttgtggctactttcatctatatggtggcacagatggtggtaactttatggcttgacaagaaacagactcaggatataagctcaggtgatgagaagaaaaaacggcaccgcaaggtactgatgcttctcgcaacatttgtggcaagcatcacatacatggctgggctgagcgcaccgggtggctactgggataacaaccaggagggccaccatccaggcgatcccgtcctgtgggaacaccactctcgccgtctgagggcgttctttgtctgcaacacaattgcatttgtcgcatccctgctcatcatcatgctgcttctggacaagaagcagcggatcttcttacccctcgacaagataaagatcaccatcaccgtacggacttatgtgctctacgcgtacatcaccattgctcttttaggccttgtgggggcctatgtggctggcagctgcagaaagcctgacactaccatctatgtactcagtctggttggtgctgttcttttatgcataggcgccctccaggcagtcctattttttctgccacaactttcaaacatatcctgcttgccaataattgcaaagttatcatgttcaccgggagggccatcagatagcagttccagaaagaatacaagcagtaagacagatattctggagaaggcccaatctcttgttgtactgcttgccactcttgtggcaactgttacttaccaagcagggctagtcccaccaggtggtgtctggcagaaaaaccaagatgggcacatggctggcgaaccaatactcttatccacacaagccaaacgttacaaggtgttcttttactgtaactcgacagcctttgcagcatcattggttgtcatagttttggtccggtataaacctttgctcaggcgccgcattctagagataactatgattttggatctgtttggtctcatgggtgcatatgctgctggaagctgccgggacataaccacatcagtttacatcattgccttggcaggcggtgttctagtctatgtggtgattcatgttgtgttcttcacgcttgaagacaatgacaaggagaaggaagttgggaacacgaattctgtacgaaatggttcagttgtgcgcacccaaaataattcagctgagggcaatcttgctgagaaagattcatgtattgacaaaaggcgcaagaggctgctccttttcgctgttttgggcgcgaccctcacttatcaagctgggttgaccccaccgggtgggttcagagttgtggatgatggttttgggcgccatgctggtgatccaatactcttttacaactttccacgccgttacaaggcatttctctattgtaactcggtaagcttcatgtcatctctttccctcatcatactcctcgtgaacccaaatctgtataggccagctatacaaagctatgctctttcggtttgcactgtagcaggcttgtttgctcttctgggagcctatgctgccggaagcactcaacatctgaaaacatccatttatgtctttgtgttggtagctgtggtgcttttcattatgatcatactcctggtgtgtttctatcaaagtgagagcaaagagaagcgagatgacatatccaaggagcccgttgagaaagacaaggacagagccaaataccatgccaagcgcaagtacttgatgttgctaggggtcctggctgcaagtgttacttactcccaggctggtctgaacccacctggcggtgtgtggcagggtaatagtgacgggcatggtgtgggtcactcggttatgcatgacaataagaggtatcgctacctcaccttcttctacagcaactcaacttcttttgtggcatctattgttgttatcatcctattgctaccgacggaactgctaaagaagaacaggtggctaagggtgatgaatattacaattgtgctggacttgctcggcctactgctagcctacgtggctgggtcgagcatgagatgggaaccttctggatatgtcattgcatttgttattggtgcactaggctgtgctgcaatccacaagtttttgtcatttgtcagaaggtctcagcaacaggggcaaggaaatgatcagccttctcggttaccagaaggcggcagtcaagcttag

SEQ ID NO: 1510 - DNA, 2436 bp, Oryza sativa
atggcagccgcggcgggtgcggcggcgtttgggatccgacgagatgcgcccaaggcatactgcttctacggcattgagtggacgggagtgccttacttgccgggcaccgccgccgccatttatatcggcaacaccaactcctgcatcgccggctaccactcgccgccggacacggccacctcctaccggttctgcatcccctcctgggtggccttcaccgccaacgccaccaccctctgcggccaacccgccgtcgaccactccgccgccatctccggcttcaagcgactcatcggcctacagccgggagatcctcacgccaagagggtggcgcagattgcgccctacaagctgggggaaaagatcgggagatgcagcatccaggtccaactggacgatggcgccaagtgccgtgtggaggatttccttcccgaggatgtcgccggcatcctcatcgcccacctcaagagcacggcggaggcgcacctgggccaccgcatcgacaacgccgtcgtcaccgtccccggccacttcaatggaaaccaaaggcaagagtacggcggcttccgctacgtctccgtcgtcgacgagcaggtcgccgcggccgccgcgcacggcctccacgaggacccgggcaacggcaaggtcatcctcgtcttccacctcggcggccgaaccgcccacgccaccaagttcgtcatccgggacggcacacccagcctcatcgcgctgcgccatgaccccttcctcggcggggacgacttcaccgccagggtggtggatcacatggccgacctcatcaaggacaagcacggcggcagggacgtccgcgccgacgccgccgcgctccgcaggctgacggcggagtgcgagcgcgccaagaaggcgttgagctaccagcaagagacggtggtgaccatgcgcttggacgacgacgacgacttgttctcggagcctctcacgcgcagcaagctggaggagctgatcggcgacctggtgggcagagcggtggacctggtggagagctgcgacgctagtggcggcgacgttgtgggcgtcgacgagatcctgctggtgggtggaagcacgaggatccccatggtccgcgacctcgtcaaggactacttccatggcaaggaggccagcaacgagaagggcgtggagcctgacgaggcggtcattcgcggcgcccttcttctttcccacccacaccaggctagcaagagggcgaggccatttctataccctgatgcagatgacgagaaaaaacctcctacctccacagccagtagcatccatctcagatgttcatccagccgccttgaacaggaggattcttggaggcaaataaattcatccaggatgctggccactgaaatagcctgtactctgtacaagagcagagcgtttcaaaacagctacttcatcatgctggaaaaggaacataaaaccgttttgcgctggcgtggacgcggccggggcgtgacacgtcagcgggcgctggaaggaggagagatttcgcgagcgctcctgcctccgcatcgtcgctgccacccgaaggtgtgggctggtttagcacgaggtttggagtgtgagccgcaactggagacgatggagttgaaggaggcggcgttgctaccaacgccgacgttctttttggcgggtgagagcagtaggagtacttcgacggcgtcgcctcacgcagcggctatggaggagtcgccggagggagagccagagtggaggcgatggagctggaggcggcggcggtggcgttctttccagcggcggacggcagtagcagcagccaggcaagaaaccgtcaccctctttccttcattttggtgcctgcaattttacaagaggctcatcgatccagagccggtggggaagttggatgtgaaagatccaggatctccggatctgttgagcttggtggcggcagtgacaacggcaacgtctcagacacgccatccttcccgagcatgcaccggcgatgtgcaggagactgaggtcaaagcggatcttccccggctccatttgaccttactgattaaaacagtgatggtgtggatgtgcaaattgatgaacatgtgggatggaggggtagcaaccggcaatagtagtgccaccaggaggggtagcaagtcgctatcaacactcagttgccttatagttgcttgccatggcagtagcaccaggtattttgtcgggcctctgtttcccatgggcaaaagaaccaacagcagccacggacactttggttacactggtcaggtgagcaagaagcaaatcgtcaactccgtcacacgttgggcaacaataatcgtgcattaccgtccatcagctgccacccgtacccgtgcgtgtggccccaatggaaaaacgtggcacaatacatgccctctggccggcttaattaattatcaaccatag

SEQ ID NO: 1511 - DNA, 2409 bp, Oryza sativa
atggcggcgcagccttcttcgtcggcgtcgacgggcgataccaagtttgatgcgtcgcagtatgctttctttggcaacaacgcggtggaagaagttgagctaggtggattggaggatgatgatggtatcgatgctggttttgttggtcctggtgatgaagaatacccttctgcttatggaagggatatgtttgagaattacaagaaaacagatgcaatacggcagcggcatgggactggaacaatacacacagatacagcaggcccaaatacccagagaccagaggtactgctgctgttctcaacacctatcgccaccactgcacctttcccctgccatcagctcatggtttgctggctggcttacagcatgcaggaagcagtggggccttatgtgcatgatgaaggtggaggttcatttactggcgttgatgatcttgctggagcattctcaaagttgaccagaagcatcaatgaaccaacacaatcgggaataattagtcgtgggggttcaatttctagacaaagttctactctggactgggcacaagattcatattggcctacacagcctatatttggagctgaaccagggctgaataatgaaagccggtggtctcaaccacctcatttagcccgctttgctgattctagactgcacagaacatcctcatcgccgcagcaagatgctcaatacaatcctaatgaacatattcttggagcaatgccatctctgttgcatagaacttcatcatacccacaacaagagcctcaatacagtcacacagaaccaattccggtttggtgcagcacaatctgcagcgtccaaatggattggtcccacctcaaatgctgtcacgccatccacaacatggaaatggccccaattcaacactctccgccacaattctcacagttccatgctcagatgcttggtcctcggcatcctccaccaaaaggttgtcagatgtacaatcctcagcgtccatcacaaatgatgagtggatttgatgcaaatttggcaatgcctgacttgagtgatccgagagcaagagcaatgctgcaccatggagtgcatggccagcattatctcccccaaggttttgagcttgctggtatgaggatggataatgggtggccgcggttcagatccaagtacatgtccacgcctgaaattgagaacattgcaaggatgcagcaagctgctactcagatcaatgatccgtacattgatgattactatcatcaagcctgtttagctaaaaagtcagcaggaggtcaactcaagcaccacttctgtccgaccttgattagagatccatcatcccgtgcacggagtaaagatgagccacatgcgtatctccaggttgatgctcttggaaggttaccattttcttccatccgcaggcctcgtccgctcctcgatgttgaacaaacctctgaatcaagtgatgacgttactgaaaaatctgcttcaaaaacacttgaccaagaaccaatgctggctgctagaatcacaattgaagatggcctctgcctactgcttgatgtagatgatattgatcgcttgctgcaatttagccagcagcaagatggtggcttgcaactgagaaacaggagacaggccctccttgagcagctggcagaatccctgcaactagttgatccacttacacctagtaacaatgcacctctctcaccaaatgatgatctggtgtttctccgaatagtctctcttccgaagggccgcaagctactttctcgttaccttgaacttgtgagttctggcagtgagcttgctagaattgcttgcatggcagtcttccggcatctaagatttatatttggaaatttgccatctgatagtagtgctgttgagacaacgacaaaacttgctactgctgtatcaacctgtgttgttcggttggagttgagtggactaagtgcttgccttgcagctattgtgtgttcttcgctgcaaccccctctgcgaccccttggacatgctgcaggtgatggggcttctttcatcataaagtctgtactggacacagcaacagagcttctcactgatcagcatgtggcctctacctacagcatgcaaaacagagctctatggcaagcatcatttgatgccttctttgggctgcttacagagtactgcatgagtaaattcgatagtgtgattcatgcattgcaaacacaacctgctgtggcagcagttataggcagggaaatgccagttgaattgttgcgtgctagccttccccacacaaatgagtatcagcggaagcagttgctcggttttgctcagcgcacggtgcctgttaacaaccatagttctcatgggtccagtaatggacccatgacatcagaatctatcccaagttcagaaagctggaaaatatga

SEQ ID NO: 1512 - DNA, 2397 bp, Oryza sativa
  misc_feature (39)..(39): n = any nucleotide
  misc_feature (2226)..(2226): n = any nucleotide
  misc_feature (2228)..(2228): n = any nucleotide
atggcggggtgctcggaggggggaggaggagacggggangtggcctgctgcggcgttggggatacctcgccggggaccattgtgtgggtgcggcggaggaacgggtcatggtggcccggcaggattctggggcccgacgagctgccgccgtcgcagatcatgtcgccaaggtccggcacgccggtcaagcttctcggccgtgaggatgccagtgtcgactggtacaacattgaaaaatcaaagcgcgtcaaagcatttaggtgtggggagtttgatgcatgtattgagaaggcagaggctactgaagggacttctgttaagaaaagagagaagtatgcacgtagagaagatgctattcttcatgctcttgaattggagaagaagctgcttgcatcaaagcatcagactcaaggttccagacctgctaacgtttctgtttgctctaaacataacaaagatcttggaagtacccgctacaagagcaaaaagagtaagaaacggaagggcataactgcttcttctgatataaaaaaggaagctgagcaatatgtcctccatgctggctcaaagagaaactttcaagattctcctactcggggcatttctgataatctttttggcaatcacttgggagacatctcgcatgtgaggcatatacaggccggagaaaatttggatagcaaggagaaaatcacaactgcggaaaagattagatcagatggaagtgattttgatgaatctattgaaaaatgtgacagacgccaacctctggttcagattttgcacagcagtccaaaattgcctcatcagtcacagcacaatgatggctatggggatgtcctaactcagggagaaatggatcgatcacctgccaattaccgagctaaaagaagtagatatgtattcctacctactgattctggtgaaactcatagtcatagtgatttaccttccgtacaagtggcttctacaggaggtgattttgagactgaaagttatcttcatcatcctgctttttctgaggagcagacatcttctgatcttgttgagaagcacatatatgagtcttcagagagggaatgctctgagagtgagacagaagatgacgctaaacttttacaatgttcggatttgattctgcatccagcatcacatgcccatgatccttatttcttaccagcttctgacaagttcaggcatgcgaatattgatgctgatgctgatgagctgacctattcttcttatatgtgtcaagtgaatgaatcagaagaggatggctcttctgagttgggcgtctcccaatggcatatgaaaggtaaacgtaatagccgtaatgcacctaagagatcggatatggcagatggaaatccctggttagacaaatcagatggtttcatggaaggatctccgtataaaataaatggtagaaatcccagagaagggagtatgcaaatccaatcagcattgctggggcaaaatttttaccaaaacgaagaggctacaagagattttagccgaagctacagctattttaacgactatggaaatgattcttccaaggtttctcccctaaacagggattcagataagatatttcattttgatcggaatgcatattggagcggaccctcattctaccaaaagtacagttcacgtcttcgtggcaggggcccaatgttgtttgatgttgacttgaaggtccaggctagctaccagggagagcatgttcctcttgtttccttaatgagcagactgaatggcaaagcaattgttgggcatcctgttcaaattgaaatacttgaagatggttccactgaccacctggttttttgtggtgatgttagtttggaagggagaactggagggcaacctgcttggtgtacaggcaggaggactgccatgcaaagaattccccgatctaacccctcaggggcattggattgtgatgatgaaggtacccttgcatatccagactgggagatgaaaccagattttagaaagtactcaaattcagattttagaaagtactcaaattcaaatcatcaggttaaggttgataagaaaagcatctcaaatgttaggaggccgtcagcctctaaatctcaaaagaagcaatccaaaaaagcaagcctgtcaagccagaaggtccgaaccctctcttccatttccactggaaaaaagcatcatggagtaggtggtcaagcaaaagcacataagcagagtggnanttttggcggcttgatcaaaccagggggaattccacttgtcacatgtgtcctgcgaaggttgcctttactaggatactggaagctgttggcaggccgcccctggctgttgctcaccgtgttagaatggctagtcctgccttgcgagatccttcataggcgtcaactgtga

SEQ ID NO: 1513 - DNA, 2376 bp, Oryza sativa
atggggaagacgcagaagttctccaaggggcacccgctcggcttcgtgccggattaccggcacggcgtggagacggtgggggagtcgaagggctgtatcgggagcccggagcggatcgtatcggggagctcgtgtgctgtgccgaagaggaaatgcggaatcctgaagacagaggatggaggggagcttccggggttcaatgtgccgcgggacgtcttcatgctgccgaggatgtcgccttcggataaaaaggacctcgagatgaggctccgcaaggagcttgagcaggttaaggccctacagagtaggctgtttttgaggccggctgcggtgagcatgaatggcggggcggcgtcagcttctggagacgtagttgcaaagagaaacgatgcgaagcttaaacggagcaattcagtgcagtctggcagaggagtgccaccatcagcagccacacctgtggtcaggtctgcaaactacgcagaagcttttaaacaatgtggcaaccttctgaagaacctcttcaagcatcagtgggctggtccgttccttgcgccggttgatgttgtacagttgaacattcctgattattttgacataatcaagaagccaatggatttgggtaccatcgagaaaaagttgaatgcaggcatgtactctacaccttgggattttgctgcagatgtgaggcttacttttgacaatgccgtgacttataacccagtcggtaatgacgtgaatttaatgggcaaaactttgaaatgtatttttgaaactagatggaagtttatcgaaaagaagcttccttcactagatgataaattctctgtgagaagagagccatcacaaaagggtgcagttaagaaagataccattgagaaagattacccttctgagaaaaagcactcgacaaaaggtgtacacaagaaagatatgtttaaaaaagaggatgcttcaactaagccagctttgcaaccaaagaagagaaaagcttctcccttggttcagggttctcttgaaatacctgtagtagaagctgataaggtcattgatgatgctcaagtggtacagccttctaaggtgattgatgatgcccaagtggtgcaggcttttaaggtgattgatgatgctcaagtggtacaggcttctaaggagattatgacggacagacaaaagtatgagctaagcgtaagacttcaatcatatggtgggttgattccaaatcatgtagttgatttcataaggagccaccttcctgatgataatgagggtgatgaagatgagttagagcttgacatgaatgtcctaagtgatagtacattgtttgaacttcagaagcttcttgatgactatgatagggtaaatcagtcaggaaaccctacaaaagatgagcatcgtgaggttgagtttgaaagtgaatatgggcttagcaactcatcgatgcatcatgaagaaggtaatgagctcgttgaagaagatgttgatattggtgggaatgatcttccacctttgacgtatcctcctgcagtatttgaaagtgaaactgcagaaagaagcagcaagcatagcacttctagcagttctagtagtgattcagaatcatcctccagtgattcagattcaagtagctcttctggaagcgatctggatgtcaatgttcctccatcaacaagtggggccaaggacaacacgcaatctgcggttaggttggatcaggaaaacgatccactgagctcgaccaatctaccacaacaaagtagtgatcctgtacctatttctgccgaagatgagggggagaatgtgtctgagaaacaggtcccccctgcaaagcaataccgagctgctgttttgttaaaccgctttgctgatacaatttttaaggctcgtgagaaaactcttgatcaggtcgcgaaaaaggatcctgagaaacttcaacacgacatggaggagcttgaaaggttacgaagagaagagagagctcggatacaagctgaggcaaaagcagctgaagatgctcgcaagagagctgaggcagcagcagctgctgaggctgctgcagaagctaaacgccaaagagaacgtgagagggaagcggctcgtaaagccttgcaacagatggagaaaactgtagacatcaatgaagggaacctctttttgaaagatcttgaaatgcttggaactgttacatcaggtgaacagtttcccagctcggttggtgagacgagtccaactcatacgcctgaaggccttggatttcagctaggtagcaaccctttagaacagcttggtttgtatatgaaaaatgatgatgaagaggatgaggaaggtgagtctgcagatgaaccaacgattgatgttgaggagggcgaaatagattga

SEQ ID NO: 1514 - DNA, 2334 bp, Oryza sativa
  misc_feature (115)..(115): n = any nucleotide
atggcctcctccatcgccatgtccctccgctccctcgccgccaccgacgccttcctccccaagccctccccctcctccgccccattcctcctcctcctctccccgtccaccccgngcctccgcctccacctccacctccgctccacccgccgcctcccgctcgcgccgctcgccgcgtccgactccttcgaatccgcttcgtcctcctccgccgccgcgctcgacttcgctgagccaggtgccgccgaggagtccgacgtgccggaggagtctgaccaggaagaggaggggtacgcgccggaggccgaggaggaggcggaggcggatgaggaggtggaggaggaagccgtcgaggcctccgcggaagttgcggaggaggccgaggacgtagaggaggtcggcgagtacgtggagccgcccgaggaggccaaggtctacgtcgggaacctaccctacgacatcgacagcgagcgcctcgcccagctcttcgaacaggccggcatcgtcgaggtctccgaggtcatctacaacagagaaacagatcggagtcgtggatttggatttgtcaccatgagcaccgttgaggaggctgagaaggctgtggagatgttccatcgctacgatgttgatgggaggcttctgactgtaaacaaggcagctcctagaggcgctcgggtggaaagacctccccgtcagtttgggccttctttcaggatttatgtgggcaatctcccttggcaagtggatgactctaggttggtacagctgttcagcgagcatggcaaagtagtcgacgccagagttgtgtatgacagagaaactgggcgttcacgaggatttggttttgtaacaatggcgacacaggaagaattggacgacgctattgcagccctcgatggacaggtttcatcaggctatgctgtattatctgaggaaacgatcatatcatacgttggtttccgttgcatgctcgtcgaccccctcaccggagccaccgtccgccggctccctcgcctccctcgcaccagcaacaatgaccacgtctgctacatcgacggcgtcgtctgcggcgacggcaccatcgtggcgtacgccacttcagatgggttcaagcacacctcccagatcgaggcagccatcctccgccccggcgacacggcatggacgacggtagagtcgaaggggatgaattactccgccttggggtacggctgctgcaccacgtatcaccaaggcggcgtcgtgttcgccgacctgtaccagacgttcgtcgccagggtgctcgtcgacgacgccggcggcggcggccgagtagtggaatccaggacaagaagatggccgcctgattatggcttcctgtacaagcggctgctatcgacgtacaccttcgagtttcggggcaagctgatgtccgcctgcgtcgagattccatggcagagcagcgcctaccagatcgacgccgccgcgctgtcggtgtccctgtacacgctggggacggcggcggcggccggcgacggcgacgagctggcgcatctgtgggtgagggcggcggacggcgggaggctgctgggtgagcacgcgctgttcctggggtgcccgaccagcttcgccgtcgacgccgccaggttcggcgccggcggcgaggtgagcggcggatgcgcctactttgtcatttggacaatgccggatgtgtgccacgtgtacaagtactccttccacgacgatgcggcgacgccaatggcagagctgccattcgaatggaccttcatgatcaagagaacactgtggttcctgccccagtattccagcgtagccccaactccaacccaagcgagctatgaaattagttttttttcattcgtgtccgaaaatgtcttccgacatccggatcgagtggagattcttggttgcgaggggaatttccgcgatcatggctacgtgatcgatgctaacgttcactaccgcaacggcgcaatcttcggggtggtaacaatgaccaccgtccagaaaccggctgatattgtcgctgccttcgacaaaagagggttcctggacttgcatcccctgttagcagtggaatttgcagagcagcagccgcgacaagagtggatcctgacagaggcggctctagctatagctccaacgactgttcatagtttttcaccgaaagatttcagtatctacgtgggaaatcttcgatgggatgttgattcgccttcgtctgctaaagtttttcggagagcatggccgagttttggtagctcaagtcgtatcatggatggccgtcccatgagagtgagctttgcaaagtggcaaccacggcttggttactaa

SEQ ID NO: 1515 - DNA, 2316 bp, Oryza sativa
atggcagacatagtggaagggaggtggtggaggcattatgcaggagaatgtaggcaactttggcatcaaatgtgtctcctacacaataggtggcaacagggaaagagtctcaccggtacctggagtagcttcgatgttggtgagagagttccgaagtactttgatgatccaatacaggaaatttttctcgaagaaattatagaggatgtctactacatgacaaaagaacaatacgctaacaatgttgtgcagcacattttgcagcatgggaaagcccttgtgcgatctttaattataaagagatttattgggaaagttgtgaccatgagcaagcaaaagtacgcttctaatgtctttgaaaagtgcttggtcttcagtagctatgatgaaacccagaagattattaatgaggtcctaaccatagccaaggttatcttcttcgtcgagaattacttcaagggtggaataactaggcttaagaggcacttggctggagttagagggcagagtgtttattgcacacaagttcctgatgatgttaaggagaaggttaaagcaatgctggatgcacatggtgaaaagaagagtgcaaaattggatagccagcttcgattgaggcaacaggttaatatcaatggaaatgatgatgaggaaatggaagaagtaggagaagttgaagttcaagaagctccatcagctgcaggaagcacactagtccgtaagaagccccgaaacaagggaccattggacagctattgcatgcgccctgaggaacctcgtgctaagggaaagcatatacaaactacaatgagtaaacactgtaagtttgttgcaggaatatttggaagtgcaaaaggagtcatggtcttctactggatgttctattatcgcaaatgcttggaccagattcggcgtggaagaagcttaatgaatttggttgctcactgtgctagaggtatgtgtttcattgatgccattgatgcttccttggaggttcacgatgggaagtacatctacagcttggtggtcactgacaatgcttcaaataatatgtctgcatcaaagatgcttcaagtgaaacatcctcacatattctggacctcatgtgctgcccactatattgatctcatgctagaggatattggtaagataactatggtacataacattattcgagatggaaagtctatcacaaatttactctatgcacaagttagattgctggccattatgcgtcaatttacgaaaggtgacttagttcgagctggtactactcgatttgccactagttacttgaacttgaaaagtctttatgataaaagaaatgaattgaagcaattgtttgcatcacaagattgggctaaaagttcctgggctaaaaagattaaaggacagaatgcacacaacttggtcatgaacaacaagttctggtcacaaatgctagaggttataaattattttgagccacttgcatatgtacttaggagggtggatggtgatgttccagcaatgggatacatttatggtgatcttatcaaagcaaagaaggacgttgcagcatgcctaaatggaaatgagaagaaatatagtcatatttggaaaatcatagatgcaagatgggacagcaagctcaagactacattgcacaaagctgggtatttcttgaatccgtgcttcttctatgagaataagagagaaatcaaggaagatttcctgatgcaagcagttgtagaatgtgcaacctgcatgtatcgtgatgatattacagtgcaagatatttgtgtagctcagcttagcctgtacactgaagccatggattcttttggaacaacaatggctattagacaaagaaatagtccaacaatcaccccagtttcatttgcatgcgaaagaaattggagtgcatttgagagagtccattctaagaaaagaactagattaggccaccgaaaattgaatgctctggtctttgtcatgttcaacaagaggctgaaatcaaaatattctcaaaaggatagggatccattagttgctaaatttatagatgatgatccaccaaatgaatggattatagatgatgatgcacctgcacaacaaccagaagttgatgctcagagtgcagctgtcagtcgaaagagaagattaatacataaaaaatcatcaagtaaagcaaagaaagcatgcgttgtggtcgaagaggaggaggaagaatttcaatcttctaacagtgaacatgaagaggaggaaaatattccttatgcagatggttcaagtgaccatgagcttgatgacgttggtgagaatgacaacgaatga

SEQ ID NO: 1516 - DNA, 2247 bp, Oryza sativa
  misc_feature (296)..(296): n = any nucleotide
  misc_feature (396)..(396): n = any nucleotide
atgactactcgccgttgtttgtgcggtgccctgcaggaaatgagcctcctttcccatttctgcctctgcctccagcggaaggcgggaagctgctgccgttgcatccgcttcttacatgtgttcgtcttcgtgctccacatccatggcggccactcccagatgtgcgaccccgccgacctggcgtcgcttctggccttctccgatggcttggacaggatgggcgccgggctggtcggatggggtcccaacgacacctcctgctgctcgtggacgggcatttcatgcgatctcggganggtggtggagctggatctctccaaccggagcctctcccggaactcttttcggggcctggccgtggcgcagctcggccgcctgccgtgcctgcggcgcctngacctcagcacgaacggcctcgttggcgcgttcccggcgagcggcttcccggcgatcgaggtggtgaacgtctcctccaacggattcaccgggccgcaccccgcgttccccggtgcgccgaacctgacggttcttgatatcaccggcaacgccttctccggcggcatcaacgtcaccgcgctctgcgcttcgccggtcaaggtcctgcggttctcggcgaatgccttctctggtgatgtgccggccggctttggtcagtgcaagctgctcaacgacctcttccttgatggcaatggccttactgggagcctccccaaggacttgtacacgattccagagttgaggtggctaagcttacaggaaaatcagctctctggcagcctcgataaggccctcggtaacctctccaagcttaccctgattgacttgtcatataacatgttcaatggcaatatccctgatgtgtttgggaaattgaggagcttggagtccttaaacttggcttccaaccaattgaatggcacattgcctctatccctgtcgagctgcccgatgcttagagtggtcagcctgaggaacaattcgctgtccggtgagattaccattgactgcagattgctcacgaggctgaacaactttgatgctgggaccaacacgctgcgtggtgctataccgcctcgccttgcctcgtgcactgagttgaggacgctgaaccttgcaaggaacaagcttcagggggagctaccggagagcttcaagaatttgacatcactgtcatacctttctcttacggggaatggttttaccaacttgtcatcagcattgcaagtcttgcagcacctgcccaacttaactagcttggtgctcaccaataacttccgtggtggtgaaaccatgccaatggacggcatcgaagggttcaagagaatgcaggttcttgtcctggcgaactgtgcactcttgggcacggttccaccttggctgcagagcttgaagagcctcagtgtgctggatatttcatggaacaatttgcatggggagatcccgccatggttaggcaacctcgacagtcttttctacatcgatctgtccaacaactcattcagtggggagcttcctgcaacctttacacagatgaagagtttaatttcaagtaatggctcaagtgggcaggcgtcaacaggagacctcccattatccttcgtcaagaagaattcgacttccactggtaaaggcttgcagtacaaccaactcagtagcttcccgtcatcactgatcctctcaaataacaagcttgttgggtcaatattgccatcctttggccgtctagtgaagcttcatgtgctggacttgggctttaacaatttttctgggccaattcctgatgagttatcaaatatgtcgagcttggaagtactggatttagctcacaatgatctcagtgggagcataccatcatctctaacgaagctgaactttctgtccaagtttgatgtttcgtacaacaatttgtctggagatgtcccggcaggaggccaattctccacgttcacagaagaggagttcgcgggcaatcctgcgctgtgtcgtagtcagagccagtcatgctacaagcgggcggtcacgactgaaatgagttctgagacacgttttacttttgggctttttttgaccgtggaagctggatttgcctttggactgttaaccgtctggaacgtactgttctttgcaagttcttggagggccgcgtattttcagatggttgataatttctttgataggttttatgtgataacaatggtgaacttgaacagactcagaaggaaatgggaacataaagatcatccttaa

SEQ ID NO: 1517 - DNA, 2175 bp, Oryza sativa
atggtcgagcatatggattggcagccggtgaccaccctcggccccaatttctcgccggagctgcatagcctgctcctctccgaccaccgcgcgtccttgctctccctcctccgccgccaggacgacgagctccggaccaagatcaagaaccacctcctcgcgctcggatggaccatcgcctccaagcccaagccccctggccttgcgcccaggctccgctacgtctcccccgccggaaccaagtcctactactccctccgccgcctcatccagaccatccacctccaccaccatcctacccaatcccaatcccaatctcaatctgattcttgcggttgcggagatacccctcttcttcttgaggaatctgatgacgaccaataccaagaacaaccagaagattatgccatcgcggggtacgttgccctcatggaggagcagaatgccaggcgcgaccgcgggcagggaaatgatgaggagcagaggtccatggccaaggagcttcggatcaaggctaaggatcagctcaggtcgtcgggatggacattctccatgaaggtcaagtacaacggccgcgaggagctgcgctacacagagcctcgtggccgctcccacatctccctcatcaccgcctgcaaggcctaccttcttcaccacacgccgtcgacgacaatggcttcatgcagcaacaacaacaacaagagaccagcgccacccgctgcctgcaagactgccacttctagcaagaagaacaagaagaagaaggaaggcgagcctgcagcaggcgcgcgttctgcgtccacagccaagaaacgaggaggggaatgcgctgacgacggcgcgcgcgaggacgctgctgtcattgctgatcgacaagaagatcctggcgccgagggaccagctcatctacaccacgaagcgagggctcatcaccggagacggcatggtgaaatgcatgtgcggcggctgcatcaacaacaacaacaagaggagggtagcagaccttgggcgcgcatgtttgtgggtgacggcaggtcactgtcgcagtgcctggtgcagctgatgatggcggacgacgaggcgggctccggcaggaagaagaagaagaagaagtatttgccgtatgtgtggcgtggtgcaagggtgaagcggaaatgggaggaggacgacgactacgtgtgctccgtgtgccacgactgcggcgagctgctcatgtgcgaccgctgtccgtccatgttccaccatgcctgcgtgggtttggagtccactccgcagggcgactggttctgcccggcctgcacctgcgccatctgcggctccagcgacttggacgatccaccagctaccaccaccacccaaggattcagcagcgacaggatggtcatctcctgcgagcagtgccgacgagagtatcatgttgggtgcatgcgagagagagacaatgggttgtggtatccagaggcggatggagaggggccatggttgtgcagtgaggcctgctcaaagatatacctgcgcctcgaggagctcgctgtcgtccaagccccttgtcgttcagttgcttcgggcttgtcattggtggtgttgagacgcggtgcagcgagagacggagaggaggaggagcacgccaagctgtgcatggccttggatgtgctccgcgagtgtttcgtcaccctcatcgagcctcgcacgcagaccgacctcactgccgacatcgtcttcaacacagaatcggagctgagacggctagatttccgggggttttacgtggtaggactggagaaagccggcgagcttatagccgtggctacactgagagtgtatggagaggaagttgcagaagtgccgctggtagggactagattcgcgcgtcgtcggcaagggatgtgccgccttctcatggatgagatacaaaagttgcttggtgagatgggggtggagaggcttgtgctgccggcggtgccggagatggtggcgacatggacgggaccatcatttgggttcagagagatggggcaggctgacaggcaggatgtagcacaccatgccatcctccgcttccagggaaccatcatgtgccacaagcagctacctcctcaacctcaacctcaacctcaacttgggcacacaacgacgaccccagcaggaagaattccaagtccaataccattgtaa

SEQ ID NO: 1518 - DNA, 2115 bp, Oryza sativa
atggggccctccatattaactgttgccaccgcagagggacacgcgtccgtctgccccgccctcaatccccgcttcgagttcgacgccggtgagcattcggtgattgttgattcttactaccaggttggtgaattcaaagaagaaatcctgcaacttgctgcgcttgcaagtcaaggagaggaaaattcacgggcagagctactggagaagttcaacaaatgtaacaaagatacactcgttgaactgatccgttcatttgatatgactggttcaaaagctaataggaaggaggaacttgtgacaaaattgatggagttcttcaaagtacactgtcctgatactaacagcgcataccttgataaggccttacagtttggtgaccttcattatcagataaatgacttcaaagaacaaaccctccaacttgctaggcttgcatttcatgaagaagaggaaaaatcacaggcagagcttctggagaagctcaacaaatctaacaaagatactatagttgaactttgccgttcatttgatatcattggctcaaaagctaacaggaaggaggaattagtaataattatgatggagttcttgaaggaacactgttctgggactgatgccacagaccctgataagaaaactaagaaaagaaggcgtaagaatgaagttacacatctatctggcagtaaacctttgaagaaaatgaaacttgatggaacttcactggaaattcatggtgaagaggaagatagtggggctaagtatgaggagaatataacaaaatactcggagtgtgacttggacgacaacaacaatgaatgtgctaataatgagaaaggacgatttccaaagaataaggccagccttgagccttctgaaagggtaaatgatgtgccaaagaattttgttggagcagctcccactgaagttcaaatactttcaaatgaacaagcactatctaagacaccgtttgcaaaggtggttagcaccgttgaaggagatagaactgacatgaagacttctggaaagaaaaatgcttctatcaccaagaaaaaaatgacctctaagacagatcgcaaggaaaaattttgtggtaaacagatgtacaaaggagatgggaaacctcggaaactggcagcaataccaaacagggatgagctgaggcaagctgtcttcttgatcttagattctgcagattttgcgacgatgacttttggagatgttgtgaaagaagtcgacaaatactttggcaaggatctctttgagaaaaagccacttataagatccctgatagaagaagagctctttaggctaggggaggaagctgagaagaaagaactggaagaagaagcggcagaagtaaaagctagagctgaacaagctgcgaaggaagggacaaatgctggagttaattcaggtatagacacggcggaagcacttcaagttaaggatggcaaatctgaagatgctgcaaagaacaaacgtgacaatagtgctgaaaatggtccgaaaggtggggtatctgtagaagttgctgagaacataaacagaagtgcggctgctgaaagttcgcaggatggacggtgtgaacatgacagagagaatgcaaacaatggtggtgactttatcagggatgataatgctgtgcaggatactatcagtggtgatcatgtggaatattccagagatggtgaagctgaaagggcaaagatgaacagtaatggtgaagccgtagaagccgtagatggcggaactgaagcatcaaaaggtggagaaagtgctgaccccaaagatgataacaaccgaaatggcgataaaagtgcactagatattgatgatcgtggagctgaagattctcactgcaacaaaaacggtgaaaatgtagcttgtgtggaaaatggcaaaactaatgaagctggcaacactgagaacggtgaaaatgtggtatcccacgatgctgaaaaggatgataaaagaaaggatcccattcaaaatgcaaaccccgaacagaccctaacagatgctggtgatgatggtaaaactgaagatgccgagcacaacgccaacaccgaagctgatgttgattcttgtgccgatggtactgctgagaattag

SEQ ID NO: 1519 - DNA, 2106 bp, Oryza sativa
atgggattcgtctccggcatcgacgaccctctcgggacggtttcaacggaagaattggatggctacctcagctctcctggtgtcgactcacggccaacagagatcctcgactacgacgacttcggctacaactatgacctccgcaacctcgacgattctgatgaagcctatgaagacaactacgcgcctctctttttcggcgttttcatggccgataatgagatagcagaacaacgtcaaccccgcgaagtagaagaacaacgcacacgacaagaagctgagcgtcgccgactggaagaggagcgacaagcgcaagagcgagaccggttgcaacatgttgaagggacggcggtttttcgtaccccacagcagaacgcagtcgcggcaatcactcttctggatactttgcttcaggaagatgtgcataaccacgtcctcagtatcatcaaccaaacgaagaccatgatcgccacctcggtcccagttaactcggcaagcgtctgcacgccgactggcagccgggttccccctcttcgatctcaagattaccaccaaccaagcctcagcgttgccgcatcaggatctaatcgcaggagcaggggtcatgttgaacgttctgttcactcacctgccgacagacacagagagcgccatgcagaacagcctcgctctccacgtcgcaggcagcccgttgatcttcgtgaaacactcaaccgacaccgcgcagaaagaggttatgtcccactagatcgctacaatgacgatgaagtgaccggcatcgagtggattggccggctggtttcaagccgactggaatcgagaaattacatccgacgtttttctaagcaacgtaacaagatctctggcatcaccaacgacgtcatcatagccgctttcactaagggtgttcgtcacgaactcttagtcggcaaatttggacgcaagcctcccaggacggtcaagcagatgttcaaaaaagccaacgactatgccaaagctgatgatgccgtcaacgcttacaagcagtcgagcggtaattggaagtccaagaaagatacaccagccgccggggggagtggaagtaacaaccataaggatcgcaagcgtaagcctgaagacctagtggctcttacatcaccatcttcccgacagcgttcacgtgtcaacacttccgacaagatcatgaacgcccaatgctcgcatcatccaaactctaaccatgcagccaaagattgtttcatctacaagcagtttgcgaagcaatatgccaatcaagcaatgaaggctacagccggagatcagggcacatcaaagaagaaggatgacgaagacgacgcttatgagtcaaagcggaaacaaaagctgcctgatagggagatcaacgccgtccagcccgatacacctcaatatcttcggtggtcagaaacagcaatcaagttcgaccacttggatcatcctgaccgagtggtccacccgggacggtaccccctggtattagacccattggttcgaaatgtcaagcttcggcgatcccacattgatggtggcagcgcactaaatattctttttgccaagactttggacgatatgcagatccctcgtactgagctgaagccgagtattgcgccctttcatggagtcatcccagggctgtcttctactccactcggccatatcactctgccggtcaccttcggcactcgggagaactttcgcacaaagaatatttgcttcaaagttgctgattttgagatggcgtatgacgctatactcggacgcccggcattagccaaattcatggcagtcccacactacacctacatgatgattaagatgccaggacctcaaggagtcatatctttgcgaagcgacatcaagcaaggcatcacctgcgacaaagaaagctgtgagatggcccaaactcatgagatcgcacttgctcgggatgagatctggctggctgcatcaaccgcaacagaaggagaagtgcctgcaaccaagttatcgaaggctggagaaggcgacgccaagaccaagaagattccccttgatctatctgatccctccaaaactgctgtaataggtgctgagttagattgtaaatag

SEQ ID NO: 1520 - DNA, 2100 bp, Oryza sativa
  misc_feature (1360)..(1360): n = any nucleotide
  misc_feature (1404)..(1404): n = any nucleotide
  misc_feature (1455)..(1455): n = any nucleotide
  misc_feature (1467)..(1467): n = any nucleotide
  misc_feature (1471)..(1471): n = any nucleotide
atggcatggcacgtctggtccaaatgttcgatacacaaggagagggaggcagatagggagagggggtcagagaagatgctggcatgcatcgcgtgctcctccaaggaaggcggggaggacgggtcccgtggcgcggccacgcctcacggcagagatgccgtcaagtccctcacctcacagctcaaggacatggtgctcaagttctccggctccaacaagcatcagcactacaaggcggcgacggccggtagcccttcgttcaggagcaggagctaccgccgtccgtacccgggcttcatcgatgactccgcgttcatgacgacgaccaggcctggaggtgaggcctacatgtacacgagagcggcgccgccgccgcccgtccgggccgcgtcgacgtcgatggcgacatgggacatgaccaggagcaagagcaaccgagggtggcagcaggatgccggcaggagccccggcggcacgacgtggatacagagcatcgaggaggaggccggcgccgacgacgtcaccgtcgtggaggatgccgtgccgagggagtggacggcgcaggtggagcccggcgtccagatcaccttcgtcacgctccccggcggtggcaacgacctcaagcgcatccggttcagccgagagatttttaacaagtgggaggcgcagcgttggtggggcgagaactacgaccgcatcgtcgagctgtacaacgtgcagacgttcagcggccggcagcaaggcgtgtccactcccacgtcctccgtcgacgactctattctgagagaatcatcgttctgctccaggggcggatcgacccgggagagtccggtcgtgacgccggcgacgtcgtcgtcgctggccaaagagccgatcgcaaggagcatgtcgtgcaaggcgatggcggcttcggcgtctaattacgccgcggcggcggcttccacaagagcggcgtgctacccatcggtggcagtgcccgacccgtccgaccacgtgtgggcgcaccacttcaacatgctcaactccgctgcggccggcccgtccgcggcgggcggcggcgtcccatcgttgtacgacccgtcgcgggggaccacctcgtcccgcgacgaggcctccgtgtccatcagcaacgcgagcgacatggaggcgaccgagtggatcgagcaggacgagccgggcgtctgcctcactatccgcgagctcggcgacggcacccgcgagctccgccgcatccggttcagccgcgagaggtttggtgaggacagggcgaagtgcaaggaagagcccgcgccacaggtcgccgcggccgaaggggcggagccgagacggcggcggccgggggccgcgttccgcggcgccntcgggttggccgcccctttcgcggcgtcattcctcttctccttncgtcgtcgggctcgcgggtctcgtccttggtggtctctccttcaacgcgtncggtctccatgncttncaccttgccggatcctttccaccggtgttgatcttaggtcatcaaaagtttgtgagctcggactgttgaactatagagctaagcatgtattttacccctcgagtaatagaaaatttcgatgccatgatgactactattgggcttcagtctttgaggttgaatacacagaatatttttctggtcagacatcttatgcggtggcagaggccccaaaggaggctcttccgctgaattgccggcctgactttggtgttgcatggtcaacaacattgaagttcaaggtaaatgaatcgtatagttgcagatacacattgggaagtagcaaggctgatatttattcagataggctgttcaattgcaccagcgaagaaccttcaacaattgagatgctcaagaggatatttgtattgttatcgaagtcctatatgttggaggatttcaattccattggaatgcttggatacgtaatggcaggggttgtggctggtattttgagtgccttactcatcactatcttactcagaagtctccgaggactagtccttgcagttgttgggtccagttacagcaaaatgattggattgaaagaacttctgttagattatgaaatcatggagagattcttgtaa

SEQ ID NO: 1521 - DNA, 2016 bp, Oryza sativa
atgaggcaggttcacgcggtcaaaccagccgtcgccgacgaaggaagccccagtgtgcctgtgccccctcctcgtctttcgtctcttctctccttccttcctccccttctcttcctctcctcccaccgagtcgccgccctctcgctttcaacccccacacggaagcaagaattgttcatcaaaacccgatctttggcgtggccccgtggatttcttgcgatctgtttggtgctatggatttctgatccggggtttcttggatcttggggagtaggaggtggggggcggcgatctggccgggagatggccggcgggaaggagccgatcgaggtcaagttccggctttttgatggtacggacatcggcccgagcaagtacgacccctccaccaccgtctccgcgctcaaggagttcatcctcgctcggtggccgcaagataaggaaataactccaaaaactgtcaatgacctgaagctcattaatgccggacggatattggagaataaccggacacttgctgagtcccgtgttccagtaggagaggttccaggaggtgtaattacaatgcatgtggtagtacgccctccacaacccgacaaaaacagtgagaagcagcttgcgaattcccccaagcagaacagatgtgggccgtccgattctggccgctcgcccatctctaccgttggtttccgccgcaaggctcgcgcggctcccgggctccgcctccgcgccgcttctccgcttgcgcgaacccaaccccggcgaccccgccgccgcaaaacccttccaccctctgctctctctctctccggctcggcgtcgcgcgcgccgtggaagaggccaccagtcgcgggggcgcggcctcccgtcggtgatccgacggcgctgtataagcgtgatcgcttggagcgtccggacccgtcgctggctcgtgtgcgtgtcaggggtttctccggctgtccgtgcgggtgcccgtccgccttaaagacggcttacgccagatttgatctcttccaagcaacacgaatccctcaacgagtcatctgtgcatcgaattcatatagttcaaattatcgaagtactagcacaagcagtcccatgaattcaaatgaaatgctgggagctcaggaaacggtatctactgaggggaacaacagctgttctagtgttcagtccactcctgacatagagaagaagtatgtgcatcgtgtatatgatgccatagccccacatttcagctcaacacgctttgcaaaatggcctaaggttgcaggattcttgaattcgttgaggccagggtcagttatactggatgctggctgtggtaatggcaaatatctgggcttcaatcctgactgtttattcataggatgtgatataagcccaccactgattgatatatgtgctgggagagggcatgaagtgttggttgctgatgctgtcaaccttccatacagggataattttggtgatgcggcaatttcaatagcagtactgcatcatttaagtactgatgccaggcggaggaaggccattgaagagttgatccgtgttgttcggaaaggtggtctggtgctcatcactgtctgggctgtggagcaggaggacaagtcacttctcaacaagtggactcccctctgtgagaagtataatgaagagtgggttgatccgagcagccctccagtgcgtaatcaatccaatactgtgcttgaaagcatatcagagactgatgaagacacaggtgcagtgaagcaaaggaatgatgatctgaaaataagtaatgatggtttggatgataacgccgatgtaacttgcagcaattccaacattgatgagtatcacaaaacccagcaggagtactttgttccttggcatcttccatttcaccgagctgaaattggtggtgcatctgctgctgctcttgaaaatggatttgcaaaaagagatgacaagaagggtactgtggtctacaaccgctattaccatgtttttgttgaaggagaacttcaaaggtga

SEQ ID NO: 1522 - DNA, 1959 bp, Oryza sativa
atggcgcctccacctccacgaacacctctcctcgtcgccgccgtcctcctcctcctcctcccgcaggcgacgccgatcgccacggcgagcccggtggccttctctttcccgtccttctccctccgcaacctcaccctcctcggcggggcctccctccgcgccatctccgtctccctcccgccgccctcctcccgggccctcttcccgctccctctccccttcccccgcaacgcctccttctccacctccttcgtcttcgcctcccccgccgccgcgcgccccgcctcgagcctctccttcctcctcctccccgacctgctcgccgagggcctcgccgccaagaaccgctcgctcccgctcgagctcaccttcgacgcgtccaggaacctcgtctcggcctcctccgccggcgttgacgtcgacgggaactccaccgccgcggtggacctgcggaacggcaacgaggttggttcttgggtcgtctacgacgcgtccctggcgcgcctggaggtgttcgtcagccacgcgagtctgcggccgcccacgcccgcgttggccgccgacgccgacagcatcgccgcccgcttcgccgagttcatgttcgtcggctttgaggtcacgtcttcgtcaggaaacgggagcagcgatggtggcttcctcatccagagctggaccttccagacgtccgggatgccggccgtcgacccggcgtctcggtcatcgcacaacgtgtccgacagcgtcgacagcgctccggcgttggacggcctcgccggccacaaggatgggcgtcgcagaaggttggcactggggcttggcatccccttgcccattgtgtttcttggtgcagtcacggtgtttgtggtaatgtcgctgaagaagtgggggtcagggtttaagaagggtttgggtgcaaaggccgcagtgggtaagccaaggcagtatacctatcaacatctcttctcagcgacaaaggggtttgatccttctctggtggttggcagtggtggtttcggtactgtgtacaaggcagtctgcccgtgttccggggtcacatatgcggtcaagcggtcgaagcaatccagggacagctacaatgagttcaatgctgagcttaccataattgctgacctgaagcaccccaatctggttcatctccaagggtggtgtgctgagaaggacgaactgctgcttgtgtatgagttcatgtcaaatggtagcctggatatggctctccatccttgttctgaggctgaatgtcatgtccctctcagctgggctcagcggtataatgtggctgtcggcattgcctgcgcagttgcatacctacatgaagaacatgacaagcaggtgatccacagggacatcaagtgcagcaacatacttcttgactcacatttcaacccaaggttgggggatttcgggcttgcaaggttgaaagatcctaacacaagccctcggtcgaccttggcagcggggactgtcggttaccttgcacctgagtacctccagatggggaaagccacagaaaagagtgatgtctacagctatggggttgtactgctagagatctgcacagggagacggccaattgagagtgcagcacctgacagtatgaacatggtgaatgttgttgattgggtttggaatttgcactcgaaaggcaaggttttggatgctgtggatccaacgctgaatggggaatatgatgcagggcaaatgatgaggtttctccttgtcggtttgagctgtgtgaacccattttcagaagagaggcctgtcatgaggaccgttctggatatgctggagggcaatagtgggctgctgtctgttccaagaaagaagccactgctggtatttgttccaaatgcccctattgatcttgagggaatagtctcggagtgcaaccagagtacagtttcaagtggtctctatgaattaaaaattgatctaaactag

SEQ ID NO: 1523 - DNA, 1950 bp, Oryza sativa
atggaggtggaggcgatggagaagaagggacacagagcctttgctaaggcaattaagtctttcggttcttcagaaaggcacaagcgttctaagagtgatcttgaggatatgtgtgctaaagatgcgctgtatgcttcagataaaacatgcgttcagcctaagccagatgctgtaaaagttaaggtaaaaagtgatatcaacgctgaagtgcaacctgggagaggagcgcagagcttcttgagaaaagagattctccagctagaaaagcacctcaaggatcagcaggtcatgcgtggcgccctggagaaagctctgggaccgaacgctactgctgctccagtcaacgtatcaaacgagaatccaatgccaaaggatgccaaagaacttatcagggagattgctacactagagcttgaggtgaagaacatggagcagtatctccttaccctgtacaggaaggcctttgagcagcaagtgcccacattttcccctcctgaccaccggggagctccgaagccgccggtaccggcgatggcggcagtgagctcgcagcctgtgcagctgcagaaatcacccagtgtcaaggcatctcgcaagaacaacagagctgacgcaatgctgcgatccagctacccgccaccgtcccgtaggacgttgaacgatccagtgatgacggattgctctacgtcgggttgctctagcaggctaggtgaatctgatgttctccggtgccagtctgcggtgtcgtaccgcggcatttgttcgtccaggatttcaccatcggaggacagtcttgcgagagctcttcggtcatgccactctcaacctttctcatttctggaggaaggagagagtactgcagcaggagtgataagcttagcagagtatctaggcactaatgtagctgaccacattcctgaaactcccaacaacctatcggaggagatggtgagatgcatggcaggggtgtactgcaaacttgcagatccccctttggttcaccacggctcgtcgtcttcgccaacgtcatcgttctcctcgacgagtgcgatatccccgcagtatctgggggatatctggagtcccaattacaagagagaatctactctggactctcgtttgataaaccctttccatgttgaggggttgaaggagttcagtggaccatacaatacaatggttgaggttccactgatttgccgcgatagtcggaggctaaaagaagttgaggatctgctccagacttacaagttgattttgtaccggttggaaaccgtcgatctcaggagaatgacgaacgaagaaaagattgcattctgggtcaacatacacaacgcccagctgatgcatgcttatctaaagtatggcgtcccacagaacaatctgaagaagacatcacttcttgttaaggctgcctgcaaaattgctggacggagcatcaatgtagctgttatccagagcatggttcttggatgcaacacatactgtcctggacagtggttacgtactttgcttcacccaaggatcaaaagcaaagtgggcaaagtagggcatgtgtggcaagcctttgccgttgcacaatcagagcctcttttacgctttgcgctttgttcaggaagccattctgatcccgcggtgagagtgtacactccaaagaggctgttccatcaactggaggctgccaaggaggagttcatccgggcaacggtgggcatctggaaggagcagaaaatactgcttccaaagctcgtcgaggcgtatgcgaaagacgtcaagctctcgtcgcagggccttgtcgacatggtgcagcgctacctcccggagagcttgaggatggcaatgcagaagtgccagcagagcagatccagcaagatcatagaatgggtgcctcataacctgaatttccggtatctgctgtccagggacctggcatttcctcacctgaactga

SEQ ID NO: 1524 - DNA, 1860 bp, Oryza sativa
  misc_feature (1035)..(1035): n = any nucleotide
atgggcaatccttctattctcacggaggatttaggcgatacgtctgactttgaggttgatggcgtcgagaacctcacggagaatgatgtcagtgatgaggagattgatgccgaggagctggcccgacggatgtggaaagacaagatcaagctgaagaggatcaaggagaggcagcagaagcttgctctgcagcaggcagcactagaggagtccaaaacaaagaagatgtctgagcaggctctccgcaagaagacggcgagagtccaggatgggatcttgaggtacatgctcaagctgatggaggtgtgcaatgctcgtgggtttgtttatgggatcattcctcataaagggaagcctgtcagtggtgcatcggataacattagagcttggtggaaggagaaggttcggttcgatgtgaatgggccggttgccattgcaaagtatgaggttaagaactcaatgctggttgatgctaagcgcagaggggtcttgaaccagcatagcttgatggatctccaggatgctaccctgggatcattgctctcatcgttgatgcagcattgcagcccgcagcagcgcaagtacccactggataagggtgtccctcccccatggtggccatcaggaaatgaggattggtggatttctttaggccttccaatgggaatatcaccaccatacagaaaaccgcatgatcttaagaaggtttggaaggttggcgtgctgacgggtgtgatcaaacacatggccccaaactttgataagatcaggaattgtgtaaggaaatcgaagtgcttgcaagacaaaatgactgctaaagagagcttgatttggctgggagttcttcgaagagaggaaatatattttcgcagttctgacaatgttggatcacagattacacaccgtagttctcgtgagggaaaaagtgatgatatatatagcagcagtgatgagtatgatgtcgaccatttggaggaacctcctcgctcttcatcatccaaagataatgtggggcgtcgtcagccaactgcgcanatcagagaggagcatacctctagtcgacacaacagaggacgccatgatcagcaacccaatcaagtacttcctagcaatgaagggaccaatgaatcaaggaagagaaagagacctagtggtcatttacttactgctgaatctgaggttgaggtaacacaaaaagatgacaatcaactagccattgtgagcaatgcattgcccaatatgagcagaataaaccaaacggagatgatgggcatggctaaccagatgacaagcctcagccatgtcaatacaactgaaactctacagcatcaatatgttcaagggaacttcgtatcttctcctgctgctgtggttaataactataacagcaaccagattacaaatgttaatccttcaaggatttatatgggatatcagcctttagcatgccaaaataatggtcacacaaatccatggtctgaagacacttttcaggttgatgttggtccaccacctattggttttactactaattcttcgtcaggtggtaatcattcttttcccatgaaacaatcactaccaaaatctatagatgatcatgtgcctattacggagacaggggtgttggctgatagcagttcatatggttatcatatcacagccacaggtagtaggaattcaacctctgttgctggccatggaaatcagctcatgggagatcctttcgacagtggtactgctgataagttcaatgggaattcgtttgatggattgccttttgacttcattggtagtagtccaatccctgacatcggtgtattgctagatgatgatgatataatgccatatctgggaacataa

SEQ ID NO: 1525 - DNA, 1860 bp, Oryza sativa
  misc_feature (975)..(975): n = any nucleotide
  misc_feature (1064)..(1064): n = any nucleotide
  misc_feature (1070)..(1070): n = any nucleotide
  misc_feature (1083)..(1083): n = any nucleotide
  misc_feature (1089)..(1089): n = any nucleotide
atgggatggatgtccggatggaagctctgctgggcttgctctaatttcgatcagcggagggcaggtgagcccggaattgtgtcatgtacatgggctactgtgatgtccttccaggaggctagacaagtgggctggctttgggcccattcggctagggagaaggagactagaaaagaggcaaagcagccagcagccaggagatttggtgtgattgtgttggttcgtgacaatatggtatcagagcagtcaattcgtggggtttctggtgtggagatgaagtgggagagcgctggtggtcagaggaactgccaacaacttggtggtggtgtctttggaggagatgcccaccacctgttcgatgaaatgtcgacctgtccaagaggcgattcagctgctgtccttcgcgtcaccgtgagccagatcatatatccagtgacatctgaggtgttgcatcaagtgtacaatacctatggagcagtggcggtgcaggttcttgcagtgagcacatggcaagtcaaggctcttgtgtcatttatgtccagccatgacgcggagagggctcggtccgccacccacggtcgcgacatctacgacgggggctgcttaatggatgtgcagcacgtccagatgttccctggagatggcgccaccaccacgcacaccacctgtttgacaatggtaccaagtagcgccaccgccaggccagcggccaagagtactgctgctacaccagaacgcgtgttccctgctacaacagcttcatctataccctcaattacatcagcagccatggtgacatcggttcctttcaacgagaccaagaaggctgagactgacatggacaaggcggtagagaacttagacaagaccattcaagacctgtgcaccaagatcgatcggatgctggaggcatttcgccacaccaaggtggatttatccttgagcaaggattccactagagatgtggcagcgttnagcgccaacactgatccaacttccatcgcattggagaaccagttggctgatgatgatggtggcaaagacatggccaaggaggaattgantgagcncatgggagttgantcccangttcaccactatgtatttatgcttcagagatccattgttaatcatcaatgcaattcctcccaggaactggagttggtgcttgagccctcagaatacacagctagccctccaccagtaccaccttggagagcagcaattccacggaacaaagctgagatgacctcaggttctcggccgttaccatggcttgatccacagctttgtcaaggcagcggaggcgtggtgatatgtctctctggtgcctttaggaaggcctatcagcacacacatcattcaacctatgtggagctaatgttgatggtaattgcacttgcaagtcacatgagagacgtacccatcgccatgctcgtatatgctgatagtagtggtgaagaaggcgtgaaggcttggtggttgaggcagcaaaagcatggtagagagtgtggttgtaatgctcaggttttatgtatgttggataagtggattcaacagtgggcagggtctacatcagatggttcgaaggtcatcaaacaattgttctgggattctgcccaacaaggcatttccctgcaggtaccttgggatcttgggggcattaatctggcgagtcagttgcatcggcttggggacaagccgattcttaacgggggaagaatgtcatgtacatggcctgctgtgatgtctttccaggaggctagacaagtgggctggctttgggcccattcggctagggagaaggagactagaaaagaggcaaagcagccagcagccagcagccagggtcatcgatga

SEQ ID NO: 1526 - DNA, 1824 bp, Oryza sativa
atgccttttggtctgaggaatgcaggggctacattcgccaggctagtgtacaaagtcttggggtcgcagttggggcgaaatgtcgaagcctatgttgatgtcattgtcatgaaaagcagcaagggcttcgaccacacatcagatttgcaagagacattcaacaacctccgcgcagctggcatgaaactaaatctagagaaatgtgtgttcggtgttcgtgctggtaagttgttgggattccttgtgtccgaacgggggatcgaagcgatccccgagaaaatcgatgccattcagcaaatgaagccaccatcgagcgtacgacaagtacaaaagctcgcggggcgaattgtggcacttagtcgattcctgtcaaaagcggctgaaaggggcttaccttttttcaagacccttcgaggggcaggaaagttctgttggacgcccgagtgccaaatagctttcgatgagcttaagcggtatctccaaagccctccaactctagttagcccagtggcagggaacgaactctggctctatctaccggcttcgcccattgctgtcagcgcagctttggtacaagaaaccgaagcaggccagaagccagtgtactttgtctccgaagctctccaggaggcgaagtgggccgctaagctgtcacctttcgacctacactttgtcgcccgcaccacgatcaagtcccaagtcctcgctgacttcatgcccgaatggacactcgcgtccgtcccagagcccgaaccggtcaaacaaccatgggtcatgcactccgatggttcgtggtctcacaaggaggcgggcatcactgcaatcctgacttcgcctgggggcattccaattcgttacgcagtaagactagagttcggcacaaccaacaacacaatagaatatgaagcaatgttaatgggcctaaggaaagcgaaagctttggttgttcggcgttcgctagtccggacggactcaaagcttgtcgccagccaagttgacaaatcttttgacgcgaaagaagggatgagaaagtacctggaggccgttcggtctatggacaaaagtttcgccggcataatggtcgaacacttgccccgaggccagaacgaaccaaacatcatggtaattgaccaagctttttcgccaggagtccttttcgaagccttgtatacaccaagtgtgccagaagacagcccagacatcatggtaattgaccaagctgaactggcgaagacccagacgactggtgaacgtcttttgtcaagcacctcaaagagggatggctaccggatgaagaagcaacgtcgaggagaagagatggtaaaagaaatacaccaagggatgtgcggagcacaccaagtagcaagaaccgtcacatcagaagtatttcgccaggacatatattggccaaccatactaaaaccaatcgcaccaatttggccattcgcaagatggggcttagacatcattggcccattcccggtggcgcgaaatggttacaagttcgccattgtagccatcgaatgtttctctcgctggattgaggccgaaccacttggcacaataactgcagcagccattcagaagtttgtttggaaaaatatcatggtactgaaggagttcattaccgacaacggcaagcagttcgactctgaaaaattcaaagaaatgtgcgaggagctaaatttgcaaatcaagttcgcctccgtcgcacatctgcaattgaagcatggggcgatgacgccggcagaactagggactaactcaccatgggtgatgttttctggtggcgaaatgggcgtgaagtgtcgctcgaactcgtga

SEQ ID NO: 1527 - DNA, 1818 bp, Oryza sativa
  misc_feature (85)..(85): n = any nucleotide
  misc_feature (778)..(778): n = any nucleotide
  misc_feature (1014)..(1014): n = any nucleotide
atgaagtggcgaaggcggctgcagcggcaagggcgcttcagaccagggcggagatcctttcggcaggacagctgctggtgccccntgccgctccgtcgcagccaacagtggcccaagccgcactccctgccgtgcaagttcaagtcaactccgaccctgaaacacaagccgaagccgatatggaaactattaggcagaacatggcacgactccaagacatgcttcgccaaatgcaagaacagcaacaagcgtacgaggcggcgaggcggtccagggtcccttcggcaccaatcctccaatattcggcagggtatgtcccgcctcaagtctgtccacaagtgcagtcccagcccgttccgccgcaagtctcacaggcatcggtgcacttcgccgggcagccggcagccgcagcagtgcaccaggccccctatggacaagctcagcagatcgcggcccaagtgtagcctcaaccacttggccaggggtgaagaggattccaagcgacggcaagccatacaagctgagtacgataaagcttctattgccgccgcccaagctcaagcacaagttcaagttgccgaaccacctcccctcgcggttcgtcagcctcaaacggcgatccaagggcagccgccaagacaaggtcaagctcccataacctggaaaaagttcaggaccgaccgcgcgggcaaggctgtgatggccgtcgaagaagtgcaagccctccgcaaggagttcgacgcccagcaagcaagcaaccatcagccggtccgtaagnagagcaatgccgaaacatcaggcaacgtggcaacacgcaagatactagaccacagcaaggagcaaccgtcgaagcacctcgtgaagcagcccaagaacaacccccggtcgaacaacgtcaagatgcacagcgaagtaatccaagtgattacgagggccgacccgctcggccatttgtccaaaaggcagaaaaagatgcagatccgagcggtccacagcatcacttcgacggggganggggcgccgcagtatatgaaccagccaatttctttcgggccagaagacgccgaaggagtcatgttcccacatcaagatccactggtaatatcagctgagatagccggctttgaagtccggcgaatcctgttcgacggagggagttcggctgatgtcatcttcgccgaggcgtatgctaagatggggttgcccacccaggctcttacaccagcaccaacgtcactccgggggttcggcggagaggcagttcaagttctcggccaggcacttctgctgatagctttcggctcgggagaaaacagacgcgaagagcaagtactgttcgatgtcgtcgacatcccgtacaactacaatgccatcctcggccgtgcgaccctgaacaagttcgaagccatttcccaccacaactatctcaaactcaagatgcccggcccagcgggagtgatagtggtcaaggggcttcagccttcgcctgcgtcgaaaggcgatcaagccgtagtcaacagggccatgcacaatgtcgaagccgaactccacagccggccaaaacacgcgccaaaacccacacctcacggcaagatagtaaaagtgcaggttgacgatgccgaccccacaaagctcgtatcgctgggagacggcatgggcaaacaagaagctgagagcatcctagcggtgctaaagaagaacattgaaattttcgcctggggcccttacgaaattgggggggggggtttcggcagacctcatcatgtatcacctagcagtcaagccggatgccaagccaagagagcagaaactgcgtaa

SEQ ID NO: 1528 - DNA, 1728 bp, Oryza sativa
atgggcggaggagcaaagcacgatgtgagcgagcgagcggggcccaggagattctgccggaaggacgccgatctagcagccacggtgctcagccatgagcgatcaaacgccgcccccgaaaaatccccaaaatacggggcaaaaatagaacaagaacatgaattacttgaagaactcgcgctccgtcctctccaggctcctccgccacaagcccaccggctgcccgcggctgcaccgtcgccgccgttgccgcaggcgcctcccgctgggtactacttcacctccccgagtcgcccggaggccgtccgcttcggccgagtgctcctccgaagcccgccgccgccgccgcggcctgcgcaggcgccgccgtctcggtacttctacacctccccgcagcggcagaaggtagtccacttcaaccgccggcgcgggtcccggtggtaccacgacccgcggaagctcaccacggtggtcgtcgtctcgggcggcgccgcggcggccgtctacttcggcaacctcgagaccgtgccttacaccaatcgcacccacctcatcctcctctcgcccccgctcgagcgccagctcggggagtcccagttcaacaatctcaagaaggagctgggccccaagatcctccccccgctacaccccgacagcatccgcgttcgcctcatcgcctcggaggtcgtccgcgccgtccaccgcggcctcgctggaaggcaccacgacgccttcgccgcggatgacgcctcctacggcgacatctccaccgacgtcgtcatcaagaaccacgaggccggcgcggaagacgtgatgctcggccggtcccgtggcaacaagaacgcgagcgtggctgccgcggcccagcgagacgaggaggttctggatgacagatgggtcaccgagagccgcgaccgtgggaaggcacggggagcacagccggagacgaggcatcttgatgggctcaattgggaggtgatcgttgtcagagatgacctcatcaatgcaatgtgcttgcccggtggcaagattgtagtctttactggactgctcaaccatttcaagactgatgctgagattgctactgtgcttgggcacgaggtggacttgggatttccgggttcatgtgtgattttggttgggcatgctattgcaaggcacgctgctgagatgattacgaagaacttgtggttttggatcctgcagattgtgatcatgcagttcatttacatgccagacatgattaatgcaatgtcgacgctactcctgaagcttcccttctcacggagggtttacgtgctaacaaggaaacggtgggggtcatggcctagccagccgaacaaagctgttcccagacgttaccaagaagccacggagcatggcaatctcacaatagcacgacattttttggccataattgtgtatccggaacaattatggttgtttgatcttgtcattgtttttgtgcataattggaagatggagatagaggcagatcatattgggctgctggtacttggtgctgctggttacgatccacgcgtagctccctcagtctacgagaaactaggaaagatcgcaggagattcaacgttgagtaattacctctccactcatccttcgagtaagaaaagagcacagcttttgaggcaagccaaggtcatggatgaagcactgagattatacagagaagttagctctggccaaggcactgaaggtttcctgtag

SEQ ID NO: 1529 - DNA, 1704 bp, Oryza sativa
  misc_feature (1285)..(1285): n = any nucleotide
atgggagcggcggttgccggcgaacaacggcacaaaaaaatgcaaacggagggcaccgggagcgacggaagatggccgacaacgagcttcgaagggcggcgaggtactgtccatggcggcgacgactttccggcgacgagcagcgataacggaggggtggacggccatcacctcgcagctgccaacccaaaggaggcgacggcgaccgaaggcgacgacgggatgagcagcagggcctcgccggagatcaaaacatggcaacggttcggccttcacggggacggcgacttctggcgggaacgggtggccggggtagagctcttcactgcgaaaccgagggaagtggcggcactgaccggcgacggccgggtcgacggcgcacggcggctggagcggctgccagaggtggagagagagggagagcgcggggagagcgattccggcgacgacggcggacgggacttgaggggatgggttttcgtctttccgatgtcgttcgacgcggtctcccggcgggagacatcgccggcggcggcgttggaggaggagatggcgactgtgactcaggcgccgccgccgtcgacgccgtccatggtcggcaatccagatggtggagctccggcggcggccgcggaccagagcgcgccgtgcgccaccggcggcgagacgttggtgggcgagggccggctgcggaaggggaagatggtcgccgaggaccagagcccgccgagcgtcagcggcggcgcaccggctgacctgcctcccggcggtgacactgacaccctcctcctgggtgttcgacggcaagaagacgccattgcaatgatgacgccgagcatgaaagagaatgtccggaagtgcaagctggccggcctgagggccgccgctccggccgcgcgccggcgtccccgtcccgtcgagaagaagctcatcggcggcgccgccatcctgggagccggccgaccaccgcacgtcgccgcggatgaggcgacgccgccgccgggagccaagaagcccaagcctgaccaccgcgcgttcttctggaccgcactagggcacgacatggcgtcgacgacctcggcggggtccgacacgggcgcgacgctcgacaacatcgccgtcgtcgacgacaacctccgcgcgaacctttggtacctcgtcgcctcgccgtggcggccgccggcgcgcgtctacggcaagaagatgacgttcacggaccggagcgtcgcccagcaccggctgctcatgtcgtgcaagggctggcacaacacgcaccgcggcggcnacgagccgttcccgttcgaggagctcctgacgccggcggagaaggccgccgccgacggcgacgagggcctgcgagtgcaggcctacgaccgcaccggccgggactacgacctcaagtgcaagttcctcaactgcaacgacgcctaccggctcatcctggaatggtccgaattccttaaagaaaaccaccttgacgtcaaggacaagaacgccgccatggccaacgaagccatgatcgatctgtgggcgttccgttcccggtggctgagccatggcgtggatggccatgaggacggccggctcgggctggtcatggtgcactacttcagaggcgacgccccgcacgccgacgccgccatgaacgtccacgacgccctaatgcattcagaggcgacgccccgcacgccgacgctgccatga

SEQ ID NO: 1530 - DNA, 1677 bp, Oryza sativa
atggcgagcgacggcgaggacgacgctcagagctacgaaagctactataccgacgatggcgacgattacaccgacgaggtggacagcaacgtcgacgacgacggcgagagttgggatctggaggaagaggaggtagatgacgacgacgacgacgaggccaagaaaaagaaggcggccgccgccgtcaacctcaccaagatcgacaggaggtaccggaatctgtccgaggagcaagtccgcgcgcggcaggacgcggacacggccaacgtcggcgagctcttcgcgatcccgccggggttcgccgccgtcctcctccggcactacaagtggagcctcgtcgagctccaggacaggctgttctgcgacggcgaccgagccggcgccgccaccggcgtggcgctcggcggcgcccccgtgtcgcgcaacgcccacccgctcgtctgcgccatctgcttcgacgagcaccccgccggcgagatgagatcggccgggtgctcccacttctactgcgtcggctgctggcgcggagcccggtacgcgacgttcttgctccggtcgtacgtggaggagggcacgaggatcaagtggtgcccggggcccgggtgcaccctggccatcgagttcgtcggcggcggcggcggcgaggagaagcaggacgacgtggagtgcaggcacgggcacgggttctgcttccggtgcggcgaggaggcgcaccggccggtgtcgtgcgagacggtgtacgcgtggtcggagaagaacgccatgaagtccgagacggcgagctgggtgctggcgaacacgaagcactgccccaagtgccggctgccgatcgagaagaaccgggggtgcatgcacatgacgtgccggccgccatgcctgcacgagttctgctggctctgcctcagcccgtggagcgatcaccggagcagcgagtactacaactgcaacgtctacgacgcggccaaggccaacggcgaggccagcgacgacaagcggcggcgggagcagggcatggcgtcgctggacaggtacatgcacttctacgagcggtgggcggcgcacgggaaggcgcggcagagcgcggtggacgacatggccggcctcgacgcctgcgccgagaagctgtccgccgcggtggccatgccggtgacggagctctgcttcctggcggaggcgtaccagcagatcgccgagtgccggcggctgctccggtggacgtacgcgtacgggtactaccacctgggcacggggctcgacggcgacgaggagcggcgcaccatggtggagtgcgcgcagggggaggccgagcggcagctggagaagctgcacgactgcgccgagcacgagagggaggagctcctcgccgaggtggaacgaaccatcaagttgaacgctatcctcaaggacaacgacggcgaggagtcgaagaagaagatggaggataaggccggcgagatggtcgacatggtcgtggcttaccggcagaagctctccgggctcaccggcgtctgcaagatcttcttccgtaacctcgtcaagacgttccaggacggcctgttggaggtgggacctgctgttgccgccgccgccgcagccgccgtagctacaggtccggccgagagctccgacgatcctgttgatcctcttcagcctcttcatcaagacgacagctcgtag

SEQ ID NO: 1531 - DNA, 1653 bp, Oryza sativa
  misc_feature (560)..(560): n = any nucleotide
  misc_feature (577)..(577): n = any nucleotide
  misc_feature (690)..(691): n = any nucleotide
  misc_feature (716)..(716): n = any nucleotide
  misc_feature (718)..(718): n = any nucleotide
  misc_feature (721)..(721): n = any nucleotide
atggcggccgcaacggcggcgatggcggccgcaacgccgccgcgggggcggcagcagcgacggggggaagaaggggaagggggaggatgcggtggtggagctgacaccgaggaggacgcggcttcccgcgggcgtgcaacagccgggccaagtgcggaaattgaaatgtacaaggcacttgagccagcaacacgattagtgatccttaaagcaatatgtgatatacgtgttgagcaagaggatattcggaacttcatagatagttctttaaagcgtggttatgagcttcctgtgttccgtaaagaacgtattggaggagattcatatggaatctcatactggagcatctctaatcaattgatgtgctacaggtatgacgaggatcccgtccttggacatcggttatatcgtgagattaggcaagtggagtatgagaaggacccaaccaaaaaagctaaagggaagggaatctcaaatgccccagttgtatcctatcaatgggagactgttgcatgcaactttattgaatttgaattagcagcagaaaaactcttttcaantaggaacaggactgagntctcgcttggcaagaagttgaagaacaattatcttccagagatggaaaagattcacaagaagaaggagaggctgctcaaaaagcaacaaagagaagcactcctccttgacaanngcttgacagtgaatgggttcacctntntcngctctcgtcgtgaaagaaagcgtgtcacctatacttttgatgattatgagcgttcaataaatgaagccataaaaccaacaaagaaaagtgagaactcttctgagttcattactacttctaacagaagagtacacccaaaacgagagacagcgaccaatggtaggttagctggtccttcgccattatgcaatggattctatggagaatatccactaaggtcacatggctaccaaggaagtgagtgggagaaaaaacctgagactctcgatcgcaggcaaagaaaaagatctcgaaggtacacgcaagattttgttgaggctatctcggacgtcgacccaaacttcgacagtgatgatgatatcattggtgaagcagtctatgatgaggaatatcttagaagtcgaaagcaatataaggccagacttttagaactcgataaagagttccaattggaacaagttgccgatgatggtaatgatgaagtggaatatccttcgagtaccagtgaagatgaaaaggagccccaacggtacaaaagattggctacttgcaatcctcgagggaccaacttgagaactatcgatggattccaaacatgcatcacacgaagtaagcgttccacccgcccacacatgaagtatcatcagtatgatctttctggcacagatacagaattgggaaagccaggtaaaataaaggtaccagatccagatgctggttctgatgcactaaatgacatggagctctcgacaactagtcaagaccaggaggaagaaggtgctgaagtaaataaagagcggccacccctgctttctcctagcaggaataatggaagcgatgggagaagatttcttgacttaaacgaggttgcgcctgtaggcggttttgatgaaacacagagtcgcaacggcgaaaggcgaccacctggataa

SEQ ID NO: 1532 - DNA, 1653 bp, Oryza sativa
atggcggacctcgatgtctccacctccgatctggcaacactggcaaagctctccaccgacggggcccttcctccagaacaagacatggccagagaaggaggaggactagcctgttcgacaagactgctggacttccaaactcccttgactccttccctggaagcctttgcgaacgttatcggggagttgcgagaacaggggctaaccgggtatgaagtcgttcaagacttcgtcgcccgacgcatccagccgttgcaagctcatgcccatcccgcgtttgattatgagggggcctctgacaagacacggatatcgtcgcgggctcttcgcacggatatcgtgacgcagcgggtcaaggatgtacttatcagtcctgcttccatagccgaggaggtgccgaccccgctctgcgacaagccagcggccgccatcaattcttctgcctccctcaaggagaaaatcgcagaagagatcgccgttgcttcctctgtccctaccgtcgaggggagcagcggaaccaagaggaaaacctgggccagggcaggcggcgttaccggatctcggcagaagtccagcggctccgagagcggctatgaggtggcaactagcgggactgccgttgtcgcctctcctcgcgggaagtccgcacctgctgccgcagagttctccgagcccgcggcggcgaccacgattgcggtgccttcgtcggggccacaagactggtccgagatgatggccgagtgccgccgcctttttgagaacacttctcgggatgtcggggcccagatggaccgcctaacgacccgcgcgatgtcattggatgggagggtggcgcagctggagacggagctcgaagtcgcttgggacgacctccagaagatgaaggagatcgtggctggcaatgagatgcaacgcctgggagtggagaataagatgaacgaccttcaagaccacatcttctccatccgcgaccagctccggaagagcttcaccagcttgcaccagctagccccggagtgtggcgtgaagtcttccgtctctgcgcaccctaacgtgacctctctgacatcggtgcttggcgaattggcaacaaagatggaggccatcccgtcgaagcatgtcgccagggtcttggaggagatctgcaacgggatccacactggggtttgtcatgtcctctcttgtgtgaagctagctctccccaacgtcgatcttaaagagatcttatcgaagggggctgctgatgccacgcgcgaggacgtgatggccgatgtggtggatctccaggagaccgtcctcccccttttcgagaaagatgttgatttcgaggatgtccagcagggcggacgtcccgatgtcgatgcgatgaaccaaccctcgttaaatctcaagggtgaactcgccgagcgagatcgacaagttctatactggaggacgaagtttgagggggcagagctcgagcggtccatggtggtcgtgaagaaagatcatgctgttgaaatgctccgagggtgcgaggtctggttgaactcgtatctaaagagctgttgcagcgccatgtcggagatctgccgacaactcaaggttgaatgcgcagagcccgaggagacaaaggccgtgtatttgtcctggatgaggggtgcgtgtgcctag

SEQ ID NO: 1533 - DNA, 1638 bp, Oryza sativa
  misc_feature (1596)..(1596): n = any nucleotide
atggcacccactgggtttgagatcgccagcaccaccactttccccgccaccacccaaatctccttcggcgcatttgacttcctcgtcgacagcgccggcaaactccgtcagaacaacatgatcgccgccaaggccctcctcgacaacatgccggtcccagtcgacccggccgtgaacaccaccatcgcccaagtgaaggctatggtggaagccaccgctgttcaacacgctgatgcactgccaacgacttcaactgccggcggttcctccggcaagagacagtcccgacaaccagcctttgagttgaagcgcgtcaaggcgtcccaagcggggagttcacaccccagtctacgcaccagcgacctaagagacaagatcgaagccgggcgccggctaaacgccgacctccgtaacgtcatgaacgagcattgccgacttcgtgacgctgaaaggttgcggattcacgaggacgacttcgacgctagccgtcgtcacacagacgtccagccggacggccgcatcgtcgtccatcgaccttaccaatactaccacgaccactcaccagaccacatcccacaccgcgacgacggcgctgagggcataccggccttcaccgacaacctatgccgagtccgctggctagccaacttcaaacccataggcatcgacaaatacgatggcaagaccgaccccaacgcatggctcgccgtctactccatcgccattcaagctaccgggggcgaccaggtggtcatagcgaaactacctgccgggctaccaaggtacaccatcaacagctgggccgagctgaagggacagttcatcgccaactttcaaggcactttccctcacccgggcacccagtgggacctctaccgaattgtccaaggccacaacgaatgcttctccgactacattcgctgcttcacggaacggtgcaacaccatcccacacgtcaccgacacagaggtgatggccgccttccaacaaggctgcaagaacgaagacttcatcaagtggtgggcctgcaagacgtcactcggagggtgcgccgctctcaccgtccgacagatgttcgaccacgccaacaaggacgccaactccgagctagcagtctacgcccaaatcaagaggaggccttcgtaccagccgcgtcgagaaagcaactcctcccgtagtaggccacccaagtgcaagagtgatgataaagtcaacaccatcgggcgcagcaacgcccagcgcaagttccgccaacccaagaaagacgacttcgacaggatgatggacggtccatgcctataccaccccgagctcaagcactccgctaagcaatgctggctactcaaacagtatgcccagcaattggccgacaagagtggctcaggaggaagaacacacgatccctctcaagacggcgacaagaccaagtcacaagctttctcgagccctcacgccgagctcaaccatatctacggctgccccgatgcatacgagtcccgacgcaagcataagttaacgcaatctctgacacaccgcaatatctacggtggtctaagacctcgatcacattcgatcgatccgaccacctcgaccacntcccccacccaggtcgctatccactcgtcctcgatccgatag

SEQ ID NO: 1534 - DNA, 1611 bp, Oryza sativa
  misc_feature (51)..(51): n = any nucleotide
  misc_feature (107)..(107): n = any nucleotide
  misc_feature (171)..(171): n = any nucleotide
  misc_feature (904)..(904): n = any nucleotide
  misc_feature (915)..(915): n = any nucleotide
  misc_feature (957)..(957): n = any nucleotide
  misc_feature (977)..(977): n = any nucleotide
  misc_feature (988)..(988): n = any nucleotide
  misc_feature (1039)..(1039): n = any nucleotide
atgcacttttaccgcggtagcttatgcttcttcgcactgagctccctccantccactcactggaactggaagcttacgagtgttcgtccaatgccacggcgtgccgntttcgccatgatgaacgtggtggccatcgggctcgtgctctccaccctggccgcggccggcgtntggtcgccggcgccgacgccaccgccgtccacggccggcgagcacgtcgtccgggagggacgccgcgtggtcatcgtcgagtacgagcgggagcacccgctgtaccccggcgacgccgtgaaggagacgcacgtcctgccccctgactccctcgacggcggcgagggcaggctcacggacaaggccaggggcgcagtctccgacgcggccgacagggtggccgacgcggcggagggcggcaaggagaagatgtccgacgccaaggagagcgcgacggggaaggtgttcggcgcggtgaagcggtgcaaggacaggctctgcggcgcggccagggaggcggaggagggcgcgaaggacaaggcgtcggcaggcgagcacggcgcggaggaggcggcgagaggtgcagaggaggcgctctcgcatgctaaggagatagctgaggacaaggtgttcgacgctgcgtccaaagtgaaggagaccgccgtgggagccaaggacaaggtctccgaagcggcgggcaaagccaaggagagggcgtctcacgtccagcacggagcagcagagaccgtgaggaatgccaaggacaaggtctctcacgccgcgagacatgcccgggagagcgctagggagcgcgccatggacgccaaggacagggtctccgacgtcgccgagagagccgagcagtgcacggaggacgccgcggggcgcgcggcgcaaaaggcggcgcgggccnaggaggccgtnaaggcaaaggccggcaaggcggccagcaacctctccgacatngcgcggagggcgcgcgaacntggcgtccgangccgccgcgcacctcctcggcggcgggcccagggaggcggcgcgcaccgcnacggcggtgatgcacctgctgggcagctcgccatggtgcagagcaagctgttcccgatgtacttccgcgccgtggcgtacggcgtcggcctcgcgctcgcggcgcacctgctcggccgcgagcgcagctccctcgccgcgcgcgcccagagcgtcaacctcctcgccgcgctcgccctggtcctcgccaacatgctgctcctggagccaaaagccaccaaagtgatgttcgagaggatgaaggtggagaaggaggaaggcagggggagggacatggccgacatcgtcgacccgccaacggtcaccgtcgcggcgggcaacacggccaccaccaccaccgttcccacggcggcggcgcgcaagccggcaggcaacaacaatatggcggcgaagtcggcggcggcggcggcgccggtggacgagcagacgtccaagagccgggtggcgacgctgaaccagcggctcaagaagctgaacggctactcgtctctgtgcaacgtgctgtgcctgatggcgctgacgtggcacctcgtgcacctggcacgtcgcctccagatagccagcgtctgctag

SEQ ID NO: 1535 - DNA, 1593 bp, Oryza sativa
atgacaagattacccctcgccccttccaccttctcgcagccacacctcctcctctttcccctctcctccctctccactccacacgccgtactcgcctccgtcttcccccccgatctgcgggcgcgcgagctcggagcgtccttccccgcgcgcgccgcggccaccgccgagagagtggcctcctcctcctcctcccttccttcccgcgtggcctgggcctgcggttaccccgcgcgcacggccgacgacgactgcgacggcgacgaaggcgagctggtttcggagcgcgacgcggccgacctgctcccccatctggttcgaatcgaaaggtctagtggctctaaggagtctcaaaattatgatagcaacaaccagaaggttcatcctcaaccaattgacgaaaacatgaatcagaacatgggctcaatggacaccatgattggaaggatattcaacaatatatcctctttaaagtctgcatacattcagctgcaggaagctcacaccccatatgacccagacaagatccaggctgcagatcagcttgtcatagaggagctcacgaagctctcagagctcaagcatgcttacagagaaaagaatcctaagcctgtagcggcaacacctcaagatgcacggctgctttctgaaatacaagagcaacagaacttgctgaagacatatgaggtcatggtaaagaagttccagtcccaaatccagactagagatactgagataacacatttacagcagcaaatcgatgaggctaaacttcggaaatcaaagcttgagaagaaactgaaacaaaggggcttactcaacaaggaatctgaggaatctgatgatgaagacaactacttttccatcgagttgacaccaagtttatttacatctgctgttgataatgcataccaatctatacatgatttttcaaagcctttgatcaacatgatgaaagctgcagggtgggatcttgatgctgctgctaatgcaattgaacctgctgtggtttacacaaggagggctcacaaaaagtatgctttcgagtcatatatttgccaaagaatgtttggtggtttccaagaagagagcttttctgttaaggctgctaacattactgtttccaatgaggctttcttccatcagttccttgcagtacgagccatggatcctttggatgtcttgagccaaaatcctgattcggtttttgggaagttttgcagaagcaagtacctattacttgtgcacccaaaaatggaaggctctttctttggtaacatggatcagagaaactatgtaatgagcggtggccatccgaggacacctttctatcaagcatttctgaagttagcgaagtcgatatggttactgcacaggctggcatactcctttgatccaaaagtcaaggtctttcaagtgaagaaggggagtgacttctccgaaattcacatggaaagtgttgtcaagaacatcatcctagatgaaggtgcagagaggcctaaagttggcctaatggtgatgcctgggttcttgattgggactagtgtcatacaatctcgggtgtatctttcaggtgtcaagtctgctgattga

SEQ ID NO: 1536 - DNA, 1566 bp, Oryza sativa
atggcatgggcagggatggttcaaagggcggcggccatggagcacacagctggtgttcatgtgcccggcggcatgcagcctgtcaggagcggtgaggttggaaacaatggcattgtcgcaacgtcccctggatggaggacggagggagtagcacgatgtggttttgacagcaatctcgagcggaaaatcgagggaacgatgcatggagacgttaatgcacggcagacggcagatgcatcggcgcatcagcgatggacggtgctggttgattgtgatatatgccgatcgatgccgccgtccccttttctctcgtggcggaaaagcaaattaaacagccggccggtgcacacatacaacgcacgcggcaacggcggcgaggcgagacgcgcggacgcttgccgactggcgactgatgacgactcgattggcggccgaggtcgtgtgcccaccgcggcggtcttgctctgggccgaattggacggagagagaaatatgtctaacatgcaaagcccagtcatcacgtcagccaaagctggacgctatactgcttgggatctcaagctgagccctgtgcgttgtattgtactgggccggtcgctggtctgtgctgttggcaaagctgcatgggctgcccctggttcgccgagtggtctcactgaccatgcaggctctgagccggaatggcctcgcagaaggaataaggtgtgcaccttagtcatctgcacgggaagagcgattggcaagccaataaatggaggaagaagggaagccgagggcgaagatccaccacctgcgccacctacaaagacgactccaacgacctgcgttaacaactccgatgacctgcgagagaacgaatggatctggcatgatctgtttagctcgtggccagtaccagaagggaagggtggaaagagaaaaaaaaggtgttatgccaatgacaaatggggcacaggtctaaaagggcacactttggccatacgagtctactgtactaaataccctaaggccattcacaggcacctaggtgtcattctcccttatacagccagctcaaagattctcctccacctaggcatagctcggagcctcgccaagaacagggagccaatttttgctccctattattcgccagaatcgcagcttttgggccacaagagaatagatgaagaagggaggggaggggagaagcgccgatgccatcgtcctccccgatctgcgccggacggggagaggaagccgcggtgcgccagacggggagctccgcccggtgtggtcgaagcttgggccgtgccgccgcctctggccccgacgaggagagatggaggcgtggagttcggtgccgctggcgctcggacgatgacgtcgctgccttcggccccgatgaggagagatggaggcatggagctcggcgtcgctgccgctttgcttcgtctgcccgagagagtgagtggtggggaaagtgtgagaggagagagagggagagataaaacccagttagaagcccaagcgcggcattttccaggacacactgtgagtagtttgcaagatatgaacatgacaaag

SEQ ID NO: 1537 - DNA, 1563 bp, Oryza sativa
  misc_feature (354)..(354): n = any nucleotide
  misc_feature (776)..(776): n = any nucleotide
atgcgctcccgatctctcctcctcgtcgccctcgccacccttcttctccacgcctccgcctccgcctccgacgacgacctcgactacctcatcgacaacgccgacgacatccccgccaacgaccccgacggctggctccaggagggctcccccgacgacgacgacgacgacgacctcttccaccatggccaggcccaggaccatcccatagatgagacccacgtcttcctcctctccgccgccaacttctccgacttcctcgcctcccaccgccatgtcatggtcgagttctacgccccctggtgcgcccattgccaggcgctcgccccagactacgccgccgccgccgccganctctcccctcttgcccatcaagtcgccctcgccaaggtcgacgccaccgaggacactgatctcgcccagaagtacgacgtccagggcttccccaccatcctcttcttcatcgacggcgttcccaaggactacaacggcgcaagaaccaaggaagccatcgtgtcgtgggtcaacaagaagctagctcccggggtgcaaaacatcaccaccgtcgacgaggcggagaagatactcaccggggaggacaaggccattcttgccgtcctcgactccctatcgggtgctcacagtgatgagattgctgctgcttcgaggctggaagatgctatcaacttttaccagacttccaatcctgatgttgccaagctttttcaccttgacccagcggccaagcgcccgtccttagtcctgctcaagaaacnagaaggaggagaaattttactatttgttgttgcaaacgaatcgtcgaaatttctgcccatctttaaggaagcatcaaaatcattcaaggggaagcttttgtttgtctttgtggagcgtgacaatgaggaagtaggtgaaccagttgccaactactttggtattactggacaagagaccacagttcttgcttacactgggaatgaagatgctaggaattttttccttgatggtgaaatatcgagatttgctgaggatttcttagaggaaaagctcacaccgttctacaagtctgaacctgtacctgaatctaatgaaggagatgtcaaaattgttgttggaaaaaacctagatcagattgttttggatgaatcaaaagatgcccttttggaggtatgttcttcctggaagatatatgcaccatggtgtgggcattgtcaggaactggagcctacctacaacaagctaggaaagcatctccgtggcattgactcccttgtaatagctaaaatggatggcactgccaatgagcatccacgtgcaaagcctgatggattcccaacgatcctcttttatccagcaggaaagaaaagttttgagcctattacttttgagggggaccgtacggtggtggagatgtacaagtttatcaagaagcacgctagcatccctttcaaactgaagcggccggattcgtcagcaacgaaaacagagaaggatcagagcacagcttcaactaatttgaggggggagaggagttccggtacaaatttcaaggatgagttgtag

SEQ ID NO: 1538 - DNA, 1551 bp, Oryza sativa
  misc_feature (79)..(79): n = any nucleotide
atggagaccggaaaacgcgcgcgtcttggtgtccacccacagctacggcgcatactcgttcgacacggcgagcgccgcntggagaaggccggcgactgggcgctgccctttcgcggccgcgccgagtacgtccccgagcacggcctctggttcggcctctccgcggcggacgacggcgtgctcggcgcgtgggacctgtccgcttccaccgtcgcacagccgcagccgccgccggcggcgcaacccgggtgcggggtcttcgaggtgccggagccggaggcgccgtacggcacgaacgtcgtgcacctcggcggcggcaagctgtgcgtcgccaagctgtacatggtcgcgcgcccggggacctgcagctgtccttgctgcgtcggcgaggaggacatgatgaaatttgccatgctcaccggcgtcgaggtggcgcgcggcggccgtggcggggagctcagcatcgtcaagcacaagtcgtgccgttacagcttcggagcaaacggggtcaacgttcacgtactgcgcacggacggactcgtcttccttccctccgcgtctctctcggttttcgccctgtcctgccccaccgccgccgccgccgccgcctgcctccggacgagctccaccgacggcaacccggccggctttgcgacgacgacgacgatgatccggcggttcctctacatggtcgacctctgcggcgacaactcgctcacccagaggctacgccgcatcgacacgtcacgtctcttctaccccaaggatcaactgccccgagcgtcgccgtcgtcgtcggcggcggcggcggcggtggaggacgctcgcctgcctccagccgccatgggcttcagcgcgtcgatgaacttcatgcgcacgagcgacgacaagatcgtcaccgtcgacgacaccggccgccgcgccatcctctacgaccccgccgcgcacaccgtccgctcgttgccccccatggcatcgcccaagttcttgaccgtgtcgctcgccgtcgccggcgacctgtacgtcatggtgacgccacctcatcctgacaaggtcggcggcggcgagggacggcggccggagtattcgttcgaggcgctcgtccaccgtgaacgccgttccgggctgccgttccgcggccgcgccgagcatgtccccgagcacggcctgtgcgtcggcttcctggagatggacgacaccgtcctcgccgcgtgggacgtgtccgcgtccccacagccgcgggcgccggcggcgagcgtgcagtcgaaggggttctcggtggcgagccccggcgagtggaagggcttggcggcgccgcgggaggtcgcgtcgcacgtcgtgcacctcggcggcggcaagctgtgcgtcgccaaggtgttctgggtcgttcgccgcgggacgtgcagctacccttgctgcgtcggcgagcacgacaagatgaaattctccatgctcaccggcgtcgaggtggcgcccggcggcggccatggcgggaagccccgcatcgtcaagcacaagtcgtgccgttatagattcggtgaaccaatctag

SEQ ID NO: 1539 - DNA, 1530 bp, Oryza sativa
atggggcctacaagtcagtcgaacaaaagtaaaaatagtggtacccacatcctttccatccacggcgccttcttctctctccctcccggccatccttcctcgccggccggcgagcgcgcacggagaaggaaaaaggcgccggccggtgagcacgcacggagaaggaaagaggcgccggccggcgaggggggcggagaggagttgcgggaggccgtgatgctcgtggcgtgcgccgggaaccccgccatcgtgaggctccgcgagatgatttgccacccggagaccagcaagctccacctcgtcatggactacgtcggcgtgaagcagatgctcgccggcggggtcatccacggcgacatcaagccgggcaacgtcctcgtcggcggcgtcgatggctgcgttaggatctgcgacttgggcctcagcaagtcggccgcggcgccgccgccgcggacgcagctggtcggcacgctctgctcaccaatcgaggagcaccatcgcctcatcgagctgtggcgagacgatggccagcttggcctcgtgggcttggtgctgctctggccggatctcgacaagaatgttagacggagctgtaacgccgcgaggagggtgggcccgacgtcccgcggggacgcgactcctcgtttcccgcgcaactccctcccacgattttgccttgccttcgccttttcctccaaatccctagcgatgccgctgccgccggcggagcgccgcctcaccgtcgccgacctcctccgcatacgccgccccaccaccggcgccgcctccctcgtctcctcctccccctccacctcgaccgccccgcctccccgcaagaagcccaggctccccgccgccgcactgaccccgacccctcgtagcacggcgcccttcgcgcccatcccccaccgcgtcctcctcgccggcgtgctctcgctccccgcgtccggctcccccgtcgcgtgccgcagccactgcctctcgctctccgactcccctcctcccgcctcctccgcctccgtctgctgctacctcctcgacttcgaccccgacgccgtcgaccgcgagatccacgtcctcgcctggaactacctcccgtccctccaccacggcggcgccggcgtgctcgaggtggtccgctggcgcctggcggaggagggcacgcccgcacctggctctggcttcctgaagacgattccgctcgattgcgtcgatgcggagcctgattcgggcacccatggccatgtgtttggggtggtgaggtcggtgagcgtggtgttcagcgtgccgcgtgctgggcagaagagtaatgcaggtggaggtgacaattcggtcgggtttatcgcggagatgatgtgctgcgcgtgccgtcgatgcagggtgttacctccagaatctgaccaggatcacaagtttgagctcgagaagtttgtgtactttgtggattccgcaagctggtggcggccggtgctggcgcggatggtcgggaggcctgtgtctgtctcggggttgaagaaaagatttctgtga

SEQ ID NO: 1540 - DNA, 1488 bp, Oryza sativa
  misc_feature (334)..(334): n = any nucleotide
  misc_feature (361)..(361): n = any nucleotide
  misc_feature (575)..(575): n = any nucleotide
  misc_feature (578)..(578): n = any nucleotide
  misc_feature (669)..(669): n = any nucleotide
  misc_feature (726)..(726): n = any nucleotide
  misc_feature (768)..(768): n = any nucleotide
  misc_feature (1426)..(1426): n = any nucleotide
atgagcggcaatccatcgttctcgcagctcggtgcggtggacgccgccatgaacggcggctacttcatggcggcgagcggcaatggcgccgacgtgccgctgttccatccggccatggcgccgccgcatgatcacggcgggagcttcggctacggcgacgcggcggcggcggcgatggacgtcggcgcgcacttcgcggcggcgaacaacctcgtgctcgcgtccctggcgacccagctgttcggcgccgcgccggcggcggcggcgcacgggcatggcgactacctcggcgcgacgacgccgccggaggaggagatgggggccgggtacgacntcgccgtcggcgacagctccggcggcncgttgagcctcgcgtgcctcggccacggccagccgggcgacatggcggcgggttgttgctcgacttcggcgaggaagccgagctgcaactggagcagcagtaacgccggtgtgcacggtggttcgtattacctcgccggggtgccggaggctgccggcttcgtgtccgcggcggcggcggcgagcgagctgtcgctgagcctgtgctccaatgntcntcggcggcgagccgttccgggtgacgcagatgagcagggtggtggtggtggagcccgagccgccgtcgtaccgtactacccggcggcgaanttcgccgtggtggtggcgcggtcccgatacgccgcggtggcgcagcaggtgctcaangacgccgtcggctgcgtgctgggcggcgtcgcggacgccgcngccgactcggccagcggcgtcgacagcggcagctcgaggccgtcgagctgctcggtggccggcggcgcgccgtcgtccgccgtgagctccaacaaccagctcatcgcctcctccggcgagcacacgcacggcggcggcgacgcttcggctcagcggctcaggagcgagctcctcaccatgctccagctggtgagctcgcccttctccacacgactcccgaggcatcagttcaagcaaatttcgtactaccatttcgaatcaaatttgaaaccatcttttgacgacgatacgaattcaaatgcgcagatggatcagaagtacaaccaatgcctcgacgagatccagagcacgacggcgaggttcaacaccctgacgcacgccacggcgcgcgccgccgggatgagcagcagcagcatctgcgcgccgttcgcgcaccgcgccgtgtcggcaatgtaccacggcctgaggcgccgcattgccggcgagatcatgtccgccgccgccgcggccggcaggccttgccgcggcggcgagtcgtcgtcggcggtgaccggcggcgagagggagcggagctgggagtcggcgttcatccagaagcactgggcggtgcagcagctgcggcgcggcgagcagcagtgctggcggccgcagcgcggcntcccggagaagtccgtcgccgtcctcaaggcctggatgttcgagaacttcctccgcccgtaa

SEQ ID NO: 1541 - DNA, 1479 bp, Oryza sativa
atggtaatactcaatgaagacctactagctgcacccacccattatttgttaagtaccgctgccgacatgtccaccgttgacgcctcccccagtcaacatgttgatgaagatgaagtagacattgatgaatatctcaccttagtccttgtaggttctacggtcctcggcaaaaggggcgtagaaatctgcaagatttatatcttaagagaacaagctaaggagcatcgagacgtacaaatcttggaatattccttcaccaacgacatcttcgagaaactcatccgaggattgccaaacttgccgggaagttgggcgtgctccatagccagctgtgaggcagatcatgggggatccccaactagtctgaagttgaaaggacgtggacaagacaccagcgctgagtcacctaggactagtgacgccttggacacgcgtcacacatgcctcgcaccacttgatttatccaagcaagtggagaagcaacggtggcactgtttcgggcaagtcgggtctcgtcaggcccaccacgcaccacgtggcgagcacactggatgttgtaaaaaaatgttcttaatggtgagaaggctaaatcgcaggagatttaatcttgtttataaggatgcacagaagaataatgattgtttacacccaaatttggcacctaggattaaaataggaaagattgccaaaatttgtaagtctaccggtttcctccgagtgggccggtctgaccgccgtgtgttgagcggatcaccgcaaggcttaaggtgctgcgatcgtgcttgtcaacttgtcaaaaaagttgccaacacgatttttggcaactccgctggggaggagatccgttcatcgtcaactcaatttcgacttcgtcatgacgaagccgccatccaagacggaggtggagccatcaatatgataccggtcacattggatgacttcgaaggagaagaccgcaaagctatggaggagtacatcaacgagctcacacgggaggcgttgatgagggcaagcactaggactcgtcaaggcgtgatcatcaagcccgggccacgtcctaagctcgctcctgatttgatcaaacgggtagtagaaccaatggagcgacgcacacggccggtcagaccgcaacatagccgtcggtccgaccggccagacagccggtcagaacgggtactaccccggcggtcagaccgggactcaggctggtccgaccacgcctctggatgccggtcagaccgggccctgggccgaacatttgatcctcctatatctactactgcaaataatccccaagttcccccacatgttcctaatgcttataatgacgttactagggggtatcctcctgatactagacaaagccaatataatcatattgcgccacaaacacaacctattaggccaccaaatccaccgccaaatcaacaagggcctaataatatggaggatataattagtgagattattaggaattga

SEQ ID NO: 1542 - DNA, 1362 bp, Oryza sativa
atggcgctgaattactcgtcgtgctcgctcaccagctcgttcctgatgaacgaggactgcgctggcatgatgtgtgggtgcgggtgctggtcggaggaggcctcgccgctgtcatccggtggggtgaactccctgtggtgggatgagctggagtttgagctggagctggaagaggaagaggagttcgaccctgtggacctcttgcctaccgaccccttcggcatgaacctggagaccacgttcaccgcggcgatcgccagttgcattgaggacctcacagtcatgtccagtgctgggcgttttggagacagccgcgatgatgctgtttttgccgacctgagttattacttgaataaggcttttgttctatcaccggagtttcagtttggtggctatcggggtgtttttgaaggccccttggggtttggaggcctttctgctggtgaaggtgattcttttgggttcatgaagaacccttcttcctcaggaaatgctgatgattcttttgggttcgtggagacccctcctacctctggaaatgctgcattggagtgcggcgatgcagttgaagttgttcctgtccaggagggaggagttccacatgagggaatgctgtttgcccttgactaccttggccttcgtgacatcctctctgttgagagagtgtgtaagacattgcattcggctgtcagaaatgagcccttactgtggaagtccatccacattgaaggggatttgcgccagagaatttctgatgctggtcttctacacctgacacagaagtgcccagatactttgcagtgtctaagtattgcgtgctgcgtaaatatcacagaccaggggctgaaggctgttttagaaagtaatccaagattaacaaagctgagcattttgggctgcccacggttaactttggatggccttatttccaatctcaagtcatttaatacgaaggcggtgtttggaattaagcacctcagagttggaacactcttcagtttacgaaaggagcagtacgaagagttattatccttgttgaataccgacaagacacaggaggtgcataaccgggggccaagattccttcatgctaatcggtttttatcagattgcaatgatggatatgctcttgatattgagatgtgccctatttgtcagaactacaaacttgtttatgattgcccagatgaaggatgtgatgacagaagatctggtaattgcaaaggttgtactgtttgcatactgagatgttatgagtgtggaaggtgtgtagacaagttggcattcaaggagtcattttctctggactgggtttgccctaattgtcaagagaagaaggatctgtctcccccaatgaaatag

SEQ ID NO: 1543 - DNA, 1346 bp, Oryza sativa
  misc_feature (623)..(623): n = any nucleotide
  misc_feature (654)..(654): n = any nucleotide
  misc_feature (1136)..(1136): n = any nucleotide
gagataatagaaggttgttagggttcgttggaggacgttcgatctctttaaattcgggtgctctgcctcgccatcgattcggttgggacttgggagagatcgatcggagatgtcgtcgtcgagctcgccgtgcgcggcgtgcaagctgctgcggcggaagtgcacgcaggggtgctgtgttcgcgccctacttcccgccggaccagccggccaagttcgccaacgtgcacaaggtgttcggcgcgagcaacgtgacgaagctgctcaacgacctgcagccggagcagcgggaggacgccgtgaactcgctggcgtacgaggccgaggcgcgcctccgcgaccccgtctacggctgcgtcgcctacatctccatcctccagctcaggatcaagcaggtgcgcgaccagatcgtcgacgcgcgcaaggagctcgccgcctacatcggccccaccgccttcgcccccgtcgtcgccgccgccgcgccgcacacgcactacctcccccccgccgactaccaccaccagcagctccaagcccaaggtggtggtggtggtgctgggatgggcgccgccggctacgcgcaccaggtggtgcagcaccagatggccggcctccagtgcagngaacccgcaccgcaccgcaccgcacaccacnatcaccatcagcagatggtgaacgcgcagcacatggcctcgtcgaggtcgcgcgggaccaggacatgctgcgagcgcgccaggccggccacgcaaaagccggcgccaccgtcgcggtcgaggcgccagggtcgtcgtcgctcaacgccgacaccttcgacggcggcccgttcctccttcgccagcagccgccctcgtcggtgcagaccgagccggcaatggccctcccgtaccacatggagccgtcccgccgcagccgtcatcgggccactcgcacgacgaggtctcgcagcagcagcaccaccaccaccacaccggcaccaccacacggacggcagcgacgaggggagcgcggcgccgccccgccgggctgaccgccgcgcgcccggccccgtctccgtctccgtcgccgtgcgtgcgtgtgtgtgttccatgattccatcaaccttcctctcgatccatctagttcgtttcggtttctcngcagctgttaattccttcatcgatcggtcacaagtcttttcgtcttccctcatctcatatgatatcgagcaaactgacacccatgcctccctgaaagcatccatgacttctcaaggcgagcgaggtggtgatctttctcaaggggccggtttgaagctgcagcaatgcgcatctgactcactgctgcatatatcagagattttgacatag

SEQ ID NO: 1544 - DNA, 1344 bp, Oryza sativa
  misc_feature (114)..(114): n = any nucleotide
  misc_feature (384)..(384): n = any nucleotide
  misc_feature (903)..(903): n = any nucleotide
atgggcagggcgggtaggtggctgcgaagcttcttgccggggaagaaggacagggcgagggcgccggcgccggagaaggagcaggcggtggcggtggtgacgacgccgggggcnaaggagaagaggcggtggagcttccggaggccggcggtgaaggatggtggtggtggtttcttggagccgcgggtggaccccgaccagcacgccgtcgcggtggccatagccacggcggcggcggcggaggcggcggtggcggccaagcaggcggcggcggccgtagtccggctcgccgggtcgtcgaggcggggcgtcgtcgtcgtcggcattgaggaggcggcggcgatcaagatccagtgcgtcttcaggtcctacctggcgaggaangcgctgtgcgcgctgagggggctcgtgaagctgcaggcgctggtgcgcggccacctcgtgcggcggcaggcgagcaacacgctccgctgcatgcaggcgctcgtcgccgcccagcaccgggcgcgcgccgcgcgcctccgcctcctcgacgacgacaaggagaagcctctcctccacaccccgaggatgatgcccacccgccgctcgccgcaccacccccgcttccgtcatcagcagcagcaacaggaggcggaggagaacgtgaagatcgtggaggtggacaccggatttggcggcggcggcggcagcggcgaggcgcactgcacgccgaggacgtcgtcccggcggagcagctgctacgcgacgccgctgtgccgcacgccgtccaaggtggagctgtaccagaaggtgtcgccgacgccgtcggcgctgacggacgccagcgcgcggacgtacagcggccggtacgacgacttctccttctccacggcgcggaacagcccgtggcaccaccaccangcctccgacgcgccgtgcaagccgcatcacccgcaccacggcaacggcgaccacccgctcttcttccccaactacatggcgaacacggagtcgtcgcgcgccaaggcgcggtcgcagagcgcgccgcggcagcgcgcgtcggtgtcgtcgtccgccagcgaggcgtcgtcggtgcggtgggagaggcaggcgagcgcccggcgcagggcgtcgctggaggcgcaggcggcgtcggcgccacccaacaagtgcggcgccgccatgatggcgcgcgtgcagcggtgcccgtcgcaggcgagcgcgccggcgtcgtgcccgtgggggtcgaggctgccggaccacgacagcgagtgcgggtcgacgagcaccgtgctcaccgccgccaccaccacctactgctggtcgctcgccaccgacaacgccgccgccgccatggcatga

SEQ ID NO: 1545 - DNA, 1284 bp, Oryza sativa
atgcggcatcatcgcgtccaacaaccgcgggttcaaactctgtgtgttgccaaggaacaggatgcagcgacaacatcagatcggttcgtaggatatgttggaactaatccaaacgagtcgtccgtgctacacctcttggaagactacgaatcctcttcggagtcaccacgagatgtaaacatggtcggcaacactgagacgagtacgtccgcagcagcgagaacgcccgctcagcagttacgaaccctgcatgcgatattgagtgaaagtccttttgatccggtgataaacccagacgtcgaccaatgggcggcgcgactgcgggagaccgtgaccaacctcaatgcctgtgggatacacggtacccagatacagagaaagacatacactgaacatagggtattacctcatcttgagggcctgaaccaggataaacacctgcgtcaccatctctccttgatcttgcacaccccaaatcgggagaccgtgaccaacctcaatgccgtatttgtagacgcagcagttgagccatcgccaggtgatccgcccgaggagacggtgaaccatccgtcgacaacgcggagggagaaaaccccaccggaggacgaccttccggaaaccgatcacctcggccgaggcgagatcctactccaccacgtcacgagaaatgcgatcttcgcgaacacttggacaaccgctggagagacagaagagatcgcgacaataacgatcgtcatcgacatcgttctccttctctcagcagggataacactactcactgacgacaccgtcaccgctctccttcgcgacgaggaaggaacgatggtcgaggaggcgcccctaacgaagatcgagaccggtgggcccctagtgaccgccgcaacgacatcaataacgacaaccaacgagatcagggggctaatcgccgagatcgaaattcccaatctcccgaccccggtcgagatcgaggacacaatcgtcgttcgagaagccgggcccctgagccaagcgactcctcatcctcatcttcgtcatcttcttcgtcggatcggcctccccgacgacgtcatgaccgcgggctgccttccatcccagggagtcagtgcagagcattcacacccgcactccgggatgtgcgatggcccgagaagttccaaccaggcgcaatcgagaaatacgatggaagcacagacccagaagaatttccgcaagtctactccacaatcctctatactgcggatgcagacgataacgcgctggcaaactatctgccggctgcgttaa

SEQ ID NO: 1546 - DNA, 1263 bp, Oryza sativa
  misc_feature (293)..(293): n = any nucleotide
atggagttcccccgccgcggccaatcctcccatcccgccgacgccgacgacgacgaccgccgccgcctccgcttccctgactccaccccgccgagcggacgcgaagctaggccggctccggcgcagggggacgcggtgacggcggcgctggggcggcggagggaggagctgctgtgggagctccacaagacgaagatccaccgggagatgctcctgtgccagctggtcgagacggagcgcgccatggcggcgcgcctcgccgcggcccgcggccaccccggcaaggcaacggntcccgagatcaccccgtggtggcgccggagcccgtcggcagtgacacccccggtgtacccgcacgtggagcgctctccgtcgccgccgattgcgcggggatggccggccgacgatgacgagcggcaggaacgtggggagccatccgggtcgccggcgatggctcctccggtgcggcatgcacctcatgtcgaacagtccacaccagtgccgatcaagtcgcctgcggcggaggccgtttgtatgccatctgggtcaccggcgatggctcctccagtgcagcctgctcctcatgtcgagcagtccacaccattgccggccaaggagcctgcggcggtggcgaaggtggaggcagatgccattgtccagactgcggccaatgctgatgccgaccaggcgttgctcggcaagggggcgacaccaggagggcaaggttgcactggtcagaagggtgaggaaggtgatttcgccatcgacggccatggcaggcagctgttgggtgagatgaatgtaagcaagagcaccgagcagccaaaacctacagaatccatctctggaggccacaccgatgaacttgtccagaagcgttatcaagataataagccggcagatcaggagattgcaacattggacaagcagaagcgacttacaccagaaaggagatcctctggtgtgaagaggcagctggcttcaggaacctcactggcaaagaagccgaggtcccaggggagctccatcacttgctccctctgcaaggtcaccatgacttctcccagggcgctggttgagcaccgggcatccctcctgcaccggtctaacctcgcgccattgcgatcggggaacaaggccaccactgaagctgcgcagcccgcggagaagaagaccgagaagccagaggcatctgaatggaacagcagtgcacaccaccaccagaatcggatgtactactgcgatatatgcgaaactatgtag

SEQ ID NO: 1547 - DNA, 1245 bp, Oryza sativa
atggatccatttgcgcgaaccaactcattgaggcggatccatgaacgctatctccttcccccttcggagagtaacactgacgctggtttttacgtctatattctggagtcaagttacagaggtggagaagtgaggagggtcttttgtccttatgcaaggcaagctgatccagctggaccatgcaaggccaggaataacttgtgtaaacttgagagagagggattcattgaatcatctccggcacaggattgtgacctctgctgcaaaatgcctgatttctgccgagagtgctgctgtgttttctgccgcagggttgttgactattcctttggaggttatagctacattaagtgtgaggcagtcctagaagagaacaaaatatgtgggcatattgggcaccttgattgtgctctccgtacttttatggctggaacagttggaggatgtattgacttggacatgcagtattgttgcagacgttgtgataacaaaacgaacttgatgctgcacgtagaaaaattcttggaaatatgccaatctcttcaatcaagggatgacattgaacctatcctgaatactggcttatgcctagtgcgtggttcaagacaaacaagagcaaaaagcttggagagcattatgagatcagcaatggcaaagctaaagtgtggggttgatcttgctgaagtttggaaaatggaagataatggtatcaactcaactccaagtgcagaagtttcccctgctaccggtggtgtaacagtgcttgggatccagcaagctccagaagaggatgctcctccagggtttccatattatgttgatttggctgacaatgatttgcagagggctgttgaaaatcttccagcttacattaccgaggatcaacacacactgtctgtcaggttcgaagattcgatagatcatgctcttaaagaactgaagagatctcaggaagcagagtacaagctggcagagcagaagctttattcccagaaggatcatgtcctgagtctttatcgtcagcttgattctgaaagatccgtccttgcagaccctatgcccttagctgatgatgatggttcactatatagtacactaatcaccaatgttatgaagcgtgtggatcaagtgaagagtgaagaggagaagctcaaggtcatgctgggaatcgctgatggatttgggaaaacgccatcaggagtcattcaggagcatttcgggctacctgctgatactgccaactga

SEQ ID NO: 1548 - DNA, 1218 bp, Oryza sativa
atggcggcggctgcggctggcgcggatgggctcctcccgggtcccaagcttgatcctagcgacgacgagctcgtcggcggctacctgctccggcgcctccagggccagcccctcccgctcgaggcggatcccctgagcgcgcggccgcggaatcttgccgcggatcacggccgcggcgacgaggccttcttcttggcggaggcgcaggccaagaacgcgaagggaaagcggcagaggagcaccgtcgaggggcagagcatgtgcgtggacggcgggaggctccgcgtccctgatgacggtcgcggcggcggcggattggctttctcgcacttcttgccgctgtcgccgtcgatcgttccctcgccagcaccgtctccccgctgctccacctccacgccgctgtccccgccgaagcttctcgcggatcacggccggggcgacgaggccgccttcttcgcggacgcgtgggccaagaacggcaagcggcagaagcagaggagcaccgtcgagggcggagggctctggcaggggcaggggatgctcgtggacggcgagaggctccgcgtcgctgatgacggcggcggcggttcggctttcttgccgccgtcgatccttccgtcgctgctgccggctccccgctgctccacgccgctctccccgtcctcgccgccgttccggccgtccagggtgatcgttcggtgggcgcggccgccgcctgggtggtgcaaactgaactttgacggctcggtgttcaacgacggctccccgcgagcgagcatcggcggcgtcatccgcgacagcgacgccggcgtggtgctcgccttcgcggagacaacggagcactggaccgtcggcgtggtggaggcccgtgctatgatcagaggcctgaggttcgcgctggcgtgcttcatcgagcggctcgtggtggagggcgacgacctggtgctggtccagctcatccgcggcgaggagacgcagacgaggatcccggcggcgatgcaggaggagatcctcaaccttctgcgatgcttcgccgaggtggatgtgcggcacatctaccgggagggaaactcggtggcccacacactgtgccggcaggcgtacgtgtgtccgggcatatggtcgcagaggggaggagggatgccggcggccgtctgggacaaggtggatgatgataggcgaggggtggtgcacgagcgcatccgcaagaacaagtag

SEQ ID NO: 1549 - DNA, 1191 bp, Oryza sativa
atgaggaagaagagagatgtatgggtggggaaaaatgtggtggaagagaaggaagaagaagccggcgaggcggcgagccggagaaggatgaatccgccggagctgatggacgacctcgtcgacgagatcctcctccgcctcccccccgacgagcccgcctgcctcgcccgcgcctccgccgtctgcaagcgctggcgccgcctcctctccgaccgggccttcctcctccgccgccgacgccgcgcgccgcctcccctgctgggtttcctccacaacctcgacaacgccgaccaccccgaccgcttcgtccccaccaccgccctcccgatccccccgccgccacccgagctccactgcgggatggccctcgactgccgccatggctgcgccctcctcgacgcctacccctccaggatcgacctcgtcgtgtggcaccccatgacgggccacctgctgcggcggcttccccgccccgacgtcccgtacctcttgtactacaacgccgcggtgctctgcgccgccgccgccgccggctgcgaccacctcgactgccacgagggccccttccgcgtcgtcgtggtgggcaccgaggaggacaacgaggcgtgggcgaccgtgtactcgtcggagtccgacgagtggagcccaccgacctccgctcgcctcgcccgaggacccgagttctgcgtcgagggcaagcccgccaccctcatcggagattcgctctacttcgccctcgtgtttggtatcggagtcgtcaagttcgacatgaagcgccatcgcctctccctcatcgatccgccggctgagctcgacgatggcttcgtgctcatgccgctggacaacgatggcgtgcttgggctcgcggccgtggaggatcacagcctcctctctgtgtggtcaatggatgtgagcctggatcatggacatgtgctaccaattggatttgtggagggtgccaatatcatcttcctgagaacagatgcgggtgtcttcacacttgagctcagatcaatgcgtgtcaccaaggtgtgcaagaatgggttcttctacgctgtcgtgccgtacacgagcttctacattcctggtgtccatctccagcagcagcacagcggacctcagatcagtaatggccgggcatggggatcgcaggctgctaacatgaggcgtggcagcagcttctcaaggtaa

SEQ ID NO: 1550 - DNA, 1188 bp, Oryza sativa
atggcctcttctcccttacccgcttttccgccgccgccgccgccgctaaatccgccggccacttcgccgtcgaggagtacctcgtggccacctgccacctcacccccgaccaggctaccaaggcctccaagtccatctcccacctcaagtccccgtccaggcccgacgccgtcgtccgccttcctcgccggcctcggcctctccgccgccgacatcgccgccgccgtcgcctacgacccgcgcctcctctgcgcggaggtcgacaggacgctcgccccgcgcctcgcggagctcgcgggcctcggcctctccccctcgcagatcgcgcgcctcgtcctcgtcgaccccgcccgcttccgccgccccaccgtcatctccaagctccagtactacgtcccgctgttcggatccttcgagaccctcctccaggcgctcaagaacaactcctacctcctcagctccgacctcgagaaggttgtcaagcccaacgtcgcgctcctgcgggagtgcgggctaggtgcttgtgatattgctaagctgtgcatcccgttgccgaggctgctcaccaccagcccagagcgtgtccgagatatggtggctcaagcagaaaacgtcggcgtgcgccgtggctccaagatgttcaggcacgctattctggccgtcgcgtacatcagcgaggaaaagatcgccgccaaaatgcagttcttgatgaagacattaaagtggtcagacgcagaggcgaggattgcggtgtccaagcttcctgtggtgctgaggagctcggaggacaagctgagccgtgtgtcggaattcttgatctctgaggtcgggttggagccggcatacattgcttacaggccggcaatgctcacttatagcctggaacgccggctcatgccccggcactgcgttctgaagtatcttaaggacaatggattgatagaatccgacaagagctactatagcgcggtccaggtgaccgaggaggtctttgtggagaaatacataagtccatacgaggacactgcgccgcaccttgctgaagactatgctgctgtatcccagcgtaaagatacccaccagattcagattgaaaggaccaaaaacaggccatgcaagtgcgcaaactgcctaattcttgccacgagtagtgagctggtaagtcctcttgcagtgttctttgcctga

SEQ ID NO: 1551 - DNA, 1155 bp, Oryza sativa
atgtcgtgctcgcgtgggtggtggaacgacctcccgtcggatctcctcgcgctcgtcgccggctgcctcacgttccaggcctacacccgcgcccgcgccgcctgcgccgccaggcgcgccgccctccccgcgatctcctcgccgtcgctcctcgtcctccacgacgaccaccgcgaacgctccagcttctccgcatggttcttgtcccccaggatctccatcgctagcttggccaccaacctgatctctacggggagggcgcagcgctgcgtcggctccggccatggctgggtcgccttcggcgacttcaatgcctccctcgtgaacgcgttcaccggcgacgagatccccttccattcgttcccggagaagcacggcgtggtgatgtcgaaggtcgtcttcgcgccgaacccgacgccggcggagttcacggcggcggcgatcaccggccacctccgcgtcacctacaccactcgcgggaacagcggatggaccgacgtcgagctcccgcgtctcggcgctatcggcggcggggactacatcgccgacgtggtgtaccacgagaaagaattcggcggcggcaagaagaagaaggtggtgtactgcctcaccggaggcggcgacgtgctcgtcctccgcctccccgccggccgccgccgccgccagcgaaggccggcgtcgttcgagccactgttcgacaaggcgagcgccgtgttctacccggcggccgcgttcgcgccaccgcacagcacgggcgacaagtacctggtggtctgcgatgacggccatctctaccagatctggatggacgaaaagatctcctatggcagtggcgccatagcatccgttctcaggtactaccctcgccgccggccgtgctggctgccggcgaaggatctcggcgggcgctcgttcttcgtcggggtgaacaacgcggtggcgctgcgcgtggatggtggcggcggcggcgcgtcggggctgagaggcaactgcgtgtactggagtgccaggtgtagtagccgggccaaggtgttcgacgtggagtccggcaagtcggcgacatgctttccggtggtcgacttggagacgggcaagtcggcgccgggctttcccggcggcgcggaagctcatagagccctctgctgctcagtgtag

SEQ ID NO: 1552 - DNA, 1131 bp, Oryza sativa
atgtttgatagcagagtggacgtacatgctcatctgatacaacgaggattcatggagggctacacatgttgggtgaagcatggagagcaagaatcacttgacgatgttgcagctgcagacagaagcggtgaaatggttgatgtggatcacgatctgatgcaagacatattacatgacgttgaggacacagcttacaacgagagagattccataaaattcagcaggaagacatcacgggttaacaggaagaaagcaagacaaaacatgcttttgagttctccccattcaccatgtgtcttcctaactgtgcgagaaggagtgctcccgaaccatggctacaaagctaggacggagttcaaagccagatgggttttgaaaggtagtggcttagagaactcgccttttgaagcggaaagcacccggtccaaatcggcagccagcaaaggtgcccgcgactcgagttatggtgacgtgaccgcaacgtcatggatgacgtgtacatccccttcattcttgaggaggcggcgacatcgtgggccaagatgtgggagagctgctggcctcgacgcggtccaagtcggtcatggtcatcgaggacgtcgacttctccctcagattgttagaccggacgcgcgcgccggcatcctaggacgacgacgactagggccatgggatactgcgacactcgctcaattttatgccaccagtgcgtttcgtggaggctactgtggacgtgccgctcgccgtggtggtgccattcagaccatccccggaggtgaagcggctatacccgagcatcgacggcgcccctgtgaaggaggagctgcaggtgcaggtgtatggtgcttggcttcgtgtctcaccatcacatcgccaacgagcagggccactgcgagcttcctggtggcatgggggctcaccacatggcagctgcccgtgggtgtggtagcgctgcccccatccgcgaccatgccgcatctcaagtcccggaccttgtcggggctcccgccgtcgcagcactggcggggatacaccaccttccagggtttgcaatttcgaaatcatgttttttgctgcaggggagcgatagaaccgaaatttccgaaaattatttcgtacgaaattttttga

SEQ ID NO: 1553 - DNA, 1128 bp, Oryza sativa
atgccggcgacagcggggcgcgtgcgcatgcccgccaacaaccgcgtccacagcagcgcggcgttgcagacccacggcatctggcagagcgccatcggctacgacccctacgccccggagaacaacaagcaccagcctccctcctcctccgtctccgccaacgccgccgccgccaacgccgccgccgcatccgccccatccgcctccgctccttcctcctcctccgccgccgcctcctccgacaacgcctataccagcttccagggcctcctcgcgctcgcccgcatcaccggctccaactccgacgagacccgcggcgcctgcaggaagtgcggccgcgtcggccacctcaccttccagtgccgcaacttcctctccgtcaaggaggacctcgacatggaggacgatattgatgccgggattcgggccgcctcgcaggccaacgcccaggccaagaagcattcaagggatgaagagaagaagacaagccgccataggagcagcagcaggggaaggtccaagcacaggaggagcaccaagaggagtgataccgaggacgacttagaggaagagaggagcaaggacaagaagaagaagagtaggcgcaagaggcatgaaagatcagatgaggacagcgagagtgattctgacaagaagaggcataggaagagcaggaaggacaggaagaggcgtaggagccatcgcaggagtgatgacacatcggatgaggatgagtctggaggcggagaaggcaccgtaagtcagaaagtagtggatcagatggtgatgaacgacatggtcagggggcaaagcggagcaaggaaaagaggggcaaagaagagtgctgaagtgggtgaggagaggaacggctcgcactgcgtgttggagaggcgtagccccgtgcgaaccggcgacgatgagctgattcgaggtgtcgacgatcatcccgagttgctccacgcgtggtcgccgctggcaaggccactacccggagctacttggttgcctccaaagcggtggcgcaagccagatccggtcgctggatccatgccaaatccgttcgtcctcgacgccttcgatggctacgttcctcgtcctcgctcgatccaccaccgccaccgaagatag

SEQ ID NO: 1554 - DNA, 1110 bp, Oryza sativa
  misc_feature (298)..(298): n = any nucleotide
  misc_feature (320)..(320): n = any nucleotide
  misc_feature (323)..(323): n = any nucleotide
atggcgagcaagcaccagctggggcagcaggaggcgatgcaggaggaggactacatcgacatggacctgacgagcgccgccgcggcgacggcgccgggtgagttcgagttcgacttccacatgtcggggccgctgggcggcggcggcgcccggtgggagcaggagccgctggcgtcgccggcggacgagctgttctacaaggggaagctgctgccgctgcacctgccgccgcggatacagatggtggaggagctgctcgacgggcgcgtcgtcgtcggcggcgccgggcggcggcagntcgccataagcacggcgccggngangccgtacgactcgtgcaccgcgtcgccggcgaactcgtgctacgccagcggggagctcaacgtggaggagtacttccaggagtacgcggccaggctcgccgaagccgccgcggcggcgtgcgagaagaagccgtggtcgcggaagctcaggttcatgaggcagctcaacctcggcctcaagctcaaggcctccaaggcctacatcaagacgatcttcgccgccaaaccggcgagctccggcgacgacgacgacaaggacgccattcttggcgcgacgagagaaaccaaagaactctcccatggtggccaccaccaccacagagcatggaggaggaacccgttcggccagatgagaagcaacaggtgcatcgcctcctcacagagcggcggcggccgtggttcggtcggaggagggaagcacaaagagcgcgaccacggcggccacaggaggtccttctccagcgtcatcgtccggtactcgacgtcgaacaagacgtcccctgcgccgcagtcgtcgtcgtgctcctcctcctcgtcggtgcggacgtcgagcgagtccgacggcggcgcggcggcgccggcgctgcggaggagcagcagcgcgagctcggaggtggagaacccgatccaggggctgatcgcctactgcaagaggtcgcagcagctggcgtcggtgaggaagagcgccagcgacgccggcttccggttcctctcgtcggcggcgtccaagatcgccgccgcggaatccgacggcccggaagagctcgtcgagatttgcagaggttga

SEQ ID NO: 1555 - DNA, 1103 bp, Oryza sativa
  misc_feature (518)..(518): n = any nucleotide
gggtggtggagatattgctgataaggacggcgccggatctgatcgacatcacggactcggccggcagcacggcgctgcactacgccgcgcagaagaacgacacgcgcatggtgagtatgctgctcgacctcaagcctgaactggccagccggcccaacgaccggcagcagtcggcgctgcacgtcgccgccgtaaacggctcgatcgcggcggcgacggagatactgcagcacagccccgatgcggcggagagtaaggacaaggacgggaggaacgcggtccatgtcgccgtgtccaatgtggacacgctcaggggcctcctcaaggtgatcggcccggcggaggtgatcaaccagggggacagcgccggcaacacgccgctgcacctcgccgccaagatggcgcacgtccagtcaacgctgacgctgctcaaggacccccgcgtcaacccctgcctcctcaaccgggacggccacaccgcgcgcagcctcgtcgaggagcgtctcgccgtcggcganatggacgcctacgtcgtctacctctgggagaagctcaagaagcaagaggagtcccggtgcaagaacctgcagcacctcccgccggtggcgacgtaccagtcgctgcgcaggcgcagccacaggtcagctggctccggcaacggtgactacttcgagctcggcgtcggcacctacaccctcgtggccactctcatcgccaccgtcaccttcgccgccaccttcaccatgcccggcggctacaaccagacctccggcctcgccatccacgccgaccgcgcggcgttcgacatcttccttgtctccaacaccgtcgccatgtgcagctccatcaccgtcgtcttctgcttcatctgggcgtggcgcgaccccgtcaagttcaacctcgaacacctgaggtgggtacacatgctcaccgtcatagcctgccttgccatgatcgtctccctcatgacctccgtctaccaagaggtggccggcgtacctggtgatcaccatcggcgcctgcactccggtcgtcgtgatactcatattagggaaggaggctttctacataccgtttgttcagaagacactgctaccggttga

SEQ ID NO: 1556 - DNA, 1095 bp, Oryza sativa
  misc_feature (163)..(163): n = any nucleotide
  misc_feature (166)..(166): n = any nucleotide
  misc_feature (194)..(194): n = any nucleotide
atgtggcgcgcggccgcctaccacctcctcctcctccgccgcgccgcgcatcctcctccctctccggcaaccgccacaggggcggcctgcgcgctccgccacgtgcgcctcttctccccgcctccgcatccgccgtcgtcgcggcccacggaggccaaggcgnagnttacggcggcgaaggctccgaaggcttnttccggctggtgggccttgaggcgctctaagcggcggctgagggacgggcgggaggaggtggtcgggtacggggagctcctggacgcctgcgtcgaggccggcgcggcgcgcacgcggcgtgacgcggaaggcgctggcccggggccatggacgaggccggcgtcgtgctgctgttccgcgacaaggcctacctccaccccgagaagcccattggagattcaaatgctcctatataagcacccattttctctgacctgcaatgttagtagtgttcctgaaatggataatcgaaatggacatgcacaattcaagttgatcgaattggataccaacaaaataacaacaaatgaagttttgttcaaagtggttgagcttgttagaagagctgttccgcttgcactctcaccggagaacgattcaagaaaagaagagctgaagaagctccaggagaagaaggaagagatcgacaagctggcgcacaagcaagtccggcgcatcctgtggtctggactaggtttcttcatgtgccaagttgggctcttcttccgccttactttctgggaattttcatgggatgtgatggagccaattgccttcttcacaactgcatctggcctgctcgttggttacgcatatttcctcattacctcaagggatccaacatatgaggacttcatggaaaggttgtatttgtcaagacacagaaagctttgtgccaagaatagttttgatatggcaaagtacctcgagttgcagaagcattgcaagtgtcctctggaaggacataaagatgccattttgatgccaaagagcaaaacaaacatcgtttttctgcctataaagatgtcaacgcaccgaaaaatagccaggcttgccattggtaaagaattggatgaataa

SEQ ID NO: 1557 - DNA, 1038 bp, Oryza sativa
atggagaacgccgccatcaacctcacgcaggcggcgcggcgcgtgcaaaatttggtcacgtcgtgtacgatcgccgtgggcggatacgactggctgatcgaggtcttcccggccgcttactaccacggcaccagctcccgcaactccggcccctacataaagctgcgcttcaccttgtcgagcgacggcgagcgcaccgtgtcggcgacgttcagatgccgccttgtcgatgatcatcagatcaatcaaaccgccgcgtccgcatccagctctttcaaggaggtgatagtgacatccatcttctccaatggccaaccaaaggacatgttcttggtgtcgaggagctatgcgtctgaatacagatacgtccaaccagacgactccttgctgatcgagtgcgcgatcaccgttctgctcgaagcaccagtgaacgcggcggcaagcgttccggcgcctctctccgacctgcagaagcacctcggcgagatgctgacgagcaagaatggcgccgacatcacgttcctcgtctccggcgagcctgtcgcggcgcacaggtgcgtgctcgccgcgaggtcgccggtgttcatggccgagctgttcggcgacatgaaggagaaagactcgcagagcatcgagatcaaggacatggaggcagaggtcttcaggaccctgctccacttcatctacaccgacactttgccggagcaagatgacgacgacgtcgaggctgaaacaatggcgtatggtcttctcgaagccgcggatcggtacggcgtggagaggctgatgctgatctgcgcggagaaggtgcacgctggcattagcgtggacaccgccgcgatggcgttggctctggcggagcgccatggatgtaccaagctcaaggctaggtgcatcgagttcatcttggcttctcaggagaatttccacgcagtcgctgcaacggagggttacaagcttctcatggatagctgcccctctgctctgaatgaccttctagtggctgtttttctgaggtacaaattaactgttctgtaa

SEQ ID NO: 1558 - DNA, 1029 bp, Oryza sativa
atggatgatgacgacaggaaggagaagatgcagaagctgatgccgctcccaatgcgcatcgggcagcaatctctattcggaaaggaggaaactgcccccaagccccatgagcccaacaaggtggtgtactgcaccgcctacgccggcggcgacttggttccgcccttctccgagttctacctgcagatgttcgtcgggctcctgcctttggtggatctcttctgtcgtaccttcgtggtgcgacatgccccgaaaagcaagatgagcagcctgctggagctcataggatgcgtcaccttcaccgcacgccctattcaagaattccttcacatccccatgaaggacaagtgggacgagtggcaccagaagtgggtctacatcagcgtagaatccccacgaatgcctcatcctccctgttgcctccacgatgggcctgctgtcatagaccaacgcaacaccacccgattggcgcttgagcccagttttttagtagatcatggaattggtgaaggccagggtcaccgcgtacatgatgtccgacgattttccatcgctagaagattggcacccctgaacccagaggagcccgtgcttggtggccctgaccagggaacaaggaatatggataacaatttcaagaatggctcacaaacaagtttagtcttcgggctgagcggcgtgcatggcggcgaagccaaggccggtggtgggcttctaggggttcctaggaggtgctaccgagagctaattaacctgggcaagatgtggctggaaggggcggcgaaagtgggagctcgaggcggagcgaggtcgtcgtcggccttctacccgggggcgacggtgcatgcaaaacaccggcgacagggcaaaatcggcgacgcgcaggctggggacgactatggggctcctagaggcatcttccggcgagaggacgacgcactaaaccgctcaaaggcagtggaggggcttgtgcagctcggtccggagcctatcagatcatggcatgctctggcgctggtgcgggcatga

SEQ ID NO: 1559 - DNA, 1002 bp, Oryza sativa
atggacgactcgagcctcttcttgcattgggcggtgagcacgctgcagcaccagcacccggcggccgtcgcagtcgtggccgacgacgacgccacgttcttctcgttccaggagctctgcgacaccgaggaggtggttgttgtcccggtccaggaagaagtgatcacggaagcgcatggtggtggagccagcagaatcggcctcgccgtggccgtggatgagcacggaggctggtcaaggtccccgaatccgggggccaggccgccgtctggtggatgcggcagcaataatctgcccctgatgagctgggacttcagcgccgcctcggtggcggtgcaggtgcagccgaacggcggcggcggtggcggcgcgccggagatggcgtacgggtcaccgccggcggcccggggatccaccaccaggaagacctcggcgcccacggtggggcggcggcggcgtacgcgcagctggagcacgtcgtcgcggagcggaagcggcgggagaagatcaaccagcggtttcatggagctctccgccgtcatccccaagctcaagaagatggacaaggcgacgatcctctccgacgcggcgagctacatcagggagctgcaagagaagctcaaggcgctagaggagcaggctgctgccagggtcaccgaggcagcaatggcgacaccgtcgccggcgagggcgatgaaccaccttccagttccgccggagatcgaggtgcggtgctcgccgacgaacaacgttgtgatggtgaggatccattgcgagaacggcgagggggtgatcgtgaggatcctcgccgaggtcgaggagatccacctcagaatcatcaacgccaatgtcatgccatttctggatcagggcgccacgatgatcataacgatcgctgcaaaggcaagcttcacagtcaaggcagaggagattgtaggcaggcttaactcagctttatacaaacaagacgtcagcactgctattgaggaaaacagaaactaa

SEQ ID NO: 1560 - DNA, 966 bp, Oryza sativa
atggggacaattttgggaccacctgtcagtgacccgtcgaagcctcgaaggctactagtagtactatttgtaaacagcgggtacacgcgctaccacacgccaggcaaacccacacgccgccttcccgccgcctccgctcttcttcccccaaccgcgtcgcaagcccacggcgagcgccgccgccgtcccaccgtcgccgatgacccgcggcgtcgctatggcgcacgcgaggctcctcctggcgcgctactacgtatgccaaacgcggggacgaagaactcaccgcccagccccccaccaacgccgtgtaagcataccgtcgaacacctcccgcgatggcggcccccagttggcctaccgtatccaagaaccttccgctgctgggccatggacgccgaggagcttgacgaggtaggcggaaccggcggacaacggcgctgtgagttgcgccgcggcggaggagtcgagcccgagccctcgagcggtggcaccgcaccaggcagagaaagatcgtctgagccgcgccgtcgtcgggatgtcgtcgtctacggctgcgatcggcgatccagatctgcttctcctattatttcagagctggcaaagaagatttgtgttccatgcaattctaaggatatacatgccatgccagaagattctgctaagaagatgctagaacaggtgggtggttgggaattagcaaccgaaggtgacattctgaaattgcacagagcatggaaggtgaagaattttgtaaaagggcttgaattccttcagcttgttgctgctgttgctgaggaagaaggccaccaccctgatcttcatcttgtcggttggaacaatgtgaaaattgatgtttggactcactctgtcagaggcttaactgacaatgatttcatccttgctgcgaagatcaataacctcaacttagaaggcctcttaagcaagaaagctacagtccaaaagtag

SEQ ID NO: 1561 - DNA, 945 bp, Oryza sativa
atggggtgtgccagattgttgcgacatccaatagccttagtcaacaagttcggcgagcattgcgcagccgcagagagctttttttcgcttttttcgctcttgatgtacagaagggcttcggcttcccctacccaggttctcgtggcgcacctgagcgcgaagcggtctgccttggagcggctggacgtgtaccgtcttcgccttcggaaggccgaagaggaccttcaccataaagaggacaaacgccgagtcgtgccggacgccctgaagaaggcgagcgcagagaacaagtcccttgtgggggaaaataaatctctctgcaccgacttggagggggtgaacaatagggccgccgaaagggagaggcagcttgctatggccgaagaaaaagtcaagtctcttgaggcccggcttggcccagccgaagctgctgctgaagctttggcgccgacgacagagtctgccaaacaggcttgctatactcttcggctggctctcaactaccttggggcgcatgtagaaggcgctctgggtgaagatggatcagcgttcgacttctctgagtggacgcaggatgcggccggctcagttgtcgaagcggctggcgcatacggcgactgctgcgcacgagttgccgtgggcttcatgctcagcattcttcacgaacatggttgttaccatgttgaggactttccccaaaccgtgaagaaggattggcccgaaagttcccaatccgtcacgtttgctttgaaggcctttcggaagaacttctgggaaagcggcggtaaggatggggcgaagacccggcttcgcgagcagctggagaaaatagcaagggccgaagatgccactgccgccaacactggcgaagaccccgagccgtcggggccggctgttggccgtgagggcgaaggcatggaaagccgagaccaccctgaggtgtga

SEQ ID NO: 1562 - DNA, 930 bp, Oryza sativa
  misc_feature (255)..(255): n = any nucleotide
atggagggcggccgcggggggaagcgatggcgcttcgcgaccccgaatctggccgtggccgcggccggggaacgcagcatccagcggtacctccttcagctgcacgcgtgcctggacgagaacgggccacggcccgtcatcccgctcagccacggcgacccttcctcctccgcctgcttccgcaccgcgcccgaggcagaggaagccgtcgccgccgccgtccgctccggcgactacaacggctactcctccccngccaccagcctccctgctcgccgagctattgcagagtacctatcctgtgatcttccttacaagctttgcacagatgatattttcctcacatctggaggtacccaagcaatcgagattgttatgtctgtttttggccaaccaggtgccaatatattgcttccaaagcccgggtacccaaaacatgaagcacatgcggtgttccacaggatggaagtgcggctctatgatcttgttccagagagaggatgggagattaatgttgaagctgttgaagctttagcagatgagaatactgttgcaatagtgattactaaccccaataacccttgtggtaatgtgtacacttatgagcatctgtccaagattgcagatacagcaagcaagttcggtctgttagtcattgctgatgaagtatatggtcaccttgtttatggaagcactccttttgtgccaatgggtgtgtttggagagactgttccagtactcacattgggagctatatcaaagagatgggttgtccctggctggagatttggatggatagcaatttgtgatcctaaaggcattctgaaagaaacaaagctctcaggatttgtcccaaaatataacgacttctccaccaacattctcttcccaaccaatcacaaccctccacaattcacttttcccacctag

SEQ ID NO: 1563 - DNA, 921 bp, Oryza sativa
atggcggcgcctccgcttccccgcgcccccgtctcctcctccgccgccgccgcgtcgccggggggccgcgctctcctcctcctccgcgtcggcggaggaggttccggaagatgcgctggcgtggcggcggcggcggcaccgggttggcggcggccgttcccggctgcctccgtcgcggcgcgctcggctggtaccacgccgggagaggtcgccgtcgatcctaaggtcgaagcaatactagacagtgtgaagtgggacagtaaaggcttggctgttgctattgcccaaaatgtggatactggagccattctcatgcagggttttgccaacaaagaagcccttgcaacaactatatcaaccaggaaagctacattctatagccgttcacggtcttcattgtggacaaaaggggagacatcaatgaatttcatcaatgtgcatgacattttcttggactgtgaccgtgattctataatataccttgggaagccagatgggcctacttgccatacaggggcagagacttgttactatacttcagtctatgatgctctacaaggttcgaagcccaatcaagataggcaggttgtctcaactctgtactcacttgaagatacaattagtagacggaaggaagagatagttactgaaggaagtggcaagccatcatggacaaaaaaactaatacttgataaccggctgctttgctcaaaaataagcgaagaagctggagagctaaaccaaacactgcttgagaacgaggacgagagccgcacaatcagtgagatgggtgatttgctataccacgcgatggtgctgcttagggtcaagggcgtgaggatggaacaggtcttggaggtcctcaggaagcgattctcgcagtctggtattgaggagaaggccagtcgcaacaaatcttag

SEQ ID NO: 1564 - DNA, 915 bp, Oryza sativa
atgctgagcgcgatgatggccgccgtcggcggcgacaagccgcagccggacacgtcggagcagatcaacgtgtcccccctcgccctcctcaagatgctcaagcacgggcgagccggcgtgccgatggaggtgatggggctgatgctgggcgagttcgtcgacgagtacacggtgacggtcgccgacgtgttcgccatgccgcagagcggcaccggcgtgagcgtggaggcggtggaccacgcgttccagagcgagatgctggagatgctccggcagacggggcggccggagatggtggtggggtggtaccactcccaccccggcttcggctgctggctctccggcaccgacatggccacgcagcagagcttcgagcagctgcacccgcgcgccgtcgccgtggtgatcgacccggtgcagagcgtcaaggggaaggtggtcatggacgcgttccgcctcgtcgaccacatggcgatggtgctcggcggcgccgcgggcggcgaggcgcggcagaccacgtcgaacgtcggcgccgtcgcgcggccgtcggcggtggcgctcgtccacggcctcgggcggcactactactcgctcgccatcagctaccggatgaaggagggggaggagcggatgctggcgtgcctcagccggagcgggtggtccgacggtttcgcgctgcggcggttcggcgcgcacgacgccggcaacgaggcggcggtgcgcgggatgcgggacctcgccgtgggctacggggcgcaggtgagggaggaggacgagacgccgccggagaggctcgccgtggtgagggcgggcaaggtggacgccaaggggaagctggaggagaaggccatggacgccatgtccgccaacatcgtgcagacgctcggcatgatgctcgacaccgtcaccttctag

SEQ ID NO: 1565 - DNA, 906 bp, Oryza sativa
atggtaggccactcccaatgcagggaacaacggaaaagtggagaacggtgtggcgaagctcgagatccggcattggaaagtacctttacccagtctttttacagcacagctctagcaagcaatggcgtgtatgtcaaccatggaccaaaagtccctgaagtagtcggggatttcgaagccgttggtagagaagagcgcaacggcgagcccgccactgctgtgaaacaacaacttcggagacgtcgggacaagaatcaggcagcagtgcagcaccagggcatcgactggcttggtgttcaggcgatcaaaccgtcgagcacctggcgtgcgtcggtgcgtggcgaaacaacgcctctctccgcggccgctccggcgccatctcgagcgcgcacaaagagtacagctcaggaggcggtaagatccaggttaggagacgcagtgacgtgtatagcaacagctcaggaggcaggcgggagatcgggagcacggaatatagttgaacgacggcgcagagagcgcgcgcaagcgcgaagggccgtgcgatggatttgcattgcacgtgaaccacaaccctgttctggcccaactatattaggcctgcttgttagccacaataccgatccggcccatcgagccgagcagacacagaagttgaatttctacaccgatgcaatagagatgaacgaactcctcacaagttcacaacgaggtaacatcctgcataccaaagctaaagctgacaacaacatcactgagatcaggcatagtttcaagccaacaacacacatcaatcccggaagaaaatcaggtaacggatcggatcgacacagctgcaactcctgcacggatggtgttcgacagttcgaggatcgagacggccagccgtcccggccggcgaggtgctag

SEQ ID NO: 1566 - DNA, 843 bp, Oryza sativa
atgaaaaagggatacgaggatgaactgggttcggaaatgattagcaaccgttccccggcaacgacgccagaaatgcttgttggtatttcttacgatcacagacaaaatccgcaagcgcacagatatatcgatgtagcacttcccctacggagtattccaagggtattgaatccaagggaactgctcgccgcccagcctccaaggcacgttgtcgccggtcctcagcctccttcgcagcccgttcgtgctcctgttgctcacgctgcagccggtctcgctcttgtgcttatcgctcatcttccagtcggcgacgctcggcttcctgtcgtgtacgttgttcttctgcttcccgggcttgacgctgcttcgctgtctcgcttcgtcaaagtcatcgaggttgctgaagtcgtagttgtagccaaagtcatcgtagtcgaggatctccgttggtctatgaccccaacttccctgaagctagattggatcggggccgaggccagatcccgtctagacctacggggagaggacatccttgtggtgaagaccgcagccagatcgtcggggagcttcatcaggatcgataggccccatcatcttgatcagatctcggccgagttcgggagaccgaacggggcggagacctcgtctcttcctgactggtttgaatccaagtcagggagagagatcttaacgaagttgtcggtgatgaagtcgaggccgccgaaccggaacgcctgttgcacttcccctacagagtattccaagggtatcgaatccaagggaacgtatgtggtcagatcttcctccggttcatccaaggacaccaagcaaatgataggctag

SEQ ID NO: 1567 - DNA, 837 bp, Oryza sativa
atggacggcggccacagcccggacaggcatgcggcggcggcggcgggggagccggtgaggtcgcggtggacgccgaagccggagcagatactcatcctggagtccatcttcaacagcggcatggtgaacccgcccaaggacgagaccgtccgcatccgcaagctgctcgagcgcttcggcgccgtcggcgacgccaacgtcttctactggttccagaaccgccgctcgcgctcccgccgccgccagcgccagctgcaggcgcaggcgcaggcggccgcggccgccgcctcgtcgggatctcctccgactgcttcgtccggtggcctcgcgcctggccacgccggctcgccggcttcgtcgctcgggatgttcgcgcacggcgccgccgggtacagctcctcgtcgtcctcatcgtggccgtcctcgccgccgtcggtggggatgatgatgggggacgtggactacgggggcggcggcgacgacctgttcgccatctcgaggcagatggggtacatggacggcggcggcggctcgtcgtcgtcggcggccgccggtcagcatcagcagcagcagctctactactcgtgtcaacctgcgacgatgacggtgttcatcaacggagtggcgacggaggtgccaaggggaccgatcgatctgagatcaatgtttgggcaggacgtgatgctggtgcattcaacgggtgctcttcttccagccaacgagtacggcatcctcctccattctctccagatgggcgagagctacttcctggttaggatgcatacctgctgcctgcctaacatcggcttgcgactgcagccaccaagaaaacagtga

SEQ ID NO: 1568 - DNA, 831 bp, Oryza sativa
atggcaacaactaccgtcaccacaccaattctctgcaacctcagcgccaagccacgcgacaccctgcgcctgccgacgacgcgttcgccgaacgacggcacgaggcgaacgacgctccacctgagctcgtcaagagcccgcggcgacttgatccgcgccgccgccgccgtctacacggtgaagctcatcgggccggaggggcaggagagcgtgatcaaggtgccggaggacacctacatcctggacgcggccgaggaagccggcgtcgacctgccctactcgtgccgcgccggcgcgtgctccacctgcgccggcaaggtcgtcgagggcggcgtcgaccagtcggaccagtcgttcctcgacgacgcccaggtcggcgccggctacgtgctcacctgcgtcgcgtacccgaccgccaacagcgtcatccagacgcacaaggaggcagacctgtattatagtcccggggcccaggatccacgtgccgccgactcggaacggcgtcaccacgcggccacaccgggccgcgtcgatcgccaccgccccatcaccgcgcaccgacgcctctgccccgccacgccccgcgtggcggccgccgcgccacggcggaaaccaatcggaattcgggaacctcgcggccgggccggcgcgcgccgtattttcgtcgtccgtccgattttcgctgaaatgcgcggggaggtttcgtgccgcgggcggaagtttcgatcgcagcagccgcccggcgcgcgcgtcaccgtccgcaaccgccacccggaaagggcatcccagggccggggtgcacggaactgcttctgcgagctgagctggtag

SEQ ID NO: 1569 - DNA, 825 bp, Oryza sativa
  misc_feature (486)..(486): n = any nucleotide
  misc_feature (737)..(737): n = any nucleotide
  misc_feature (802)..(803): n = any nucleotide
atggccagaaagcagaaggaaggggggaagaacggtggccaacctgcagctcaccgccatcagcttcggatcgagaagccggagaggggcgcagaggtggagcttgcccgcggcagttgggtgcggcagcaattgggtgcagaggtggagaagcggtggtgccccgaccctgacggcggtgcccatgtcagcccacacctcctgatccatgccgtcgagctcccgcttccctcgctcctgcgccgccgacctccgctgcttccggggagcaaagaagtggtggtgtgccatgctggaactggccacccagctacccctccagccgacactgtctacgcttggcacttcgctttctttgtccgatgccttggcttcctctgccgccggcaagagggcggaatagtagcggtggcccggcctctccacgctggtcggcatcctcgtctcctccctctgcaatgcaatgaaaagctcgacggcgaggcnctgtgggtggggctcgacggtggggcgccgtgggtggggctcgacggcgacgcggtgacgaaggaggagaaggcgtgggtggggaaggcggcgaggggcagcggggtcggtggttgggggagaggggctcggttgcggttgagggggggagatggcggcattgatgtcgagaacaggcgagcgaggcggggcggcaagccgccgctcctcttccgctctcccgccgccgtggcgctgtcgctccacccacngcccgccacgatcgagtcacgtaggcgccgcgtcatccaaaaccaagcacaatactgcccgaggnnccttttctgcccggttttgtaa

SEQ ID NO: 1570 - DNA, 818 bp, Oryza sativa
agaaagaggtgcgtatagagagggatgaggaggatgaggatgtgcgcgtacgggagctcaccgcggcgagggtgcggcagaggaccgccggcaccgctgccgctcgcgggatggggatcgtcgcaggcggcggccggcgggcgaggagacgggaggggaaggcgaggggactagggcgcgaggaggaggaattagaggcgccacctgctgctgcgatgtttgggcggtacgcgcttcttgtaccctcggacctcgttggggcaatggcccgcctgcgaaaatccaataaaaaaaccaaaaaaatcacctcgtcgccgtccatgcgcatgcctcgccgccaccgccctcccccggcctcctccggctggatctggaggggaggggatgggagccgccgccgctgcaacgggagccaccgaccacacgcgcgcctcgccgccgctgccgcaccgggagccatcatcgacgtcgccgaccacgcgcgcgcctcgccgccgccacccttccccagcctccctccgtccggatcggggaagggaaaggaagggaagggagccacccacgtcgccgtccacgccgccgctgccctcccccggcctccctccggccggatctgggaggggaggggaggggagctactgccgccgcaccgggagccaccgatgtcgccgtccacgccaccaccgcgtccgcgcactccgccgctgcgcgctctaccgccgccgcgtccgtgccgccggtggagggagggaggggaggggaggggagaagccggtggagggagagagagagttgagaagataagtttggggaaatga

SEQ ID NO: 1571 - DNA, 810 bp, Oryza sativa
atggagaccgcctccgcctccgcctccgatccgccgcctctccgccgccgccgccagcgccagcgccgcctcgtcttcgaccgccgctacggatggatgttctgcgtgctgccgatggcgcggtcgctggtggacgtcgccgtgtcctcggacaggtcccttcaactcctttataacatggacaccagccaatctcctgttgacttcccttgctccatgaagaagttctctaaaattgaaccacattttcctgggcaattctctgccggtgctagtggtaatctgaaaaagctactctcacgcgacggcgggatcggcggccggtgcccatctcttcccatccggagccgcggcgggcgagcgggcgagcggcgacctcgctgtcgccagccacgccgcctccacggtgccgtgcacctcctcagcgcgacaccggcggaggatgcggaggagcggcccacccgccgcccgccgcaggccgagcgcagggagtccgccaagctgcgcatcaaccgcgccctcaaccagagcggctctgtcggccgcgccttcggcagccggttcggcatcgttgtgatgctcttcaccaggaccgagagcttcattcgcgaccagtgcgacgtcgccgacgactgggtcaacaccgtcgccgcgggggccagcgccggggcgctctaccgcatcgcgtccggcccaaggtcgatgatcgtcgccgacatcctcggcggagtcctgtccggcgccgccgtcgcggggaagccgatgcttcagagattcgcaccgaagctatccgccagattggactattaa

SEQ ID NO: 1572 - DNA, 795 bp, Oryza sativa
  misc_feature (2)..(2): n = any nucleotide
anggtccaccccccccccctccccctgaagctaaccgtttgcttgtgccaaaaatttctgctgcctttagggtgtcgtgtagtaactgcccttgccccctttgccaaaacaattacggcatgttcttggaatgaatatgtgatctgcagtgatatacctgtgcttattgagttttgggcctcatggtgtggaccctgcagaatggtccaccgaattgttgatgagattgcacaagaatatgctggaaggataaaatgctataagcttgacactgatgattacccacaagtcgcaacatcttacagcatcgagaggattccaactgttttactctttaaggatggagagaaaacgcatagcattactgggactcttccgaaggctgtttatatatctggtattattttagattccacaattcttacagttatatttatgcatgcagatgcagctaatcagctgaaggtttttcttctcatatggtatgtcacttctctttcaagtagctttacaaggttatatttgttagccttttttgcaccaggatttgtgcttctgaaatactaccttcgggtcagctcaggaacccatgcgatctggggggatcctagtattgcatatgagtatatcaggatgatagtggcaacccgcaagcatgtactagcactcaggcagcaagcgctgatactcagtagaagagaacaaaagatataccttgttactgaagctcgcaatttggtcagagctggtatttgggatctgctcatcagtgctcctaccgtcctgcgctgctag

SEQ ID NO: 1573 - DNA, 783 bp, Oryza sativa
atggccgggtacaccgaaattttggacaccaaccatcacgagcacaaggtgtgcttggttcgcaaggacgaacctttcatttgctctggctgcaaagagctcggcttcgagctccggtacgcttgccacactgcgggctgcaaccatcagtaccacaggtcctgtacactgcagcctctcaacactcgcgtgccagctcccttctacaagcacgacttcttcttcttcaagtcggtcagtacagctggaagctcgcaggtgcgaggttacgtgtactactgcccggacaagaaggtcagcctgcacccttgctgcgcagatctcccccgcgtgataaccaccgagacggtgcagctgaaactggagaggaagatcaccaagaaatgcggcatgtgccacgagcggaatcaggggagcttcagcaacccatgggcctacgcctccagcgagaagatgatccagctgcacgtcgcctgcgtccggaaagctctcgtttcgcagttcgagtcgaggctttacggcgtgcaaaagccgaagatgctgctgccgccgccgcctgctgctggagcaagcgctgcttcttcaactagtagttcgactgccattgtggaatgcaacagcttccccgtgctcgaggtggataagtaccggaggaaatcggccgggttcctcgatacgttcaggcggatcgtcagggcagtcatggccatggtctcggcggtgatcaccgggaaccatttggagatatacatggctttcatagaattcttcaaaccgaactga

SEQ ID NO: 1574 - DNA, 762 bp, Oryza sativa
  misc_feature (229)..(229): n = any nucleotide
atgttgcgtgttgtccctaagaagaacaagccggtggcaatttcactcaagcaactcctcgatatcaagaccatggccttggaggagctcgtcgggcagttgtccacgattgattcgtacagtgacgatgattggctagtgccagtggcaaactatacctcggagcagtgggagcaatgtcgcaagccacgacgccaacgccgaggggaagcaaatttggctcaggggnagggggagccaactctgctcatggctcatgttatggggttgtctctcactggcgaggcgacatttggccaaacacctggcgtctacgaggtgcatatgacaaagaagaaagtggtcttggatcacgacgatgtaggtgaggaggacactgcagaatggttcctagacacaggagccaccaatcacatgattggggcgtgctccgcgttcgccgacctcgatgccggcgtcgtggggacagtcaagttcggagatggctctgtggtagaaatccagggacgtggcgccgtggtgttcaagtgtaagaacggcgaccaccgctcgttggaggcggtgtattacatcccaaactgcgcaagaatattatcagtgtcgggcgccttgatgcacgcggttacgatgcacatgtctggggtggcgttttcacgctgcgtaacccggcggactcctgcttgcaaaggtaaaactgtctcccagctatctttatatattgagattggacatggcaaggcccgtttgtttggcggcgagtag

SEQ ID NO: 1575 - DNA, 747 bp, Oryza sativa
atggtgtcccagtcactaaagcatctctgtgtcaccaaatgtaacttcgagatgagcacacgtatttctgtcccaggtctcatttcactacgattgggtgataattacggctcgattcctttgcttgaaagcatgccattgctagtaacagcatctgtgaagtttgggactttgtcttggggttgtcggaaatgcagatatgatcctggtacatgtgtttgttgtgatggtgatcctgacggtgatggcagtgtcaagtataagtttttcagaggtctgtcaaatgctgcaaatttggaattagtagctgaagctgggatgcaagacttgacatggtgccccacattcagcaagttaaagactttgcttcttgatggatgggtcgttgggcataatttctgcgctcttggttgctttctccaacaaacatcaattctggagaagctcactcttcaactttataagggccatgaagatatggtggaaattgaagaaagtagcagttcaattggacaattggtccagtttcagaaccttgaaagagtcaaagtaagatgtttaaggaatgaagaatgggttcacaaagttttcaagatcttgaatgcctgtggcgtttctcctgacaaaatcactatccagcattacatttacattataaatatgaagcaagcattacggttcagcaatagttcagcagcagaggtcagcaacagttcagaagtggagagtcaagcattacagttgtag

SEQ ID NO: 1576 - DNA, 681 bp, Oryza sativa
atggctaccagccccagtgccctgcacatgcaggcggttgccttaggcgccgccgtgtttctcctctcctgccttgcgtcggctcagcagccgccggcgccgggctgcctcgacaagtgcggggacatcaacatcacctatcccttcggcgtcggcggcgcccattgcttccgcgataaaagcttccagctcgagtgcaacgtcgtcgtcaacaattcccatccacgcctcatcatgcctgcctataatcagcagctgctcagcctgtcccccgacggcgaggcgctcgccgccctcgacatccaacatgaggcctactactacaactgcaacgcgagccatcccaccgccagcgccagcagccagccgaacaacatgacgtttgcgaccctcaacaaaagcactgtctaccgcttccccgtgtccacgtaccgcttcaacgccaccaccaacagctacgtcgtgcccgtcgcgctggactgggccatccgggacgtccacaactgcagcgccgccaagctcaacgccaccaactacgcgtgccggagcgccaacagcaaatgctccgacaccaccgatggcgccgggtaccggtgcagatgttccgggggctacgagggcaacccctacctccatgccggatgccaaggtataggtcacctcccaaaatcagttatttaa

SEQ ID NO: 1577 - DNA, 645 bp, Oryza sativa
atgttccttacaagctgcgcgaggaagaagaatgcgaggaatgcgaatggccgccgtggacatatattgatcctacctgtgttttcatccaagactggttcttgggaggagaggaaatttgctctggaaggggaggctgcagggatgttaccaggccccaacttcaggtttggtttcctgaatgaacggtgtggtcagaccgagtgggtgttgaagcatgacatggacatttcccacatcctactgaatctgaactatgatgaacaacaacacgagccaatagtggaagagaaatttgagaaattcgggtgggactctgacagtgataatgttcttgaacctggaaatactcaacctggagggctcttgaggaatgcacattcttccgatgcccattatgtaccacatgctgtggctcttccagctttcatgatcagattgtcttttcacttgggcattgatttgtacagctcagatgtagtttgctctgttcttgctagttcacgtatccatgtagctgaatctcagcgcttagttcatctgagtgacgattttggtgccgcggttaatcagaaatttagcatggctgctgttgaaacatttcggccgaatgtgcgagcagggaataagctggcaagtgcttag

SEQ ID NO: 1578 - DNA, 635 bp, Oryza sativa
atggcaagtgtcaactgtggcgagaggccgagagcgcggaggaggaggaggcgtggggcgaggtgcgttggcggcggcggcggtggtggcgaggtggacggaggggacccgaagaagcggcggctgagcgacgagcaggtggagatgctggagctgagcttccgggaggagcggaagctggagaccgggcggaaggtgcaccttgcctccgagctcgggctcgaccccaagcaggtggccgtctggttccagaaccgccgcgcccgccacaagagcaagctgctcgaggaggagttctccaagctcaagcacgcccacgacgccgccatcctccacaaatgccacctcgagaacgaggtgctgaggctgaaggagaggctggtggtcgccgaggaggaagtgaggcggctcagatcagcggcggggagccacacggcctccggagaaggcggagacatcatgggcttaggcggcagcggcgcctgcgtcgccgggagcccgagctcgtcgttctcgacgggtacctgccagccgccgagcttcggcggcggagatcacctcggagacgatgacctggtgtatgtcccggagtacggcggctacgctgataacagtgtggttgagtggttcagcct

SEQ ID NO: 1579 - DNA, 633 bp, Oryza sativa
  misc_feature (127)..(127): n = any nucleotide
atgtggttggaggtagaggagatgatggaacgtgaagtggacgctgctgtggctgtgcggcctgtggtttttgcagaatttgatgggcgccgctggggtggctgcagttatagaaatggaggggggnaggggcagcagaagaggtcaggaattgcgggaatgccactggccgctaataattgggcggaattccagccagggccagggccggaggccagcagagcttctgcaggatggcacagctggcaatgcgctgccagttcagttgccggtcgggtctggcctcgcgcccgcctcggtgtcccaagattgatgcgtgatacgtgctgcccatccccacgcgctgacaggtgggccccacaaacgagcgcggtccccacctcacggccaccgatgccgtgcggcgctggagcgtggcgagggggaggaggcaacggtcgtgttggtggactggcgggggaagggtgggtggggcccggcgctgggacggaggagaccgccgaccacgtggcctcgctggctacgctgccgcttgccaccgtggctgccgttgctcctctcccccgaaatctcgtttcaatccgcggctccgtttccggcgccgccttggtcagattcagagtgaccgggtga

SEQ ID NO: 1580 - DNA, 621 bp, Oryza sativa
  misc_feature (208)..(208): n = any nucleotide
atgattgccacgaagcagcagccgccggcgctgccgccgccgccgccgccgaagctgatcctgcagccgaggcagcggacgtcgccggcgatgtggtgcgcggcgatcgtgtgcttcgccttcagcctcctcctgatcgccgccggcgcggtgatcctcgtcgtgttcctggcggtgaggccccgggcgccgtcgttcgacgccgcgngcgccaccctgaacgccgtctacgtcggctcgacctcgccggcgccgtacgtgaacggcgacatgacgaagatggacgtggtgttccggtcggccgccgtggagctcttcttcggcggccggcggatggcggcgcaagcgctgccggcgccgttcgtgcagcggcgggggcagtcgcagatcatcagcgtgcacatggtgtccagccaggtggcgctgccgccggagctcgccgtggcgatggtgaaccaggtgaggagcaacagggtggtgtacaccatcaggggcacgttcaaggtccaggccaagctctggttctggcactacacctactcgatgtcggcgctctgtgacctggagctcactgctcctccctgtggtgttcttgttgctaggagatgcatcacaaggtga

SEQ ID NO: 1581 - DNA, 612 bp, Oryza sativa
atggccagctacgttgatcagcccccactggccattcaaagctcgttccttgtaaattattctctgcataagttcttggtgaaactaatgcaagtggtcatgagctcaaaggaggacagcccggtgacaccaccactggggaaggaacggttacctcgttcgttccatagaccattgtcaggtggtggtgcagtgggttcatcttcatcagattctcttgagcatcattcaaaccactactgtaatggtggccaccaccaccatggacaccagtgctatgattcagtggggctggtctcaacaccgaagctgtcaagtataagtggagccaagacagaaacctcgtcaatggacgcatcaatgaggacgagctcatctcctgaagaggtcgacagatctggtgagctctcggtgtccatcagcaatgcaagtgaccaagagcgggagtgggtcgaggaagacgagcctggtgtatatattaccatccgggctttgcctggtggtatcagagaactccggcgtgttcgattcagccgagagaggttcagcgagatgcatgccaggctatggtgggaagaaaaccgagcgaggatacatgaacagtatctctga

SEQ ID NO: 1582 - DNA, 603 bp, Oryza sativa
  misc_feature (244)..(244): n = any nucleotide
  misc_feature (284)..(284): n = any nucleotide
atgggagagagggacaaggtagaagaggaaaagcctgcgaacagagaggatgggatcatgggacaaagggagaggatagaagaggaagaagttgatgccaatgatatgtcgggccgggccgacccaaggccaaaaagccgtgccgtgggccgggccttcgggcctcgggccttatggccatctataggagcctgcatgatccgtgaaccaacctctctcccatcacccacatacatatcgctcntacccgccggaggagagcgtgcggagttcccatcgccgcntcggcccccacggagtttgcctgccgagaccgtccaagatggcggcccttggtatcccgtcgaggacagcggcgggaagagcttgccatggagacgccgcttgaggagcccccgtgctcggtctcctcccacccttccgctcgtcttcatcgtaggggctaccatggccaagaaggccatggcgcaaccatccccatcgatctgctctgctctgccccttctatcaagttgggctcctagtgacaaaacaaaacgggaggaggaagatagcaactcaactcatgaactgatggtgttaccagaggcaaggcaagcgtaa

SEQ ID NO: 1583 - DNA, 582 bp, Oryza sativa
atggcgttcgtccctccgtcaagccgatcgcgtttcgtcaagtgtgctgcagcctcttcgtcgtcttcgtcctcggctccgtgtcgtcaagccttgtgcaggcctcgtctcgccttcgtccaaggatcaccaccgaagtcattccatcaccgttcgcctccgttgtccccgagccgtctccgccgcgcccgttcgtcatcgtcgttccgcgcctcgtcttgtggtggtaaggatccctcttctcgctaccccgttctcgtccttttggtgtcgccccgtgcccgtcgtgcggttgtcgacccaggtacccgtgtaccgcccgcatggtgtctagtggagtccgtttgtcggccactcaccttggttgacaaacagggtccgcttccgtcgacccgtggaccgtctctgtgtactcggtctaccgtgggcctttgggttgacatgtggggtctgcatgtcgacaagcgcagccttcctgcttgtagctttgcttgtgtgcttcgcgtagcttatgtcattccggaggttcccgaagcgtggttcgctgtcgtcgccgatggttcggaaggccgttctctctga

SEQ ID NO: 1584 - DNA, 576 bp, Oryza sativa
atggaggagcaaagaggcgaggaggagtgggtgatgtggggatcggcagggagaagacgaatcatcaggcaatcggcgtcgtgggaggagcaggcgttcgcgcgcgatgcggcggccaacgccaacctcggcggctgcgtgtggccgccgcgcttctacacgtgcagcttctgccagcgcgagttccggtcggcgcaggcgctcggcggccacatgaacgtgcaccgccgcgaccgggctcgtctccgacagaggcagacctcctcctcctcctcccccagccaccaagaagaagaagctgaagcaccccaagatcagcaagctggcccttactatacctctttctctaaacctagcaccacctccaccgataatactacttgcagtaacgacatactactgctagcaagagatcaagaaaccatcaagaagagggtaccgagacagcaagtacaagtagttgcagatcaggacgaggacgaaccggccgggagaaggtacaagaggaggaggcttggtttggtggatcagctgccgtcgtcatgtgaaggaggagatcatcatcatcaggaatag

SEQ ID NO: 1585 - DNA, 567 bp, Oryza sativa
atgcaggagtccaccactaccgttgcacagggaaggttcttggtgcaaggagaggtcaacgccaaaacgatgcctaatggcgccgtcgtcgtcatgccggcccatggcgtggcaaggctttcgccagcgattccaatcctagctccacacaaccatcctgcacaacgaccagtaccggaccatcgcaccatccctttagcacccaagcccagttcacgaccatcgccgaacaccaccacggctacacaccccccgcagttctgctaccgtctcgttgtcgagagccggccttccttgccggagaggccaaatccagtgggagggatggagggagggggcgcaggatccggcaagaggagccagattcggcggcccccggcttggcgccccatcaatcgccggagaagggagctccaccgccttgccgagctagagctccacctctcgccggcgcacgaggagatgacctcccaagagggtgccagatccgccagtagccgccgcgacgaccccgccaacgtgctctccctgccgccttttctcctccagttccgccgccaccgctag

SEQ ID NO: 1586 - DNA, 552 bp, Oryza sativa
atggggcacatcgtgctcacgccgcattccgtcagcgcgctcggcgggttccggccacaggggaagacggtcgagagcgccgtcaaggtcgtggaggcggcgctcgcgttgcaggaggccggctgcttcgccgtcgtgctggagtgcgtgccggctccggtggcggcggcggcgacttcggcactgacaatcccgaccattggcatcggcgccgggccattctgcagcgggcaggtcttagtctaccacgacttgttagggacgttccaaacaagtcatgccaaggtctcgccaaaattctgtaaacagtatggtaacattggggacgtgattaacagagctctatcaaagtacaagcaagaggtggaaacccagtcttttccgggtcctagtcacacgccctacaaactagctgccacagatgttgatgcctttctgaatgcgctgaagatgaagggcctgaatgtggctgctgatgctgcagccgatgctgttgaatatacagatgagaaagagataaatggaacgccgcagctcaaggtctatgcttga

SEQ ID NO: 1587 - DNA, 534 bp, Oryza sativa
atggcgagttattgcagtgaccggtcgtcggggtcgtcgcatcccagcagtcgtgctcccatcccggcgcgagttgggccctatgattatcagccggcggtgatgtgccgatgtggtgcgaaggcggcacggtggatttccgggagcgtggacaaccctggtcgatggtactaccgatgccgcaatcggggcgccggctgcgatttttttgactggtatgagcctgcaacaagtagttttttgagggagctgttgaacgatcttcatgaagccgtgttatcgctaagaagggagaagaatgagctgcaacattgtgttgaagaactgaggccaaaggtagaagagcagtgcctagaattaggggtagcaatgaatgaagtggcacaattgaggattgtggcagctgagaatgaagctaacatggctgctatgagagcaagtaacagtaggctagagaaacagagagtttggcttgtactgatgtcgttgggatgcatgcttgtgttgtttgctatgattttagttcagctgtga

SEQ ID NO: 1588 - DNA, 507 bp, Oryza sativa
atggacgcacctcgccggcggagcaacggcgcgtgggagatcaacctggtgcggcggagcccggccacggcgcggaccgaccgctgctcgaggctgctgctgctgtggagcgggttcgtcggcgtcgtcgtcgtgctctacctgttcgtcggccacgtctgggcgtccgtcgccacggcggtgctcctcgccgccgcgggctggttcacctgccggcggcgcccgttggaggcccgcgggctcagccaggaggacatcgaggccatcccggcgttcgagtacaggaggggatcatcgggcagcggggttgcgcagtgcgcggtgtgcatcgccgccgtgaaggacggggacacggtgcggcggctgccggcgtgcggccacgcgttccacgcgccgtgcgtggacgggtggctgcgcgaccacgcgacgtgccccatgtgccgcgccgacgtcgtcaaggtcgccggagagacgacgccggcgacggaggaggagccgcccgtgtag

SEQ ID NO: 1589 - DNA, 504 bp, Oryza sativa
atggcgggcagggcgccctgcgcgtgtgcctacagctgccagggaacatggcctgcgccgcctcgtctaatcaccattaatgaggggctttttgcctctcgtctgaacccagaccaaatctctttatacggtccgttcgagaaatcaccgccaagcggtgggaacggatgggcgaaagtcgaggtccatgccccagtgaaaaaggggatgaatcccaaaaagccgaaagcacttgtattcttccaccgagatcaatcacacacaggagtagggtgttacgctcccatagcggcccgaacctatctaaactctttccatctccaaccgcttgtgaggggcccgaccccctctcattccctcaccgattctcaatccttcaccgcgtccccggtccgaaccgaaggggggtctcatggtgttaacgaccaaatttggcatcggctggagtatgcatcggctgagttggaatcggtcagaggatggacaatgcagccgatagagccg

SEQ ID NO: 1590 - DNA, 500 bp, Oryza sativa
gcaaggaggaggaggaggaggacggcggcggcggtgcaccggcggcggcggccaacaactacgggagctcgacgacgagcagtactacggaggaggagggatccggggagagcaggcggcgcacgtcgtcgtcgtcgtcggtgcgcccctacgtccgctccaagaaccctcgcctccgttggacgccggagctccacctctccttcgtccgcgccgtcgacaggctcggtggccaagatcgcgcaactcctaagctcgttcttcagctgatgaatgttagagggcttagcataggccatgtcaagagccatctccagatgtataggagcaagaagatcgatgagtccggccagggtttggcaattcatggtccccatggagatgtcatggatcatactggctccctgcaggccatcacctgcttgttggatcaaaaccctattacccaccagcagctgaagctgaagctcctttccgcagatcaagtgctaggtatgtag

SEQ ID NO: 1591 - DNA, 483 bp, Oryza sativa
atggaggcgacggcggagagcgtgtggcggctgtgcgcagggaaggttgggaagagcgccgggaggagggtgaggaggatgcaggacgggcgaagggtttttgggtctttgatcctcggttcttggtctgtctccgtctccgactgcaagggctcctcctcatccaccgtcaacatggccaaggttttcaggtttctgaagcttgtcggagttggcttcaaagcaaggacagagcgtgaaggccgtgagttgtttctgaaacttggttacagccatgaggtgcagttcactgctccacctgctgttcgtgtcttctgcttcaaacccaacttaatttgctgtactggtatcgacaagaatcgggtgcacaactttgcgggcgctgttcggaactgtaagcctccagaggtatacaaagggaaaggcatattgtacattgatgaagttatcaagctgaagccagggaagaagcaaaagaagtaa

SEQ ID NO: 1592 - DNA, 423 bp, Oryza sativa
atggaagccggcggcaggcgtgaccccgttcttctctccgccatccacgcggaccacgccacctccgtcgggcccatcttcatcgtcgactcctcctcgtcgagtcagaggtggctggagagaggaggggcggcggcggtggcagccggttttggggggtggaagggacgccagtggtgggagccggatttgggggagagagcggcggcgggagcagcggcggtggccggagctagggagggaggggcgctggggcggcagtggtcgtcgtcggcgttggcccacaagtccataaaggcccaataccaatctccacacgctccaattccctcgtccgcgccgtcgctgccacggctccctgcagtccaccgcccgtcgccggtgacgagggggcccgcggcgctgcctaccaaccgcggctag

SEQ ID NO: 1593 - DNA, 423 bp, Oryza sativa
  misc_feature (330)..(330): n = any nucleotide
  misc_feature (344)..(344): n = any nucleotide
atggccttcacgcggcagctggaccaagacggtggacaacagcgccggcgacggaagcctcaaccgggggagaggaggtgccgcggtggccggagccggggtggtaggcgcggcggcgggtgtggtggtggtaggcgcggggtggtgggtgccgcagcgggggccggtgtggcgggggtggtcagctggcagcaggcgtcctccttctccatggacaccggcaagcagcacttgctcatcgtcggcagcaatgcgacggcctcgatgcgctcatgctcgaggtcgaacgacatgatctacttgccctcggtcacccagtacgtggcgccnttgacgctgaaaangccccaggcgacgcacaggctccacggcgacgcccccaccccgcgccgccggcggcggtggtgtcgtctcccagcgtga

SEQ ID NO: 1594 - DNA, 404 bp, Oryza sativa
gcagcaaggtcgaagtcaccagtaatgatgatggttttcatggagcttggttccaggggactgctctaaaatatgttaacaacaagattttagtggaatatgacgcattgaaggctgatgatgaaatcactcctttgacagaagccatagaagtgcagcacgtcagaccctgtcctccagatatccctgtaaccagtggattcaatttacttgatgaagttgatgcttgttggaatgatggatggtgggttggtgtgatatccaaggttaacagtggtgacaggtacatggtatacttcaggtcttctacagaagagactgagttcgggcatgaacagttaaggcttcactgcgattgggtgggtggaaggtggatgcgggcttcgctgggattggaggcataa

SEQ ID NO: 1595 - DNA, 357 bp, Oryza sativa
atgtctgctcctcgctggcgtgcgctgcgacagcggccagatgctgagcgacgggagcagcacctccgcggccttggcgactggtgccgcgggagcggcgggccgacggcggagcctccctccgcggccgacgcatgctggcttccctcggcggcggcggcggctctgggggcgtcctccgccatggctgcggaccgagagggagaaaagaagctccgccgccccttcctcttccgcccacagccgccgggccgtgcctccgctgtcgcgccgctccctcctctcccgccggccgccatgcgccactgcctctccgttgcgcctggagagaggatcccaatccgagagagagattaa

SEQ ID NO: 1596 - DNA, 355 bp, Oryza sativa
atggtttgcacggtctcggccgaagctccaatctcaccccttgcccgtgaggggcttgttggcggatggcatgaggcccttcgaccaaatctgccgaaacccgtggcgaaggctatggagcaagaacggcatgaggcgaagagtcgcacgagtgccttgccaggccaggggcgtctcgggcgaagggtgcaaggcgaagactatctgccgaaggaagacaacttcgctatggcaagttcgcccccgcaagggccgaggaagcttttccgacccatcaagcctaagggctatagggccggcgatcgccagacagcccatcagggacccatgagctcctataacattatgtacccct

SEQ ID NO: 1597 - DNA, 351 bp, Oryza sativa
atggcgagacccgccatcgtggcggcgcccgcgctgctgctgctggcgctgctcatcgcgctggccaccgggggagccgacgcggcgccgggcgaggtgccgctgagctgggagctcggggttgtcggcgccgacgacgcgttcggcttcccgggtgaggaggcggcggacagcgccaccgcggtggtgcggcgggtgctgcagcaggggagctacatcagctacggcgcgctgcggcgcgacacgacgccgtgctccgtgcgcggcgcgtcctactacaactgccagcccggcgcggaggccaacccctactcccgcggctgctccgccatcacccagtgcaggggatga

SEQ ID NO: 1598 - DNA, 2000 bp, Oryza sativa
ggcaggcgtgcgcgcctcctcctccccggttactcccacgacgccgactacctcaccgcccttcccaatccctatctcatcgccgatgccgtccgccgggccccgccaccttcctccgccctgcagcctcgccaccctcactctgcccgacgcggtggagctggtctgcgtgctgaagcaggtggaggagaggcggctgcccgacacggtggagctggtctccctgagctcccatctgaacctgacaccgaaatggcatcaaagctgttggaattgtgaaggtgatcgacaggccgtcaggcccacgcatgtttcttctcgctgtaaacctcatcccaggaggtttgtttgtcaccaatctatcctgtaaaagagatcaccacaaaaacagaggaaagtcagatcctacatccattgttcagttccataatctcacccttatcaagcaaaaatgaaacaatatgattcaggttcagcaagagaaattctgatcccaaacagttcagcacaaaaaattcttatctcaaacaaaaaatatcacacagcaacacaaaaaaattgatacagtacgattcaagttcagcaagagaaattctgatctcgaacagttcagcatggcaattgctgatctaaaaaaaaacatgatacagcaacaaaaacttcccaaatgatcaatcacaaaaatgtaagctccctttcccctatatttctttagcaatcttctttgcatgccaaaagccttctttcttatccatcaccaaaacgaaacaaagcaatgcaatgatgatgcactgaaaagaaaaagctctcaacaacccggagcaggtgctgcgcaggatggagcaggagaggcggctcgtgcggatgggcaccgccgggagcgtgtccatccgcgtcctcaccagcggcggtggcggcgaggccgtctccttcctcttcaacggtgcctcgatggcctcctcgggagccgccgtcgccggccgcaccaccctccgggcgtgcgcgccgccgtgggggaagccgacgaatgcggcggcggaaggaggatgaggacgggagctattgtcactccttgctacgatgaggacggcctcgagtccgccgagagcggcggcaaggctcgagagtccacctctgcgcccggcccgccgccgcctcgtcgccataccaccctgccgctcgtcgccggctgcccagctcctctcccgcctcccgcgcgctgctcctcccctgtcgcccgccgccgcattcccaccttccgtcgtcatcttcaccaccggcggtgaagcaccatcagacgccgccacatctccggcgcccgtcgcctcctccatccctcccaactcgcttgagcggacacgagcagccgcaggagctcctccagctccggccaccggcgtggtgctcgtgctccgccgcggcactctcgccggaaaaagaacgaagagaagagagagagaggaggaaccgaggaagaggagagggaggggagagatgacatggcatatatgtgggggtcccacgctgactcaactgtcacataggacaaaaccaagatcaaaaccatagaggatctattgtgaacgggttttgattagttaagagaccccaaatattttttcagttgaggtacgattttgtaactcgatgacaagttgagggacctttggtgtactttttcctagccaaaaggcctcggcccatgtattaaggtgacggcccacttgtgccgtcctcgaagacggccgacagaccaacattcatttacagcccaaaaattacgaaaacctagctgcatcgcatcttcttctcctttccccaggcggagcaccgtccgatgagcatccaacggctacggtcagcaccctcggaaccttcgagaacaccctccccgctataaattcccgcctttccggtagcatctagtcttcctctcccactcttcctcctccccaaaccctagccgccgccgccggcgtactcgagagaaacatcagcat

SEQ ID NO: 1599 - DNA, 2000 bp, Oryza sativa
  misc_feature (920)..(920): n = any nucleotide
cgcggcgagttcggcgtcggcgatgctctcccagacggaccatagccaatgaccacgcgaaatctgcacgcacagacccatccttgagtggaacacgagtgggagcagatggtgatggtggtcgtcgcagtggcagtccccatagagaaaggcctcgcgacacgtggtgcagaataggtccagcagctgctcaggctgagctgagcagccaacttccaagagagacagaacccacgggtgcgccgccgcagcagcagcgtggtcagcatgcgcccagcaagatatcgtacagagcgtggccagcctgctgtagagaccatcgagcgaggcaatgtcggagcagaccctgcagcgggtgcccggtgatggctgaagcaagtacggccggccaagaaacggagacgggagccggtcactctgcacccatcaccattggcattgcaaacaacacatgagcaaaattttcaattcctccacaagcacaagcacaactgcacaagaagaagcaacaagtcaagcatttcaattacctcgattcctaggaagatgggcgccatcctctcggcccctgtcaaccatgcgcaccagtcacctcggaacatgccgaggacgagcacctcgtgatcgtggacgccgccacggccgaacgcgtcgcaggacgggcagtagtagagcatgcccactcctgcggtcgcgtcggcgacggcgctcatgtcgtcgacgcagaccaccgatgatagcatcctcctcctcaggcatactgagcagacgcctccctcaccctcatcggccacctgccgccgacgacagacgacgcacctcgccacgagcgcctcctcctgaacgccatccgcgccatcaccatccgggcccacctcgccaccgccgccatgaccgcgcgccgccgccgcgccggcttngcccgcttcgccgtggtcgcctgcagcgccgccgtcatgcgtgccctccgtgccatccaatccggtctccttggccgcggatgaggaacgtctgcaaaaaaccatttccaatcaagaaccattcttttggtcaagaaatctggcaagaatcgatttcttaatgaaaccatggaattcagttctcttcttacctcggggagctgtcggccaacaagaaatccgccacctcgccaccgccaccggtcgccgcgtcgccggcgccgctgctcttgccgagctgggccacgggtacccccatcctgaaagaacgcaggagagatcgaaacaggcgcgcgtcgggaggcgaactcgaggcgccggtgcggaggaggaagaagaggagagccaagaaaggggagacgaagggcgcgcgtcgggaggcgagttcgtctgagacgaagacgaagcggagacaaggaagatgggcgcttgtcagtcagtatacatggccatatgggccgcccggccgtgcctgggccgaggcttgtcgggtctgcacggcccgacggacgcaccgggccgtgccgtgccagcccacgtgccgcactcacggcccaggcacggcccaacacgcctcgggccgtgctgggccggccccaaggcactacggcccatcgcgctttacctcagcataagtctaatttttctccctcctattgggctgtgacatatatagctaaaaaaagtctattttacctccctcttctttgggctgtgatatataaggaaaaagtacaccgaaggtccctcaacttgtcatcgagatacaaaatcgtcccctaattacaaaaccagatacgtggcatcctcaacttacaaaccattcactcagtggttttaaccccggttttgtccgacgtggacgctgagtcagcgggacccacatgggccccacatgtcagacagaccacgccggccaagtcccggccgcgccgctcgccctcaccggcgccggtccatgaggctgagggtgcacccagcgtcgcggaagcgcaccatcgcctgcagcggtggtgcggggtctccgcagtggcggcgggg

SEQ ID NO: 1600 - DNA, 2000 bp, Oryza sativa
  misc_feature (688)..(688): n = any nucleotide
  misc_feature (702)..(702): n = any nucleotide
aaaggcgcgtagggcagggagagtgcggccgtgacctatgggctgcttatcttccatcggtgactttagattttatggactctactttagggcacacaccagtgtaaaacttgtgttcaatttcgatcttaggcttacctggcatgtgaggttcggcaaatgagattctcgcactgctatcgccctaaggataagtaaaccaggagacggttaccgaagtatcaaatatatcaaataactctcttttggcaaggtcgcatatagatttattttcagaaaataggacttacattttgaaatctacaactagcacccggtaggtaataatgaaggtttagtttgtaaagtatactccctccgtccccgtaaaaactaacatacagtagaatatgatattttctattactataataaatctggatatatctatgttcagattcatcgtaaacgttacttctcgttataaattgatttttttttatgggagcgaggaggagataaaaaaaggtactacctccatcccaaaatataataatttttgggtagatgaaacatatcatagcttgttcagtactatatatcccatccaatcaaaattgttatgttttgagagagagtgaggccatgtttagattccaaattttttcttcaaacttttaacttttccgtcacatcgaatttttctacncaaaaactttcaanttttccgtcacatcattccaatctcttcaattttcaattttagcatggaactaaacacagcagtagtaggagttttaaaaccggaaaagaaaaaaaaatccgaggcgtctttctccgtttctcgaagccgcctcctcctccggcgccgctagcttctgggaaattgcgtggtggagacgagcacgctacggaccccccttcgacccaacggaacgaaccgtcaagccgcgggattccttccccaaccttccaaggctccagctataaataccgccccctccttcctcctctcctccccacgcacaccccgctgcttccgatcaaatcgatccccaaattccccgatccccgcagccgctcctgcgactcgtaggtctcgtcaagtcggcggcgacgactttgatctctattcaaggtatgtatatacggtgccgccgcctcctcctgttctggttttgatctgtatataggcgattgattggtttggtggttgggaaggtgaaatcgatctcgggctagatctgatcgattgtgtagctggatggttgatcggatcgtttgttttggtcctggatgctcgatcggatagttccgtggtaatttttgtgtagatctgtttgttaaatcatgatttatttggcttgcccggttgtcccgtgcaaatcgtgcgctaattttacctgtgagtataagttgtggctctgtgtgtatttgttcctgatgctcgtgtggtcttgataaaagcttgggcatatctgctgatccatgatgtactcttaatttttgccctagcaaacttgatgctgttcgtgtattcattgaattcctgatgctcgtgtcctgtggcctccgtaacctttcacttgtctgctgatccattatgtactgacttaagccctacagccctagcatacttgatacttttataggtgcgcattgtttgagttcacaagattcaatttagtcaagttgcagtaacatgattggaattagaattcttcatgatcctgtgaagcacccaatctagctttgtcagatttgcatgtggcacttccctgagttagatcaaagatatgctctgctgtatatcttttttatgctttgtaatctaatatagagaagtacagaacaaccattgctacgtttgacattaactacaaccttctgttatctgttaattttttgtagtttggtgcttagaagaatctttttttttgttaacatttgtttgcttgatcctggttcccttataatcttgtatatactggagacttaccatggttgatatacattcttgc

SEQ ID NO: 1601 - DNA, 2000 bp, Oryza sativa
aaggcatgtcatgcccgaaaattcactagtaatttccaaacttatttatgcattaaattctcgtctaggaatcagccgagatacacaaactgacaatttaatatacagattcatcataataataacgtaaatacttacaaaagaaaagaaaaatagcagcggaattatggtctagcgaagctccggctccactcccacagacagctcaactggggtataagccaaacgtcttctccttcgcaacttgacttcaactgaggtttgattgattattgcaaggtgagtacatggaatactccgcaagccacacagcaaatatgcaagtgaacaaggataccaaaggatggcataatataggactcatttgcaaaagcagcatttagcaaacatttgataattgtaaaacagtagagtaattaatcatcaatattaatcaacactgaacagcacacccatgctgcacaggcccaaccatcctgaacaaccatacccggctgtacagatctatctccaaaccaggaatgtaccattccaaactaggagctaaattaattaacatcaattaccacattattattaataagtagtgtgagactaatcacgaaagacattgttcgacccgcccataaccatgggcacggctattcgaatagttttactctggccagaggtgtaccactgtacccacaagacacaactccacaatatgtcaccatatcatcatgtgcccatgctgaacatatcaccatttgtgtagttgtgacaagacccctcgcataggtcaactcaaagcagtgcaccgttcctggatcgtagtcaccccctcaaaaaccagaggcatggactccccagcaacccccgtgggcttatctccgccacttctcagtctggcactccgcaatgagccttgctatacaaagtgtccagccgttgcccattctggcttgtggttggcacggttaatgtttcacaaccgaaactcgtgaaccggtccttaattgtcatgagcacgaccatcaaaaacatgtgctcacaacccacaattatcaaattttagttggcaaattaattaattaaccaatcacaattaaccaccgtgagctatcattaaatatccatcattaagtaatagtgaaacattagttatcccaattgtgtgctaatatttctaagcatggctaagcaattatgtctaacatctagttgaaccaatatataaagctcaactagtcaaattataataacccaaggtaatcaagaaatagggtaatcaatgcaaactggccttaacaaaggaataggttcaaaccacccgatgacattcaaaaataaatgcacagttaaaataaatagagaatttaaatataggatcaacatgctcaaaggaattgtgtttgggatctgtgtgacttgccttgcaataacgggtcttcaattaatcttcttgatcacatcgactcactcacgaacctttgaaacgacggaaacgacaagctaacacgcaaaacaaagaaaaagactaagaaactccaaataaacaatacatataaagtaaacaaacatgtagatcataattttagatgaattatgagacttgaacggcctcattctgacttcatatgaattaattacgaattttacaagatttaatctaattaaagcccatttaaaaagaattaagtaaatttaattcaatttatggataattttaatatatagatctttattttatacaacttttgcaacttgaaccacattaaaccgagttacaatgaattagttatgaatttttaaagattaaactggattaaagcatttatatggatttttattgaattatgacgcaataaagaattatttttgaaaggaaaaagggatttattgcgtcatcaaagacggtccacggtagaccgggtgcacagaggcggtctacgaaaccaacggccaaaatctaatctaaacaaaacggacggccgagatcgatctaaaccaccaggggt

SEQ ID NO: 1602 - DNA, 2000 bp, Oryza sativa
gacccgatccattgccatccctaccctcttcctcctatctcgccggtgcggtgacggggaggggaccttgccggttcccctcggccactcccttccccttcctcacggcaacgggacactgtcgattcccctcgcccgctccctccccattactccacggcaacggggaggggatccaccggcagcgccgcttcccctcggccactccctcacccatcctccaccagctccaccggcggcgctctccctctcggcacagagtcggcggccctccgccccttctcgccttcttcccgcgccagatcaggcgggtggaggagtcggtggcggtggcttcctccgccccctctcgccttccttccgccacagatcgggcggcggtggcggccgcggctggattcggtggcggagaacggattcggcggcagtggcggcggctccttccaccctcgcctccctccctcggcagaaacgacagcggtggcgagcggcggcggcgtagctcggcaagccacgactggcggccactccatgccccctcctcgtcagatctggccatgggagacggtggcggctgcggcaaactccgctcgatttttggtcaatttgttttttttaatctccgtttgctgttcttctattcttgtatttgggatcaaacttgattaaaactttgtgtgttatttgctgcggactctggatgatttgttgtgtgttcggacttatgatgttgtggacaaaaataggtgaagacggacgaaacacctcacggaatccttgtgttatttgatgcggaccctggatgatttttttatgaacattatggactgtttttaatcggacagattcggttttttttcgccctttctttttaccatgtcgcatataatcggattccatttttttgcccgattcttttgtcgcctattttttcacggacggatgacggaaacactcgtaattttgtaagtggtagagattttttccttttttacataagacggaaactcttttttcgcactcctttttaatcgaccagaattttttttgcactttttttggatcttggttttttttggcacagacgacggatttttttaatcggacagaaataatttttcgcgttattttttccttttttacggaagacagaaaccctttttttgcctttttttaatcggacagaaatttttcgcactttcttttgtcgcttgttttttcgtacaaaaatcttttttttggcactcttttttgaagtcggaaaccgtttttcgcacctttttttttctgggaatcggacagaaaatatttttcgcacttttttttggaaatttttcttaactttttaagtagcagagatagagatatatgcacgtgttctcctggtgatgctaaccgaataggacccggattttctagatcggacagttttggtttttcttttctttttccgcacttctttttcgcccggttttttatcggacaaacctgatttttttcgttcggtttttttgatgaacgatggaagcacctcttttttaagtagtagaggtagagattcatgatcctttaacactgaatgatggcgaaagcggacaagtccaaacgattccgtgccgcccccgctgacctcccttcggccgccacaaacgcatctgagccgtccgcctccgaatatccgtccccaatatcccgatcggacggcaggcaatcaaccacgtactcctcccggcttctcccccactcaaaagcccaaaccggcacaaatcggagatctgggccgtccatcggtaatattcccacggcatcagccagatcggacggccagaatcgcggcccagatatttcggcccgcttataaataccggctggtcgcctccacctcaaaccctctctctccgtccgtccgcgccgctactcccccctcgccgagagagctctagggtttccgctgccgaattttttttttaattcggggggagagatttgaagaggcggca

SEQ ID NO: 1603 - DNA, 1365 bp, Oryza sativa
  misc_feature (99)..(99): n = any nucleotide
  misc_feature (112)..(113): n = any nucleotide
  misc_feature (118)..(118): n = any nucleotide
  misc_feature (272)..(272): n = any nucleotide
  misc_feature (305)..(305): n = any nucleotide
  misc_feature (972)..(972): n = any nucleotide
  misc_feature (1173)..(1173): n = any nucleotide
  misc_feature (1175)..(1175): n = any nucleotide
agttctttggaaaagaatctgcaataatgtcactactctagtcatgagttatagaatatatatggatggatatgaatatatattcttctacaaattttngatatgaatttcnnggaanccttgcgtgcaatgatagatggtgatacaaaattccactttgtttaatctaaaaggaggttccactttattttctataaaagcccctaacaaagaaaacaacaatgattatcttgactgaaatgatatggattaccatgtttaaagtggatccnttttctatacaaagtattattgatatctaaacnagaacatatatacttaaaaactcaaaagctaggctatccacaaatatttttatgagtagagtctatccacatatttttttcgctaaaaggaaatggaaaatgccataacagattttaagaaaactagcaataaaatgtgaatttttcccattaaatagtaaatacaacataaattccatcgctagccaaaacgatacaataagatttgctcatttacttggaaaaaatcctctccaccaaagtgaaaggtgaataaaacctttcaagtatgtggttgtggttagcattgctaaagaaagaaacacatagtcatcaaaattgatcccccatccacataaaaagtgcacaagaaagggatgctcatgagctaaagtgaaaatacacacgagtgcgtgctttacaaagaatatgaacattgcgtgcaagaaacgttacaaatgaaatggtgagacaaaatgtgctccgtgcatacgtggtggtgactcacattcgtatgaatacggacaaacaaattcatgcttcgtgtatatatactagttgcaaacgtatcggcatgtaagtaaattaagtgtacgtgcttagcctaacttagtaagttaaccacactaaaaaaaaatgtatacgctataagcgtgcgtgacacattgctacgcacgcaaaaccaaangaaaaggaaaaaaaacactactccacgtcatgtagcaaaagggcggaattctttccattatctttagaaaaggaaaatatcatgtacagtatactactagtggtgtagatacttggcgtgagcgtagcaaaaacacaaagacaacttgaccccccgtatattccaaaggcacccacctcatatccttatcctgcgcccctnancccccaccgtcggatgcgatctggacggccacggattcccctgagccggctataaatcccacctgaggtgcagccttcttccccgtggtctctcagaggtgggttggcttctcctccccctcccggttcggttcggttcgggtccggttcgatttcgtttttttttcttcttcgtggggttggtgggaaa

SEQ ID NO: 1604 - DNA, 2000 bp, Oryza sativa
  misc_feature (12)..(12): n = any nucleotide
tcatcgcccctncccctatccttttccccatttcaccgagctcacccatggcctctaccgccctagcgccgtgcacccgccgccgctgccgccttagccatcttcggccgccgctagccatcgctagctactgcaccgagccacgccgtcaacgccgtcgcgttcgcgagcccgagggccacgccgtccgcttctgtcacgcccagaaattcccgaatagaattccaagcagaatgtgcattaaaatccccgtccaggaccggccggggtacacaaacgacaatgttgacattcagacccacatcttacaaacatcataaaagtcttacataaatgcagcggaaaagcgaaagacaacaggagctaagccttgactagaactgcagcgggaacaccactccacaggcatcctcgatggcacggacgaagcctactccttggagaaacctccatctgacacacactcgtactctggggttgggaaaaaaagagcaagactgagtactacccactgtactcagcaagtcataccggaataggggtatgatgcagggaattatcaaaggagagctagagtggttcatttgcataaagcgagcatttataaacagaagttggaagatttaaacagttgtaataattaatcaatattaatcatccactgtccaacgctatgccacgttgcgacaggcccaaccatccacctatactatccaaattctaaagattacactagggtgagactaatcacggtgaatctggttgaccgcccataaccgcgggcacggctattcgaatagttttactctaatcagaggtgtacaactgtacccacaagacacagccccacgacacgtttccgtgcgtcgacatgccaccacgacataccggaaagaggccgtgataggacccttcgcataaccctctctaaccaagcacaccacacctcaggtttcaccgccactcctcgcaaggcagcgggcagtcccctctcgtgcctaggtgaatccggaagcgacagaggccgtcgcagggcccgccccgctccatcacgcccacccttgcctggatgcgtcagctagaggtaagctacactacaagcccagccgttgcccacgctggcttgtggtaagtacgataagttcttccagggcatcccgcgaaccggtccttaactgtcatgggtgcgaccagcaaaaccatgcacccacagcccaccatgtgatttattttaattaaccaacaccaaagcggtggcgctaatccaacaataccattagaaccaacagtctaaacattaatagaattttccccattgtgcactagttgaactaagcatggctaagcaatccctagtccaatctctagtcatgttataaccccaagctgacaaagggacatggtacaacaatagcatggctatgacaataggtaaacaccccatagtaacattataaaacaatgcaatatttgaagaaaaacaatagagcatttgcaatataggatcaacatgttcaagtgacaagcatgacttgccttgctctgctgctagaggaacctcggcgactatttcgaagtacaccggagcgtcggaggaaccggaatctagcgacatacaaggcaaacattgcaaacaggctataagactactgaaacagggaacaaaaccatttttaatggattctacgcatttttcttgacttactgagacttgaatgggcttaaacggagctcggatgaattagttatgaattttagaagattcactgtgtttattactataacaaaaagtcattaaatcatttattgcgcaataattcccagggctgacgtcatcaaggggggcgcggcgccgacatgcggggcccaccggtcagcggctcgggagagagggaaaaggggcgccggcaaacgggccccactcggcagcggctcaaagggggggtggtccaccgtggaccgggaccacgcgggtggtccaccgccggtccacaggatcg

SEQ ID NO: 1605 - DNA, 2000 bp, Oryza sativa
tggcattttggcccaagtttgagaatttgttgggcctgataatgtttctttcctgggccacgtggcctgaggcctaagtccgtccctgtgtgggacgaagggagtactccataggaagcatgtgcattaaggccctgttcgagataaaagttttagtttttcatggcacgtattttaaactgctaaacggtgtgtttcgtgcaaaaattttctatatgaaaattattctaaaatatcagattaatccatttttttttaattttgtaataattaaaattcagttaatcacaagttattatcacatcatttcaaacatagcctaattctccaacattctattccttgtaaaaggaagcggtttgcactagaccacctgatgtgaaccatcctttgcctaggaataaggtcacgttttttttttcttatgggttatcgtagatatgcttcccaggctcttaaacattatattttgttgacctcatcggttcgtcatgcttggttaaccctgtttaaatctgatgaaaatagatattaagtgatgccacacaaacgagaaaaccattagcacagggttagttaagttttattttttttaacttaaaaatatgttcatttgatattttaaagcaatttatatgtagaaagtttttacacggaatacaacgttagcatttcgaaagtcatgctaacgaaaaccaagttaaaatccatatcttaatcaagttagaatatttaaactacatatgcaaagtctgtatcttagtgcatcagcacgtaccaactggactagcctcgcatttataatttttattttttaaaaaatcaacgtactttataatttgtgctatttaatccctgcattttccatacatgaaataccatacaaaaatataattaccgctatctccgactatagtcgtttgagaagggtcctaaccatttgctcccatgtataatttagccgctataacttcatttaacccgctatagttgtttgggaaggtcaactactaaatatcttatctcgttatttaaaacaccgattataagtaggagtgacaatgatacacctagggcctgttcattttgatgctattttaaaccttatcaaattttggtaaagttgccaaaaaagttgctacatttattttgtagctaatttttgacaactatataagaaatcatactaaaattttgacatagtgtagatgtcgggcatgaaagtgaacaggcccctagcgtagatgtcgggtgggatggtttcaggaaaagaaacatgatgagtagagctacgctcatttggcatatgcaaattattctttcgtgccgtccttttacaattttatacgtgtcttattacctgtaaccttttgtcagagaagagaacacgattgtttacagtcacaaatgcattgtgaagcttttgcaagtcttcagaaatttaatttggttgacttacatagttaaataggagtacctaacatggccagcttaattcatctcacaaataattttggctcaaagccttttacgccttcaaactacagaaacgtattttactaacctcatggcacccaactatgggcccacttgtcataggatagaaacccatccgaaattttctagaccgcgcgcagacccgccacccaaaaaacccggggcccacctgccatccacccaacacggagcccactccccgctcgaattcccgcacccccgccacatcctcacaaaagaaacacacctcccgctcaccaccacgccacgtcaccgatccgcgcaacccccacctcccccactccccgccgtccatctcccatccaacggcggaaaaccagcagcacgcggatcgtgccccccatcgcttcccctaaacccacgcctctataaagccccgcccccacacgcctcctcctccccacctcatcaccaccgccgccaaccactcctcaccaagtcaaagtttcttcctcgcgaccggcggcgagcggcggcggcgg

SEQ ID NO: 1606 - DNA, 2000 bp, Oryza sativa
ctacggtctgggttggggggcaattgaactcgatccacttccaggatgaattcaccgttttcgctgcgcaaaacggtataggtctgaacgctatgaatccctgagtggtcccagttaagttaggttggtctgattatctactgctactatgtcaaaattttcaattttgttattggtaaattttggtaaaataagtatcatttggtgcatgcacatctcctactttactgtaagttcgtaactggtgagtttagtccacatcagtattaaaagttgagggcagtccacatccatcaattagcatgtggtagagatggcccatggttgatgagctagattgcgcgctccaactgtaacttctataataaagaaatttaaaatgtttgtaatgctacctagcactaaaatctgttggtgaattaactataggtacatatattatattactatacctctccatggagtgagttccaaaattaatctcataattaagtaagagcaaaacgaggaattcctttatattttgtcctcaatgttttttcttcaattgttaagaggataatatcttatcctcttaataattaaagaaaaccgttcagaaaaagataagataaaactcatcgtgttagcttattatgtaccttttattaatctctactattataaaaattaaagatgtttttaccgatactttggtatgccatcgtgtatgagtcggtttttaagttcgttcactttaataaatacatatctgtatttgagacgggttttaagttcgttcgtttttagaaacacagaaggagtcatataagaaatctcttaaaaaactcgcttgctaacttgagatgatcggactcctaattatagctaatgattttctatatatatatccaagctgatttccacagtgaattttaccttaactaaactatataacaataataatattattagaatagctttcacccgttgcaatgcatgggcattttttatctattatctcttaatgttcagaaaaatctttgcattttcacctgcatatatttgttctaattagttcaaccgaattaaaaaatttatcctcaaatagtagggacatatatacctttccaacaaggagaggaaacctattcaatcaaataaaagaattgtttgaaccacttttccccgaaactgactttcaaactactagaaacttatgacaaagaggtttccagaaatggtcgtttttttttcttatatcaagattattgtaccaatgtgagatgaattctttggtgttatcaatatttttgtaacgttggaagtattccttccgtaaaagcaacttgatttttatctatgcaactttacaacttatcatttgggatgaaggaagtaggatattggtgaggtatttactctattaccgtataaacattttggataaacccatgttgctctcccttcctatcgtcttattcaactctacattttgttaagaagtgtgtggacgtatgagcatgagtatgtactacctcatgacgagtggtttcaatttcacccttttgttgagaagtgtatgaacatgctagcctaaatactccgtaaaattcctaaccaaagctaaatactccctaccatttattttaaaattttaaaaaacccacccttttgtttgtatatagtcagtgagtatgttcgatcggccacttggttgtaatactgcttgtataacgttacatactcggcaatacaccccggctgtgttaatttggcagcgtgtgctgttcacttgtacattactcatcaagtggcggacaagttgtagaaatgtagaggccaaaccatcaaaaagccaaactactccacacaagacaccgtatgcacaaacgatcaacattcccatcatgcccatccagcgtgacatcaaaagcggcgtcctaggaagccagccaccattccatgccttcccctgccgattccaccccctgctactaccagtctctctgccttccaag

SEQ ID NO: 1607 - DNA, 2000 bp, Oryza sativa
  misc_feature (16)..(16): n = any nucleotide
  misc_feature (19)..(19): n = any nucleotide
  misc_feature (23)..(23): n = any nucleotide
  misc_feature (118)..(118): n = any nucleotide
  misc_feature (157)..(157): n = any nucleotide
  misc_feature (168)..(168): n = any nucleotide
atgctgctgtcacctntcntccngccggatctgacgaatgggagggcaccccccgctgcttccctcctgccaccgcacgccgctgttgtcgcctaccctcccgctagatctggcggangggaggccaccgccgcccgagggggggggagagagagtncggtggagganaggataaggaaggaagagaaaggattaggattagggggaggccatcggttcggctcggttcgattttagggtacatcgtttttctttttaaaaaaaccgacacctataatataaggaaccatctatagtagaggtgttggtttttctttagaattggtacctatagttgattaaagatgttggttttttgtgttttcagcccgaggtggtgggaaaatgtctatagtgttggttttagcacattcagtacctatagtatcgatttctatgtgttttttttctagtagtgtactttgctttcttagtttcatgtgatgctaccaaaaagctcctctccatatttcatgggtttttctatctgcatgtctgaggggcccagagccaataaatgatacaactcttactataagatggtgtttagatctagggacttaactttagtctctgtatttagacactaatttagagtattaaatatatactaattacaaactaattacataaatgaaagctaattcgcgagacaaattttttaagtctaattaatccataattagataatgtttactatagcatcacatagtctaatcatggattaattaagctcaatagattcgtcttgcgaattagtccaagattatggatgaattttattaatagtctatgtttaatatttataattagtgtctaaatatccgatgtgataggcacttaaaagtttttagtcacatctaataaacatggtctaactctcatgaacaccagtattaactatgaagtgtgaatctgtcataaggcccggactaattgtttacccgtggaagagccagcattttctcaagcctacggctatattagtgtaattttcataggtttgccgtttatcttctaaaatttaaaatttgaagtgttgtttcaatgggtatttaggctcagaataaggctctagccctaactaggccactcctggttccaccatgcagttgctcattatcagcttgatatttactaagatattagaattattaaaccatgaagataatataaatgatattctaaactaattaaggacaatatgaagtatattaattttgaaatattaaatcaaagaggcatctgacaaagcacaactcaatattactacatgattactagttaatattccaaataaatttattataattgagaatctggtcgggtatgacttggtatttgttaattttaaaattttaaattgttaaataatgaaaggaaaactatactgaggctgaatgacttgggtagtgtttggttgctgggatgggatgggatgggatgggatgggatgaacccatttttaggggtgtttggttcaggggtgagtgggatgggttggtccctatagaggaatattcctctcagatccgggaccaatcggtccggccaaaactggcggacgaactcgtcccacctgggacgagcgacggcgtgaaaccgccgctttgctcgtgcgctcttcctcgggagacggcggcgggctcggcgacggcggcggtgggctcggcaacggcggcggtggggggctcggcgacggcggcggtagatggcttgggcgacggtggcggcggtgggctcgacgacggcggcggcggcgggctcgacgacagtggcggcggggggctcggtggtggcggatccattggtggggagggcggcggcggcgattccggcggtgtggagggcggcggcggcggatccggcgatggggaaggttgtggcgacggatccggagacggggaactcggcggcgggccgaccgtgtgtcgtcgagcttctccgcccgcccgaccacg

SEQ ID NO: 1608 - DNA, 2000 bp, Oryza sativa
  misc_feature (1853)..(1853): n = any nucleotide
cgcgtacgcgccggcccacacggcccaataaacggcaagacacggttagtttttttttccgaatttttttctatatatgtgtaaacttttaactcatatttgaaaactttcaactccgatttgaaaactttcaacttcgacttgaaaactttcaactcatatttgaaatctttcaactcagatttaaaaattttctactcgagattcaaaaacattcaattcagattcgaaaactttcaactcgagattcgaaaactttcgactcgagatttgaaaactttcaacttgagatttgaatactttcaaatcagatttaaaaattttcaagttaagatttaaaaactttcaactcaaaacattttttaaaaaataagtgtgctaaagattaaaaaaagtaatcagaaaaaaacgaaaaaaaaaccgaaaaaaatcgcaaaagaaaaggaaaaaacaaatcgcaaaaaaagactgatgggccttgggtcgggagcagccaactagcaaccctcctcatcatcaccggcatcctgctcggctaggccagccccatctagtagctcagacgcaacaagttgtagtagcaaggacaaggccgcggcgagcgtgatcatgccagtagcaccgaccaccgattggtagaacaatgtgtcgtgggccccacatgttttttttcttatcacacaaaaccagccctccatagtccatactgccatgggacctgatttagatggttctctcaagatcaggggtgaagatttctggtattacggtttagagatgttaattgaacggaggctgagggaattaccgatcgggcgtccgatccatacatgcaaaaatcgcgccacgcgcgtgcaaaaccactttaaactgattttttctcttaaattatttatccaaatcataatccgattgcaccattaaattcgttgcaattaaatctttaaaacaagaccacacatggatatattccgacgaaaaaaatttagcttattattgaatttttttaaaaaatgtttcacgatgttccaccaagtatatcggaattgtttcactaagtagatcgaaaatgtttcaatcgtttaaatcggacgttgtttcacctatataaaaacaatgtttcagcaaataacgaaagaatgtttcagttcactacaacattagatctatacatagtgaaaaattgtgagtacactaggtgaaacatttttggtggaaaaaaaataaaacgaattcccttaatagagggtttctaaaatatgtgggtgatttgttgcaaaagaatgtttcgttcaatgcaacattagatctacatatagtgaaacattgtgagtacactaggtgaaaaaaaaataaaacgaattctcttaatacaggatttccaaaatatgtggatgatttgttgcaatggagtatgtggtggagacacgtggcaggtgggccagagaacgtggtggggcccaggcacctgcatgcatgcgcgtggggccggggccgtggggggagcctccgatctgctccacccccgctggtcgcccgagagcgagcattttcgtaattgaactcaatacaaatatgagggatggaaagtggacttatccctgaacagaaattagtcgtggaacttggtagtacccaacaaatcaggcttaaggaaaccaagcccaacgggccagagcacccaccacacctccgacacggactcgggggcccataattccgctacgacatattgcgcgactcgacccaaccccgacccagcccgacgcacggacgagccagaccgatccccatccgtttcgggccgcctcatccccgacctcgcggagcagcggccgcgacgcgcatggccncgcttgcgccgcgacgcccgccgcggcggcggcggcacgggaggagagaggaggagggcgtgagctgcggcatctgcctgacggacgcgcggcgggcggtgcgcggggagctcgactgctgcgcccaccacttctgcttcgtctgca

SEQ ID NO: 1609 - DNA, 2000 bp, Oryza sativa
gacttgtttttcctacttgccaatgattcggatgaatttaacaggttgctctctgtttcctgttttaagtcatcttctcttttattggagatttttaatctgagaattcttgcattccttaggtgggaagctggtcaggtgctgtcacgtaaactgatgctcagtcttgtagctgacttccagcaacagaaaacactggccctgaaccctaaatttgttgatggacttagatcaatcctgcggaacacaagcttggataaagtattttttttttctgatgctactatgattttatcatacggaattcaactgtaaaatgtctaacatgtgttcttttaggaattcattgcgaaagcgataactttgccgggtcaaggggagattatggatatgatgccagttgcagatcctgatgcagttcatgctgtccgtacctttattaagaaggagcttgcccttcaactcaaagatgaccttctttcaacagtaagtggcaccaagctattgtctgtagatgtggttactgtctaatgtgctttggtgtagtaattgtttttcaaggtgatataagttccactcttgtgcctagtaaacatgctgaaaacgtaaccagggcggttgtacctttttcgctttttgtttgcttattattgaatactcaaaagggtgggatttttgtgtgtgagagagcttgtcttttacttacatttatgtctatttcatcaggtgacaaataacagaagttctgaagcttatacatttaaccatgatagcatggcccgccgtgcattgaaaaacacatgccttggtatgtctttccatctagcattttaacatggaaattttgttccatacactgtggtttcaaatatattttcctggttttgtttttcagcttatcttgcatctctgaatgaaccggacaccactgaacttgcatttgttgaatacaagtctgctactaacatgacggagcagtttgctgcactagcagcattgtctcaaaatccaggccaagttcgtgatgacacccttctggacttctataacaaatggcagcatgattatttggtaagatgcttgctgcttatatgtgtcattcttatacataagtgctattcatctatgccagagtagcacagtaattttctttttacatcggagcccatacttgtctttcttctcaaataggttgtaagcaagtggtttgctcttcaagctacatcagacatccctggaaatgttgctaacgttcaaaagttacttggtcaccctgcttttgacatgaggaatccgaacaaggtatgtgattcttttccttcaaattttttgagtacatagttcaggaccttacagaaaacatactaaaaatgcaggtgtattcgctaattggaggattttgtgggtcccctgtgaatttccatgcaaaagatggctctggttacaagttcttgggtgaagttgttttacagctagacaagataaatccaggttctgtttcacgtgctaaatgaatgaacaaacactagtttgcctatcaccgtctgattgtggttttttgctggactgaaaatgtaggtggcctcccgcatggtgtcagctttctctcggtggaggcgatatgatgagagcagacaagctcttgctaaggtatgtatgttgttgtaacaccggatgatcacattgctttggtctaaacatgttgatgttcctttgttgtacaacaggctcagctggagatgatcgtgtcagccaatgggctatcagagaatgtgtacgagatagcttcaaagagcctggcagcttgaataatcccgtgagtgaacaagtcagtcggtcctgcctctcatcacatgacatccacacagggtgctaaaagtgtagttaaactgaatatgtttatgtggcaagagtaaaagaaggctgcttttagactggtacaaaactctgttgcttatagtatcgcagaccccaaaagtaatgcaattctttcttacgcg

SEQ ID NO: 1610 - DNA, 2000 bp, Oryza sativa
  misc_feature (1157)..(1157): n = any nucleotide
  misc_feature (1199)..(1199): n = any nucleotide
  misc_feature (1243)..(1243): n = any nucleotide
  misc_feature (1370)..(1370): n = any nucleotide
  misc_feature (1375)..(1375): n = any nucleotide
  misc_feature (1401)..(1401): n = any nucleotide
  misc_feature (1407)..(1407): n = any nucleotide
agcaattgctgctgccatggccgcgtcttgatcagtgaaaattgtgcttggatgccttcctgacattgatgttagaaaagtttcaaagagctaaacaaatgattcaatagtttgattaaataacaacgcagcaccaaaaattacagtctgcttgtgatggttggttccaaggagtggagcaaaaggcatttcaaacttattagtatcaaatgtggtgtcgaatgacacagcatcaccaaaacaggagtaatccatgatagattgaccatctgcccaaaagaaattagctatccgaccatcttccttgtctatttggatggcgtaaaaaaatgtaggatcctctaattgcttattcttcaactattccaacaatgtttgtgtgtcattggattctaagtacttcttgcgttcgcgaccgatctcattattgcaatccatctttgagaatggtactttgtcagctcctccataccactccttcatgaactcatacacttgcgctggtttcatcccggcttcccttatttggccaattagctgcctatctgcttctataacacgccgttgggacctcaccttgtgcgacttatttggactaacaagacaatggttgtgttcaagtacaactttttgcactgtccaaattccctttcgacaaatactaaactgaacacaagcatcacaactcgtcctagtagtgtctagtgatgacttagtctgtcgttgtccttggttactacaaactatatatttctggtatatagttccatcgactcggtgctttgcttggctctttctaatactgaacccaatcttcccggcataggtgttgtacatatcatacactttctgctctgaatcaaaagccattccaacttgaggcaagatcaaagtttgtgcaactttatcattggcctgttgtacgataaatgagttatattaccacagtatgaaatattctgttttccatcgaatttgctattaaattatcgttacctgatttggtgctttatctgccatctcttcaagtactatgcgacatagtgtgttgtcatcaccattagcgttggcatcgatagcgccggcaacatcttcttccatggtcataaactcggagatctgtgcaagatgatcatgcacgatatgatcacacatcngtacgtattagccacacatcagtatttgcgatgagggcatgnaagacgatcactcacgatcatgcatgcatgtactgatgaaaaancatgagtcaattagctaggcaatgtacctgcgttctctgcttgccatcggctccatgatccccaacgattacatcgtgttcatgtgaagattgtcctgccatgtcgtgcgctacggcaggcaaaggntgcancagatgagacgacggcaccagaagcncggcgncgcctgtgctcttctgctggactcctcgtcctgccatgtagcgaatctgttttgctctaatcgtccgcctctaatcacgccctacccaatctaatcctgagccgcgcaagccgagctgagggagaacgacctgagtcgagccgtgcaggatgcggacccgcttgtgtgggccggccgtcggatgagcgcctcatccacgcgtcatgcatccgcgtcggggcgcacggactgctgttttgcatccggtctgcaccagatttttttccgccatcccctcccagacggttctcccccatctctctcctgtacccctcggccttctcccggctcctccccgcacctccctcccgctccaccaccacgcggcggcgcggtgacgacgagcgaacgcggcggcggtggtggcagctggggaggtgacgagcggacgcggcatcggcggtggcggaggcgatgagcgaacgcggcatcggcgacgggcgaggcgatgagcggacgccggggttcttgtcggcgatgagcggtcggatgctgcctcgtcggcggcgacgagcggacgcggcatcgtcggcggcagcggtggcgacgagcgg

SEQ ID NO: 1611 - DNA, 2000 bp, Oryza sativa
tcccgttcgccgccgccgggccgtcgccttccctccaccaccgcccgccgccccccggggccgtcgccttccctctaccaccgcccgccgcccccgcctcccctcctgccgggccgccactcccggctagatctggcggaggggaggcgccgccgccgcccccgcctcccctcctgcggagggagccgccgccgggatgtcgccttccctcccgccgccgccaccaccgcctccaccgccaggccgccgccgacgcgtgagaaaggcgaggggagggtgcgagagagccgaggggagaagaagagaagaaagagaggagacgacgagcccctgcctgcgctgtcgctagggttgcgctcgcctagcggtggaggagaaggagggagcgccgagagaaggggagcagcggtggagatggagagcgagaagagaaggaagagataaggagagagagagcggacacgtgtggctcttatccatccataccgactgaattgacgcgagacgcaatcatggtagggaaaaaaaaatcaaaactcggtatccacgaaataaattggccccaccacttctctatgaattgctaaaatgacacttcttttgacagctctgggggcagtggaacatgcagttttatggacggaggaattaattaggggtgtttggatccagggactaaactttagtccatatcatatcggatgaatttggagtattaaatatagactaattataaaactaattacataaatgagagctaatttacgtgacaatttttttaaacctaattaatctataattagcgtatgtttactgtagcatcacatagcctaattatagattaattagcctcaatagattcgttttgcgaattaattcaggattatagaatgagttttattaatagtttatgtttaatatctataattagtgtccaaacatccaatctgatagggaagttttagtaccatctatttaataggtcttagataccaataggcgatggcctcagtagcgtgcgttcaacactctcctttctcaaaacttatgctctttagtttttctgcgcacgttctccgatcaattaaacgctgtatttttaaagaaaatctatagaatattttttaaacaaaaaatcgtaataatgcattttattaaatgatgtttttataaaaaaaatcataataatccatttttcaggtttttaagataatactttattaatcatgtgctaatgagctacatcgttttttgtgcatgaggaattagttacgaacctagggttcgatgtttgagattcattgttcataactttatctctctcatttttcggccacacgctcaaacagctaaacggtacttttttaataaaatatgtagggaaattgttttaacaaaataatattaatttattttaaaaaaattttaaaactaatacttaattaattatgcgctaatttatgtttcgttttgtgtgccggagaggagggcccctcctcccgaacataaccttagttgctttgcattcacacctccgctcgccgtgcaactcggtgtgtagctctgtagagaggactaaagatagatgaggtaaaaaaaattgaccgtgtggagaggatagggatatgagtttgtatttgaccctacttttaataaatgtgtatatctttggtctctaccaatacgctcacaaccaaaacgtatacattttagagtagataaattttagagtagataaagaaaaagagaaacaaatgtcatattcaactatttatccaccacagtccatatataattgaaattgcttttaactcgttgcaacgcacgggcattttttctagtttttctaaaaaagaaaagaaaagaaattctactgcgggctgcctgggccgattggaagcccacttcccacgggctaggcctttaattatacaaacccacgaaggccccttcgtcgccgactctactagccggtggttacttctcgaaaccgccgctac

SEQ ID NO: 1612 - DNA, 2000 bp, Oryza sativa
  misc_feature (1676)..(1676): n = any nucleotide
tcagaattttaaaagttggactaaaatttactgcaagtgttaaatatttataaccggatctagtagtaggttgtctctatggcaaagaagaaaaaaaaataaaataaaacgcatatgaacttgatcttgtttcacgtcatttgtttaaacgagtaagcgcatggatagatggtgtgtagacatgacaaaaaagatgatgccggaacgagtacgcactacgtaaactagatgatgcgtaggaaaaacgataatgccaatcgcaccactcaaaaaccacgtgcaattttagagtaccaatattatttggatgaaattagttatagaggaataatcgtatttgtatttatagaaaatttcaaagatattagcagtacactcaaataaccctatttaatgttgtttgtaatgatagaaattcactcttaatccatcacttcatgcacaaatttaatgtggatgatttgctatttcatagtatattcaataaacatcatgtatggaataaaaggaaggttgaatcatatggcgatggtaagatgggagggtagaattggatgagcccactttattataaaacaatccttttttataagatttgaatgatagaaataaaattattttgggacagaggtattagttaaaatcaaggggaaaaaactttcacatatttacccaattctccgtttgatttgtaggaattacatggcacttttggaagattccaaacctataagaaaattttctatgaagacatgtgaaataaaagatttaatcttatctctcaattttttatggaatgaacaatcctatggagattttagatgaaagttagcaagagctccaacctcttcaaaatttccttacaaatctatctcccatctggattcatgtgtttttcatgcggtccaatcaaaccatcttttcttgtattgcattcccctatcaaaattatgtgtttgtttctaaatgatcatccatgtattacaatcctctatttttcacttatatttctattaaaattttatgtttttctattcctatgttcaatcctatgtattcctatttgtatttgtcctatagtggcggcaacggcaccaagggtcttaggaggcgctggcagtgatggtggtggtaacggtggtgtcaggtggccagctcggtgatggcattggctggtcagctcgatggtgcactaggagcgacgccgggtacagcagccacgccaacgacagttgtggaggtcgacatggtggcggtggctcttgagtgagataagctataacggcttggtggaggtcacgatttgcgcaatgacaacttggtggcaatggtctttcggggagataacctttggcagctcgacggaggtgggcatttgcggcaacaacgacggtgggacaacagcagcctggtttgcgttgcaggaagatggccggccgttgtgctttgtagcgatgaaaatgtagcagcgatgacttttggcgatataagctacggcagctcaacagagacagtgctctatgacgttgacgctatgatgccatggttcgggcaacgtaagaccaatgtttagcgatgataggcggatgaaaggattagttccggtcccttcctccacttatgattgagagcataagctttcggggtggctgcaacgacaatgacagagtgaggcngtgaaagtgcgggctctagtttcgcattgctctgaagtttgaagtgttggggaaaagctgaaagctcagccttctagtattttctttttagttgtttgttttttttttatatctcagttatgagatttggagtgtatacgcttgtataactttgattttgtatatctgctagtggatatagatactggatttctatacattataaggttttttattgtccttgaggttgtgcagtatcaaatcctgatcgttgatctggcatcatccaacggtcagaaatcgtccgcacctcatggtaccgcacctcctcattgaagtggtacc

SEQ ID NO: 1613 - DNA, 2000 bp, Oryza sativa
  misc_feature (352)..(352): n = any nucleotide
  misc_feature (360)..(360): n = any nucleotide
  misc_feature (439)..(439): n = any nucleotide
gtatatttataatacattgctaaatttgtagtttttgcaatactgtgacttgcagctttttgaaaaatctagtgttataagcttggatttgttgttgtatgatttttgttttgtcctaatacttgcagtttcatgtaaagtacactaaatcaaatcttttatttttaaaaaaaaaactagtttttactgggaaactgggctttgggttatccattattttggtctggttaaccaaacagaccagcaattttccaagaccctactagacctgggttctctacaaaattcataacccaaacaacctaaatctttcctaccgatttcatatgtgttgttgctatgcatgatatcnaaggcaangcctctttttaggctggttgcccgattgtaatggtttgataatcttgtatactagacgtttctttttctttatactttngtattctttaacagagcacaaaatataattggaacatcatttactatttttaccaccacccaccttctcaggttgtcatggagcacaaaatatctaacttttgctgtccatatcatacttcatcattttggttcttttagaaagaactttgctcaagttgtcccgtgtttattacagcatcatatagcataataaagcatatgtatcatcagatgtttgaggtatgagttatgaattatgtatctgcactgggaatcaaatcaatagttgatcatcattaatcttttaacaacattgatcattacgatgattaaagtgcaaaaatatttcatactctgcaggcaattattggatttcatttttggattaaagacatgtacgaagattatcgttatctggcaagtgttctgatgccatcagaaacaattagaagctatcacgtcaagatattcaacaactgcacatggccctttattgatttgtttgtcttttcctctcacttgtagccagtatataacttcagtgtaacagaatgttatttttttagttgtaaactgtgatgtgagaaatagttggaaagatatctaaaaaagatagcaaattgcaaatttttggtgttgaatgagcactaatattggtttgattgtaccaatatatcagtatgtaattggatgattcattggccacaatttaggtttttttattagatgtttttttcattggaggcattataaaaaatgccacaaagcaaagatgaaggcattttgaataatgccacagatacctaaaatggcattctggaaactgccctagtaagctctaacggcattcttgaaaacgccaggctagacactttttaaggcgtttgtaaaaattgccctggattgcttttcccgtcgggagtaaatgtggcatttttcaaactgcctctaaagaccattcaaggcgtttttttgactattcaaggcattccaaatcgcctcctaaagtgtgtcatcctgtagtgggagggggaaggcgtgggacccacgattggataggcgatcctggctggccaaagttggccagcgtgaggccgagtttagccagccaagccatccggctggccagtctgttggagtacatttttggcctaaaattactaaaatttagcttggagagtgagataagtagactgttggagatgctcttagcaggttggctgacaaattagtgacagtggtttcactatagcttggtacgcctttaatggtgcggccacgtgacaatgtcctcgtcagctggcccgtacatacataaattgtgatccactgcatcatcatcgatcgcctctgtatttggaccgacgcaacgtcagactagcgtgataaaacaacactgttatatgaggttagcaccgttgtttttatctcgcgtggcaaagaccgggcttaatttgtcacatactcctattaggttgacatacacggctagaaaaagcatttttcctaacgtaggggtctcatttttgcagacggacataccccttagaaccaaacgaccgcctaaaaaatatatatcg

SEQ ID NO: 1614 - DNA, 230 bp, Oryza sativa
gaaagtcggaagcatttggtatacgaaaaaagatctcatgattaatccatgtctatccaatatagctcaaatccgtcggcatgttttaatggagcagatttgattacgatttagtttccatatatgtggatttacttcttttttggtaaacagttcatagtttattatccattggttaagcgaaactcatggcactatgttatctatgtaatcaatgtttggtaatgccg

SEQ ID NO: 1615 - DNA, 2000 bp, Oryza sativa
  misc_feature (1339)..(1339): n = any nucleotide
gataattgtgtgattgttcaattgctaatccaatggttaggtgcaccggctgctggcgtcacttggaaggacatggtggacttgcacgtgcgtttcccacgtgcattggcttgaggttaagccaattttcaaggaagggaggatgttggggaggctatggtgacgatgactacaacatgtgctccctcgaagatgaagtcaaataaggtgttggcaatcaagatgacgaggaacagagcggtacagcaagaaggtgccttcactgaagagaagcaaccacacaagaacaatctaaatatcacgggccgatgtggactatgtaacgattgttctatcttgggccagtcgtggcgtgcctacggaggagagaaggtaggtgaagtataactgtacaccgtccactgttagcaaactgaactagaacctggcggcattggtggcggcaactccgtcttgttgggcgagagataattccaaaatctattccagatatttcatgtgttcctgtggtgttctagtattcttcctcctgttttgcgagatgcgctaacattctttagaatatatttattaatatggatatgaaattgggctatgaaagcttctaatcagtctatatgtatggtaacaatctgaaagaaaatgaacatatacaaattgtcaaaaaaagggattgctgcttcttgctttcgctaggtacattattgtactatctattcttgcagacgaagaaggcaaaggtgttgagattcagaatcagtacattgaataagacgggctatttttcttacagaaaatttgaaaaccttcatgccacgcttgtcatggttaattaattgtagagtggtatgtagcataaactattgttttaatcgatggaatttgctatgcatttcatgaagaagttctaatgggtgaacatggaggcttgaagttctaattgcctagaaaacttaaaatctgaagatattttagtgtttttttttcgggagcgtatcctatgcacacaggccctcgcgtgtacacaccgtgtacaccaactaaaaattatcacaaaaaattctaggaaaattcatacatgtactttcaatagtatacatctacatgcaaagtcgcatcttcaaattcattctacatagagaataacaaaaaaagataaaattatgacaaaattgcaaccttaaaactgtcagatttttttttgttacggctaaaatataatgaatttgatgttaagattttaaccctaggtgtaatacaattgaaagtatgtgtatgattttttctagattttttggtgacattttttagttggtgtgcacgtgtgtacacgtgaggncctgtgtgcataggatatgttggcttttttttcagcatgtcttgttaaattttatctcgtagaggtattcttttggtattataaactctgcatggtatgtataggcattttcttgagacattttaagctttgcataggcactttcaaaactagatattagtaacgcaaggtacaaacgtaccaaattaaattatttttgttaactaaaacatcaaaagttttctggccacttacaagaagataatgagaaccaaaatattgcacactcaagtaactcatcaaccgttggttcaaacagggtccgagagcagcaaccacgtgtttcatgaaatatatcgcgcgatgtcaggcgcccgacggcatagtcgcatagttgcctcctgccgtaatctgctcaccgttctgattgatcctaggtgctgcatgcccaaatgacttatcgtcttggctaaaaatactagcatatgcgataaatagacacatatggatgcatgcacaatggcacactccctcgtctttctgctggccaccaccctccccgtcttccttggagataggtggcaggtggctagagagggatcaagggtaggagggagaggaacggatcgcgcgcgcgcgacacgtacaccacacacatccactcacggcacggtacggccgg

SEQ ID NO: 1616 - DNA, 2000 bp, Oryza sativa
agtttcaatagaaagggattggttaccactcaaacctgtctttatgacttgaaccgtttgcacagggggtcaaattgttccctttttactaggattcttccccttctatagatttttaatccctacataaaggtataaatctaacatatttggagagattattccaggatagccaggtgaaaaaagaaaatttagcccggcgaaaaagagattattccaggataaagaacttacaatatattaaattgataagcctattggtttctagcgtgcagcttaaaagatctttactgaaacatgtcctatggtcctttagaagtatcagattttttaagtgtaaattttgatacctcccaaccatgagcatgatggaattgtacaatgggacataggggtggaattgtatccccaaagtttttggcaaacaatatgcaatcaagtaggcataatatgtatatagaccattagataaaaagaattattaagcccaaaatcaccatttccaatatattatagtttattttgagtatataattttatctttttgttctatgcaaataatttttatttgcactagtaacaaaaactagcacctcattttctgaagttctgttgctcctatttcagtcaaaaagtggtatggtgctcttctagcactgatgtaacaagaatttgcgacatatcgaataacaaaatgtgggcattgcatttgttctgtgaaatttgcagggtgtagtggcgtctggctttgggtacctgatgctcacatattgtgtggagaagagaggccctgttttcaccgctgccttcagccctctctcccagatcttcgtggccggcatcgatctcttcatcctccacgagccgctctatcttggcaggtactaattcttaattaatttctagcacaaacgaattgattgattcattcatgattccataagttactgattgttggtatggcactaaaagaatagttaattttttgcagtgtgttagggtcagtcctggtgattgtggggctctaccttgttctgtggggcaaaagggaggagaccgccgccgtcagcaaagatgccattgcttcgccggagaagccagtgcaagacgtagaacagcagcaagagaaagtgtgattgatattgattcctcttagctaggctgcatgctatctgcaaatgtgttgcaattaacttaacttgagtgtttatgcattcgtgatgatggagtatatatgtactaatcagaaatctgacaaggcaacgtacaattaatccagctgtaatagctattggtgtactagtagagtattagtagactcacaggactgtacacatgaaggaacatatgtgctgaaatactgtaccattatgcttgagctagatgtgcaaaagaagtggttttttcatctctcaccttttcccttcaacctattgtgcttgtggtcatcgaccaattgtggcaaaacactgttattctagctagttggatgtgatatatcctaaaattatgaacatagcctaaaatatgtcatattcacctaaaattccttatgttttgggacggatgaagtatctcagaagtattggagtactgcaattactgaacagggagggaacaccattacaccaagcaataagataacagggaaggaacaaaatgtgcatgccattttggtttgctacgtacgtacgggtacagtgagttcgtcgtcgtcgtcgtggtggcggcggcggaaggaaggaaggcggcgaccaagaagatcgcgatccagcacggaggcccggatacttactatgggcttaattccacttactaggcctggatccttaaaccttgggctgtcaagtgggcccggcccagataaatttcattctcggaactaaaagttaacccatctccctccaaaaaagaaagaaagaaaagcgcaaccagctgtgtctcctcggcccaaaaccctagctagcaccctcctcctcctcctctgccgccgccgccgg

SEQ ID NO: 1617 - DNA, 2000 bp, Oryza sativa
ttctgctagcttccatgcaaaatatttgcaaatggatagtgcagtgcagaagagcagaaacctaacaaggactgtcactttgtgcaacatcctgccgtttgttcaggctcgtaggacaagcaggaaaagcagcgtttgctcgtagttgccatgacaaaatcgagataaaaaaaataacccaaaagaactgtacctaacattatactagcatgctgcatatatacaagagaagatatacataattacatatatcatttgattaaccgggaatggatcgaagacggcctaccaaacgtgtacaagtgcattgcatctggtcagtcagccgcgtgcagaaatgggcgaagaaactgtacaaagtgcatggctagctaacatttactgtcacttcatcgatcgcactgagtacgaaagacgagtagacgacgaccatcattagtgacgtccacgctaattaccctctcgagtcaaacacaggtgcaggacattagtgcggttaatatcttggagtagttaattaaggcgttaaatcatgtgcaaccgcacgatctctcgttccgtccatttgtggtgctgaccacaggatggttgaaggacaattgagcagtactgctcacttacatgtgagcccgagaggctatggggttcacatgtcagtgagcaatattgcatgtacaatattgcagatgacctgcatggctgcatctggttgaagggtagaaacaccacttttccactttttactcccttgtttttcatgcatatttcttcaacaactaaacattgtgtttttcttaaaaaaatttactatagaaaagttgaatttttaaaatcatattaatctatttttattcttttactaatatttaatcatgtgctaatgaactatattgttttctgtacagaaagaagaagagccccatcggttgccttaataagccaaagcaaaagataaaatttgaatttttaaacttaattttgaagttgatttaaagatttttttcaacatagtttttttttcagcatcgacttttaaatcgttaagaacacatgtataaaaagttttaccaataaattagttttttattatctaatgaaccaaaatggcttattagaaaatatgagtaaccgatgaggccggaagtatccaactaatactcttgaacacatagggcctgttcattttgatgccattttcaaccataccattttttttgtcaaagttgccaaaaaatatatacgtttagtttgttaccaaatttggtcaatacataagaaatcctgccaaaatgttggcaatattgccatcttgttaaaattttggtattgccaaaacttggtaaggtttattttggctacaatctgaacatgcctataatagtagaaggggtttatttgcaaatatccatctccaacttcacgtgggactatctgagtggattaaagtggtttagaatctaataatcgaaacccattttgaaaagggttaaattatcaaatctctcctcttgaccctccctttctttccatgggcttcgccggcgactggaccctctactgtcttgaatgcgcttcatagcttgttttcatagacttcattggcgacttgatcctagtttgttttcatgggctttacgggccactggaccctcgcttgtcttcatgggctttatgggcctcattttcttcagaattttatggccttctatacgcccactacacctaatcacgcgcaaaatctcactgccggtccggcctggcccacccgcaacgactagtcaacacgcgctgcggcctcgccggcttctaggcccacgtagaaggttcgagaacaacgaggaccgcataaaagcatctcccacccccacgatctcgccctctcaaaaccctctcctaaccctagccgccgccgcagccgcagccgcagccgcgcgtcgtctcctccgcccgcgagctcctcttcccgccggcgagagatcaggagcacgcaaggcgcgcgg

SEQ ID NO: 1618 - DNA, 2000 bp, Oryza sativa
  misc_feature (433)..(433): n = any nucleotide
  misc_feature (436)..(436): n = any nucleotide
  misc_feature (807)..(807): n = any nucleotide
  misc_feature (811)..(811): n = any nucleotide
attattcgtatcaaaccaatagcgattcatacaagttaaatcttctaatcaatggtgggccaataatgaatttttttgcatatgtattaagacgcttggcctgatttcgaaattgtccagagttttttatgtagttttcattgcaaaatgatggatctccttccgtaactttccaattacgagtacgagaattgaaagacatgaaaattctcaattctctacggcgtctaggagatagatagaatattttcaggaacaagaaaaccagaagaatctttctctctattcactaccattccgcgtcttcgacttctattagtttcttttcttctttaatgcaatagctatagtttgatatagaatccatttctcaaagtaatggaaacctttctcttataggaaatggttcgaaaatcgctattccaccttttangtntcgtgaaaagtgatacctgtgaagatcgtgcatttcagtcacattcagatccgttttttgagtccatgatataaccaaattggatggatcttccacccgtttagctaagaaagaatagatgcagaggtggataatagatcgatatgaagatcatgagctgccccataatgaaaccaccaggagtcgcgaatatctccttcttccctaatccaagattggagaaagaagatctaagagggacccatggagaatgtggtcagaaacccataatagagtccgaccgcaacgaccgaattaattatcctcatcgagaaacttagactactaagtagaaaagatttgaaaatcatggcatgggtctccttttttcnttcnttagagttttctatatgcacaatttctcgatgtttcgatgagaatttcttgactttccatatatagaaagagatagactataaatgacatctcttatgtcaattagaccaaagggatggatattaaatgataggaagtgctaggaagtgaaatagaatgaaatagagccactctgggcttacctatgaaatgaggcatggaacggagccactacgaagaaattccgggagttacgaaagaagcttcggactcatattgttcatgggttgagagcgggagttgaactctaggaggtcgaatcccccttattcctcagtagctcagtggtagagcggtcggctgttaattgactggtcgtaggttcgaatcctacttggggagatttgattcattctttaatgtaagaataaagaattgaatcaaagggcttgctttgacccttaggagtaggtaacccgttcgctatccttgtttctattgcattttatctcatcgtatcacattctgttctacgattccacttcgacaaaaggatagaatccaaaaaatgcattgatcattacatggaattctattaagatattatatgaaagtcgaatttcttccactctcatttatcacaaaaaaaatgtgatactacagataaaccttccttttagttctgaaacatgaaagaaaaagacatgaatccaaatgcagatcaccctgaaaactaaataactcgacaggttacaggagagcagcacaaacacatgcagtttcgtgagaaaaatcccaggaatcttcaccaagactcctgttcttattcaaacccaaaaacacacaccaaaaaaaaagtaaccccaccatctcatctttattcccccataattccgaatccatcgaaactggcgcgatcactcgatctcactcaccaaccttttccattttacacttgaccttagtaagccgtactcttgtgggctcactgatagcttcaagcttctgcaaagattttgcttagaaacagcaaagacaaaaaaccattgcgtggtggctcgtcgtactagctgatggcgccacctttgcatggcttcccttgccggtgacgggaaaagccgaccggtgaaccgccctgacggcgagccggagacgacggtgagccgggtcatggcgtgtccgtacgtgttccgtgcacaggcgccgccgg

SEQ ID NO: 1619 - DNA, 2000 bp, Oryza sativa
agctccaattcatttatagccaatctaatagttcattcatacaatagttatatactacattattaatatctggtcccacctatcatacacacactgcgtcttggagtccgtgctacagctgactacaaatctatagcccgctgctcttctctctcctcatttatcttcttaaaatatgtttgcagctggcttatagcctgctattatacttgctctaatggcgtagtatatttttatagttaactattatatgaatgggctattagattggctatagatattttggagccagtaattgactatactattgaccttgctcttaggcgcagacaaaacatgcgcgaggcaaagctgcgtgtcagtataacagcgattttattctctgtaaacaacaacggtcactatatgttggttgctgctcctgtcaatattgtcaccgtggtttagtatgtcacagcacgtgtagcaggggtagaatattatgctacattgatatttaggatagtctacgatgagatgggatgggatgaacttaggggtgtttagttgacgggtgagtgtgggttggtcctaggagaggaatatttttctcagatccgggaccaatcgatccgggaaaaatagtcggacgaactcgtcccacctgggacgagtgcacggtgtcagctcgtccgcgactgccgccgctcatccacgcctcgccttacctccgcgtccgcctccgcatctgggaccggccgtcgctcgtccgcgtctcgcctcgcctccgcggccggtctcggagatccgcaaccgccgccgcctctgggaccagccgccaccgcgtctgcaaccgcctccgctgccgccgctcgtccgctgggaaccagacggccctaacggtccatctcatctcaactcaatttcttctatcaaacaaaaaaaactataaccatcccattttttttaaaaaactagaataggtctaactcattccattttgtccccaaaccaaacacacgctgggattccttttgaggaaaaagaaatcagcggcatgtcagctttgatggtattgtttacaacactgttgtggataatttaaaattttggcttgacgtgtcaggaggctcctggcatccaaatacatgcgtcgtctgaaatatcaaaattcagcccccagcagctcgtagtggagtgaacgagtgatgtggaacaggtagggcacgcgaagaagatgtttggttgatgccaatgcttgatacaactaattttaggtaagttattttcactttgagctggagattttttttacttttgtggtcttttgaactaacctcaacaaattttatctatctacgtctaaattgtcatacgacgaagaaataatcttacatataacgacgagagttcgttgacgagtaaaaaccgacgtaatcgagatcgttgatatatttgagaaaagagtcaggtgttctaaagtaaaaacaaaagaagtaagtttacctgatcgaaagtaaaaatattgattaaagggtggtttaaaataaaacatcgataataaaagataatctaaaataaaaagttttaattaaaaacccctaaacattgagataagaattgattttgagaggccgctggtgatattcttagtgagagaaccttttcgatttcgatctccatcgatcatttcggttcaggttttcgttctactgtgccgagttgccgacccctccccaggaggagaaaattgagtcccgaatttcttttcaatcacaaaccatttttttttccgtttccttggatacatgctcatgtcggggtgcgtgcagcgtccacatgatgtgtataaataatcacccgcacatatgcccactccctcccaccttccccaccctcattggctcccccgcctgcctccccttctccatccaccaactcgccgcacactcaaccccgcctcgccgccgcacaccacccaccggcgaagagaagaagtcgtggtttttcttggctgcaag

SEQ ID NO: 1620 - DNA, 199 bp, Oryza sativa
  misc_feature (2)..(2): n = any nucleotide
  misc_feature (10)..(10): n = any nucleotide
tnagttcccnaccccccacacgaaggcgccctaaaatatccccaaaccttccaaatctccgccccccaacttcccttccccgacgccgaaatcccccaaattccacccccgcctcctcctcctcctcgcgtcgcgagagaatccgaggcgcgcgagcgagaggaaggagagaaggtgagagcagcggcggagggaggag

SEQ ID NO: 1621 - DNA, 2000 bp, Oryza sativa
  misc_feature (846)..(846): n = any nucleotide
  misc_feature (859)..(859): n = any nucleotide
tacctaggaagacatgtcatgatttcttttgcttatccaaagtgtcaaacattttattttattagatcctatgctaaactatgtaactgctgctgatatcattttgtaattaatactctgcattttgtctacatgattttgaatcgaggcagcaggagcaaaacagctttgttcgaaggactcaatgctaggaatagcatggggttaaggcattgaatattcctctcccatgctctggaccgtttttctgttggcggtctaagtcaggcattgctccagtattagcttttggatggctttaattttattttgtgaaatttgaatctgataaaagtacatgaataaaaacttatgttatttcttatttcatcattgtaaactatgagatcaatctagccccaggaggtgtttgacaatatttgaatgtttattgaatcaactacctcttggatatgggatcgtctgagaaaaatgtgtgttcaatgatctatatagattctctccacttctggggctacagtattgagcttgttatgaaaatcaaagcttgaatttccataaagaatcataaaaaaagccacttaaagcatgttgtataatatccaaggtactttagttattcactggaagggatcaaggtaatataaagccacggttttgtatactatacctggcacttctgatatagggaatagttttcacttttagggaactaccgataaatatgtttatttttccaaattatcacacctttttttcctggaccatttatctttcctatgctaatataattatttggaaagtctcgcaatcgtattatcttttctctgataatatttcttttanatatttcacaagnttgcatagctgaaaatttgcagcccaaacatttcttctttaaatggcatcccataattaaatgttaaactgtttcttgctaacttatgtatttttcgagcttgcatggtgaaccatcaattctgaattatttgtacttgtctgttttgtcaattgacattcaagcaaccaacaagcacctgaagctatcctgatatacaaaccctgtgtggtctatctataaatgccgatattctttttatttgtttgaatctttagatagataatacgcctaccacaacgttttcttgaatgtgtatacattgggaactagcatgtatacttaaaatcaacaacaagaatgtatgttaatccatacataaatatatctatctggattggatgtagccaatctgtacatgtactaaatttaaaatagcgacggataataatgattcttccataggagtgtccatgacattaaaaatgccattgaagaggcaaatgaacacacaaaatattaggcaaataaaaagggatttgcaacaccaattggcactcctaatgcttaacatgacttttgtgcacgatctacataacaaaaacttttatatatgtctatccgtgacgtgccttgcacgtgcacgctcactagtaataaaaatggaccagctgtggaggaaaactaaggtgaaattttttatctttttagatcaaagaacatggtatatgtggacaacataacactacctgatgtcaaagaaaaaacataaccctgtgtatgttaatctgtatagctgaggcatccaccagagcatgcatgtgcagtatattattggttgaatttggaaaactagaatacgcaccatataacatatatcggtcaacattatcataatccccaaataaaaaagataactttaacaacaaaaaagatgcatctggcatgcagctactaaatccaaatgaacaaaattcatatctcccaaacaattttggtcaaaatggattaaaaactcaagacgatgtcaagaaatgaaaaaaaaatcgacatgctgcatctgcctatttaaagctcaagaacattcagaagaatggcggcgaaaccaaacacaacaatcgcatgatcagctagagatcgaaacagagaaagaccgtgaccc

SEQ ID NO: 1622 - DNA, 2000 bp, Oryza sativa
cagcactgtacacctcagaccgaggcctaccgtttaccaaagttttggcctttctcatgtcctcatcactagtctttaccctggatttctctttggaatgcatcatgtcctgttcatttgacgctattctttctctgaattttgctcctaacgtttcagctagccgcatacatggacgtaaattaaagtatcgcattcaattcagatgaaaatgaataacaacttaacaagagtctgattattcactaaaaacagtgtgctgaaggcctaaaacatcgccttaatcaagcgttacagatgacaagccgccatcatccgtatcgaataattataattatattccataaactgccccgtgataatgaaatgatctatagtttgggtcagatcagacagatctggagtcggtagaggagattataatctatcagttcagttcacctagagcaagaaaacaatgagcacactgtatcagaaaaaagaagaaacaacaaacaaatgcttagtcttttacttgccacatgcaaaccttccttaattccaagtccaactgtacttgtaaacaattggagggatgagctgcataattaacaagtgtggtcaaagatgccctgctggtcattagaggtcgcctaggcaaatttctcgtttatatctgcctagtaattcacctagacaaatcttacgtctccaacaagaggtgcaggccaaaacattgagaaatccactgtaaattaagcaaattaagtaatagaggagcagcggcctcctaggcgttggagacctcacgtcactggccatttttctctcgataatccaattgttttatctcacctcgtcaactcttttctgcttcatctcactcgcttcacctctagcatcgcgcgcgcacgaactgaaacaaacttatcttataatttggtgcaagctagtttttttttaatttaaaagggtatcatgcaatgctcgtggcctattatgtgcagtactataatcttgatattattcacgaatggagatcttcatctcatttactacaaaagcactatctgcttaggcaaatcacttggatcgaagataatgtttgattttttttcttgttttctgaagattttatttacaaaatcaaccaacaaaatatttttcaagttactataaatatttttgacaatgatatgataactccaatatatgtctatggcaatacgatacttcgttatggcatggctagtcaacaacagtggcctggacaaaggatttattagtattgaaaatgaggcatgaggagtgttttttttttacaaaaacaagaaaaagattctgaaaataaaaaaaaatcagttagtgctattactccctccggtttcattttaattgacgctttggacaatgacacgttctacaagatatacatttgagcttattttttattataatatatacaataaataaatgcatgtttatttttattatagtgttttgaaagacaaatctatatatgtttttctagtttctttaaactaaatatttttaaagttattgatggttaaagttataaaagtttaacctcaatcttatccaaaacgataattagtatagaaccagagggagggagtaaagaaaaagtttggggcggtgacaagagagaatcaagttgtaagattaatcaactgaggcgtcaccttcatggaaggctagcaacaaccaaagagctagctagctaccttgaccgaccgaattctttaatattcgggcagctcatgctcgtgctctcgctcatgcgtgtggactttgaatccatccacctcatcctcctcccgcgtactccataaaactactcggattcgatctcttcctccagtactccccatctcccatccaccattgctgccatctccaccacatacaatacaacaactactactcagctcaccatcaccggagcaagagccaagaagacgacgacgacgacgagctagcagcagcattgcaaccgacgg

SEQ ID NO: 1623 - DNA, 2000 bp, Oryza sativa
atcccaccatttatcattgcaaaatatgacatatagaaagagaaatgaaaaagaaaaatactcttagagaataagacgaaccatttttaataattcgaggtgtaaaatgagtcaagaaattgtttagactccagcgaaaagggttaacccggaagtgatatggttggagtcgcttcgtgtataagtgttaacccggaagtgatacggttgaagtcgcttagtgtataagggttaacctgagagtgcactttcgttctcgcttcgtgtacatacagtgaatagtgatatatgattggagggacaagcggacgttgtaagttggttgcaaccacacaactcaggcaggctcacagcccaaccagggaaacctacatctctggcccacgaggcccgtttaggcccaggagcgagtccacaaaggcatcatcgcatacgtgggttgccgaatattcgctccgcttcccccctcacgcgagatatttcctctcccccggtgggccgagccgccacgccacaccgccccctgtatcgctcactcgcttactatatagccagaggggagggagcgggtagggttttacctcctcccccccgcagcgccgccgccgccacacactcccccacatctccccttcccttccactcctcctcctcctcggatcgggaggcggagcgagcaatcccccaaggtgatttcctgctgctcttctctcatctccccccatcctctccgttgcgtgaatctgttgtgtggttcgtcgtcgattatcttagctaggctagattcctcgcggtggtggtgatttgagtgcgtccatctggtcaaaggttcgaggtaggagtagtagtatgtgtgggtgctctcagttcgttgcatgtttgggttctgtatctggtttggattatcatgtttagtggttggcgcggtagttgtaaatctgtggggttttgtcacgctggttaattttttggtttcgtcccggttccgatcgacgtttctttgggtcgtcaggtgtagcgaatggatgggattggttcgatccgtctggtagggattcgttctgctcgtagatctgctgtggattgctttcgcggtcgcctgctggagctaatttggcaggattaggatggttacccatttctccagggcagatctatgctatgttcgttgattggcgtgtgctggctacagacttgttcatgttgttcactagattgttaaacatgtgacgtcagccggtgattgcttgtctgccacggttttgtttgttgtcctagtgaaatatgcacagatacttaagggccgtgtttttgttttcacaataatggcagtagatgagttgaattcagtttgtcatatcgtttttgtatcaaaacaagtttttttcttactggttaagtgcttctcgcggtcccgccagaatttttatgtactgggtatctctgttatgagtactcccatatcctgcatgtacagtactgcagtggtgaattggtgatgtgctgatggtaatgaatatggcggaagtgtatcagtttgctgcttttgttacatttgatgtgtgttttcaagtttcatcttttttttcttattaatgctgcatctatcaagctgtgcagtttttttctttgatcgtcttaaacctaacagtgtaactgcatcagtgtggtatttggaggtagtattagtaaaactggacatgttaaaaattcgcatttagtaaaactggacatgttaaaaaatcgtatttagtattttgtatcatgtatgatgcttaatttttgtttgcgatatcaattatatttttatttgttgcattgctatgtttttacttgagtcatgccgtgatatatttgtagttagaattttgattttaggttttgtgttttgcatggttctaactgggtttctttttttggtacaggaatttgtatttgtagcgtgatttgcaaagctagtcaagatggtgaagttcacagtagaagagctccgccggatc

SEQ ID NO: 1624 - DNA, 2000 bp, Oryza sativa
  misc_feature (1176)..(1176): n = any nucleotide
  misc_feature (1256)..(1256): n = any nucleotide
attaccgtgttattgttttgattacatatctgccacatgaccatcctttgctagccctggtacaaaattggtattccatcgatgaattatccaactactcataacaattaaggaaaacatttagttacagttccaacctttacgagtagaacatgtccgatcaatacgctgactactctagttatttaaaatatattatccgctaggagacattaatatcttctttgtacgtacttgatgctgaccttcgggtatatgttaccgaatccactaaaagcctagtgaacgacaaatcacatccgttaccatattattgtttggatcatataattgtcgcacgattatcctttttggctctagtgcaaatttggtattatatagaccgtttcacctatctaacggcttacaatatttaagggacacatttagttacaatcgaaacccctacgagttatttaaagtatattatctgctcaagagcattaatgtcttgtttgttcgtactcgacgctaacctttgggggtacgttacagaatcgactaaaagccaagtaaacgacaaagccgcagccattaccgtattattgtttggatcacataaccgtcacacgattatccttgactggctctggtactaaattggcattatatggactgtttcacctatctaactaatcataatatcaagaaacatatttagtggcaattctaacctatacgagttgtttaaagtatattatccactcaagggcattaatgtctttgtttgtacgtattcaacgctgaccttcagggctacattacaaaatcgattgaaagcctatgaaacgacaaagccacgacagttaccgtattattgtttagatcacgtaaccgtcgtacgattatccttggctagatccggcacaaaattggcattaatatcgaccgtttcacttatccaaatagaaaagaaaacatttaagaaacacatgcagatatttttccaacctttccaactacaaccaatatgatcaacgagcggtgacactctctccaaacaaaaaccagcgacacttttgctcaaccggttagccctaaccaaagcgcataagtggtcccggtcctcgcgctagttttacccgtacaatcttgactatacaaatcttctttgatcttcaaactaagattcatggncacatagagatgctaacaacaagatgaggaggagtgatggatggagttggaatgatgatagatgcaatgtggtctagtgnggtcacaatgaggaaaatgttgggtgtgaggatggtgtggggggtgcacatagggacaagggagttctggtgggtttgtcaaggctgcaagggacagagttccacccctgatagtggttgggttggagtcccaaacccacacgagcggcctttgaaacccaaaaaaaaaaaaagattcataaaaacaccccaagagaagaacagagatagaaatgaaaagaacacaagacaggaacaacaccatctctcttttccaacccttttgccatcgtcctcaaagtaagtgaaacccctccccacacaaaaaccaaatcctctcacatgaagataaaaaagaagaaccaccctaaccaaaccaaaacaattcagttcagagagagagagataagcacaatacagatagacataaatagagatatacacaaagattgttttttctttcaacaataaaaaaaactctacttttcttttaaggaggcctgtggcatttatgcatttctgttttgtttttgttggttgggagagtcgaagccaaagcccccctctcctctcttattcctatattagccccccctaccccattttgccgttcgctgcagaagcaacaacaccaacaaagctatagctgtctctttccttgcatctcctctcctcttctcttctcttatataggccaccgcgaggtcggtctccatccatccatccattccagcatttcttgaagcttgctgtggatcagagagg

SEQ ID NO: 1625 - DNA, 2000 bp, Oryza sativa
  misc_feature (1304)..(1304): n = any nucleotide
  misc_feature (1308)..(1308): n = any nucleotide
  misc_feature (1333)..(1333): n = any nucleotide
  misc_feature (1347)..(1347): n = any nucleotide
  misc_feature (1422)..(1422): n = any nucleotide
  misc_feature (1807)..(1807): n = any nucleotide
  misc_feature (1818)..(1818): n = any nucleotide
  misc_feature (1851)..(1851): n = any nucleotide
  misc_feature (1853)..(1853): n = any nucleotide
tcggcgtcagattaagcaaactgcactttcatcttctctgcattttaagcaaacggagtattaattaattaatttcggaaacaaaatggtaccaatgggcacggcggtagccatcagctgccggagatcgaaaagaggtgggagaccgaagatacagctccgatacaggtcacgggtatcgtcgggcttctcgagaaagcggacggccgccgcccgccggacgcgtgcctcgcgagatgatcgagctggccgttgtcatcagactgacgaggaggtagtagtgtgccacgtatgtatagcttcgcggcaccccattccaatcaaatgatccttgcgacgtgaaccatccaaagaggatcggtggaatttcgacttgcacagccagcccattcctgcaaaggcttttatcaacttctctccgttcgaaaaagggtttatcacgagtgcacattcaacgtgtacacgtatactacatggttcgacactcgaacagttctttttcttttaaagatgttcgaacgtcagttcgggcaaacaacgttatctgttttttggagtgcacattttacaatcccgaggttgcgatatgtggcccaataatgtgcactctgctgcattcccctttggagaaggttggatcagatgtagtatagggtgtgtttatttcacgctaaaattgaaagtttggttgaaattgaaacgatgtgatagaaaagttgaaagtttatgtgtgtaggaaagttttgatatgatgaaaaaattaaaagtttaaaaaaaaatttgtaactaaacaagaccataatgtattaatcacttgcgttgacaacaattggcacactcaaactccacaagccatctcatacactcctattatattattattagtagtattttttgctgggaacattaggtacagtctactattttaaggaggccaaaacgaaaagcacatcctcttttctttttctttttaacgcattgacatgacagtgtagcaccaacaacttcaacaccagcacgatcaagcatattctaccatagaaacttcaacagttcaaccaacatcagcatcaactcctgttccgttcaaaagaacgtccaaactctacctaattgacaaatgatttcaccacgtccctttccattttcccttgttttttttcctcctcgaagaggtcgctttctgtaccgtctggaagacgtcatgtgttcttactatagaatgtccacagaaaatcctgcattccacggcggccgaaatccaatcttgccgatggtttggtttcctcttcctcactttttcnttcnttcttcctctccaagaagacaagtnaccctttcccaagnccctctctctcctgacgagtggggcccaagtcgtgcggtcatagactttttactactacaaccaacgttcgcganccaccgaaagttccagaaatccaccgctctccgggccccacctgtcgccctgggcccgcatgtcatacgcgtgcccgccaccgcgctgcgggcgccgcctctcccggtgggtttagaaactgtgaggccgatccgcataccgcggcggccgtggtgggcccaccgtctagcgaaaaccacccccgccgccgcgcgtgccacgtttactcccgtgggccccgcaacgaggcacaaaccctaggccgcttatataaacccgacccgccccgctccggtgatcggatccccacagctttgcgtttgcactcctctcgatctccattcgtttttgagttcctcgtttgctccgcctctctttcactcatgggtaaatccgccaatcttngattttatttnattttgagtttgattttgggtttgattttgtangngtttttggctgattggtttgggatttttttttttttggtttctctggaatgagcaggcaagattaagatcggaatcaatggtgagtgttcgagcatacgattggatctggttattttatggtatggggtttattcggtgcggatttg

SEQ ID NO: 1626 - DNA, 2000 bp, Oryza sativa
ggtgatgaattttatagatatataggatttggctggggcaattctgcagccaccccattgaaaagagataaaattttcgccctagagtctaagttagcaaccttaacagtatattttaaattatctagatttgtttaatgaatattgtataattacatttttcattacatatgctttagtaatattgcaaatttactatgatgtcttaatgtaaagctatgaaaagcaattatcaaaatcactcattagagcaataaaaaggttagaaataccaagtaaaaaaagaaaagagtactgcacttagatacttacaagttaggaaaaagtgcaaataccctcctaaactttagatagaagtccgtctagcaccctgaactttaaaaccggatatcaaacctcctaaacttcacaaaaccgttcatatattaccctctatggtgttttttacagtggtttttatctaattagtatataaattggatgaatttgatcacgtgacatacacatcgaacatatatattaaaatctccacctaaatctttctttttatcaacataataatagtacggtatcactgtataagtataaattgatggcttacagttgatgatatgcaaatatattatattagttatttaaagttgttcgtttaagcttttaaaacatgcaaaaccaccattcaaaaccactttagggggggtaatatgaacgtttttgcaaagtttaaggggttgaatatccggttttaaagtttaaggtgctagatggacttccatccaaagtttaggggggtatttgaactttttcctacaagttacaatgcttcaaggtgtgtgcaacatgtaaaaaaacaaactttggtgcataactggtctctcagaattataatgattttacagatggatgaatagaagactaacaatgcaaaatccaactagttaatgtggagggaataggagttgactgcttatgtatggagttgctgtacaaatccaaggcagcattaaccaatgagataggaaggggatgatgcgtttgattcagcttattgcctgagtcgcctcatttgttaatgctgcctctccgccgcctgcctcgcccgcctctccgccgccgaccgcgccatccgccgtcgtcccggcacagccgtacgtgcgcatgccgagagagagagaggaagaacgagagagagaagagagagaggaaaaggggaagaggagtatgataggtgggtcccatattttttaataaataaaatgctgactggattgccacgcgtacgccacgtatgataaaaccgctctggattgggtcgaggggggtaatttgtccagtattgaaagtttacgggggtaatttagttgaccacgatagttcgagggggagtaattcgtactttttccttataaaaacgattttgatgtttcacttgcgacaaatttttgaacctctatctttcagtttttcggttgtaaaatcttacattaagattcatatttatgtatatccaacctacatctacactaagtaacattagattttacaacaactttttatctctcttttaaaaaaaaattaagacgggctatatctattggttaaaatttctgcaagatttaaaactataaatatgttgaaagatgaataggtgcagtcccttgtaataaaaatgatgtaaaaaaagcttgtttccattttgttgggtaatggaacccaggtacaatgggaaaaaaataatgagaaaataataaaaaaaatctctcaccatcatcctcttcctctgttttattagcagtagccagtagctagctgagctgagcctgagcttattatatttccctccacttcgtcctcttcttcctcctccatccccatcctccatcggatgcactagtagctggccttgtaccctacctagcttagctacccacccatgtcctcctcctcgtctcctctcgctgtctgcctttgacttggagacctagctcgtcgatcgccgg

SEQ ID NO: 1627 - DNA, 1121 bp, Oryza sativa
  misc_feature (44)..(44): n = any nucleotide
  misc_feature (70)..(70): n = any nucleotide
  misc_feature (72)..(72): n = any nucleotide
  misc_feature (74)..(75): n = any nucleotide
  misc_feature (77)..(77): n = any nucleotide
  misc_feature (80)..(80): n = any nucleotide
  misc_feature (84)..(84): n = any nucleotide
  misc_feature (162)..(162): n = any nucleotide
aaaactccgaatggctaagccgttcgggatttggaacgggaggntaacgcccgaagccgaaggcttggcngnanntnttnggtngctaacggagcttcgaagcggcgaacggcggcgagcacacggcgagcgacggcaacggtcggggcggcgccggctaantacggggagtctacttgagctactaccgagcctctctccgacgaggagctcgccaattgttccgcgtcatatcgccagctctacggcatcgcaaagttcattgatcgcaagatgaacgattatgagcagctcctcatcgaccagtacgtcaaacagggctacgccgaggaggagaccgaggccaccgacgacgacgacgacgacgagtagccttgcaattaattgttgctcgttattggaacagtactagtagtattcttgcgcaaatgattgattacttaatttttccataatctgctttgttttatgttcggtttctgtcgattctcaattcccggtctgtgttcgtctccacagaaatccagcatctgctgcatattatgtctgtttttgctcatctattagtacgtaagagttgtcaagttgcagttatggtgatatatctcttctttttacatcaaaatcttcctcttttcattggttaccacctctcatgtctcctatgtcgatctaaacatttctctgttggctttcaacatgaatttgttttcctttgcacggcacccaaagccacgggcttcgttattttctccactcactacttgttcgtttagcaatttgttgttgattcgtggtaacaaggagagtttgtgaattgttgcatgcgctggactaaattatggacagtgctcaattcagtattcagcgctaacaaggaaccaacctgatggaccgaccttcctcttattttcttggataattcaactgtgacgatgacctctctgtagattcttttaattttcatcattggataattcaaccgtggtgatagattttcatcggagaattaaactgtggtggtgatcttcagctgtaaatttcaaagtcaaacaggcagaattttcagacacatttgttggaatggagtatatatttgttggagctgagcagaggcagca

SEQ ID NO: 1628 - DNA, 2000 bp, Oryza sativa
tttccgttggtcgtgtagacgctgcagcttcagaagatccgctctacgtggagattgaagccgacgtttgggaaagcgagcaaggcaagtcacatcatccttgaacatattgaatcccagtttataaaattattttgatttaaattaatgcattatcgctttatttaaattcccacgttatcactgttttatttagccatgcctatttacctttgttatgaccttattattattgttattgttattattaccttgttcaccctagaataaacaaaaccccaactagtggatactctattcatggtaccactagtatgaatttaggtagatgcttcgctatttaattaggcaacattaggtggttttacaactctagactttgggaatattcatattgcttggacattatggaatggttggattattgtggaactggattcacacctccccctctattcaaaaccctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacaaagtcagggggtcgatggacatctctagggcaaatgaaggctacacgagctgcggcccggtagtcgagatgtcatggcacagggctggtgtcctgctgctaggggctcagtcctgcctacctgtcccagaggttccggccgtaggtggggttgggtcggtactcttgtctatggctaggatgggttgggaactacgtcacgtctttcgtccgtataccgtggtggtatgtggcacgtagttacacgtgaagaagatgtgtcttgtgggtaaagatgtacacctctgatcagagtataatctattcgaatagccgcgccctcggttatgggcaagcctagcaatgtacccaagttagtgttttaaattcttaaaacctggttaacaactaaaatgtggaatggttggcctgggttggcttgggacgagctgggacccagggtcgggttgccagttcggtctgaatcatcgtaggccttgggttaaggcaggttcgtgtgggttcacggccttgtttaataatattgtatagctctaggatcgtgtttttaaaagtagctttgagcaactaagtgtcttttaatgctgtttactgcaaaccctaaccccctatattataactcccttgtacccccttgcatttattctgcacttgtgggtgtgtcttgttgagtacggtggttgtactcagtcttgctcaattttttcccaaacccagaagaggagttcatggaagatgaaggctttggtgtctagctcgtgcctgtcgtcaagcgcctgtggtcgtcgccctagtcttccgctgtttttttttcgtttgtcttcatgtgtgctgggctttcgccgcccatgtaataaattaactatttacgcttccgcttgttaaactttgtattgtatcaacttttggtgtaccttgcctcctgggacaaggaataatacacgcacgtaaggaacgcccgttgggttatttccggtcgtgacatccagctccctgggccatcggtgtactcgccctctccttcggtggtgccgccctctcctgttgcggtgtgtcacaccccgaagttttcctcccaagccaaaattgtaatttataaatgaccctaagaaaataccggtgcaaatcaggagaaaaccctaagaaagtaatgcaaataataatcggatttgacatgtggaattttttcttgagttctacatgtcgaaattcattaacaagatttttagtggaattttcagagctctagaaataattttaaccagttaaaattgagccagcaatattgtaattccagggaaaatcctttttcctttttctttttcttttccctccctttttcctccttttttttc

SEQ ID NO: 1629 - DNA, 235 bp, Oryza sativa
  misc_feature (13)..(13): n = any nucleotide
  misc_feature (16)..(16): n = any nucleotide
  misc_feature (38)..(38): n = any nucleotide
  misc_feature (87)..(87): n = any nucleotide
  misc_feature (96)..(96): n = any nucleotide
  misc_feature (112)..(112): n = any nucleotide
  misc_feature (117)..(117): n = any nucleotide
  misc_feature (142)..(142): n = any nucleotide
  misc_feature (163)..(163): n = any nucleotide
  misc_feature (166)..(166): n = any nucleotide
  misc_feature (226)..(226): n = any nucleotide
ttccatggcccanggnacttgatgggccttgaaacaantcaaataggttacatattgggccgaagaggcccagcccaattggcccgncggatcctnacctcaaaaccctagntgcgntaaccttcccgtataaatacccttntccaatctcgttctcccaatnttngggccgccgcagcagccgcctccaatccccaacccccagagaaccctaatccacaccctntcaagccag

SEQ ID NO: 1630 - DNA, 2000 bp, Oryza sativa
  misc_feature (679)..(679): n = any nucleotide
aagagcctagagtctatatagaaaaacaatttacaaaaaattcggaattaaaaaatatattaaaagacgagtctagtgtccatataggaatatatataatttacaaataactaaaatttggtattaaaaataattagtaactaacacgtatataaaatacgctatgcatattacatatttgtagtttcgtaaagttattgcaaaatttaaaattataatgtcattttaatatatctgaataatataatgagaaaacatatatgctattatatgagagaaaatataatgatgctagccgcgcaatctgtgcgggccaccatgttagtatctataaaataaatatattttaaataaaaataattgcatattatgatagcttgtttaataataaatctagtaacatcaatcaattttacttgattgattttttttatttttcttgcaagtaatagccgaagtaaaaaagtgtaacttaacactatgctaaaaatatttatattttgggatggagggagtacaactcatccagccatgtttcccctgagcccctgatggtcgtctgactatttttttgtgacaaaggaatcatgtgcagcagagcttaagacgtgtactcacatacagtaccgagcacaaacaatacgcgcgcacaaacaatgcaagtcgaggttaagccggnggcgtggcgactggcgagggaagagtagacgaggtcgatcgacgagagtaggtggtggactggtggcgcaatgattacggcggccgtcccgcgggccgacaggccggctcgcctacccccgaaccgggggacctgccggcaatcctcctgcacccgcccatgcgccccgacgcgtggcgtgcccaccgtcacccctccgcccgcgagcgcggcccgtccatccatccccacccaccagtccaccatcgcccggctcgccgtgaccggctgcggcggctgcgcgagcgcgaccgaacgagtgcggcgaggcgactggcccggcccggcccgggaaaagcctgcctccgacgtgacgggttaggtcaaagcttgtgtggggctggcactccggcgtgacggagcccttccccgatgtgatgcctaccggattcacacttccgttaggcagggtagctaacaccgttcgtacctggagatcatgaaatgctatgttccgatgctcactatggtttcatgttcatggatcaaagggacttggaactagacaagagtctacaagttccgatcatcttatccatgttcagcactcctaaatcatggagattgatggaaaacaaatccaactcaatgatgggtagtactcctatgtgggaaaattctcgatatctgtaggattaagtccattattaggccatcagaactaatcatacatataatcttgtttggttcaaatcaggagccaaggatccaccattccaacaagttgtaatcccagtcaaagaacaaaaaaaccacatcatgtcccaaacagtatgagcctaataatttaaagtacacgccctgctactagtagcagcagcagcaatattatttccacacacaatatacaatatacaatagcaggctataagccagctgcaaatatattttaataagataaaagatgaaagagaagagcagcgggctacaaatctttagccagctacagcatggactctaagacgtaatgtgtgtatgacagtgggaccatatgctaatagtatagtaagcaactattgtataaattgactattaaattggctatagataaattggagctagtagttggctatactgttaaccttgctctaaaggggcactgccactgttaaaagttctaacgtgtccatgcctctaccctggcagcctcgccctggaaacgccccttatataacgcctccccaggcttctactccttttcaacctgtctttgtctccctccgcctttgccccgccttccctgcccttttctcttgctgagccgcttctgcattggcttgtg

SEQ ID NO: 1631 - DNA, 2000 bp, Oryza sativa
  misc_feature (327)..(327): n = any nucleotide
tatgaaatggagcatgtactctttataactaactttacatgtcatcctctacttatcttctcttcctctcttcctacttctctcgatcttgctcctcgtagccccatcattattattgtcgccactttcctatcaccttacatgatttgctcgtccttgtaaaaaatccctttgccacaagctgatgtcgttgcagccatcgacaagtcaaatagccaatgtcgtctataagctcaccggtactacccttcatcagagtttgtgcatttttcactggatcgcatagagatggaatgctgagctagagcgagaggtggctatagcttnaccctcgatgtgtccatgaggtcgccgccggcgtgaggtggctagatctagtcgttgcaacaccactagatctaaaggttgtgtggccatgaatcgagttagcaagggcgaaacaatatagggtattggtcgcctcaagctcatgggaaggggtgtgtcatttttaccgttgccttgagccatccaaatcttagatacgtgagatcatcttcgtcatttcggtggcctactaccggaacatggttgttgcatatattccatcggcacaatgacatggagccccaccatgcaacacaaggtaggtgttaagaggctgagctgtagacttgcggtgcatgtcttgccagaaagctcaatggagccagtggacttagcatgtgttatttggcggtttcatgaaagcacagcacacacattagcgtgtttagtaaggaaaaaatatacatgtccaactgaaccaattctctagcttgtgttgaggatgtgcatgtgatatgtatgttaagtgttcgactattgtatttgaaagaaaacaacataaccaatgaatcgtgttcctaaacttcccatttgtttgttcttctttagcctttttggcaaacggtggcacaaaatggtttgtgtggattgaaagcattactagtgactggattaatgtactatggtattaaacaaaccactaaagaaaactatcgagttgatatttaactcttaaaagttaaccaaaatgtaggactagttccaaacagcaccaccaaccaataattaaattataaaagaagggagcatatatattaacataatacaaatgttcatccaaaattattcgtttgtctatctagatttgactaaattaagtagttgtttaactagtatatcaggattcattacttgagtggtggtagaaatatactgtgcgcagggaaatcaaaggccataaagaccacgatgtttttggtagcttggaaaatctagagtgaacacaatagacaagtcttcaaccaacaagagagagagagagagagaggaaggtgtctcaaattgttgaaagaaatcaacatttgagttatgtgtagagtgaaagacttagcgagaacatctagcttaacatagccgtgtagtttatgaagactccacagtcatatttttttcttatgtttttgtcgactgtaagtattgtttgtactgaaatattgggcctgttcactttgatgctattttcaaccttaccaaattttggtaaaattaccaaaaaaatatctacatttagtttgctgctaaattttggtaactatataagaaatcctaccaaaattttgacaactatgccaaaatttttggcaatgccaaatttcggtaagttttttttcatcaaagtgaacatgcccattgttactcattcctaatactataggaacagcaatatttagaaaaaaaaacagtcatatttgtttgaaaaacttttttctcagctttgaagaggttactttgagaacaagcatgagaaggccacagctgtcattttcagtctcggcctaaagcccaagaaagaaaaaggcctaaaccccttaggcccttaacgccaccaagagtccaacaccaagccgcaccagatctccctcttcccgaaccccagcgccgccgccgccgccgccgccgatcgcatcgggccg

SEQ ID NO: 1632 - DNA, 2000 bp, Oryza sativa
  misc_feature (1410)..(1410): n = any nucleotide
gggcggcagcttgcgtacattctccgtggtgaaaccaagttcaagaatatcaagaagaacaagactactggaggattttcagtgactttcttgggcgacattgtggcgactgggctgaaggttgaggaccagctctctcttgggaagaggttggcactggtggcgagcacaggtgcaatgcgagctcaaggcgacaccgcttatggagctaacttggaggcacgcctgaaagacaaagattatccgattggccagtccctgtcaaccctgggtctttctttgatgaagtggcgccgagaccttgctctcggtgcgaatttgcagtcccagttctcgattggaaggggctcgaagatggtggttcgtcttggattgaataacaaactaagtggccagatcactgtcaggacaagcacctcggagcaggtccagatcgcgctgttgggtcttatcccagttgcagcctccatttacaggagcttcaggcccagcgaaccctccttcgcctattagcttcgcatcaagatgaacaatttactcatgtcggctgcgcctcctttcgtcttagcaattttcctatcttatatgaaccataattttctgtctgtttttgcttttaccagtgtactccgaagatcgttcctatcataattttggctgaagagggttgtgaaatttaatgtggaacttcaactgaataatgttgttagatctatataccatccgtttttctattacagtaccattgttgctctgaatttaatgcttttatcctagtaattatgctttttgctggagcctggaagtggtctttacaagctgctgataagcatgtcttgagcctctgctgatgatttttgttgagatgcaggtgtttctgtgaaatatctgtcacttcagatctttgagagattggaagcatacgcatcgttgttggagtgcattttcttgcagcagcttgttttgaatttgcactactttctgcaatgtgatgtcctggaaaagaagatactagcatgttctttctggcattcggctgattgtgaacttctttctgagttctgataggaatgatagcatatgaattcatctgaacatatgttgaaatgaattgagggtaccattcagcttcattgcttcttgctttctcaatggtagtagcagtgtaattgcatttgaacccaggtccgcttgatgtacatttgggtctaagaccaatgagattttttcataattcatctttaaatttgaaaaatatgattgttcatatctgctagtagtatttttttccttgctgcaattcagatcttttttctctcattatcagaagagattcaaaattcaagtcatatacaggtggtcaacgcaaagcccacagctcccgagtcgtccaaatttttttaaaaaatnaaaatattaaaaaaaccccacaaaaatccgcggatggcgttcacacgtgaacccgagcggcccgcacgtcacgtctacccaccgacgcgtgggacccacaagccacagggcccacatgtcagtgacacgtgaagcgcccctcccttctagaagcccctcgtctcttcgacgcgaaccaaaccgcccaaacagagagacgcgtcatcgaacccttaacacttaagaaaaaaaactaaaaaaaaacggcgagaaaaaacttgacgcctcaattaagtcttcgccttcctataaaatcccccgaattccccacgcccaaaaacccaagcaaaagaatccccaaattccaacaagaacaccttcgatttcgatccaccaatctaacacaacatccaatatccatggccgattcaggcagcgacgccccgatcagcaaccgccccgtaagaatctgctccaatttctctctctctctctctctctctctctctctctctctctcttgtgagttctgggtggtggtggtagattgatttgtgtggtttggtttggttgagcaggaggaggaggtgacggtggagaagacgccggag

SEQ ID NO: 1633 - DNA, 1519 bp, Oryza sativa
  misc_feature (1)..(2): n = any nucleotide
  misc_feature (4)..(4): n = any nucleotide
  misc_feature (7)..(8): n = any nucleotide
  misc_feature (10)..(10): n = any nucleotide
  misc_feature (12)..(15): n = any nucleotide
  misc_feature (23)..(24): n = any nucleotide
  misc_feature (27)..(28): n = any nucleotide
  misc_feature (30)..(30): n = any nucleotide
  misc_feature (33)..(33): n = any nucleotide
  misc_feature (36)..(37): n = any nucleotide
  misc_feature (42)..(42): n = any nucleotide
  misc_feature (47)..(47): n = any nucleotide
  misc_feature (50)..(50): n = any nucleotide
  misc_feature (52)..(52): n = any nucleotide
  misc_feature (54)..(54): n = any nucleotide
  misc_feature (61)..(62): n = any nucleotide
  misc_feature (64)..(64): n = any nucleotide
  misc_feature (66)..(66): n = any nucleotide
  misc_feature (68)..(68): n = any nucleotide
  misc_feature (70)..(73): n = any nucleotide
  misc_feature (75)..(75): n = any nucleotide
  misc_feature (78)..(79): n = any nucleotide
  misc_feature (81)..(81): n = any nucleotide
  misc_feature (85)..(85): n = any nucleotide
  misc_feature (91)..(91): n = any nucleotide
  misc_feature (95)..(95): n = any nucleotide
  misc_feature (97)..(99): n = any nucleotide
  misc_feature (117)..(117): n = any nucleotide
  misc_feature (123)..(123): n = any nucleotide
  misc_feature (141)..(142): n = any nucleotide
  misc_feature (145)..(146): n = any nucleotide
  misc_feature (149)..(149): n = any nucleotide
  misc_feature (151)..(155): n = any nucleotide
  misc_feature (157)..(159): n = any nucleotide
  misc_feature (165)..(165): n = any nucleotide
  misc_feature (171)..(173): n = any nucleotide
  misc_feature (175)..(175): n = any nucleotide
  misc_feature (180)..(183): n = any nucleotide
  misc_feature (190)..(190): n = any nucleotide
  misc_feature (198)..(198): n = any nucleotide
  misc_feature (208)..(208): n = any nucleotide
  misc_feature (211)..(211): n = any nucleotide
  misc_feature (217)..(217): n = any nucleotide
  misc_feature (228)..(228): n = any nucleotide
  misc_feature (233)..(233): n = any nucleotide
  misc_feature (235)..(236): n = any nucleotide
  misc_feature (239)..(239): n = any nucleotide
  misc_feature (241)..(241): n = any nucleotide
  misc_feature (252)..(252): n = any nucleotide
  misc_feature (268)..(268): n = any nucleotide
  misc_feature (274)..(274): n = any nucleotide
  misc_feature (277)..(277): n = any nucleotide
  misc_feature (293)..(293): n = any nucleotide
  misc_feature (295)..(295): n = any nucleotide
  misc_feature (298)..(298): n = any nucleotide
  misc_feature (301)..(301): n = any nucleotide
  misc_feature (305)..(305): n = any nucleotide
  misc_feature (307)..(308): n = any nucleotide
  misc_feature (337)..(337): n = any nucleotide
  misc_feature (355)..(355): n = any nucleotide
  misc_feature (357)..(357): n = any nucleotide
  misc_feature (359)..(359): n = any nucleotide
  misc_feature (368)..(368): n = any nucleotide
  misc_feature (378)..(379): n = any nucleotide
  misc_feature (387)..(387): n = any nucleotide
  misc_feature (390)..(391): n = any nucleotide
  misc_feature (394)..(394): n = any nucleotide
  misc_feature (396)..(396): n = any nucleotide
  misc_feature (399)..(399): n = any nucleotide
  misc_feature (405)..(405): n = any nucleotide
  misc_feature (411)..(411): n = any nucleotide
nnantannanannnntaatatanngannangtngannatatntatanaanancntgcctanncnananannnngntgnngntgtnctcatnttangnnnacacacagagggaggtgngagagnaagagaggagagaggttnnccnnccncnnnnncnnncccccngggggnnnanaaaannnnccccccntttttttncccccccccncanagaaanccccccccccnttttntnnttntnacacccccccntttttggggggggggncccccnccnttttttttttttcatncnaanatncttnannggggggcaaatttccccccgaatttgggncccaaggggttagtgggnantntttgggggnaaaagggtannccggggtntgnnccntnggntccganttctangattccccttaggaataattgtagccatgcaacgcacgagttgatgactattatttacaaaattcattgagatcatattgagagctaatttttaagataattatgaatatatgagttttatacaatcaatctaaaaagatgttgccattcaaagaattaaaggtttgtttgggacgttttaatgtttttacgactgctggagtatccataccgtgcatgtactccaatatatgacttttgacaaagagattaatattattcagctcagaatatacgataacacgttttagctatgttcgttgacaaatcattgtgatttatttttaataagattatatatctaaaaacagatgacgcgccatgcatataaattaatatagcatgttctttcatggtagatggaactaataatgaatatcataatgaacatctgtttctagatgaactaataactacacataaggaactgaataatgcaaataaattgaggatcatttctcattaaagacatgacactaaatgaatatatttgcatcactgcataaaaatagccctctctaaatgaaccattactacaatttacaggtgggcagatcaggttttcttcatctttttctgaatgccaaatgtggcaccacaccacaggtatatggaatgcagaataaatgcaaactttaaaccaaaacaaatccaaaaaatcaaaatgcatttaaaactcgactagatcaaaccacagagagaggccttctttctttctcctcctcctcctcctccttccccctagaaatcggaattaattggcattaaataattcccccaaccatttcccaacaacaccaataaattagtggccgcccattcgccgcgtgggtcccacctgtcggccacggcggcgcgcgccctctatatatatataggcgagccgcgcccaccaccaccagcgccaccgcttcttcttctttcgattcttcttcttcttgcggcgacgcggagaagcagaggaaagccgccacgggggagaggggaatggcggcggacgtgagctctgtggcgaggctgctgcgaggggaggccgggaggaggggcggggcggcgggggaggtcgtga

SEQ ID NO: 1634 - DNA, 2000 bp, Oryza sativa
ccccggccgggatgatcaactcttcaccatccaacgcaggggatggaggaacgaagcagtagcacaagaggggaaacgggatcgccagcggccggcggccaccgcgcgccatgaatccctcgctccctctctctctctctccgcctctccccagtttgagccgcgaacgagcgtgacagatgggccctgcagaaacgggcctcaagtagatgggccgagaataaggcccacacggtccccacctcccctgccacgtggcggcgcgtcgtcgtttgcacgcagctcgacgtgacgggaatatatctatccatccataagagcaggtacaatagcaggctataataagccagctataaatatattttaaacatataaatgagaagagagaaggacaacgggctatagatttatagacagctgtagcacggactctaagacacagtgtgtgtatgatatgtgggaccatatatcaatagtgtggtatgtaactattgtatgaatgagctattagattggctatagatgaattaaagctaatagttggctatactattaaacttgctctaagcgatcgtttcgaaaacgacatatttgtaaatagaaaataatttgtgaataaaatttttatatacatgttcttagtgatggtatatccgtaaatggaaagtaatttataaataaattttttatacacgtgttcctagcaatccaataacaaagactgaaaaataaagttcaataaaaaaaacctcaaaatcagctttaaatttaaagttgaaaatttaaattttagctaataagcataagtataagtaaaaaaaattccctctgtccaaaaaaaaatctagtactgatgtgatatattctaatacaataaatttggacagagatatgtccagattcgtacacgttggttttttataagatagagggagtagaccttatctctcctacgccatgtaggccccacctcaccacaaccgtcagttttccttgcttgcttcgccgcgttgccttttttattttctctttccttccaggacgacgcgctctccacgcgctcgcgcgtctccatgggccccacatgtcagtgacgcggcgcacaaggtcaaagcctatccggttcgtcccacccacccagctgggcccacgcggcagtgacacgcaacggacgtggccgcctcctatataggcggaggagacatcgcccgcagaattgcagagcaccaatcaatccttcctcccagccaagatctttcttcctcctcctcgtcttcaggactcaattcgtcttctggtacgcccgaattctcctcatcgtagaaatcatctgtgttgggtgttgctgtgcgttttattattaattggtcgaaagaaattggggatacagactgatgtggggaattgatctgagaaataatccatccattcattcatcagggatcatatatggcctggtgttcgtttgatcttgtaagcttgtttgttccggattttagtgctaccagagatccggaaaacatcgtagtttcggcttgtttcctggtgaaataatctggtagtatatgaatcaagttggcaacacttctctaaaaagaaaatcaagctggcaaccattctctcgtgtgttgagatatgattagttattagttgtcacgcgttgaatgccttgtttctgttcaagtatttgcacgttagtcatgttctagagtcagaattttgcaacgaggattggtatggtaggtacaactacttttatatttcccagtaggatatggctaagatcggagctgtctttcggtactatatagatgcctccacgcctgttcattgcacaacatcaatggttggttttctgatgagagtggatcgtttcatgtattggaaatatcaaagatttatttcatgccatctcattccaatttcaagaattcagtttgctcataccatgatcatcctactttgtttcagatagcttagcttgattggggtgggtgaca

SEQ ID NO: 1635 - DNA, 2000 bp, Oryza sativa
tttcagagaaaaatgaaaacatctaaacctttcattttcattcaaacttgtggacccactatttagatccatgagatctattgtgtagaactaatgtcttttttagttcgcgaaaagaaaatttttgggtgtcacatcatacgtttgaccggatatcggaagggattttcggacacgaatgaaaaaactaatttcataactcgcctggaaaccgcgagacgaatttattaagcctaattaatccatcattagcatatatgggttactgtagcactttatggctaatcatggactaattaggttcaaaagattcgtctcacgatttccatgcaaactgtacaattatttcttttactttatatatatttactgcttcatgcatatgttcaaagatttgatttgacctttttggaaaaaaaaattgggaactaaacaaagcctaaggaccgttcgatctctagatttggagagaaattattgttgcacgcaaaacgagaaatctcattagcactttattaagtattataactattataaaatcgaaaaatggatttatttgcttttttaaaaacaacttctatataaaaacttttaaaaaacacacactatttggtggtttgaaaagcgtgcgaatggaaaacaagttagttgaagaatagaacagagcctaaggttgccaatccgctccactgtcttccataaggaaattgtggatattataggtaccatatacgctcacgactagactaaccgactggttgtcggggaaatattatatataagatatgtaagggattaggattcagatattacgtttacttgtatatcaaggaaatggcctgtagccctacttcggtaagattataaagtagttataggagatttaaaccgtattaggttaaatctctatcttgtaaacatatgtctcctctgtctatataaggggaatagagcgtcccatcccttaaggtcataaccacaatttagatcatcagataaatacaacaaccaacgaatataatctctaaacatgagtacattattatttttcatcaaaaaggcttgaacatgtataaaatcttacctcatcacccattcattttagatactttgcataaacccttttacgtgttgccgaattctagttttgacagaaacgttcccctcctgcctaacacgcatttcgtttccttggccgggatatcctactaatatttcgttcattctcaaacacacatacagacacagcacacacgcccacgcatttacgtgggctactttttttttatcaaacgaccgctaattttttttagaaaaaaatcaatcatgctaaactaagaaaacaaacggccccaagagagaggagaaattgattgtggtgtaacggaattggttggtttgcgaatgcgtggtcttccaggcgcttcctccccctccggctttcccctgtccggttcacacgcggcaccctcctcccgctgctgctgacttgtgggctcccacggcctctcctggtccacgtgtaccagccgcaaaggccacgtcaccctctcccccaccgctatctccctctgacacggagggcccaagccccccacctcggttcacgagccccgcacgctgcatgctgggcacggcacgcggcgtctccacgtgtccagcccgcggctgctgcgtggtgagcttagccatcaccaccggcgagctcctccccgcccgcgacgtggcgcgcggagacgggtccgatggggctcgatccgacgatccggactccggcctacagtaccacctggcccctccctccccgcgccgcctctagtggtgagatatttaattgcgcggggccccgccgtactcgcttggcaaccccccccaacccccaacgccaacgttgccgaaccggaagccgaagcgaagccaagctaagcttccctctgcatgccttgccgcgggcggcaaatgtgaggattcgaatccggagatttccatccgtctatgcc

SEQ ID NO: 1636 - DNA, 717 bp, Oryza sativa
gttatctataggctctctataaaagatccatgtcagtatattttcctacttggaagatattaaatgaagagagagagcaaagctatttactaccctggagatagtctatagagaaaaacgagacaatgtattaaagagctatagatacccatgtagacatactattgagatagtttactattaatctagtctattgttgagatgtacatgttttatagatagcacattactttaccattgcgggtgctcttatagggtagataagagaagagtgagagagagagagaggagaaagggagaggaggggagagggtgatgatgtggcaagctgacatgtggggtctgcatggatcccacgctgactcagccgccacgtagaccaaaactggggtcaaaaccaccaaaggacctcgggtgaccggttttgtatagttaaaggactccgtatatctcgttttgcggtttgaggacgtttttttatcccgatgataagttgagggacctttggtgtaccttttccaaacaagtacaacggtagaaaaggcccagacagtccaaccgaaccagcccacaaggcccagtaggcccaggagaagagaaaacggccatcaccgcggtatataaatcggtccttgccccaccaccagccaccccaccccgaccgacgccgaccccacctctcagaatccccccaccccaccaccaccaccaccaatg

SEQ ID NO: 1637 - DNA, 2000 bp, Oryza sativa
  misc_feature (564)..(564): n = any nucleotide
  misc_feature (1313)..(1313): n = any nucleotide
tcatgttgcacagtacttatcatttatgagagtaacatcgttcgttgctctttttgtgcattgtattgtacagtattgggttacattgcactcgagcaaacttttgcgagtcgtgttgcttgcttattttcaatctatagctgcatctttcttggtcgccctagctatatgtatggtcgttgttgagaaatgaggaatgactgccaaagcaacaaattgaccttatttacgttgaagggcagggtgctgctagcgctttggctatcaagaatgctagtattcttttttttcctatcctttacaaagtcaagtgtcacaaacgaatcgctgtgttccgttcttgattgtatgtcatcctttgcattccattggatgtaacatcgtcttttctttcttgccaaattagatattgtctgcgggaatgtaataagttagctgatgctatagtatccattggatgtaacagtcccccaaacaccgatcttttgggacggtgcacctccgggcgttgagggtttggttgccggcgattttgtcgctttcatgggttaatggaaacatgangttttcccttaaaaaaaaaaactttgcattcctttgtcgcgcagaggcggttcgtccgtcagcttttccgatgaagcaattgccatattgccataattgctactgatactccatcccaattgttcttggaaactatatcatctcatgttgttttcttaaaataaattatcataaccatctctcttttcttccatttcatctctctatcccctcatatattgaactggtttcttacatgataaatgatttcttcatctttttgttttctctgctcaactcttttgcaacatcattttttttcttcttacttatcaacatattaatgctataaaaattagttgaagtgaagggtttcggattgcactaaccatcatatattgcccatttgcattgatgttgatcggtgaaatcgtacactccattccacgcacacgacgcatcgtacattgcacaaattcgggactagatacgctacaacccactaacttaggtagggatgtgatcccttctagtacgatgaatctggatatccatatatcaaaattcattataataagggaccacctatacatttgtcgacaaattttctcctaaaaatttgacagatgtaattatagtataatcgtagtgtaattacactgtaacttatatgtaattacactgtaacttgcagggtaactacaggtgtaacttggtatataaggtttcacgtaattttggaatcgttaaatctattacaagatttggtnttattgaggaagaaaaaaaaatcacgacacacacatatgtgtggtaaggatttattctcacaatctccattttatcgaaataacatattacacagatatttttgaaagttacatacaagttacactatagttacagtgtaattacatgcaagttacagtgtaattacactatgattgtactgtaattacatctgtcaaatttttgggagaaaaattgttgacaaatatatagcaaaatcgttataataaaaggggttacatcctttttagttgagttttttttttaaatggagagagtagcaacgagcaaagcataattttcgtactgtaccattttgcttgggaacgaacaaaactagagaggctgagcaaccaacaagacacggccagggtggatcgcccatcccgtccctgtggtccagaggataagccgcaccaccacgcgccgacacgtggctgccgacctgatgggcctgccagcttggccggccgcatcatccccggcgaagcggcagccactcctccccaatcctctcggcagccaaccgtggccatggatgaaatgacatgatacgattgctgtttatataagctgctggtgaaccagcgtacagggcctcaacagcactgctactggacatactctactactactagccagtaagctagctaactaactacgtggct

SEQ ID NO: 1638 - DNA, 2000 bp, Oryza sativa
  misc_feature (81)..(81): n = any nucleotide
  misc_feature (197)..(197): n = any nucleotide
  misc_feature (285)..(285): n = any nucleotide
  misc_feature (573)..(573): n = any nucleotide
  misc_feature (586)..(586): n = any nucleotide
  misc_feature (1757)..(1757): n = any nucleotide
agcggaaaaagataaaagcgagctaagcctgaaggcttgactcctgcagcgggcgactccattccacaagcatccttgacngcagcgacgaaaccaacctcttcgagacatcttcaactgagaaggacttcaactctggtgtgggggaaaagagagcaagactgagtactacccactgtactcagcaagtcataccngaagagaaggtatgatgcaagatatatccaagggaggctaaaggttcttttgcataaagccggcatttcaagacagtagttgaaagcngtaaaacagttgtagtaattaatccatattaaccaatcactgtccaacgttacaccacgttgcaacaggcccaaaccaccacctgaactaatcagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggaccnttcgcataacccnctctaaccgatcgcaccacaccttagggttcgcccccgtccccagcaggcaacgggcagccccccctttcgtgccacggtgaatccggaagccgatcaaccggacaccccggacgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtagtgtattttaattaaccaacaccattgcggtggcactaatccaaagctattgctaataatcaaagtctatgctttaatgtgaccccctttctgtgcactagttgaactaagcatggctaagcatctcctaaaccaacatctagtcattttaatacccaagttatcaatggcgtaagggacaacaacatatagctgagtaataggacccatcccacatgatattgtaaaacaatggcaatatttaatagaaatgcgggatatttgtaaattgggtacaatatgatcaattgtattggcatgacttggccttgctctcgcactgatgagaccacagcaacgtcttcgagaaaccacgaatcgacgaaacgggcgaaatctacgcgacaaacaaagcacacaagcaaaacatgctataagactactgaaacagataacaaagccatttttaatggattctacacatttttatgaatttactgagacttgaatggatttaatcggagctcggatgaattagttatgatttttagaagattatctgtgtttttactataaaagaaaaacccttaatcaatttattgcgcaataattcatcccagggctgacgtcagcacaaggaggggtggcgccgacacgcgggacccgcgggtcagtgactcaaggagagagaggggcggctggcaagcgggccccaccgagcggtggctcatggggacgaggagatgcccggtcggctcggctcggcctcaaaccggccgaccggttatggcgagggcggtgccgcgcacgcacggtcgccggcgacggcaaccggaggcgcggaaagcggcggcggatgacggcggcccaaaggcggcggcacacagccgnagcggcggctcggcccggcacggcgctaggagggagagaaaggggaaaagagggggaaggggcgcctcaccgcgagttggccggccttggggggaaaagacgacggcgaacggcgacggcgagcgaccggggaacggcgacgataggcggacgagctccgagacctcctagggaacaagatgggagggattagagggagaggggtggttaacagcgagcggattcgccggtcgaaggcggcgg

SEQ ID NO: 1639 - DNA, 2000 bp, Oryza sativa
  misc_feature (187)..(187): n = any nucleotide
  misc_feature (655)..(655): n = any nucleotide
  misc_feature (667)..(667): n = any nucleotide
  misc_feature (686)..(686): n = any nucleotide
  misc_feature (1910)..(1910): n = any nucleotide
  misc_feature (1938)..(1938): n = any nucleotide
ttcaaaacactagcttctgacttctgagttactctcacctgaaggccctacactaacacgtgtaaacacaagattaatccaaaaattaattcactgtttatttatcttccagttttcctcaatcagttagcgttagcctgcctttgtcaaaatccaaaagtatttgacgatagtcaattacagaacnaatctccagctacaaattatcatcaacaaatatgagaatcactagaaaaagtgacagaaatatcacacagtctacataattttgcatgagttaccaaacatgtcgaaaaactataacaactataaaatgcatcttgactatggacttatactcttgtacataacaatttaatgttcttgccacaaatatctaaaacttaactttctgatttggaacatactgaaggaccagtaaaacatggggctgaaagacctgtatacataccagcatcagtagacctctgttgtgaactttcagcgcttcctgaagttagcagtggttcatccaaaatcacatctttggcccctgccattggcacataaaggaccagacatttaaagtcatacgataacgagaatcaaacagccacaatacatggaaaaattgcattttgattaaggcttgtgttctggcattcttttaccaaantgtgaccagaanttaaaataaaactaaaaanggaagattgtcgaaaacccatccagcatatcattctcatcgataaactcacttaaatagtaaataaagaacagtatccaaaagaactttatatgcaggtgcttgattatgatccttattaaaattaaaaaaaaactaacatcacataattagggtgtttagaatagcacactgaaaagataaacagttaaggaaatgcattttttaaaaaaaaaaatagttgaggggtccatggccccatgttaatatgcatgagtggtatatacgaccagaaactaacaaagcagatgagctcttgagtgaaagattgaaaacatcttaacattcaaactgccgcatattcctaacattccacatccaaatgacatcttgagttcgcatgagtaaaaatctgaaacatatcctacgaatgctcatctatctgtatccgggttcagttatcaaatgcaagatgactaataggaaaaattgccgaattgggaaaaagtgtgttatttcagacttaaggatgcaggatgcatgcttaagcaaacattttgttccaccaacggttaaatctccgcttgcaaagaattacatgcaacttatccaatgccctcaccaaaccaaggggaaaaaaaatcaaaacatagtatcaattatcaagaaccgccgcaccacagcgaacagggcgcatcattcgagctacacgaaaccaatcacacgcagtaaccttatcacacgacatatcagaatcggcgcctcaaatctcccaaggaacacgcctcccaaggaacacgccttactctcccattgactttcaatcccaatgtaaccagctaaaccacccaagatttgggtcgctccgtacctgagctgcccatgtcgccggaggagctccccgacgccatcctcgacgcggcctaccctatcccgtaccacccccccccttttcccggcggcggtggttggtggcggcgctgcggctgcgcgcggcggcgaaagcggacggaggcttcggcttaaggagagagagagagagagagagagagagagaaagagaaagcgaattgcgaggagaagaacacgcgaggcggcccaataaccaaaaagaagcccataaggcggcccatctcccactaggggagtagcacccaccgtccgatcgaatccaacggcgcaggatgcctcgcctcagctatataagagtcgcctctctcatttcgcctaaaccctagccgtccanaccccaccaccaccgccgtcgcctccancccgccgccgcgggagaaaccacaggtaagggcaagcgcgccgccgctgcggccgccggcga

SEQ ID NO: 1640 - DNA, 2000 bp, Oryza sativa
gcaaggttggggaaagaaagaggggaaaataagagtaggcgttgatatgtggaccttataatttttaaattttttttccttgtcacttacatgtgagcagttagtcctacatctactttttaatacctggatgctgcatcagtcaaatcaccctaaaaaaagcctcgaagagtttgttttgtactggattttaatatttgagaaggcgatatattcggttttgcggtggtgtacaatcatattcggccaatagtccagggagtcaaaatggaccttttagtaaatagtaaattcattaaccgggcctatgcaatgtaaagcggaataagttcatttgaggtcccttaacttgtcaacgaatctgattttcgtccctcaaccagaaaaccagatacaacgggtccttcaactatcaaaaccggtacagattagatccctcggcggttttgactgacgtggcgcctacgtggctaatttgactcagtcttcatctgacgtgacattgatgtagcgtttacgtgacaattctatccagaaaaataataaaactcgtgggatccacacgtcagtttcacacacaaattaataaaaaatggtatcatcctcacccctcctcttcctcctctctccccattttccctttcttcggaaaagctggtccattcgcgggatgatgggctcccgcgctagcatcacgaaccgcaccatgttcccggagtcgtcctggatgccgtcggcgagcacctggagcccgtacagctcggcggcacgggatgatgcgatggcggcggtggacgagccgccggatattgttctacacctcccgcgccttcttcctcctcatcatcctccagatcccgctcttcatgtcgcccccttctccctcccaatcccctctgatttagctctgtttccgtgtcgatcgtgtggtcaatcttagcaaacgagcaaacaatggttgcctcaaaatagatcctgtatgcatatcactacttgtagctagtaggtttgattatagtgcatatgtgcgtgtgatgagttctcgacgagcaggacggcgcggtcggcgatccagagctccacggcctggaaggcctcctcgaactggtcgcaggggatggtgttgcaggtggtctggcagtgggcgcgggagaacggggtagcgcacggcgggcggacggccgtggatctggggatttgcgcggggcgcggcgctggcgaggtttcaatcctccagaggcgaggtgttcgtggctggaaagggcggcgttgcgcagccgttttgacgatggtttccctggcctaccggcgagcgcgcaagagagagatggccggcggccggtccactccatttcgtcgtcgccggccgcatctggtgcccatccccccagcgcaagagagagatgaagagaggggagatggggagagaggaggaagaagaggagtggtgagttggaccgacatatggggctcacgtgggcccatctttttttaattatttactctgtgagactgacatgtgggtcccatgggttttattatttttccggattaaattgccacgtaagcaccatgtcagatgaagaccgagtcaaattagccacgtaggcgccacgtcagccaaaaccgctctcaaaaccgccggaggacctaatctgcaccggttttgatagttgaggggcccgttgtgtctggtttttcgatcgagggacgaaaatcggattcgttgacaagttaagggacctcagatgaacttattccatgtaaagccgtaaagcccatgaggtccgtgaagagcagaactgggcctcctccattccatctcggcccaaatcgcgactcgactagctcccccctagctagggtttcactacataaacacgctcacgacgcctctcccctctctctctctctctctctcctgcctccgcttctctcccccgcgccgccgccgcctccaccgaaagcagcagccgccggcgagccagccagcagcctag

SEQ ID NO: 1641 - DNA, 2000 bp, Oryza sativa
  misc_feature (1040)..(1040): n = any nucleotide
agttacgtacatatagtaactaatggaattgctcagttgtacgaatattaaagttcagtaacctatattattgtaaacactcagatctttaaggcaaaggactaaaataactaagtatttcactgagtagaaacatgtggcacttcatcctacatttgacatttgtaataccaaacactgaatggaagtagacaatattgaccttgcaaagaagtattaaggggctctacaaactcagggaactccatttcatcgagtgccttgaggacatcatcagcgttgatcgtctgcctctttgattctttgcacatgtcattggcactgcaaacaatttctataagtaaaggcgctgcaaataaaatcatcacgaatacttacaaagaggtatggtactgcagtttgattctaatagatctacacaaaaagtcttcttttttaaaaaaagaaaatgttcacgaagggaagaaaaatgattcttatgagtttgcctgtaccctcaagtacattactagagttaagaaagtttatgaacaaatgcagatcgtggatcacctgcaccatcaaatgtcaataatttttttcccaaagtaatgtcaagcaattctggccatgagcataaattcacttagctttacccagcgaaataaataaattcactaatagctttctcccccaaacccctagagattaaacagaaacatgaaatccatgaccaaaaacgtgaaagttatactatatcagtatgagtatctatattcatagtccatatccatagatagaaggaagaataaggcgaaggggggatggggtacggacgtggcggagaggtagtggatgaagatgcgggcgctctcggcgaaggcggacatggcgtccttgttgacgatgacctcggcccctccggcggcgacctgggcgagcttctccttcactaggcgccgcacgatggccttgggcagctcctccacctccgcctccgccatggacgccgccgccgccgcttggcccggctgcttctcaggttgggaatgggatccccnaccttcccccgtctccccagccatctccctctctctctctttctcaggttgggaacggtggtgcagcggcgattcgacaaggcaaaccctagcctagtgaaaaattgacgagtcgcgcgcgctttgtctcttcttcccccctcccttcccgcgctttgcttctgcttgagttcgcactaccaaaacaagcaactgtccattccattttcatttcgagcactaaagaatttcagttccatttttcactctaaaaacacactccaacaaatctaaatctaaaccacaattgtgaaagcaagatggtgtctacttccggttccgggtcgagattatgcacacatcactttgaccagtcaccaggactacatgtacagttgagtcggggacacagaaaaagggagaggaatcagatgggccaggaaagaggagagggccatgaacacaaagcccatgtcagaccaattcctattttttaaaaaaaattagacaaaacatggggtgttgcgagaatcgaactcgcgacctctcgcacccgaagcgagaatcataccactagaccaaacacccgattcgaacttttgtctctggaacatttaactgacccaagcattttacaaacagtaagaacagctactacgaagaacaaaatgtgtttccccttccacaggtagtaagaggtaactagtcaacttggaagtaactcagatggattcgcggtcaaaaagtgggtgagtgttactgatgccagcaacgggccggtttcagcccacgcaaatgtttaaagcaaaagcaaagcccggcccaccataaaccctagctctctttctagcatggacaggaggacaggacccgattcctcctccctcgccggcatataagtagccgcagccgccgcctccatttcccgaccttgctccacacccgcagcagcagcagcagcaaggagaagaagaagagcca

SEQ ID NO: 1642 - DNA, 2000 bp, Oryza sativa
  misc_feature (516)..(516): n = any nucleotide
gagttcggccgggggaaaaggcccgcctttggaaatctcgtatccgccccctagattatcagctagtgtgcacaccacaaaattatacaggttcgggccgctatgaagcgtaataccctactcttgtttgtatgatgattcttctgtgcttgtgaagcctctgaatctccgacatacaagctagggttaaagaagctttggatcggggatccagagttcgatccttttcccgctaggcatggtcctccttttatactctaaggggataccacacatgctgcgagagctacctagggagaagggaaaatattctctatattaattatatatcttgtgccttagcttggaaaccgcatacacgtcgtctcggtcgtggggcctaccacaccacgccgcctgacacgggggacacccctgtcaatcccccattaatagatggagaattatggtggtggtcctctcatggggaggacctcgaatgacccttccgatgggacgggtcatacctacctccantccgccggaggcagatgcgacgtgggggcgcagctgtctgtccagtcagctgtgaccggtgacaggccggtcacagaccggtcattcctgaccgccgcgcaccagtcgggcacaccgcacgtcttctcctaccgcattgaatacggcagggagcagttggggcgctgcagtcattaaaggaggttcggcttcggccttctccccgcttgctccccccgccagatggcggataggcgagagcctcggggtgaagcggtacgagggcccgagaggtacgacgtggcaccccgaggcctcggggcgaaaacgtgcgagggcccgagtggcacgacgtggcaccccgaggccccctggccgctcccgcgaaccgcggggtacggaagtaggaccaggctgtaggtcatgcgccaggatgggaaggtaaattcccctcattccgcataccctcgggcccacttcaccgacagacgacaacaagtacttttaaaataatatattcatttaacatcgcttatgttttaagggtgtgtttagttcacgccaaaattaaaagtttggttgaaattgaaacaatgtgatgaaaaagttggaagtttatgtgtgtagaaaagttttgatgtgatgaaaaagttggaagcttgaagaaaaagtttgaaaataaacaaggcctaaatatcagatcaaaacacactcatcctactaaaagcctggagacgagctgtaactttccaaggggtagtacaaaaataccaactttcctgggtattaaaacaaaagaaaagcaaaaataatacacattgacagatgagttaacgcccgtgacaggctggcacacggaaaacgccgtccagtccaacctcccatttttctccaaatccccaaaatgccctcctccccagctataaatacaccctcccagagcccttctaaaccttccccatccgtctaattgcgccccttatgcattagagcccccggagtcccctctgtttcgcagataagtcctttggttcccatctttttattacattcaggtcctcctagtttcttttcctttcgagtctactccttgcattcttgcgaggaagcccctcgggttggtcgaattttagtttccactccctctcctcggggagtcgttgctgttcttgttcttggtcgaggttgaggttggtggcgtagatccgatctgaggaatgtttacctatcctttcctctaacgttcgccgtactccgatgaagttgaacgtgctccgccgccgccgttcccactccttctccgtcgccttcctctactggttctacgtcttctcatgaactcatcgccttcctcccaagaacaccatctccagcctctaattgattatatcttgatttctttttcatcctcctactagtttctttcttgtgttctttggaatttttttgatctcttgaagagatccggttcttggattaagttttggacaagaaccgtactgtga

SEQ ID NO: 1643 - DNA, 2000 bp, Oryza sativa
gaacttcaatcatgctgatttctagtcgccaatgcatggtagagatagcaaaagaagcaaaaatcctaagaattattcactgatttgttccggtactcagtaatagtgacaagtaaccgccgtctcccctccatcagccaccgtcgtcaaccaagcggccgcgactcgcagccgccgtcgttgccctgccccgtggcgccttgcaagccgtcgtcgcccttttccgcagcatgcgacacctcggaaacaaccaccatcatcaccatttcttttggagaacaccttgcaaaaacgaccgaactaacaaaaggagccggtacaatctaacactaacagtcccatatgccacagggatagaaccaggggcaaattggtatttgcatgtgtcaactcacggctaaacattcgaccataaactactaccacgacggaagtgctacgaatcgaaaaaaaaaaggatgtcctatgcttctagtcgaaagcgggaaatttttgtgctattttttgataccgagttgttttctgtgttatgtatcgaatttttttattgaaaaaatgtggcaagtcacaactgtggcagtgaaccaaacacatacctaacaaactgtgacatctaaaagtgtggtgtgacaaagtatgaccataaacacgccgaagacatcccgctccgccccggcctccccgagttgatcttgttgtcgtggttgaaggaggaggtgtcattttctgcagtacgacgagacaaccggcgcccggtggatgaccttacgcactaacgtcacattgccgccttccgtgaatcgtgatgacgtagactgtgctggagtccgaccatcttggagatgatgacccgatgtctgcctcgaattttcaaatgcaacaagcaaaattctcactctcaatttaggccgtgtttagatttcaacttttttcttcaaacttttaactttttcgtcacatcaaatgtttaggcacatatatagaacatcaaatgtggacgaaaaaaaaccaattgcacagtccgactgtaaattgcgagacgaatcttttgagcctaattatgccatgatttgacaatgtgatgctacaataaatatttactaatgatggattacttaggcttaataaattcgtctcatagtttacagacgaaatatgtaatttgttttgttattagtctacgtttaatacttcaaatgtatgtccacatacttaaaaaaaaattttggcacacagaataaactcagccttacatagctcgatcgaaagatcactgcaaggctcgatagtggatatctgaattcgttacctcacgatccgggtgaacggggatgagtcgacggcgacgcttctctggtgaccaagatgtgggctagcttatggtttattttcctgctaaaattgccacgtaggacggttgtgctacatccgtgaaaaccaccgtcaatactgtcatacgagttagtagtattttgcatggtttgaacagttgaatgactaattatacccggttttatatggatgagggatataaatcaagggaaaattggaaccatgccattataattttgtaaaatttaagatatgccatcctgacccacatgtcattgactcatgtgggtcctacgtgtcatttgagataccgatgacatatctcaaactttgtaaaattataatggcattgttgcaaattacccataaatcaaagggtatccgacctatattagaaggacacaaattggactttttccaatagaggagcccactccaatcgagacacagcgagaggcccaagcccacctcactccctcgacgcccccaaaaccctaactcccccgcatccaacggtgacgaccaccccacctcacgatccaacggccaatacccattcaccggacgctatatagcccgcgccccactctctcttccaccttcgcctcttccctcccaccccgccggcccccgcctccgccgccgcgccgctcgcaactccgccgctg

SEQ ID NO: 1644 - DNA, 1491 bp, Oryza sativa
  misc_feature (24)..(24): n = any nucleotide
aaaatttccccccttttttttttngcttttgccccatttttggctctcacctacaattggtgtatatataataccattatgggtatctatagtataaattgatcaccaatgattaacaatatgtaaacatgctatattaattattcaaaaccactcatttaagtttcctaatgtgcaataccacatagccatcttagaaggtaatatgaacaacattgtaaattgttgatcggaatgttactctataacgtactcttgttttgtccagcatatcatcaccattcagatggaatatcatgtgattatcttctcccgatcatctcgtactacatgtgtcgctgatcacatgactatataacacgtgtctctctcagtatctaattttgccatcgacaaaaaatagtagtcaagccatgtagatcttgaaagaagacgttaacaagacgacaaacaattgttatacattgtgaaaactattaacttgacattttttactccagtattaagttaaaaattctatggtctcgttttcaaaattgtacacaacaaattgaaattttcaattcaacttttaaaacctccaaccttttaatttctcacgcgaccatgcacgactttggagagtgaatgcgcgcacgtcgctgcatctcccacgataatatatactacctacatgtctcaatattacattatgcttatacacataacaaaattaaattagactacccatttcaataggaattaaaaaaatatcctaaaatagactaattattgaacgcacccatacaaaagtgtgacatgatcccaaaataaactattttatcacaccacgcaaaaaaagggccatgtgacataaatcacactgtagtgctttagaatgggcggcttcaatatgaatacaaactaattctaaaataaaatatttatcaaatgtgtggcaaacaataatagagatatgtgacattatcctaaaataaaatattttatcacaagctcaaaaaaaaaatccgtgcatgacatgagttataattgagagatctgcacataaaaaatccactgagctctggatatagcctttcttttatatattcattcattcataccagaccatctccggtttgaaaaatatatttgttaacaaataatattgcaccttaacatttagcatgaacatattactatcaaataaaggaaaaaatcgtgctatacgtccattctccacgtggcatgccaggtccaccgtcggattctatcacttcccgcgatccacttctcaacatctgggccgtcgtccatccagcacggatcttgaagcaggaaggcccattagcaaaccctagacagctacgccgccgcaaataaatagcttctctgccctttccgttatctctctcctctattgcagccgccgccgctcccagctcgcgctcccctcgccgccgcagccgccgccgcctcgcctcctcggagatcttcgctgcccttccgtca

SEQ ID NO: 1645 - DNA, 2000 bp, Oryza sativa
  misc_feature (1)..(1): n = any nucleotide
ngatgggagggggaagaagacgaggtataaaaggcggagagagagagagagagagagagaggtgattgcgtgggcgggaggcgggaggtcgctctcaggtaggtggccattgtggtgtgcagagtgttacactctctctgatgagtgatgaagcatctcatctcatcatcttcttcttcttctcgaagactttctcttctcagctcaggtctccctaccttaagctctctcctctctctcgatcacttgctaatattttccaccacctttactaacttcaacctataatagtactcactttggtcataaatgtttgtcgtttaatttaagacaagatttaggtcctcttgaaacgcaggataagtaataggaaaaatgtaggaattaaaggggtaggaaatggaaagaggagcacattgattgcaccattggaaaaaaaattaaacccatgaaaagtttccaagaagtctaaccttttgtttatttttctatgaaattgatcatagaaatatgtaatcctacgaaaatattcatatcttgttcctacgaatcaaaggatcctatggggaaaaaattccgaagagaattgaatatttcaaaaattctttgccaatcctctatgtcaaaggaacccctcgattgatgttttggaactttgaccatcactaacttctaaaacaataatttagaaacgtaaaattaatataagtaaaattgtcttaaaatgtacctaccataatatcataagtgtgggtggggagaggttaatatcataaatttgtcttaaaatgcgtaaatcaataagttaatcacgtattacacacaacgaagcagaaaacggttgcttctgctgctaatggcagcttcaccaattatctccagggtatgtgtggtgatcaggtgtagtaaccatccacccagctcatcatcacacttcgtcagatcagccgtgttggtagggctagcagcagctgcatatgttggactctttttctgccttaagctttttgcctcttatctatctttctcctgctaacattatgttcaccttgacacttttgcatcgatcgatctgccactaactactgcagatgctattgctagctctgcatggatgcatgcccctgttggactttgtacacacacattcgctttgctttagcatcacttcattctcgaccagtgatttaattggaacgcaagcaaccgaccaacatggtttaattatcggtctcatcttctcaccatcaattaattaattaattaattaattaacaattaattacatgtaataattaattgctagccagatatgccacagcacacacagaatcttatcatgcatggccatgggggcctaattaattagcctttggttatctatatctatagcttggttagggacagacaaacagtagtgctagctagatagagcggtactgcatgtgtggaagagatggcatttggatggtaaccacatgttaaataataataaggcaaaatttgctacaggacacgcaaaaaacgtgtaattagctggaagacaccgtgaaaacgtgatacggctaacggacactacaaaaattgtgtaattagctataggacacttgtcgtattattttattattttcggatcaaaagaggtgagatatttttctaaatgcccagattgccccttctctttccttggttttctccttcgccgggatcgcgcgcagtggggcgaggttggcgaggtcggcacaagaggacgcctgtgcatgctccgacttgcaaatcagagaccagatcgagcccctgaccggctgcagctgcctcctggctgcctgctcaagctctcaagcctgaagtctgaaggagctcgccattgctgcctgctcaagctctcaagtctgaattgaaggagctagctagccatcttcttgctggtggagcgagctcgccggcgcatgcttggctgctgctagctgctagctggccggtcttcctcttgtccggcg

SEQ ID NO: 1646 - DNA, 2000 bp, Oryza sativa
  misc_feature (782)..(782): n = any nucleotide
  misc_feature (954)..(954): n = any nucleotide
  misc_feature (956)..(956): n = any nucleotide
  misc_feature (961)..(961): n = any nucleotide
tacttgtgacttgaaacttttattcagaagcatctatgcatgatgttcaggttcacttttgtctcaaatttccagagatgtccacagtttggttagatgttttcttctgctgttctctttggacctggtactagctagcgcaatgtatagcatccatcgatgacatgcttaagaaatacaggtgatgattttctctatgttctagcttcatttatacgtatctttttttaagaagggtacaactcaggacgcacacttacacacaccacactcacacacgcgtgcgcgtctctaacacacgctaggaatttgattgaagatactaggcctcaatgcacggagaacgtgcagtgtcactgaacacgcacgcgtgagtaccctattacatagtcgggaccaaccgaagtccttccggaggaaagaggggaaaaatccgagcaagcgagcaagctcaggttgccaccggtgacacttcacctgagcaagctcgctcggtctctacaggttgctttatctgaacgcaaaagcgatattccatggaaaagctctcaggcccacggcctcattagacaaggcccaacgctcaagtttctttgaggcggcacatttagataaggaaatgtctgagggaataagatcacggaggtccctcaacctaacagcgagatgagatttttgagatcccttacccttaaactcacataaaccatgcaatcaaagtcctatgatagtatatatgagcggttttgctgacgtggcatcctagtcagtcaaataaaaancaaaaaagttatggggcctaaaagtaagtgagaaggaaaaaatatgagacccacatatcttccttttctctttcttctcctctcttctctttgccactgagggggagcggcagcaggcggtgacaaggaaccggagcaggcaggcgagtgctcggcggctgacggagtggancngggtngtggcagcaggcgagcgcacgtctggagcagcgtggctgtgagcgcgcgaccgacacagtggagcggcggtggcaagcaagtgatgttgcgagtgcgactagtggagcggagcgggcagtggtggcgcgggtgctcggcgacgccgacgccgtcgcgcttggccacggccacgccaccaaccacctccccctcatctcctcctcctcttcttcctcttccccaaactgcgacatctgccaggagacccacgcctacttcttttgcgtcgcggatcacgccctgctctgtcggacctgcgacagcgtcgtccacatcgccaatgccttcatctccgcccattgcaggttccttctcaccggcgtccacgtcgccccttgacaccacccctctgctccttcgcacctggagccactgttcgctcgccgcgtcccaagcccctttgcacctcctgagcccggagccgccgctcgcccgccgacgtcgccgctccgcctgcctccggccgcacgccgccgctgctccccttctacggcaaatataaaaatgaagagaagaagagaaaaagtaaaagagcggcaaagataaaaatgaagagaagaagagaaaaaggaaaagagaaggagattggtgactagatcgttgaccacatattttttttctcacttacatgtggatcccacatttttatttattttattttatgctgattaggatgtcatgtcagcaaaatcgggcaaaaattgagtcgaatactgccatgggacctcctttgaacggtttgagtgagtttaggggtacaaatttctggttctgtggttaagggacctaaaaaattctcgctgttaagttgagggatctccggtgaacttattgcaatgtctgagagacaacgaagtgatagattgggcctccagcccacgagagtagaagtcccagtcgcacgtttcgtcgcctataaatactctcccccttgggcagccacaaaccctagtcgaggagagcacccaacccctgcgccgccacctccgatcgtcagcc

SEQ ID NO: 1647 - DNA, 2000 bp, Oryza sativa
  misc_feature (1416)..(1416): n = any nucleotide
  misc_feature (1418)..(1418): n = any nucleotide
  misc_feature (1423)..(1425): n = any nucleotide
  misc_feature (1432)..(1432): n = any nucleotide
  misc_feature (1436)..(1437): n = any nucleotide
ttttcattcaaaaaaaatgcatcctcaacatactgaaacaatgtactaactactagcaacagatcaatatgcagcaattccctggatatatgaccaaagcataagaagggacatggactctgaatatttgcatcctcttgtgggctctaaccttaattctgaactatacaggtggtgcacatggatgagaagggatggaacaggaaattgccgcggaatagggttcaaaattaccggtgtagaagacccatttgacggggcgtttggtgagggtgtcctcgtagtaggtgatgaagtcggccttggcccagacgtggcagtcgaagccgtcggcggggtggcggccgaggtagacggagccagggacgagccagtttgggggcaggatgccgacgccgacggcggcgaagcggcaggcgcggcgggccggggtgtagaagaaggaggtgccgttgttccactcgttgtcgtagaagggctcgtcggcggcgagctggtagcggatgacgtggaggttgcggccccccggccagtcgtaccacaggtccgccagcgacaggttgccgtggaactccatcaggagcttcgcgtggaactgggccggccatggcgtcggcgtcggcgtcggctccgatccgtcgccggcgacgacgaggaacaaggccgccgcgaggaggagaggggccgccgtcttctccatcttgtgcaagtggctgcgctgctgcgtgggagtgagatggcgtagtacggtttcgagggcttgagtgaaattgtgtgattttccaagggtgattatgcaaaaattcgtccatttttagtacggtttgggcccattaacaaatggactttgctttgtccaattgctacaaattgagcctactttcttttcgtttttgctgctttaacaagtagaaataggcccaagtggcagagttacctacctttgctaattttggactccaagcacacaattagtactcatccgcattgtgctaattcaggttattgagaggggaagaaagtggttatacgagatcgatggaggacgcagcagctaacggtcgctatacgatggaaatgagattgtaccggacatattgtgcatatatacaaaaagtataggagtatgttccagacgatggcaacttgacctctttaattcaaagctagcctcaaacgtacttaactattcatgctttgacgtcaaggcaagggtcgagtagtaagtaacacaggctcaaaaggcaggctatcttaagctacctatacgttttgagtgtagtatacgagccgatcgatcgatcgatcgaccactgtaccgcactgcacgcgccaaattgaaaatcggattagtggctcaaatcaaaaactaaagttagtctgaactttgtctagtgtgcaaaatcttttgacatnanttaannnattggtnggtnntgtgcgttgtgtcttgtgtgatttccacacttggttgacgccgacgtcgttgtaaagtttgcacgcggcaactgggcgtggtctctgaacgaaccgtcaattcattcatggaatgaatttgatggaaacatatcccgactttgtgcagtctgtaattgtgctatgttagtgccacaaagtcgatatagcacaactacaaattgcacaaaatcgacatgggacgactgcagattgcacaaagttagaggagtttctttcgaatttgatatatggtccgtccaaaaaaaatcatgggattggcgcctgcctgaatccatggtgggtcgttggccaactcctccatttctcacggcgccggtcgccgccccggccctacttcccttcacgcctccactgacctcgccggccggccaccaccaccgcccgcgcgccacacctataaaacctcacctcctccacctccatggctcaccaccacgtacagcaaacaccaactcagctagctatactctactcatcttctctgccagctgctactacaccaaccagagctaatcaagtaa

SEQ ID NO: 1648 - DNA, 2000 bp, Oryza sativa
  misc_feature (1578)..(1578): n = any nucleotide
tacaaaatccaaatacgacataacacaaatacattataattattatgtaatcaactctcggtttcaacttaaacagagctaattagtgttgagaaaaacacaacccatggtgcttaattattctctcgttgcatcacctttaattttcttttcatgttattaacaaaattaatcatcttcatatatgatttatgatttgatatgtggcaaagcggtagtgctagagcggttgtgatcaccttagatgtctcagacactacgctttgtcacacgtgcgaaaggccaaggtgcagacgtgcgctgtgcagcatgcaaaaagagaatttcggacgctttatttattagcaaacaatagatccaatgattataataatatgtccaccagttctagtgtaagtgtaaattagttaatatagaatttaaattagttaattagttaataatagtagaccttattttgaaacagtgcattacctgagaataatagaccaatgtaaaaagtagatccgataatttatataatagggccatcagtttaagtgcacgtataaatttgttaatatagatattgtttatttgataggtacacgatataattgtgtaaaatttattttaaaatagtgcattatttgaaaataatagtacaaagtaaagagtacaccggtttaaattatatgatggtagattctttggtttgtaaaattattattatttaaaaaatatatccattatatatataaattgaaaaaagaagaaaaaaagggaaaaaaaaggggaggaatcgtatgtacagtacgcacgtatataatccacctgccaatgtgcgggaggaggataggtgggacccatagtatttagtttgttttaagatcaattttatctaacggtgtgtaatattggaccccgccaatttaatttaaaatcaagggatagatgttttgcttttttcttagaatttctaggattttctctattttattagagcgccacgtggtggcttgagaacgtctgtaggaagttttatggacttttagtatataatagatagatagataatagatagatagatagatagatagatgacgacgtttatggtgactttcgttcgcctcaaaatatacaccaatttttaaacgtatccatagaggataaggtgttcggattcgcctttacaaaggctaaagggtgaatgtacctatgtataagggcttgcatctctaaaaagaaaaaaacgctcttctttgacatacagggcatgtgccactttaccgctactttcaacataaccaaattttagtgttaccaaattttaattgggaaaaaaactaaacactaccttaacaacaccatcctaccaacatttggtagttccgaagattccctcataaaaatgctactaaattttggaaaaacatcaaactaaaccaacgctatcaaaatttggtacaaaagcctatagcgattggtgaaggttataggaaaaagaatatttcgacaaaaaacaaggggagtactaatcttctttgctgctacatgatggcattaagtgaaaagcgagcagacgaaagatttcatgtncaagaattttacatttcaaggcttacagcctctcgagataacaacgaaacgcgagctaaaaagcgaaatggataagtgaagcaagcccatagtcattgcccaggaaggcaaactaggccggcccattaattcctcctacgaatcgatctgggctgtgaccctagtacccgacgtgtatataacaacatcctctccatcgcttagggtttctcctcggacgcagccggcggcttagggttttgtagctgtcgccgatccaaggtacgcagcctccgagcgccgcctctctctcacacacacgagcgcttccttactcgagatctctcgcgcccctctccgcttcgattctctgtttgttgatcgattttggtttgttccgtcgccttcgccgcaggttccgaggagcgaggaggagatccgcc

SEQ ID NO: 1649 - DNA, 2000 bp, Oryza sativa
atactacctttttcatggacaagaaccaagatcatatactcgaagtctgcatcattcagatagtcaatcgacagttgcatatcataaatactactctgtagcctcagaaattaaggagaagtaagctagaatgcggttaaggagataggggacaataactgcttggaagaagaaagaaagaaaagaagatcgaaataaagcagcaacaacatgacaggatgatcagaaaacgagacgcggagaagagaagcaaaagcatagcaagcaaagggaagaatccaaaggagaattaagaagattaggttggattagtacatataataacaataatcctatagtaggagagaaggccggataaatccaatggcaggtggtcgagagaagaagaagacgacgacgaggaggagcagcgagagaggcgatggagacggaccgtgcaaggtgcggctgttcggcgcgaaatggtttctttatgcagcccgcctacgtacgtgcacactcaactcacttcaattgatagtataattttaatttagctgcattgattgattggttcatgcctcactcttgactggatctcctctactgaaaatgtagtttctctgcaaacaaaatgtacggattgagatcaaatgcagtcactgctagaactgcaagtcagtgacggcacattatctcatccattcattttttagatcaagggtgtagatcaactgctatagtaccatcgctacagtagctgtgaaatattttttacgcgtgaacagtgctctaaggatctcagcccttagatgcaacttggatggtcctagtgtgactaattaagttgcagtcacactagggactgcacctgaaccaaatccaaaatgtattgctccctctcaggctccctgtgggtttcggtatataacatttaaccgtccatcttatttaaaaaaattaaaaatataaattacgcataaagtactattcattttttatctaataacaataaaatactattcataaaataaattaaataaaacgaatagtcaaacgtataacatagaaacccacaactaaactacgggcctgttcactttgatgccattttcaatcttatcaaatttaggtaaagtcgcaaaaaaagtggctacatttagtttgctgtcaaattttggtaactatataagaaatcctgctatgccaaaattttggtaatgcaaaaatttgataaggtttttttttgacatcaaagtgaacaggctctacaattataacagaacaaagggagtaagttttttatttccttctcattcttgtactggacaaatccaacagtactactgaaaaattatcaaggttcagtataagtattccacggcaattaatctagctagctagtatcctttctgagggcatatataggatatgttcattctagtgattatctttcacctgcaaattaaacttcaatgttcatgaagatgttggtggtaagcaaagtgtagaaattaaactggaccgtttctgcatattttcaatgaagatcagattatattactagtacatacgtaccaatattatttatatatatagtcattatctgctccatgacaactgatcaattaaggaagactatacaaatcacatggccatgttgtacactaatatttctttcttttttctgaaggtgatatatatacagtagtagaattgattagtttaagctgcaggttaattagcaagtgagtcgtagtaaggcagaggacgttggccttcttattcaacgcagcattaacacgtttgctcccctcgaaccagacaccctaccctacctgtcctcctctcttcttcctcctctcctctccttcctcctcttataaatccacctcctccatctcaagttgcaccgctactagcagctaacctacctacactacactacaccacacactacacttggagagaagcacacgtagctagagtgatcgattcattttcttgctcgatcttgatcg

SEQ ID NO: 1650 - DNA, 2000 bp, Oryza sativa
  misc_feature (1983)..(1983): n = any nucleotide
cctttcttaaaaaattaaattaagtaagggtgagtacaaacgtactcagtaagtcaccactacaaaatgcatttagtgcacacaggggttcaaggatggcttggtttatttgcataaagctagttttcacaattcatatcacaaacctatgacttagcatttttaactgaaaaaccacgttaaattgaagttgtcatttatcgagggttcatccaccttcccaagtctcgcttggttcggtttaccctcacattccattttataccactaccaaaataacctccctgcacatcggcaaggttacgcatgcctttacatctcgtagtctaagcaatattaaaatctatgagtctagtcaagagtagtacaagttccgacgctcattaaccgcgagcatggctattcgaatagatcggtttactcatactgcagtggatgtacgctttttaatcctgcaatccgtgacttgtccaacacatgagcctagtcccaacacatgagacttgtcacggcccggtttttcagtcattctcgcattgcggcacccactccaaggactatgagcccccattacacccaagcacaccaaccctacctcgagtcggaagtgaggggagtcctggcgctctcgggattaggagttatttaacatatatacacttatagggtgtattttaggttttagtcggcattatccaaacatcaacactgcaacaacaacaacaacaacaataacatactcgtacagaacctaccatgattggggtgccgcccccatgagaatttcctagttcatcgggtctatacccacttgagaaatgcaatcgtactcggttcgtttcttgtatagcttcctgactcggtccttaactgaccagggtcggcgactaacagtttccagaaccacccatattctattcttgccaccctagtcgaaattattttgttttattaagttttggttttcacaaaaggtttttgagtgatcacacatccatacccatataacataagtatggagtgtacgatcgtctaaaatagcaatgctaagcaatgccaataattgactgtgtataaataaatagactcatgcaacaatggatgaatgcataaacataatgataacaagatcaaggaggggtttcattcaagtgtaggtacacagttttataaatagcatgcaattttatttgaagacaacacatttataaatataggttcgatatgctcgaggaagggagcgtagtgacttgccttgttttcagaaacctatgtcttcgaggaatccgtttcagttagatacccggaatgcccacgttcaaagaataaccaatatccaaaacgtccgacaaacgaccacagaagaaccacacacaatcctaaatataaaataaaagtaatattcagtacaaactaatggtgccagtaaatagatcttgattttagagagattatggaagttgaatggagtcattcggaggtatggttcgtaagatatggatttccaaagtttggaaggatttgtaaaccgtggaggtagcactcctcggggtggggagatgattcagacttccagagagggttttgggttgtagagggacacaagatgtgattttagtgagcaaggaggctgatgatggtctcagcccgaaggttagatgaaggacattatacagacttctatagaggaattaatctctggaataagtacatctgaggtcccttaattttacatcgaatctgattatcgtccttaaccccaaaaccagatacaaccggtcctcaaactgtcaaaaccggtgcaaacgaggtcccttagcagttttgaaggcggttttggctgacgtggcgcctacgtgactggtttgaccaggtctccgtcccacgtggcgatgacgtggcaattatatctcgaaaaaataataaaaaccatgggcccacatgtcagccacacaaaaaaaatttaaaaacggtggggcccanacgtcagctaaaaagat

SEQ ID NO: 1651 - DNA, 2000 bp, Oryza sativa
aaaaaaaactatatgatccacatgttaataggacccacgtcatcacccccatttctttcccctcttctctcccttcctcctctccgtcgtcgacgcaccccctctcttcgccctcttctatccctccctcggctgtgagcctaggatcgcggggaggagcagaggcggccgggcgaaggaggcgggagtggggaaggccacgcagagctaggcgcaatgggagctcgaccatggccgtgcaaagcgacacaggagcggaggaggttggacggcaatgaaacggtgagtaaagaggaaaccgagtggggcaaggcgaagaggaggaggcccacaacggcgaggtgatggtggtccagcccgggtagatccctccgcggacgtgagaagaagaagtggagttcactggtgaggtcgccgttgggctttgggctcggccttccccatgctcccctacatcacccatcccctccccgctcaccagcagcccagtcagagtcgtcgcgcttggcgacttcctcctatgtctatcttaggaagcagcccgcccacagcgggaggcctgctacgcccatgctatagtcgtccgctgcagcgtttgggccgggcatggagctcattggtgacttcctctgtgtgttgctctgccaccggccgacctcagctccatcattcctgtctctgccgcgacgtcgcctaccactacatgggagagagtgtaaagaaagatagggagggagagaaagagggtgccaggtgggacctgtatttttttttcacgcaatgacatgcaaagcaccatgtagacgccacatgcaacaaagaccaagttaaagcaccacataggataaagagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatattatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaatctttttttattttaatgaaataatgttttattttcaaaaattcataacaaatatttagtaatttattccttattggttttcacaactcaaataatttacacataaaacatttctagcttttaacaatataacaaggacaataaaagtaatttctacaataactaacggtcaaactaatggtcaactaacggaatgggtatataagggatccaaataaaaactcaggggtatataagagatcaaacaaatttcaggggcgtagaagggattgggtgaaattacatgggcatatagggaattggccctaggataaaatcattgttccaaactgcccaggaacctgatttgttctggttttgatagttggcctatgttatgtcgcaagttttgttgctaagggatggtaataaaattcgacctatagttgagggacataaaatggaccttattgtcttacagatttcttgttacaatgggccttgaggtttaggggaaatagcccatcgacggtgggccacatagctagaattttggcgggaaaactagtgactgggtggcaactggtcgtccaaaaatatctcaatacggtctg

SEQ ID NO: 1652 - DNA, 2000 bp, Oryza sativa
  misc_feature (728)..(728): n = any nucleotide
  misc_feature (787)..(787): n = any nucleotide
  misc_feature (832)..(832): n = any nucleotide
  misc_feature (882)..(882): n = any nucleotide
  misc_feature (940)..(940): n = any nucleotide
atgttgcaactacaaacataccctgagttcacaatgagtcagtgccaaagataacggaagtgaaacaagaccaacaccacaggtgtgacttggaaacttggccgaaactctaggattgactgaagtcgtttgctcctagaagaactcatcttcgggttccatctcctcctcttcgagagttgggagtagatatttatatagagagcaagggtgggtactatatattatacagaccaaggtaggggtattaagtgtttaatgctagctttagaggaaaggttgtttattttcaagttttgaattcgtctagtgagtgcttctcgacgaccagagtgagagtgagtctcactcagtcggaggagtgtagtgtatcattgttggatcaacaacaatggctcctggccaaagagacaaaaggactttgaagctttcgtgacaaggtatttccaaagcagacatggggtcaccttatgccaactggaggggtctcatggaccaagaacatgttaggtctcagaccatgttgcaccaggaagcttaggggtccttcccgaaaccatccccgtgaatctacttgtccatcggcatcaaggcttccctgccctagctagttactcagttagggggtgtcccactcacccatgcggtcacactatgttatgcttggtgaaattttgaacaaaatcagtccttagatacgagaatggtaaaactacaccacaagtacntctttttaatacaccaacccttatgttggatttttcttaggattcacaaaaccaaattnttaaccactgtagatcattatgacattgagaaaggcgtttagttntgatactaaagagtacagctatttaaacacaactagatagacgacaaacngtgctttgaataactcaattagcaatggacggttgtgcacccacttaggaggacatgncgatatattgcaatatacgaccgagctcatgtgtcacctagagaagcgcatatggaaaattaaagtgcttaatttcaaattatgggccaatatgatcgaatgtgactttccttgatcaagattttgagcttcttcctcaatgaaatgagaaatgatttgaaattttccatgaatttgttgagagagttttgggattttttttatttgaatttgaatttttcgctggaattttggtttgatcagagatttggagggagatcttggcaacacagctactcttcaatcaaagaacaactttcacgatagggtttttaaaaattaaattttcccgctaaagccacaaagaacgagcattacagaatttagataggatttattcagatttgtaatattaaaatgtatcatagtctaaattagatttgtctattttgggataaaatgagcatgtgttcagctgtcatcaacgactcatcgtcgttgacttggataataagggcggcaacagtaccacgcaggcacgtgccatgctcttgtatttttcttgctcctataagctaggactcgagagattttgcagcttatatagacgtacgtacttgctgagttagacgaagttacatctgatctgtgcatgttctttgtcatgctatgcagaataacgccaaaacccaggcccccagacccaccattcaccaagctatgcagtataacgccagacttttggctcacgagcagactagcaaaagcagcaaatgagcaatacatgattgtacatttgtacttagctgcagtgctcttgaagctaacggagtactccctctgactcataagacgttatgatatttttaaaacttaaatttcgataagtttgattaactttatagaaaaatatagcaatcatttaacacaaaacaaatatactactatcaaaatataataaatgttaattaataaaattaatttgatgttataagtatcgttatagtttactataaacttaattaaagttaaaaatgttttttttataaaaagttaaagcgatcttctataatatcaaatg

SEQ ID NO: 1653 - DNA, 2000 bp, Oryza sativa
ttgagcaacgtactacttcaattcctgcgttttttctattcatgtgttttttctatcctgctaatcaaagggcccctaattcattttctggattctataactacatattctcagaatttatgtgacaatctgaactgtttaggaagctgaagattctgtgaaaagttacagctactaaaagctccctaaacaggcactaggttgtgtttgattaccggttacattttatcacaactatactttgttagctaagttatagtagataaaaatatggtagatagattactagctataatatgtggtaaagttaataaaaatataactatgataatgaaccgaactcaactatggtagcttaaaaaatggtgtagtaaaacgtgataatgaatcaaacacctctttaatccgtccagatcaccggcagtcggtgagattgcactcgatcatcgagactgtaggacatggccattttgttgactatcagcgaggaccctggaccctaaccaataaccatctagatgatggacaattacattgattaatcaactacagaaaaaaaatagatggaaaattctactttcttttctgacacaagcgtggctaagacactgtcgagaggacatacatcgtccgcattaatactgttgatgtaataacaatcacttgggtgatctactccagttttatacaaggggcggatccaacgtggatgcaggggggattcgattccccccctacacccacaagacccatggatacctccggagcaatcctttcaattttctcgccataaatgataaactaatggtccctaaatagctgtaggttaaagaaactatataattaagtccatcattttttttttattcctggatccgccctgtttatacacatacaatcaaccaaacgcatcgctggctgcacgagggatacgagccaccccaatgcagccaatcaaacatacccatactacatcagcagtaatgcattgaagctgtttgctagtgaaaggtcattgtcaggtagctactgattgttattgctgcatggcacggtcgatgcagagagagagagagaatgcgacccatacatgtgtgcagatgtgctcatcgatcgtcgtctccttgcaagcgacctgtcggttgcggcaaaaccaaccacatccacatgaacacacagtcagtaacattaacagtaaaattaattttctctgtacctttgatatataatgcttcctccgtcctacgataacttcacttttcactcatcacacatatcaataaaagggaaaaaagctagaatatcttctaatttaacatatcccaaaacaatcgcccccaccactttaataagtctcattatatttgcgatctactttcacaaactctaataaagtgataatctaaaagtatttgaggacagattagatggtgaaaaataaaattattttagaaatgtacgacctgatcgtgcctgaggagtaaacaaatatactacggctgtacggcatatatggctcgttgcgtccctatcgaaccaatgctattttccaagcaaagaactatgaggcatctagcaaatccacagcatcgacgtgaacgaatatgcggccatggaattacagtactaattgccctaattttttttcctgtagaaaggagtataaatgtataattaataagatgatataaacgagctgtggaagttgcgacaaagagaacaagggagccaagagccaaggatttatttatttatttctcctttttaacttgggagtcttttgctattttcgtcttaattaagccgtcgatatatatcttcctgatacttctgatgatactccttgaaatctttgtgataccttcgatatactcgttaatatacggtgatacttgctggcaagtacactatgatagttgttgatattcgtatgtactatcttaaaataaaccatatgagaaaaaaaagggggatacatagtaggattatatcctgccata

SEQ ID NO: 1654 - DNA, 2000 bp, Oryza sativa
ttttaattgggtaaaaaagctatatcttttgggaaatgttaaatatgtttaaaaaatattaagaaaagttagtgtgggattgattttagaaaatgaggataattattgatgttgtttctttcctccggctgtttgtttagggtatatttagatccttggtaatttttttcaccctgtcacattctaatgtttggacatatacatgaagtattaaatatagaaaaaaaaaactaattaaacagattgcgtgtaaattgcgagatgaatcttttaagcctaattactacaatgatttgataatatgatgctacagtaaacatttactaatgacgaattaattaggcttaataaattcgtctcgcagtttacaggcggaatctgtaatttgttttgttattagactacatttaatacttcaaataagtatctgtatatccgatatgacacgacaaaaaatttcacccttaatctaagaacagccttagccctcctttattcatgagacaatggtgattacgagctcctatacctcctactactagtagcttggtgatgtgaattgatggcagcatcaaaccaggtgaaggtggcatggactcacgcgtagctcgcccttgagggcttgaggaggcaaacctgacttgccccttctttcttaagacccaaagctaatatatgtggttaagtcacgtcacctcaaattaccatagccattagatgaaatagcaacagtttagattgcaagtctctacttagcttcccttccattaacagtagcccaatatacatgggcaagcccaatccactgcctaggcccaattcgcccgttcccactacactgccgagcgtttccatctacccgcgccacctgaataacggccgacgcgccggctccctacctcccgcgcgcctccccgcctcctcgaaactgctcgcctccttggtatttggagagacagaaaactaatcgtcgccgcacatggagtaaaatttcattagaaaccgtcttccacaggcataacagtcttctcgcattacttcgattggtttcctacttcatctccgtcactggaaacggcctctccctcccatgaaacctggagcagcccctcacctttaagaaatcacacgagtatacaattcttctcccaaaggtctgcttcctcctcttcttgaatcacatatatgttcattcaatttatggcctttatttctttttccatggacgctagatttatttgttcctcttgccactgaagttatcaaagaatagaaaaacagacagatggatttggttttgtcccttctttatgtttctactagcaagattgaaatttatttggtctgtatacttaaaggagtcaattcatggtatttataaggtttctactagcctgttcatggtatgtaaaccattttttcaactttgctgtacctataatttgttgtgtttctaaactcctattgcagttcgtccctacacctattgcctactatcattgtagcagcagctatgggctattactgaggtcagtacccataacattcccatccaaagcagcgactgattgggtttttccatatgattcctctatcaagaaaatatcccaatatattggtacctcatattcgttcatggtcaccggctttcaagatattattatatgatcatcctacgatatcttcttttcaagatattactaagcatttcttctgtaaaaacaccgtcaggattttcatgtatatactatcatagattgcaagtgcaaggttatgtgtgattattttaacaatgaacttaatttaggtacatatattggttcctggatctgtgcatgctatccttccttgctatatgatgtttctactttaagttcagaattgtaagctacagttttgtgattgatgtaactttattcttcggattttgttctgtctgaggtttcaatgtagtccaagaatgtaaatcacatcagccaatgtgatcaaccacaaaacag

SEQ ID NO: 1655 - DNA, 2000 bp, Oryza sativa
cggcggcggcggcagcggacgcggattagggcggcggttgcggaggtcgcgttcgaggccggcggcggaccacgcacgcggaaggttccccttcagattccatcattgaagaagcaggtagagcaagtgggcacctctgcgactcttcccttcccgtcaatatggagatcgaagcctgttaatccaatttattctccctctaaacggctttcaattcatcctctagctagataaaccacaagaaccatcgtccacgctgggaggcaaggcatcatcagtcaagcagaagcaatagctaggttggcgcatgccgtaggctgggttatcgacttcctgcctgagaagaactttacgaagcaagagcaaggcatgaagtgtgtttttctttgattcatgtgctcttaacagtgttacttacagatctatcaggctttcaggaaacatatatgctctttatcccactaaggtataatattttcttttctctctccatcgattgtgtatatagattccactgttggatagcagtcccacgatgcatctgcatgatgattcatataattggctaaccagtgtgcagtttttatcaatgtgtaatttactggatactcaattatgcagatgccatgcccagcaattgtataagaactgtaagacttgatcaatgttttttttaatgtatatgattggcattgtggttttctgtaggcttctgtcagacttgatctgttgaaaccaaccacaaatgtgctacccttttttccggtcatggtgctgctaccatattcatatgcaaaagaagaaatactctgttgcttaaataaggaacgctttcttttttcatatataagtagtattcatattcttctatctcatattacagttttgctcatatggaaatagagatagttagatgaataaatttgaagatcgtcatgggctcattaattcattgtggccttactttcaggttcttacctacctttccctcaggcaagtgtgctacaaactttttggtgacaaaagagagtttatatatgtggtccggggcacatttattttctttagtgaaccaactttacactgagatttatgctacatgtcttccttcacagtagaattattatcggttttgatgtttttagtacttatagaatggacatctcaatcagaatgtttcttccaaactgacgaacagaagttttttttttcatggtgtttgctggacttacaggtcaaatgctattttattttttggaagtcgattgacaaaccgtgcattcatctccgctcatctccaaatgataacataaaatctattacgtaatttgttgtttgataactttagagtagtgataactggtatttttatttttctcatgatgggtttataattttacctttgaacagttctttgactatgtgattgtctggcctaggtgacgttggtgatgagctgtgagcatacacttctatatcttattatttttagttctaaaattaattatgctgtactattctttgttttcagaaattgaatggtttgtcagatttttattcaaaaatattatattttcttttcacaaattgaacatagagtaccgtctcacacgctgctcatcatgttttttatactttaatgtacacacgaactatatagttaatgctatttttcttctttcattaagccataccattttaattatttatagctctatggtccacattgtcctttgtgtcccatcatcttagttttttcctttagacgatcaagcaatatttgatctaaaatatcataaagcaaatcatctcaattgcttatagttttctcgatgattataaaatatgcaattatatgaagcatacaaaatcgtgtcatttagttgaaagaacacatcttcatcttatatttattttctatgtttatcatacgaaattcccgtagcaatgcgcggggtttcatctagtataaaaaggaggagttgcccccctccaatccc

SEQ ID NO: 1656 - DNA, 2000 bp, Oryza sativa
  misc_feature (1258)..(1258): n = any nucleotide
  misc_feature (1425)..(1425): n = any nucleotide
taggcctcgttggcatgggcttctaccccgggccatctacgtgtacggacggaataatagtaaggaataagttcacttttgatcctcaactcataatattggtgtaaccaaggctccatcgtgtccagttttaactgacaagacaagttagcgtatgacccatgtagcctccgtgtgttagtgactaatcttcttccttctctctaccattctcccctcttttgcctatctctctctatggatagtatattttgttgttaattattatgtcgattatggaaagattagtgataattaaaatatttttttgttaattaaaaatttactgttctcatctcattctctctcatccagccgactaaacaaattagttgttttcctatctagccaatgattaagagataacgtttggatgatttttgtggtaaatttgtacaaagacaacagtgtatagtagaggtagatcctgccgagtcctaaccaatacactccagtagtaaggtagaaagaaaaacatacagatggcaggtgacaattaacaagaaggtactactccagtacaattgtacggctgtgatctttagggcctgtttagttggaaaaaaaaacctacataccacatcggatatacggatatatggacgcacatttgaagtattaaacgttgtctaataacaaaaattgcagattccaccaggaaactgcgagacgaatttattaagcttaattaatccgtcattagcaaatatttactatagcaccacattgtcgaatcatggcgcaattatgcttaaaagattcgtctcgcaatttcctgacgaactgtgtaattgattttttctacatttaatactccatgcatatgtccacacatttgatatgacagcgtgggaaatgttatttgggaactaaataggcacttagtctactactttcccaacttcatatccctcgttttttcattatatgcatgcttcccaaattgttaaacgacgtgtttttaagaaaatgttgaaaaattgctttaaaaatcatattattctattcatgaattttttagctaatacttatttagacatacgctgaaccgtcatttcgtattgcgtgcaatggaggaagtgttcacaacttcatccggctcagccgtatcaagccagcactacatacatatggtgcaggaactctgtgtttagatctatgggcgtaaagtttagatatacggacatatatttgaagtattaaacattgtctaataacnaaacaaattacagattctgccaggaaactgcgagacgaatttattaagcttaattaatccgtcattagtaagtgtttactatagcaccacattgtcgaaacatggtgcaattatgcttaaaagattcgtcttgcaatttacacacaatctatataattgttttttantttatttatatttaatactatatacatgtatccaaatattcgatgtgacatggtgtaaaattttaccagggatctaaacaggcccctactccaccaaaagagcacaaacatggtaacactaacaccccccgtgctgttctacagctgtaacaaacacatacttcctccgtttcacaatataagactttctagcattacccacattcatgtctagatttattaacatctaaataaatatgggtaatgctagaataaatgaatgtagacaatgctaaaaagtcagtacattataaaacggagggagtaataaaaccaggaatttacacttggcgcgtacaaaacggggaaagccatgctggcaaattcattccttccttgcatacacccacagccaaaaggagttacatgtaaatcttatccccttgggagtatttttttcccccttacaaactggtcccctgcagcaaatgcaaaaggccacccagtccaggagtccaggcaggcaaggcagaggcacacacacctcacctatccccttcccttccgccgccgccgccgccgccgccgccaccacg

SEQ ID NO: 1657 - DNA, 2000 bp, Oryza sativa
tgacgagctacacggtgcttctgtcgtcgctcgtcaggacaggggacgacgtggacgagctgcacagggccggcatagtcgacaacatgctctccaacaacgacgacgcagcgtccggcttcttccagcgtctcggcgactgcagcacgatgaactacgatgaccacctgttcggcgcgctcttcgccggcgtgaagcggtaccacgacgcgagctggcacaggcacaaagccaggtttctgcgcgaccactgcagcaatccatggtctgtcatcgccttggggctcgccgtgctggcatttgtcttttccctattcaaccaattagttgttatccacagtctaatccaccataatggatagtggatagtgatagtgtactgcatgataaattaaggagtactagtattaactattataaatttgagagatggatttgtttgatattttttaaggaaattttatataacaggctatataaaaaatgagagagtggccaatctaaaaagaaaacccctttagaacgaagcctgaaaagattgcaacgaaattagcagcagcaagaatctctaaatgattttgtgctcaaaatcgacagaaagcagtgagtatgtgtctacatagatgtagcgaaaccgttaatgtattaggcaattcccttgctttctttaatttattggggccacctgaaatcctgaacatacccgaatgtggttcgctagtagcaataatcctatcggtttttgctatcatgctgtccataagatccgagatccatgatgatagggagaggaaaaaaatttcaagcataaccctatttttttcatacttttgtccaaatatgattgtgaaaattattttttgcttaacccgaacatctttgcattttacaaagtgagtgtaactcaattgattaggtttctagcaatgaaacctgccacacctaggttaagtctagacttgacacgggtgttcgtatataggactatttttttttcaatggtaggcgatgtattcatcgacagcgaagcatggtgaattcgtaaatctcaagatataccggcctagtttttgaaggtactgataagggtgaggtgctagtatgtgcaatataattggatgtgtgcgcgtttatataatttcgtgcatctacactgtgtttcggaaaaaaaaaatagaaaggacatctatgccatttttacacgtcgctagtcttttagtctatatatgtaaaaataaagaggtatcagtgaagatggtacttactccgttttatattataagtcgttttaaaaatattgctatatttttctttaaacgtgattataattaaaataataattagaaaaaaatcaaaatgacttataatataaattataaattataaaagaataaattgtatccatgctacatcaacttgacagttaaatacaatttggtgtaagaacttgagaaaccgagtgttctagtgaaacaacttggcaggtagatgtaatttagtataagaactttataagtgatcatataaatacaacaatttgtaaggtaggtacgattttgatacaataaattaagaagttatgcggcaacttaatatcattttttggtgtataagcagatttatatttttatcctaataactattaattgaaagtcaattaaactggatatagaaaaccttatatttcggttgatatttgagaaagtgaagaaaacaaaaaaaaatcttaagaggtaattggatgtaaattatatgtgcagtataattcttaaatattaaattcaatattataaggtaatatccgtaggattagtatgcaatggcatattgataacgttaaaaagattcatctagcatatacttagccaagttgatccactaaaatactaaattgtcaaagtctcgtacttgaacgtatcctcttgtcaagttgttgcactcagatgtttaattctcaagttcttatactatatcgcacctatctgccaagttgttatatg

SEQ ID NO: 1658 - DNA, 2000 bp, Oryza sativa
  misc_feature (137)..(137): n = any nucleotide
  misc_feature (148)..(148): n = any nucleotide
  misc_feature (387)..(387): n = any nucleotide
  misc_feature (394)..(394): n = any nucleotide
ttctcgacgtagtcgtacttcctcgaacgcgcgtgcgcctcggcgcaaccgccgctaccggcttggccatggctgcagatcaaagtcaatcaaaagtccaaaaaaaaccaaccgaatcgaatcaccacgcggccganacggttggggntaggtttttggccgaatcgatggatcggctggtggattacctttggcagggcgagccgaacgaagccggcgacctctcgccgagttgtccgccgccgccgccgccgccgccgcgtcgagtcgcggcgattctcctctcttctcgtcgtacgtcgcggcggagaagggaggaggagggtttggtttggagggaagacggcgttgaaacccgcgctgattttgcggggatctttttttttncttcttnatttttgcgggtatttattttgtgggggagacaggtcggtttgatggacgaaccgactttggaaacgtgtactacagtgaaaggaagcccacgtaacctcaggcccacaaggcccatctattttgacggttttgctgacgtcaaattttcttcttagatcgatttttctaacgaaaggcgtagtgtgcggttcgttacgtacgcggcattggactcgatgatgaccaagtgagggtcttgcatacatattttttcccttttcactgtataaactgaagtgattagatgataactctacttaaatgcatatgggagagatatgtgaccttcgaaaattacatactaattacgtgcaagttatattatagttacaatataattatattgcaaacgtaccatatttaatttgacaatagctaaatgtacaaataatatctgaatgtgataatttaacgctatttcacgaggggataggggttggcttttagtccgtgtgtctatgtatataatttgtatacatgtatatcaagtttatacgtatatgtataagtgcatacttttaatgtataaaatttttatatatatataaacaaaactttgtatatattcatacaaactttatacatatgcttacagagtttattcatatacgtacaaactttgtacgtatatataaaaatttgtatatacacgtacacatatatgtacaacaagtactccgtaccatatagaaactaactacgtgcaagggggccgcgcatggccgatcgttaattagcaatcttggtttcaacgtggtctacttttatccactaagatagtcttatatgtcatcctcaagtgtcgattaaaataaattggtaaaaaaaaagagtcaaattatcaaaattctcaaggttaccatatctataaatttcaagaaagggtttgtaagccacttacagaaattgaattctagaaattaatttttagggtttttcaattattatgttctactttttcagttttgtcttttgaaccattattaccaatataggtcttaccttaattttttattactttgtttatttttgtacgcaaattttgaaatagaatcacaaccttagaattgcattgaggaaaatcattacaagctgcaactatatcatgagcaggttatgcgcacagtggaaacattgcgtccaatctgggaactagtggttgcacccgtatgatttcttactagcatactttcactcaatttttttttttgaagcgaaaatttcactcaaatatttttttttctgttcaacatttttcatcatgagcacaaatagtttggaaatggtcttctccccaagattggtcatcatcagtatcctcgaatgcacacgcgaacaaggtggccagcaatggtgcaaaatagtttgatctactgtatattcgccaaaactccatttttttcccctagagaagaaagggttcagacttctgaatttacctgctatgtttcatttttatctgaccatttgatagatgccaacataaggaaggaaaatgaaatattcaaggtccataagaaatgaaattttcagagaatgactaaggacagcatgaaagcttgtta

SEQ ID NO: 1659 - DNA, 2000 bp, Oryza sativa
  misc_feature (14)..(14): n = any nucleotide
  misc_feature (22)..(22): n = any nucleotide
cgtccccgtcgacntcacccgntgcttcctcgtcggcgacagcgccggcggcaacatcgcccaacaacgtcgcgcaccgatgggccgccgccaccacctcctcgagccgccgcgtccgcctcgccggcgtcgtcctgctgcagccgttcttcggcggcgaggagcggacggaggcggagctgaggctggacggcgtggggccggtggtgagcatggcgcgcgcggactggtgctggagggcgttcctgccggagggcgccgaccgcgaccacccggcggcgcacgtcaccggcgagaacgccgagctggcggaggagttcccgccggcgatggtggtggtcggagggtacgacacgctgcaggactggcagcggcggtacgccgggatgctgcggcggaatgggaaggcggtgcaggtggtggagtacccggcggcgatccactccttctacgtcttcccggagctcgccgactccggcgagctcgtcaaggagatgaaggcgttcatggagcgcaacgcgccgcccaaatcgaatgcttaattagaagcgttttatttacctttggcatttcaaaatgttaacctggactgctatttcatatatattttgctgaaatttgatcaagttttgcgatgatgaattgctctgtgaaataaacagattttactttttttagataatgaaataaaacatctcggcttttgctcatcagagctacagccaattattataaaagtaacacccaaacactgaacgtagtttaaatgaattaaacatacctaataaaataaaaccgattttactagcagcgtattttttattccgatttcatcgcatggatcccatgatgctgacggagacattaacctaccatacgattctgttcacgcggagcacgagcacagctgcacatttctgacttctttttgacgcgacaagagaaaaagagagagagagagaggaaggctgtgttttcggtgcaaagtttagattttggttgaaattaaagatgatgtgactaaaaagttatgtgtgtatgacagattgatgtgatggaaaaggactgaagtttggattcactttagatctaaacacacagccttgaaacatgataagaattactttttgcgacaagtaaaatcagtctgacttttgagacgtacgcgacgcattacacgtcgatagaaaaaatcaaattcaaaagctattttgaagaacacttttcgtgtagggttctatccttttcttacaggctctcgttttgagcctataggattagattctcctcgttttctgttagcacgcttttcaaactgccaaatggtatatttcgtgcgaaaactttctataaagaagttgttaaaaaaatccaacaaatttattcataaaaaagttatatattaataattaattaatcatatactaatcgcatttctcgttttgcgtgcgactaaaccgtccaccgccccagccgaaacaatcgcacccttattgggccagaaaatataatcattgtgttatcatacaattatttcgtaagtttaaacaacttctatttccaactttagtcgtctattacacggtccaaaatgaaacacactcttttgtttaatgatattttctaattaagtagagggcgttttgtataaaacaaatgtttaatgatttttttcacgtgtgccaaagtcgaacactttaggagcgtatgctactacaaaatcgatcttttatggcgtcaccttattattttctccggcggccatacgtgaaaactaccagcgacaatggggctatagaccgccagcaaaaatggatcttcgctggccaacgaaagtgtatctttttgctggcggctcactttagcgatttccactggcggttgaagaggactgccatattaaaagatcagctctctccaccgcacctaactctttactccctctccatccctatcggtacgcactccttccctacccctctccttctccttccctgcag

SEQ ID NO: 1660 - DNA, 2000 bp, Oryza sativa
  misc_feature (119)..(119): n = any nucleotide
ggacgccggcgatgggtgctggcggcggtggcggccgtgagccctgtcacactctaaaatttagcccaaatttccagactattttgtgttttcctgtccaagaattagccaggggtacncaaaacggtaagtaatatacagttctaaacataaatacttacagaagaggcacttaatccttacaccgaaatgaaagcagcagcagtggaaaaagacgatcctagtggggcttcagctccactccacaggcaaaactcaactggggtctgagccttggtcatctaactctgtcttcaactcagaagcactacacttctgaaaagggggaataatagcaaggctgagtacaaccaccgtactcagcaaaccacaccaatgatgcagacgtgcaagtggatttaagaacggcttgtggctatttgcataaaggcggttgtaaaacattttattgagtaaaacagtaaaacagttggttaattaaggtaacattaaatctccactgatcaatgctacatcacgttgaacaggcccaaccaacccatatgaactacagtgcattgagtcgatttattaagtgtgagactaatcacggtgattctggtcgatcgcccataaccgcgggcacggctattcgaatagtttctctggccagaggtgcacaactgtacctacaagacacaatccatcagcatgtcaccgtgcccggccggaggcgtcaccatgtcaagtgattgtgacaagacccttcatattaccctctctgaccaagcacaccataccttaggtttcaccccgcccccagcaggcagcgagcagtcccctctcgtgcctaggtgaatctggaagcgacaaaggccgtcgcagggcccatcccgctccatcacgcccaccattgcttagatgcgtcagccagagaagagctatacttcaagtcaggcagttacccattcccgcttgtggcaagcattgtatgtcttccagtgcatcccgtgaaccggtccttaattgctatgggtgcgaccagcaaaaccatgcacccacagcccaccattcagtcgcattttagttggataattacggccaataaaacatggccgggtgtctcgagcacgcagctcgttctgataccaaaatgtctaatactgtaattatcccatcaactgagctagtggtaattaagcatggctaagcatatagttctagctaggtcatcaaagtaacacaagctagtcgatttatcacccaaggttgacgaaggacaagcaagcagataggtaaaccctgatcccatgtaattagcaaaacgatgcatatttatttgcaaacagtaaaacatttataaattgggatcaacatgctcaagaggaatgtgttactttccttgcttcttcacaacaatcttctgaactcttttcctcgcgatcgcgatcttccgaaacgacggattctacacgctggcatgcaaaacaagaaaaaaaacctaataaaaaccaagaaaacagtacataaaaagtaaacaaacatgtagagctcaattttagatgaattttgcaagttgaatggcccaatttggagttcgtatgaattagatatgaattttagaagttttgagccatttatatgaatttatagaattattaccgatttattgcgcaattaaaatggtttatgatgtcaccgaggggaataggtggcgccgacaagcgggccccacctgtcagtggctcaaaggaggtcggcgcacggtggactcggtccacgcgcgcgttgcccacgggcgcaccatgtggcagcctcgtggtggccatggcggacgggctagcggaggtggcgccacgagagcacccacgcggggcggcacagggaggccacgtggacggcccagatcggctaggacggtcgatcgaacggccacgggcaggcgcggcgcggcaaaggggccgggcagccacgggcgagcagggcggcggcagccggccggaaagcggtggcgctcggcc

SEQ ID NO: 1661 - DNA, 1770 bp, Oryza sativa
  misc_feature (204)..(204): n = any nucleotide
ttatatatcatataaaaatatactattattatcctatcagtttgatttatccaactaaacgtcgatacgcgaacggcggccgcatcatcgcaggcttgcacatacgatgattgctccagttcacatgtgacgccgtggcacggagaaataccaacgtaccatttcattgaacttcgccaatttctctcgtggttgttttctttnctctttttttatggtatgtgagggtagaatggttatttcatccctatcattgcatgtggcacacctatgaggtatttttatgggtctaatgactatgttaagccaaacgattaattttgggaacctttttcaacgatttgaaacctcggggactgaattgatccaggaatgaaacttcatggactgtattggccattcacccttaaagaaatacttcctccgtttcataatgtaagtcattctagtattttccatattcatattattattaatgaatctagataaatatatatgtctagatttactaacatcaatatgaatattggaaatgctagaatgacttgcattgtgaaacggaggtagtagcaaaaatacccttctgttgctaggaatagtaaaatgtccggtcgttactgtggactcaaacaacatgattattttaagtaagggtcaaatacccaatacccggactcaatttagttcctaacatttcctattatccaaaatagtcctacaaatttagcatacgagtagttggatccaccggtgcatgcgatgtcatctcaacatgtaaggtcaatatttaaatgtccaaagcaaccctacatttatcattagaaagaaacaatcaaaaaggaaaaagaaaaaaagggaaaaaaaagggccggcccggccagcgttgtttcgtccttattagtttcattaatttgttttgtttttctctttatttttccttagatctattttttttagtttttgagactaccaaaaaaattgttgcaagtttttcaagggaaaaactttcaaatctaaatataatttcactatagctataatataacttatatataagtattaaaataatatatacaactttatatctaacttatatagagattacaatggtagcctacgtacagtgcagttacattatagattacagtgtaactatagtgtaattataaattataattacacaacaactatattagcctatagtttcatttgaaagttttttttttgccaaaaacttgtgacattttttttagcaattctttttttatcttaaatggcatatataaggataggatagacatttagcgcttaccttgcatgcgggatgaggattacatggcatacgaagtggtgctcccgatgagtccaaggaatatattgtgccgcataaaaaaatatagcattactttgcacaatatgaaacaacaagaatatttatgggacgcgctaagtaccatgaaaaatgactatatatgaaatatatagatagtagatttaattagatccatgcctttgcaaagtctatggttaatttgaaaatctactgacactattgattcatttgtaactatatatgccattacaatatatttaaaactagatccatgccactttgtacatctcgactatgatttgaattgtttttttgtcaccgtattttcatgtggatcgaagtgcccatgcccccgatactgtgggactcacatatatgcgcgtggcatggtgcagcggcgtgcggcagcaagggtgaggctcccgtcatgtgcgagc

SEQ ID NO: 1662 - DNA, 2000 bp, Oryza sativa
cgcaaatttattcccccctcagggtcagcaccttgattttctttattttttttgctccttttctcccaccaaaatcatgtgagctgaaaaaatcacatgattgtgtttgaaaaaacagctgtgggctgtcactttctaaaaagtagctgtgactctgtgaggaagtcaaaagctcgtttggttatacataggtgggcttttgaataactagtcccactgacaagtgggccccgcatgtcatacacatgttgaaacaaaagaagggggagagatggagatggcggcggcggtgttatcgtcctcggtgtcatcggcctcggcggcggcggcgtgtcacgcccagaaattcccgaatagaattccaagcagaatgtgcattaaaacccccgtccaggaccggccggggtacacaaacgacaatgttgacatacagatccacgtcttacaaacaatataaaagtcttacataaatgcagcggacaaacgaaagataacaggagctaagccttgacttgaactgcagcgggaacaccactccacaggcatcctcgacggcacggacgaagcctactcctcggagaacccaccatcggacacatactcatactccggggttgggggaaaatagagtaagactgagtactatccactgtactcagcaagtcataccggaataggggtatgatgcagggatttaacaagggatagctatacaggttcatttgcataatactggcatttataaacagaagttgaatgcggataacagttgtaataattaatcaatattaatcatccactgtccaacgttacaccacgttgcaacaggcccaaccatccacctgtactatccaattccattaaactaaactaggatgggactaatcacggtgaatctggttgaccgcccataaccgcaggcacggctattcgaatagttttactctgatcagaggtgtacaactgtacctacaagacacagccccacgacacgtttccgtgcgccgacatgccaccacgacatatcagaaagagactgtgacaggacccttcgcataaccccctctagccaagcacaccacacctcaggtttcacccccgtccccagcgggcgacgggcagtcccctctcgtgcctaggtgaatccggaagccgcataggccgtcgcagggcccatccaaactccatcacgcccacccttgcctggatgcgtcagctagagaaaagctacactacaagcccagccgttgcccacgctggcttgtggtaagcacgataaattcttccagggtttcccgcgaaccggtccttaaatgccatgggtgcgactagcaaaaccatgcacccacagcccaccatgtgattcattttaattaaccaacaccaaaatggtggtactaaaccaaccttaccaattgaacctaaagtctatattttaatgagatttcctcattgtgtgctagtggaactaagcatggcgaagcaattcctagtccaaaatctattcatgttataacccaagctaacaaaggagcatggtatcaaaaatagcatggctgtaacgataggtaaacatcccatagtaatattgcaaaacaaatgcagtatttgaaggaaaacaatagaacatttgcaatgtaggatcaacatgatcaagtaacaagcatgacttgccttgctctactgctggaggaacctcggcgactatttcgaagtacaccggagcgtcagaagaaccggatatctagcgacatacaaggcaaacaatgcaaacaagctataagactactgaaacagagaacaaaactatttttaatggattctacacatttttcttgatttactgagacttgaatgggcttaaacggagctcggatgatttagatatgaattttagaaaattcactgtgtttttactataaacagaaaatccttaattgaattattgcgcaataattaaatcccgacgagagagagggcggcgccgacatgcgggcccc

SEQ ID NO: 1663 - DNA, 2000 bp, Oryza sativa
tctggacacttggttaagtgagaaaccatgtgcataatatgtgaacacgctgagtatttcctcgaacgatcgacatttgaacattttagttaactgaacgagctaatctaactttgctatatatacccaatttggtaagcgtatattaatcgatgtttggcttgcggtgcaagtaaaaatgggcgccctgatcgactactgtgcatgccgtacgttgaatcactctacggtcttgatcagaaaattaactaagagctagacataacattgtagttaccactaattcatcaggtccattagtgcttgacttgtagtgttggccatgcttacgagctaggagacgtgctcgtggaagcaatcacgcaaatgaaggtgaaagtgtaacatataatgtgcaacctttacaagatcgtgctttaatttgtcacagcttcagcttaaaacctaagctaattttgaagctcttgttaaagcttcatgaaaagaaagccaggcaacacagagtgacaaaaagggtccttaacactctaatcatctacacgtggacttatatataagcgattttgatttgttttcactataaatttatagtatgttattttaatcttggctttcaaattacgaataatacagattcaaaagttttgtctggttcattattttttctacgacttatcaacaaatcgatcggtcgaaagtaaattagaaacaggaagattcaacttttaaactcaagtgacatcagcaagcatgctccaagtctggtgaccatgctatagcaaaccatttttcatagatcattttaagcacatgataaatttcaaaaatagaaactgagcacatgataaacaatctttgtgccacccaattttatgatggtttttctcaacagttgcagtccgaagaggcgtactccattgtactacgatccaatagtggtcgtcgaatatatgcttgatataaccaaaacaggcatcccccataacttgattcgactgagggaattgctaaagatactgattttatatcatttttgttagcatttttttaaagtggtaaacgtcctactttgtacgggaactttttatataaaagttcttttaaatatcttataaagtcatttctaaatttaaaataatttaaacccaattaattagtaatatgagctaataatattctcgttttacgtgtccaagcttaatatcctcattagtgtaatcaaacggagagtgaacatcctcatttttttccttatatttatacttgtcagtcaaaattttaattttcaaccttaaatttagagttgagtttaagatttttgttcattatagttatttttcagtcttttcttttagataatttaaaacacatatatgaggaggagagctagggttaatatctctgcacgaatcttaaagcatattcgatggtccaaaatttaaaaaataagatgtgagattttatatcaatagatatatagacaatacaataaaagttagagttttatttacaaattatttttcgttagcaaatactccctccatttcgaaatgtttggcaccattgactttttagcacatgtttgaccgttcgtcttattcgaaaacttttatgaaatatgtaaaattatatgcctacataaaaatatatttaacaatgaatcaaatgaatcaaatgataggaaaagatgtaacaattacttaaatttttttaataagacgaacggtcaatcatattaaaaaataatcaatggcgccaaatatttcgaaacggtggaagtattccgtttcgcttttacctcgaacaaaccacgatggaggtggaaactttccgtgtggccggaatgtaaacgcgatccccgaggtggatactgacagcgacgtccgccttcttcaaaccgggcacgtgccacgacgacgccctatccaccacactatccacacacacaaaaccgcattactactcgatcgccggcgtcgcggtcgccatccgccgcatgc

SEQ ID NO: 1664 - DNA, 2000 bp, Oryza sativa
accggtgtactgtgttgcgggagaagatttgggattattccctttcggagcaaactggatagttttggaggcaagatccagcactgaagagcaagtcgatatataggccattatctgagaacgaaagatgtttgcttctactccttgcgaacttggcaatacggtgaaaaatatatactacaggtgtcgaagcaggcggtgcattttttaccttcctatgggggagaaaaacaatgcgcttcctcccccgggtctgtaattaaataacatggcaaaattttgtccgtgcccgttcccgttgccgtcgatagccaaattgctctcgtcgttttccatgttccatgtacgatgcggaacgatggaatatctggtcgaaacgcaaccgcgcaccgtacgtgtacacgcgctcgtcgcaaacgtgcacggtttgcacgagtggccgacgtctagcgaaagccccagacgcagagccaacgacgcgcgcacgctacaccacaccgtggaggttgtcagccacacgtgcaagtacaaccacaaccgagggccaggcggtagtggacaccgcgccacgcccgctagtcaatccacgcgagtagtacgcgactagcaacggcgtgtacgtccgtgtacgacggacacgatgcctcgtcgtcccgtacggctgcaaccaggcaaaaaccggcgcggtgaggccaggtccgcgcgtgcgcgcctcgcaaagccgcgagtcgtccgtccaccagtccaccacacgggcgggcatggagaatggagaaagagaaaaaagaacaaacagcctcggtcccgtcacaaaagaccgacatgcggggcccatgtaactgaccccgacacgcctcattcccaccccgcacgtgcgccggcagccttatctctcagcgcggtggccaggattctctgcgtccagcgacactgtgaatggatttgcatattagtagtacactttataaatcttcgaattcatcatatataattttcataaatcttcgaattcatagtattactccaagcatgtcatactccctccgtcccataatataaggaattttgtgtttttgcttacaatgtttgatcactcgtcttatttaattttttttaaaattattatttattttatttgtgacttactttattatccacagtattttaagcacaacttttcgttttttatatttgcaaaaaaaattaaataagacaagtggtcaaacgttggaagcaaaaactcaaaatctcttagagcaaagataataatatagccaacctgttggctataaggttctttgtagccttctcttagcctactcatataatagttagctctttacgattaatacagggcccacttgtctttctcacagagtttattagttcttatgttcaagccggctgtaagtttatagcctgcttgtcctctctctcctctcttttctcctccatctcagcatttagccggcttatagcctactattatacttgctcttatatcgtgagacggagggagtcaattcggatcctctactgtagaggagaaattttcagaggtagctacagtgcccggcattaggagtactgtgaagcgtccgatagaagatggatggatcagatgagatgctacagtaaatctgctacagcactaaccagaggtgctacagtacattcatcccctgtagctacagtaaatcgtgactgtggtgtgcattagaacactgttcccctcacatattagtgtagctatagtgaccctctacattactgcagaggatccgaatccggagggagtacctcaaagtagggttttttatgggagtacattgttttgtacgagtgcggtgttcgcagaagatctttttcatattcctcagctgctagccgccagctctacggatggcacactcgtaaataactcgggagtacgtgccggtttggtgcgctcgcgaaaccacaagccgttagtagtaagctccggtggtggcgccttcatt

SEQ ID NO: 1665 - DNA, 2000 bp, Oryza sativa
  misc_feature (24)..(24): n = any nucleotide
actgcccgtcgcccgctggggacnggggtaaacctgaggtgtggtgtgcttggctagagggggttatgcgaacggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggccaaccagattcaccgtgattagtcttatcctagtttagtctaatgaaattggatagtacaggtggatggttgggcctgttgcaacgtggggtagcgttggacagtggatgattaatattggttaaattattacaacagtttttcgcatccaacttctgtttataaatgccagtattatgcaaatgaacatgtatagctatcccttgttaaatccctgcatcatacctctattccggtatgacttgctgagtacagtggatagtactcagtcttgctctatttccccccaaccccagagtttgagtatgtgtccgatggcgggttctccgaggagtaggcttcgtccgtgccgtcgaggatgcctgtggagtggtgttcccgctgcagttcaagtcaaggcttagctcctgttatctttcgtttttccgctgtatttatgtaagacttttataatatttgtaagacgtggatctgtatgtcaacattgtcgtttgtgtaccccggccggtcctggacgggggttttaatgcacattctgcttggaattctattcggtaatttctgggcgtgacactgggcgatagagatagagatgataaggcacgctcctctcctcactggaatatctccctcccacaccctctggcttgggtcggctagattaaaaaccgacatctataatatattatataaaaaaattagtttggtgtcgccgaaagtttacaagtttataaatataccatcaaaagttttagttgccttccgtttctataatttttttaatatgtttttcatttgctttctgccaaataataaagagaaactaaaggacggatttgcccttatcctcctgaactggattgatgcgtccgtatttatcgcgagtgtgcgtctcggcgacttgcggtgtcagcctgcagccgcaatctcctttccaccagccagcgctagctagcggtgaagtggctggtcttgtcacaaaaagctaatcggtgaccagtcacgcgcgccctcccgcgtgattgaacacgtgtcgcgcgcagaggggggcggcggacggtacccacgcggaggggttttccgggttttttattcggttttctctttctattttggtttttttcggtttctcttctttttttttctttttaagatgtacgtatgcaaagtttatattcgtatgtataccaagttttgtatttgtacgtatagaaagtttgtatttatatttttttctctcggtttttaatatgtacatatgtaaagtttatatatgcgtaggggtgaaaacggtacgaaaacggacggaaacaatctttacctttttgttttcatatttttttcagaattagaatcggaatcaaaaactccggatacgaaaacagaatcgaatattatcgaaacaaaaaacggagcgaaaatgaaccggcgcgaatacggtaacgaaaatttatcagaatacaaaagtccctcaagctaagcttcaaactttgtcaggtacaattctcaagttttaacaatcaacaatacattacaaaacacaatcatatcaaatgaaatattttaatggggcccgactgtaagccggtcaacgttgagtcaagggctgagggagaggcgtgggtcccactctctttttattttatcttcttttcttttctttctctctttcctcctcatctcttttctatctctccctatatcttttctttctccgcttcttttttctcttgtgcttcccaaccaggtagagaggggatgggcggcgacgcagggggatg

SEQ ID NO: 1666 - DNA, 2000 bp, Oryza sativa
  misc_feature (108)..(108): n = any nucleotide
aggaaacattttgagcagaaatcgagtaaacattaagatacacagccatagggcctcttgattccgcagctgtctgtaggaggctaggagccaacacacaagaaaatnaaaagaaagggaaaatagtgatgctaccttggagatggaggttgggagagattggctgagaggaagccagacctgtgttgtctgcgagcgggagaagacttaatcagcatcttcagtccacggtaagtgctgctagcttaatggatcaccaaaaaacagctttattaaccatcagaaaggtttaaaacaaaatctttttactccatctaccaaaagcagaggatggtggaaacaacaaaatctttttactccatctagctttgatggctaaatctcgcacttgagagcaacaagtgatttgttgtaataaccaggacaatacagactatattggttaataaaatccaaaatggagtctgtttggcaatggaaaacaagcagtcatgtttacaacactttcattttctcataatatttttttgggagaattgtgtttataccccagctttcaatctcaattgtgattttactcagttttttagcgtttgcaattttacccccgctttctctgaacgaagttgccgtttgcccctactatggatggcagttaggtgggtcccacaatattcagttaaggaaagagaaattagaagagaaaaataattttggaaatatgggattaccattgtacccttaagtaatatatgtgggtgtgcatcagtacatgttcgatatcctccttcccccagatccattcccatcccgaagtccttggcgcggcggcgccagaagcaggcggtggagcagctcttcagcgcggccgggagcaggtggcggcgcagctcctcggcgtggccaggagcaagctgcggctccaactcctcggcgaggccggaaggcggcggtgatggctcctcaacacggcgtcgcgagcagcaggaggcggcaggagtacctggcagcgacggcgatcctcagcgctatggcaggagcagcaggcgatggcagcgactcctcggagcggcaaaccattggtgatgaatcctgctcttgacgggttcatcagatcgaaaggacttgaccaacatgaagatacctgatgtggctgatactatgcacttatgcagtaagacacaggatgttaatgaacttaccattcatagacatcattcatgttcatgcaatgtggcgccattagattttcatacggattttgaatcatttcacgaaagctcagtacaaaataagggtaaaaagacaagtgttgtttaaaaagtaggggcaaatatgcaatagctagcaagggcataaaagtcttttcgtgctcgacttaaccccgttaaattgaccatccaaaccagggacaaatctctacttcgtttcaaaaaagtaggagtaaaaacgcaaaccctaaaaagcgagggcaaaatcacaattgaacttcaaaataggggtaagaatgcaatagcccctattttttttgaaggaaattttctgataatttagaaacatacaagacttcatgacattttctgataatctagaaacatttttctgataatcccaaattggtcaatctaaaagattaacacagacagtatatagtgaagaagaattgcagatcatcaaccatatcatgtatttgtatttgtagttctagatacaacatactgaaacactgaataagtacaaacttcttccttagctttaagggaatcaaagccaaaaaaaaaaaatccaaaacatgaatccctaaccatcacaagataaatcagttattccatacccaaaatcataggtggtgtagcagaggcggacatcgacaggaccaagatcataggtgacaggaccaattggagagtccctccagactcccggcgtcgacgccgggtgggacggctgatcgcgaaggagacgggcaagacacgatgacggaggtggccagggcgctt

SEQ ID NO: 1667 - DNA, 2000 bp, Oryza sativa
  misc_feature (839)..(839): n = any nucleotide
  misc_feature (845)..(845): n = any nucleotide
  misc_feature (1144)..(1144): n = any nucleotide
ggatgggtttgtcgcgcatgtacgccaccactgtctcctcgggaagctcatcgttggagcccctgtgcacgatgttgaacagtcgcggcgcctgcagtggcgccttcgccattcccgctgcgcctccttctcctcccccgaccaacgatcgtgcccccgcgacatcgcagtgcacaagacaagcaccatcgttgccgtggcccctgcacccgacgatggtggtggagaatgagaagcgtcgctggagggagagaccggagagaggtagggaaaagagaagagaggggagggaagtgaagaagatgaaactgacagctaggtccctcatgcagttgaggttaacggagattttcgacatatttttgacagattcgtaaccgcgtgccacacacattttgcaaaattggaaaccatgccactgccatcacattttccatccgtcttcttccttctctcttctcatcttcttgctttgcgagcgtcagacatcggtagttttgtgacgattgcggcagtcagcctccgcggctgtgaggaggtcagcgcgagggctctggcaacggcgagggagagaggcaggaggggttggcagagagcgcggtcacccaacgggctgacacgggggatgtggcctccagatctaaagaggagacaaggagctagagagagaagagaaagggacaggggtggagagtggaggggggcaccaccggcgatggaagggagcgtaggtgacaaatggtagcgacggtggtggaggaggaggagcgacgacggtggctgtgaggaagtcggcccgaaggtgggagcgacggcggcaaccagcggcggtggtgganggggangaggagcgatgggggcggagggagcaaacgactcaaccgggctgcaccgcccgcccttgtgtgcgccatgaccgtttgccaccaccccgtctccggtcgctctggcctcgacttcaacaccgggtgaggaggcaggagaggatggtgatgcgtatcgggttaaggagggaggagcggatgagatggattgctagggaggctgagaggtggtggagagagatgggaaaaacaagagggaaggatggaggaaaaagatgaatctgataggtgagacccacatgcagatgagaaagaagatngaaaatgtgacggcagtggcacggtagtgacagcaaagatgttggccatcgagatcttctgcgattacttcacatcatagttcttcctttcagccttgatcacacacagaaaatcctaaacgcatgtaaacctgtacacaaatatgacacaatgcatgtgaccgaataaaatttgtgcaaacttattaactttggtcaattaacactctaattgcatttggtcaattaacactaattgcttatcagtacgaaaaccatcagaagctgactaaccaaatcacagtgaaccaatatttatcatttggctaattgtttggctaataaccgaattgtgcaaattaaactctcacggctatgtatcaaatttggctcagtgtgattactatattggatgcgtgtaatacatgcaacgagttcctctttattaatgtataatatggtttcggggaactgctggtttcattttgcattttagacttcacacaacttgcagcagcctcttacgagacaaggcagtattttttttcaacaaaactagaccaaaaccacatataaaaaaagcacagagaaattaaaagtatgccgaatctaattcgtacccttatcagaaaatcaagtaggatggctcccataactattgaaatcggtgtaatttaaccctctcagcggttttggagaacggtttcactgacgtgatgtttcaacccgatccaaccgactggctcaacatgtgggacccacgtatcatagtcacattttttttcttccttctctttctctttgtttcttcttttacccaccatggcgacacatggcccaaggaggagctgcagctaggccgccctgatgcgtagcg

SEQ ID NO: 1668 - DNA, 2000 bp, Oryza sativa
  misc_feature (1907)..(1907): n = any nucleotide
aagcccttcctaccagcatgaccagttcgtccaacacgatgaacatagtcctcataatggttagggacatcataattcacaaccagctcaagctacttcacatctaattcacaaccagcaatcagcaagttgcatacgttgctcttgaaatcagcaagagttgattcacggtcagtctgatctttcccaccatgtaaagataagcatggatatccacgctgaaacaagtctttaagtagagaatcacatttatcttgtgagtggacaaaaacaagaattttgcctctatcaaaccactctccaagcaactccaacagcctcaagaacctctcattttctggccgcacctcaaccagttgtgtgatatctttgttgacgacactcctcccacccacctggatctcaacaggctttgtcagcaccttacgtgccagtatctccacctgccgtggaaaaatggctgagaaaagaacagtctgcctatctgggcgggtattctgaactatccgagtaatctgaggctcaaagcccatatcaaacatcctatcagcttcatccatcaccaagaatgtaactctccgaaggttagtaatctttccactgctggtgcaaaggatatcgatcatcctgcccggtgtacaaacaacaatttcagcgcccctctttagttcactgatctgctgggcaacacctgaacctccatagatagctacacagttgatgccaagcgacttcgcgaacttcttaatgtctgaatgtatctgcaccacgagctctctggtaggagccataatgagcccaatagggccatctccaggcacaacaggcggctggtctttgacatgcctgagcattggcaggacaaacgctagagtcttgcccgatccagtctttgcaattcctatacaatcacgcccactcattatgattggtaatgcctgtgcctgtataggcatcggcttctcaaaaccaagcttcttgatggtgtcaaggagcttgctggtcagcccactctgcacccatgtttttattggcttgggcacatctttcccatgtaccttgagctccagatttttcctgtaggtagccacttcctctcctgtcatcattgtgatatccttcacctcaatgtacaaattcttccggaatggctggtactcaattttggaatggtcaacaatagccagcttttctaccttcgtcttcttgacacgtttcatgaactcctcatcatcctcatctttcgatccaccctcatcgtcgtcgtcgtcatcataatcagagtccgaatcatccccttgcataattctccccattgccttcttttgccctttcttatcaccattactcacagcatcctttgcacttttaccattcttatcacccatgttggaagcaggcatgctctccattgatgccacagccgtctccagctttgcgacctccggcaacaccatggagctcatgaatgcatcgagcggatcaatctcatcctcctccataggagcagcaacatttgcatcattcacctcactcggcaaatcggcagtgatgccaccgtcatcttctgcattttggctatcctccttgtatccctcctcatcagactcctcaccatccagagtccacttcttcccggcattggaatcgccgtcggccccagcggccgcggcaggagtgccagcaccggccgccgcctcctgctcgcggcgcttcgcctcctcctcctccaaccgcttctgctcctgccactccttgacacggcggcggcggagctccatctcctcgtcgagccgcttcttctcctcctcaatcatcttctgacgccgcctctcggactcctcctcatccaccaccaccaccacctcctcctcctccatggcagccgccgcctccggctccgcgtngccgcggtggtggtggtggtgcgaggaccggcggcggcgcttgcggtggcggtcctcatcttccccctctccctcctcctcctcctacgcccc

SEQ ID NO: 1669 - DNA, 2000 bp, Oryza sativa
  misc_feature (777)..(777): n = any nucleotide
aggatgagaaaagcttttgcaaggagcaatgggataaggaggaaaacagacttttgcaaatagatttttgttttagcaaagacacgtccttatgggtttaaccgtttggcttgacctacagtcgagattgctctgataccaacttgtcacgcccagaaattcacaagtaatttctgaactaatttgtgcattaaaaccctcgtccaggaatcagccgaggtacacaaactgacaatttaatatatagattcatcaaaataactaaaacgataaatacttacataagaggcacttagtcctcaccatgaagaaaactgcagcggaaaataaaacctagcgaagcttcagctccactcccacaggcagctcgactgggttctaagccaaatgtcttctccttctggatcctttttcttcaactgaggtttgatgattattgcaagaatgagcatatgatatactcaacaagccacacagcaaatatgcaagtgtacaaggataccaaaggatggcataatatagggttcatttgcgaaagcagcatttagcaaagagttgagaatttgtaaaacaatagagtaattaatcatcaaaattaaccaacactgaacagcacacccatgctgtacaggcccaaccaaacctgaacaaccaacccggtcgtacatatcaacctccaaaccgggattatccattccaaaccaggagtcaaattaattatcacattattaacattgatgagtagtgtgggactaatcacgaaaaacattgctcaantcgcccataaccgcgggcacggctattcgaatagttttactctggccagagatgtaccactgtacacacacgacacgattccacacatgtcgccatgccctgaagtaccaccacggcactacaaaaggggaaatcgtgacaatacctttcgcacaacacaactcaccacagtgcaccattcctggatcataatcaccccctcaataaccagaggcatggactccccagcgacccccacggacttctcgccacttttcagtctggcaccccgtaatgaaccatgctatacaaaaggtaaagccgttgcacacgttggcttgtggttggcacggttaatgtttcacaacagtagctcgtgaaccggaccttaattgtcatgagcacgaccttcaaaaccatgtgctcacaacccaccattaatcatattttaattatcaattaattatcataacacgattgaccatcgtgagttaccattaaatataaacataagtaatagtgaagtataatttatcccattaatgagctaatgtttctaagcacggctaagcaaatgtaaataacatctagctgaaccaatccaatatataaggtccatgctagtcaaattataacccataggaaaataaagtcatcttcagccataattaaatgggaaaggctcaccacccgatgacattctaaaataatgcataagttgaaataaaacattagctttaaacgggttcaacatgctcaaagggttgtttgggatttgtgtgacttgccttgcaaacaagcgtcttcaattcgtcttcaggaacttctccaacgaacgaacgatcctccgaaacaacggaaaactaaacctagaacgcaaaacgagaaaaaacactaataaaaacaaaataaacagtacaattaaagttcataaataggtagaacttgaatttagatgaattatgagacttgaacgacctcattccgagttcgtatgaataagatatgaattttagaagatttaattccaattaaacctattaaagaaaagactattccaaattgattaaacaatttacaaatcacttatagctgagacaaaagattaaaaccggaaatagattagatcatatttggtagatgacatatattaaaaaggaataatatgccattgaaaagaaagaacggatttatatcgattttggacggctgagattaatctcgaccgagtcgaccaagatcgg

SEQ ID NO: 1670 - DNA, 148 bp, Oryza sativa
  misc_feature (140)..(140): n = any nucleotide
gcctctcgcgtcctctcttccgggcgggcagggggcgtcctaggcggagcggcggtgaccaccagatccagcccgctccggccggatctggcggggtagcgactagcggcggcgagggtgggggcaacggcggcgggganggcgacgg

SEQ ID NO: 1671 - DNA, 2000 bp, Oryza sativa
  misc_feature (10)..(10): n = any nucleotide
  misc_feature (26)..(26): n = any nucleotide
  misc_feature (48)..(48): n = any nucleotide
  misc_feature (134)..(134): n = any nucleotide
  misc_feature (1874)..(1874): n = any nucleotide
ctctttgttnagggatgtctgaaaanggggcagggacattcgctgctncagcggctgcatcttcttgggcccatattgcctccttgccgatgtaccctgcggtgcccagccgatgtgggtgctcattccgctgntgcagttggcgatgtgcctcgcttgattccctaaactcttgggtgttcttgagagagcagaattcctcccacaccgcctcggttatttgagggtattcatcgaatggcgtatgattgccgggcgggttgacaaactcggtgaagagcttcgacttccaattcttccaagctttacccatcttatggaatgccttccgcttgagcctatcctttgcttcagctggaaatgtgaaccatttctccattgccgtccaagctcgctctttctcggcttctgtgaccttgccgatatctttatggaggatcccgaagttctcacgtgccgccagcccgcagcagttagaccatcttccaatgacagtcctgggcgccgtgggcctaccactagcgtcaacctctcttataacttgcactgtggtaggccatatattttgtgaccggggatttctactcgacctacttgcacttgtcccgccctgacatcgatgtatgttgttcctgcggcaattctgtagcacaaacagaaggcaacatttgctaaggggtgctagctaaaatttatgtggtcatgtggtgaaaatttgtcctataaattaccatgaattttgggttgttcgaccgccgttgtcgagggatgaccttcggcaactgtctccgtggctgggtttgcttcttcttggatcctcgcaggtgttggggagggcgggtttgcgccgggcgttgtcatggtctaattttcgcgaaaaagcttataaatttcctaccattatactaaatagcattagatccaatgtaatacggggtatactatgaaagatatggcctcagttttgctcagaactatgcatcaattacaatcatttgcatgaagggataaaaagaggaaatcataacatcgaaagagcaagtgcagaaaatctgttcttatgcataaaaaaggaacaagtgtagataatctgttcttatctataaagaacaagtgtagaggtatataaccactaaatcaacagcaacagcggggggaaattcatataaacagcaacagcagggggaaattcacataaacaacaacagcagggggaaattcacatagacagcaagggtatataaatctgttcttatccataaagaaaagaacaagtatagatagaatgttattgagcaattcatccttggccatttaacaagaagtacagggggcagcagcagcagtatatatgccacaggggtagcaacatcagggggaaattcacaaaaagaagaatagataaaaaaaatgaacaagtgtagataatctgttcttattgagcaattcatcactggccatttaacaaggaacacattgggcagcagtagcatgggcaaagatactccataggggcagcaacaataggggtgtattaacaagtagcccacaataacagcagtagcaggggtgtattaacataaaacatcactggccatttatatagttaaaatcatgcaaaattcaaccaatgtaggcaaaattaatcctaaaatcatctaatacaaaaagactaattcctataatactgcatatatttcatccacaaacagtccaaattcatcacctcatatatttcacatctcaaatatgcatatatttcatcaaaaaaaaggagacaatactactaacttcatgtaaacaacaattcatccattcaattcaagcaagtgctgataataaaacagcccacaatcataaatcaacaaaggaantacaaaatgcattttgtatatgagggtattcatctacaaaatgcattcaacaaaaagggtatataaatcaataagtttagataatctgcaaagttccttaatcatcaaagaatgacagaaaacaaa

SEQ ID NO: 1672 - DNA, 2000 bp, Oryza sativa
  misc_feature (904)..(904): n = any nucleotide
  misc_feature (986)..(986): n = any nucleotide
  misc_feature (992)..(992): n = any nucleotide
ggttagctacactacttcaagagtgcaactctctcgtttgccgtggccatcgcagtcgcaatgacacccacgttaaggttaaggtctgtttggagagcttaaaattctaagaaacaattagttgatagcagcttttgaaaacatagaaaaactgggtttatcagcttctgacttctattcattttctggtttatataactacagtttctcataatctaaaaaaaagctgaaccgtttaggaagcttccgattctgaaaaaagttgtagcaactataagctccctaaacagagatggagataaggagagcaccagagctgaccaatgagaatgagctaaaacgctattgccaactcacaatctaaaacagtgttcgggaggtggagcacatgaaaacttggtggtttattaatggttaattaactaagtattagctataaataatttaaaaaagaattaatataattttttaaaccactttcgtatagaaattttttgtaaaattacaacattcaataatttaaaaagcgtgcatacggataacgagacatatgagttggaaaagtaaagaaaaaaactcggcctaatataccggtataccgtaaaccgtgaccgtagcgtttgccggtcgaactgccggccatcctccgtcgtgcggtagtcgagcagcacgtccaggaagtcgttcttgggcggctcacccgcgtcgcgctcccgcatgcgccgctcgatctgctcgtcgaactcagcgaacagtcgcgtgaacaccctcgacagccacctccgcagccgctgcgggtcgaacgccgcgaccgccgggaagtagtccaccacgttcgggacaccgacggtgcccgcgaactctgcgaccgtgtccgctaattcccccgccgatccggcgcgtncctcgtcgaggtcggcgaggtcggccgagaacagcgtgcaggagagcatgttcagcaaggtcgtgaacacgacgcggcggangtcganggccgcgccctcgcgcgccatcctcgcgacgtgcgacacgagccggcgcgccttctcgcggcggaggcgctgctgcgcgtcgaggcggcgcggcgcgaagagctccgcggagcacaccttgcggagggcgcgccactgggggctgctgggagggagccagggcatggcaaacctgtcgtgcccgcacgcccggacgatgtccggaacagggcgcgtcgagaaggcggcgtcgtggcgctggaggatgtctcgggcggcgtccggtgaggacgcgacgatggtggtgacggcgccgaggcggagcgtcatgagcgggccgtggcgctccgcgaggcgtgccagggagcggtgtggcttggcaccgagctcgaggaggttgccgacgagcggcagcgggcggggacccggcggcaggttgcggcgagcgtcagagaagagccggagaaggtacagggaggagacgaggagaataacacacggcgcatacaggagcaggagctccatgattgaccgtacaaatgtgtgcttactgcttagttagccgcaaaacggtgcggcggactggcattgtatattgagataaggttgggggcgaggaaaatgagaatgatagttatgatatgattaattaagttttaattattaaaaacttaaaaaatatatttatcttatattttaagcaatttttatataagaagtaaaaagcattcgtaggaaatataagataaatactaaatcaatcttaatagagaaaaacaaaggtttgagtagtgacggttttctcttgccatggttagtccttgtactgttctttatctttacgggccaagcttctccattatactttccatcctataaaagcatctcaaacaacatctctattctactctctaagctaaaatttagctagtgtagataaatttacagcttcaacagacttgctagctggatggcttgtccatctggttggccaaacccatcccctcgctgaccagtcgtgcacaacaa

SEQ ID NO: 1673 - DNA, 115 bp, Oryza sativa
  misc_feature (32)..(32): n = any nucleotide
  misc_feature (42)..(42): n = any nucleotide
  misc_feature (52)..(52): n = any nucleotide
  misc_feature (60)..(60): n = any nucleotide
  misc_feature (70)..(70): n = any nucleotide
  misc_feature (73)..(73): n = any nucleotide
  misc_feature (102)..(102): n = any nucleotide
aaggaatactttgaatgctaaatgatgacaancatggtatcntagtatgacnagctgatntcgacgcatnacntgaagtgggtaacttgtatgaggttgacnccaaagatatgaa

SEQ ID NO: 1674 - DNA, 2000 bp, Oryza sativa
atgaggtccttgggccattggatgaaggtaccacgggcatttcctagtgataggacctcgtcgttcggtggatactttagtgggaacagctcgtattcgggcttcaccgagttgacttgaacttttgcacagtcgcccctaagttgcgctccatgcactcttgtctctggggtcggcttgtacgcaagtccctcggctgctggaaccgtgaaggtcggcatcaccctaactgtgagtgtgcagctcgttggttcctgcgatagattcatcaatttttagaacattatataacatatggattcgttaagcctttcatgtattgtggacgaaacttttaccgttatgtggtcgacggcgctgtcgaccaatgttggattttccgccacctcagttgatgcgcaattgctgcgcttttgggtgggacttcctaactcttcgtcgcagcagcaacagcggcctgtgggttatgttgctcttctcggatctcttgcctaatcttggccctcatcgactcgagcttttcattgaattcagatgccagctccgctctgatcgacgccgggatcttggctttaaggcgtgcatctttctccgccttgttggaagtccgcttcttggactgccacgcgtagtctggaaatccaaacttctagggaatggaggacccaatgccccgtgtccttccacggtgttccttgttgcccaacgctttcgtgaggaggtcgtcctcgcgtctttgagagcaggcctcttgcgaggcttgttgctcggcaaccatctccttatgcattacaatttagttgggttaaataaactgcatgataggaaacaatgtgatcatctattttgactagacacttactatagcttcgtacactcgttgatcttctggatttggcatgaaaattgtgccattagcattcttctggtatctagccctggcccagttcctagcccgagggtgtgggatatcggcaaacacccgcggcgtgttcgattcctcctcttcttcatcctcctgctgccattcctcttccttaccggcatatccggcggtgccaagctagtgtggatactggttcaaggtctggagcatcgaaatgcctcgcttcttgctctggactcggtggtcgacttctttgcgtggaattcgtcccagacccatttcgtgatacaaggaaatttctctgttggatcgggattcgccgggttgaagacgaactcgccgactagcttactcttaaagttcttccaagcattgcccataaccttaaaagcagcctgcctgataaggtactcgtgctcctcaggataatcaaaactctccttgaatgttagccaagcactgtccttctctgcggccggcacttgcttgatgtcatcctatagaatattgaatttctgcctccctatgaccccgcagatagacctaaatcggctcaacattttcctaggacttgtcggcaagcctatttggttcactgcagttatgcggtaccgttccttagggattttgttccctgtcctaggagtacgtgcccttaaggacccactagttgttgtcgacattggttctccttactgagatattgtctattttttttcaaaataacgaaaatacacaatttagtgcttcaatggctaagaattcaaatttcaaaaatcacttagtcacataaataaattaaattgcacatctcacagatctaacaaactgaattgaatatcacataaaaataaattaaacatatcatcaatcactaaaatcagctattcatccacatgacacattcatctattcatccacattcatctaatcatctattcatccacattcatctatgcatacacattcatctatttatccacattcatctaatcatctattcttccacattcatctattcatacacattcatctattcatccacattcatctatccatctattcatcactaaaatcattcatgcaccacattcatctattcatcattcatgcg

SEQ ID NO: 1675 - DNA, 1742 bp, Oryza sativa
  misc_feature (5)..(5): n = any nucleotide
  misc_feature (48)..(48): n = any nucleotide
  misc_feature (51)..(51): n = any nucleotide
  misc_feature (91)..(91): n = any nucleotide
  misc_feature (109)..(109): n = any nucleotide
  misc_feature (112)..(112): n = any nucleotide
  misc_feature (126)..(126): n = any nucleotide
  misc_feature (136)..(136): n = any nucleotide
  misc_feature (140)..(140): n = any nucleotide
  misc_feature (144)..(144): n = any nucleotide
  misc_feature (150)..(150): n = any nucleotide
  misc_feature (152)..(152): n = any nucleotide
  misc_feature (1014)..(1014): n = any nucleotide
  misc_feature (1017)..(1017): n = any nucleotide
  misc_feature (1019)..(1019): n = any nucleotide
  misc_feature (1027)..(1027): n = any nucleotide
  misc_feature (1031)..(1032): n = any nucleotide
gaatnccccgattgatcaacacatgttgtccttctgcaccactatttncanggctatagccttttctcccttacttttactaacaaacttnctccaaatcccagttgangcnaacttcaataattntcaatggcanccangttngacccntnatgggccaaagggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagaatcgccataatacagacgaatgggcatatcacctgacatcctgataaaacatgacaaatagtctcacgtttaatcatttaatcattcgataattaccctattacaacttatactatattgccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgttgccaaccctttgctcccggccggcgcctcctcggcctcctctccggcctgctaatcccttcccctcgctccctccggcgctcacggcgacgatgtggcgactctcggtggtggctggcgatgtggtcctcaaaacaaatcgaactcgcggcctgggtggacggggctttaaaccggcctgtcgaacgcccattgttcgacagggtcggtggagggccctgtcgaacgcccccggttcgacaggcctcgtggcgcccgntgntnggccctgnccgnngtggcctccgaatcctccgttgacagtgagctcaacgccagccgttcgactgggctttgtcgactgccgtcgttcgataggtgccctatcgaattgcacccgttcgacagggacctactttcgcgattttccccggttggccactacttttgcgattttccataaaaataatattaattctcaaaaaaattccactgtccaccaccttccccatgcatcctcatgccgctgctcggtgtctctggcttgactttgatgaggcgctggatctggccggctggcgagctcctgcgttggtgtgctcgcgagagaaaatgttggatggagtgtgagatctcgggagggagcaggggaggaggaggaggaggaggaggatctatgtcaagcggattggggtggcctcacccctcctcgcctggatcgagccactgccatggccatctccatcgccggctcctctgccgccccggctccaccctccttcctccggcctccctccaccgccaccaagacgcaccgctgaggcgcaccgtgctaccgtcgtgtaccattgtcgcatcagccagcgaggaggctggggtcgccagatctggtggtttgcttttctctcgctctcctctctctcggtcctcttgttcgcttttctctcgctctcctctctctcggagccaaggcgacaggcggcggcgcaagaggggaggcggcaggcg

SEQ ID NO: 1676 - DNA, 2000 bp, Oryza sativa
  misc_feature (1689)..(1689): n = any nucleotide
  misc_feature (1703)..(1703): n = any nucleotide
  misc_feature (1735)..(1735): n = any nucleotide
  misc_feature (1823)..(1823): n = any nucleotide
  misc_feature (1923)..(1923): n = any nucleotide
acgagagtcttacttgtatgatgtcactagtagctacgctttctaacttttaactgcagagaaatgtctctttcttttctaccttgtgttgtgtgattcaatgtagcatagatactagcacagaagcttcattttaggccgataattccttctctcgaagaattcagggctctttaacgttgtcaacgttcaggtcacaatcagcctcgcaagttcaggtctacagtcttgcaacctaaacaagctggttttcttcattctgattctggaagtaagaaaaacagagggcatacttgtcaagcctacccggatttaatgtgttggcaacttttttgacaagtcgacaagcacaattgcaacacctaaacaccttgcggtgatatagagtctctaaccacctcgatctagccaaagggccaaatcaagatgggttttgcaaaaagaaaagctaaaccggctagcggagccgatttagagatcaaaatcagcctctaggccgatttagatcgatatgaggataactacccgtcttgtgggcaaaacggaaggttttcaggacaaacctacaaagaggtgtcacactctcgcagcggcggcggatggtttacggcgcaaaccgataaagatggactaaaactagggtaaaatagaaaacatagtaaaagaacgattcaagtagattgtattcgggggttttacaatgaaccggccttatcctttaaataggggttggtcttaccctctacaggctcttctccacgtccaactcgggatagaaaccaaaggaaatacgaaacatgccttcccgagcaaggaaacccgagacccgatgaaaacagactcggactcggaccctgacggtctgactgcccacatatctgcggtcagaacggccctactagccggtcagaccgcccacacacctgtggtctgaccggtcctatgaaggaaacccgtcactttccaaactttgtcaatttttccctatttcgtccataggtgccaaatttgggtgtaaacataatgttcaacaataaaagacgataacatctgctttaacatctagggcgtgtttagttcacaccgaaattggaaatttgattgaaattggaacgatgtgatggaaaagttagaagtttgtgtacgtaggaaaattttgatatgatagaaaagttggaagtttgaagaaatattttggaactaaatagtagaggtgaaaacggtacggaaacggacagaaacgacctttatcgtttcgttttcatatttttttcggaattgaaatcggaatcggaaacccccggaaacaaaaacggaaacgaatattatcgaaaccgaaaacggagcgaaaacgaaccggcgcggatacggtaacaaaaatttatcggaatacacaaacccctcaaactgagggtcaaactttgtcaagtccaaatctcaagtctcaacattcaacaatacatcacaaaacacaaccatatcaaatccaattgtttctctcagcagtaccatcataaacacaatctatgcagtctgtaacttcatatttgcataacaaatattgcatggagttgcataacttcaacaagcaacaacagcaagtcagccatagtacatagttcatcacaaaacattgctgagaattacatagttcagcaatagtagaagtataaagtcagccactatatnaacatatgttagtnaaacaagcacaaaccagggacaccaaggcacnaaaatttcgctccaggttctccattcaccagtcaccaccactccaccagtggggcttgagtcggcggcggtgacgaggacggcgcganacggtggtgcccgggacgacgcaagacgtcgggggcggggacggggacggcgagcgactacacgagacgcggtggccgggacggcgcgagacgttggggncggggatggcgagcaacggcggggtcgaggacggcgcgagacggcggtggcgactggcgaggacgaagcgtaggggg

SEQ ID NO: 1677 - DNA, 2000 bp, Oryza sativa
  misc_feature (574)..(574): n = any nucleotide
  misc_feature (598)..(598): n = any nucleotide
  misc_feature (601)..(601): n = any nucleotide
  misc_feature (710)..(710): n = any nucleotide
  misc_feature (720)..(720): n = any nucleotide
  misc_feature (726)..(726): n = any nucleotide
  misc_feature (731)..(732): n = any nucleotide
gccacacgacccaagaagccaagggcctatatgggccatccgccactgggaggtcaatcataaagcccattaaggagcccaagacaaaatagacactgtttaccctcataagtgtacctatcataagggtatccatataaattcccctatacacattaactctagggtgtatgagcttgcacagaggctataaaatagccccctattggcatgtaatggggggatcctaaaaattcctcaaattaatacatattgttttactttccactgtgtgaaccacgtctttcgacgtacgcaattatgaatcgacaacagttggcgcaaccattgatgccacccaagaaatcggtcaaagagagagagagagagagtagcgcctagaagaaaggagggagaaggtgatgtggagatagctggcgaagaaccagcaaggaccgaagcaaaatcagagccaccaaggggcgaagggggagtaggccgaagctggtcaaggaaccaaagatgcaacccaagcgacgacttccacccaaggaagcttagaagcaatgcttcggtggcgcaaaaggcggagatngaggcgatgtgacaagacatgcangangctgcaggacaccctttagccaaatgcaagaacaacaccaggcatacgatgcagccctgcaggccaagtcaacatcttcagcaagactaactcccttcttggccccctnatggggaaanggggtncaacnncggttcaagcttcacaagcaatacaagcttcgactcacttagtgcagccctctgcagctgtacaagcagtccacactgtgtttcaagtggtgaaactgacttcggctttccaagtgcatcccaccgctcatgcaacgatggcaccggttcatccaacggttgccccgatcctacctgtcaaaccgattcaagctcaagcaaatcaatcttcggtggctgcttcatcgactctcgaagcacggttccagacctttctccagcaactaggccagccccacacaatcccaattgtatgccctttggcctacgccgttatgggaccaaaccaagccacgatggcagggcaactgttataccagcacaaagcccgcatttcgtctcatgatcctttgaagaactctcaagccatgtggcctggcttagatgatggaacgtcttgtccccaactcatgtgcaagcgatggctttgtctttcgcacaaccatacccaggcctttcgccacagtaccagcaaggcacggcgttaaaggctgggggcgaaaagaacctacctctaagctgggggctgaggaaagaacccatcgctcctcagttcgagtatccaccagtgtcaaagtattcggggaaaccaatccgagcgaagtcctgtcgatctatgagttgactatcaaagcgactcatggcgaggaaaacaccaaggcaaaggtaatacatcttattctggacgggattgcccgatcctagtattttaacttgcctctaaatagcatttactcatgggagcaattgtgcaatgtttttgtcttgaatttccagtggacctacgaggagccaaaaactcagcaagacatgtgcagcattcggcaaaagctgggcgaatcgacaaggaagtatgctaggcgtgtttcacaagcaagatgtcgagtgcaagatatcaccgaggcctccatgattaatgctgcttcggctggcatttgtcttggcaaatttacaagaaaaatcacaacgaaaagagccacagacggttgaacacttgttctctatcattgacggctatgctcgcagtgaagaggatatgaagcgaaagctcgagattcaagctaattacgacaaggttgcagccgccgccgctcaagcaagcttacaagagtctgaagttgggtccatggaaaatcgccttatgtagccagcgagccaagcctcacccccaaggcaaggctcaactcccacgacttggaagaagtttcgctttgaaagggggaaagcag

SEQ ID NO: 1678 - DNA, 2000 bp, Oryza sativa
atttaacgacaatcctgccatagagaacaaaacaagtcccaacacagttgtagcccatattacccttttaagtcatttagaacgtcatggttgccgccaaatcacagatggaatgttgaacaagaagtactcctaacctggtcgttcctatccattttgcaacacttgatctatagaaatattcttgacaggtgctaaatgaattgtggaagtctaaagattcagtccagcaggacaatacatttttgttcctaacccattgccattaaatctttgcaattgaatctccagagctacaagatacaacatgtagcatacaactataacctacatactttttcagcacaagttttaacaaaggtagtacaaaatgataagggatcacaaaccttaatattttgcattcttgtgcaacaatctagccaaatttcccagcataaactttaacatcatccaatttcagtctacaggcaaaccaatgaacgaactccatttgcttccccagaacaactggaggtataagcatcagcaaggccttgaattttgtccttaaaaggatccacaaacctttgcacaaacttctcctcgctcatcgcggctatgcagtagtaagacaagtcacagttcagcaatccctttgccttgaggaccttgagcaagcaatgccgaggcaacaaccgccgctcaaggctatacgccaacaacgttggcctttgtgcgatgtagctttgctccagaccgacatcccttatcaagaactcaacagatcgccgtatccttccatcggataaacgcagcacttgtggcgccctccttacgattaccaggaaatcatcctgcgaaaacccaagatcatccagcagctgcattttactggcaatagtctccctgcttaagaaagccactgtactgagcacgcggtggaacgtcctccaaccacgggccacgcctaactcctccactcttgccacagcgtcctggaggaacctagggttcacggtgaagagccggcaggagtacagggacaaggttgtgcgagtgacatcggaggcgtttatcccgcattgcgcgaggaaggccaggttcggcttcgccaccttgtcgaggtcggagccgaggagggcggcgttcatcttgagcgccttgaggatattctcgaacgagccgaacaccgggtgccagaaggcgagccttgtggcgagggagctgctccggaagcacctgccggcgagcgggaggaggcgcgcgatctgggagcgggagaggcccaggccgccgagctcgtcgacgcgcctggcgaggctgctccccacgtcggcgcacagcagccttgggtcggcggcgacggcggcggcgatgccgtcggggcgcgagaggccgaggtcggagaggaaggcgaggacggcgtcgggattggagggggacctgaggttggagagcttctccgaagccttggctgcctgggctcgggtgaggccgcaggtggcgacgaggtactcgtcgacggcgaagggtttgggggaaactggcgcggtggtggagaggaggcggcggagggggcaaggcggcgggaaaattccggcgattgggcgaggggatgctggctggaggagcagagataggatgcgctcccggaggcggatcatggcgtcgtcgtcgtcggcggcggcggcgcaagggttgccgacggcggccgcgtgaaatcacagggttatgatttctcagctcggtgagctcacaaacaaggaagggaaaagtacactaaaggtccctcaacttgtcatcgagttacaaaatcatcccccaaccgcaaaaccagatatcgaaggtccctcaactaacaaaaccgttcggttgaggtcctctggtggttttggacgcagttttgtctgacgtggcgtgtgagtcagcgtgggcctcacgtgggtcccacgtgtgggaatgagtcatctctctcccttccttctctctctcaaactcttctcctctctgcgcaattc

SEQ ID NO: 1679 - DNA, 2000 bp, Oryza sativa
ataaggcgatccaaattaacctgtatgcctgtaccagtcccaggaaatagcgctggtacaacaggaagacagaatatcacaacaacagcggtctctttattaagagtaggattacaaccaaggttggaactgcggacagaacccgagttcgcaacaacattacaaaaaggcggaagcggaaagcggagactagccctaagccacaagcaaagccttggggaaaggccgaaaccctactactgctcgaagtctgcttgctcctggaagaactcttcatcagccgggtccacctcttcgtcttcaagaactgggggggtttaattatatagagcaagggtgagtatgggagtactcagcaagtcaggggaattaagtgtttaatgcaagcttcaagggaaagccagttgtttttcacaattgattttagtttaagactttcagaaacatctaagtgagtgcttctcaacggcgcggacgagaaagtgcgtctcatccggccggagcagtgaaaatgtgtcgattgattcttgtcggcacgagaggctcccagccaatcgtttaccgacccggctgctccaacagccacacgcgagaggctccctgccaatcgctcaccagcaccggctgcaccaacagccacgaatcaaacacgtcggaacaagaggctccctgccaatcgttcaccgacaccggctgctccaacagcctcgaatcaaacacgtcggaacgagaggctccctgccaatcgttcaccgacaccggctgctccaacagcctcaaaccaatcacaaaagggaaaaactcacacaccaacagcaatttccaaagtgttcactaaaactacgctaaggaatcacctcacatcctcccatgaccgtgggcacggctgttcgaatagttattaacctctgcagaaggggtacactttacccacacgacgttactaaccccgaatcacccagcccgcgactctcggtcacgtctggcgaccttgaggctttcacgacaaggcatttcgaaagccgactcagggtcatcttatgccaactggaggggtcccacggaccaacaccaggttaggtcccagaccatactgtgccaggaagcccaggggtcctccccgacaccaccccagcgaatccacttgtcccttggcagcaagatttccctggcctagctaattactcagccaggggcgtcccatatcacccatgtggtcgtacttgacatatgctcggatgtaattcccaaggaatcggtccttagagcgagaacggacagaccgtacctccagtacgtcttccgtaccgcgagttttagaaactcactttattttcaaggcaccaacccaagtgtcgggttttccaagcattttgtaaactcaagttttacccaggtgatcaattttagagtttgaggggagtctcgatattcgtacgcgaggtgcgaataccgagatttcacctgacgggtgtcaagggtgttagggtattcaaatatcaaggaaggtgaatgcagcaaatgggtagggcctgccggttgtattgcaaaccgaggccaagtgccaagtgtaacctagttaatgcatagtttgcggaaatcaaaatacttaatttaaactataggttcaattgatcaaaggtgacttgccttgctcgagatcttgagcttcttcctcgaaatccgcgcactgcgggtcttcgggctccgagactacacgcagaacgagacgactcaacaaagcgataaaaagaagccctattaaagaccattaagcatgccattggatagatctcgatttttgagaaattttggaagtggaacggagtcaatcggacgatcggttgagaagatatgaatttccgaagattaaaggattttctggaaaaagaaaaggaattattaattccctggaaaaagaaaagaaggagggatgcaatttagatttcattttgggcggctaagggcagcccaatagaatggaatgtacgcggccgaaa

SEQ ID NO: 1680 - DNA, 2000 bp, Oryza sativa
tgatcagggtcgacattgtgtaggaaagattataatgaaatggaaaacatacgaagaaaaactaggtagatcacgagggtgaaaaggtatgaaaaaatggagagagatagagggaaatgtgctaatagtagatgaattgttgtgacatgaccttgtcacatagaattgctagggcacactatatttacatgccaatatatttatattgcattttcctacatctaagtaattagatttctcgtacaattcatacttgggtatgatattctcatggatagttggggatgtcagcaatctatagcttacacggtcccttatgaaagactctattggtcttattgtgctccttgtgagcacatttggatacacattcaaatagattaagataactcgatggaatgtataccctcaaattctttttcgataatgtaatcaatattaccctattaatttttctagcatgaaaatctcagatcaatccaaaaccatgtccaactcaatagttatatatcataataatttacaactcgtccactcataaattatatttttttaaagaaccactcaccatcccttccctcctctttttcatatttgtatccaataaacaccttgcccattctcttgctcatccttctgtctgtttgacagattggaccaatttatcactcgtagttgaaaggaacaagagcgatttaatgatatcttatcacttgtaattggacttcaagcctctttttttagaactacttcaagcctaccatcatcgagttatgcctggtgtcgtggcagctcggtagagccatgatatcgactgcgcagcattgtcacgtgtgtcatggatctagctagcctgcctttggtgtgttggtaaggcttgaggccatggggctgcgggttcagctttgtggtgttcttgaattggtggttatgtctggcacatagggtggttgtgtgtgaggatttgattgtggaatgacgaaagctttgtcaaattcttgcaagctttgatgacggcaacaatcttgagcgtcgtcacgacatcccatttctccacacaagtttccatattagaatcttggtccgatttcccaaacaagcaacggcgacgtgagcgtccccatggaattgttgctttggagaatcttcttcctatgacagtggccattattaggaacttagtggcatcttggaccatcttgtggctagggttcaccttttcgtatcggaaattatacccgcttatcaacggtttatagaaacccgataaaaaccaacaactttcggtcaacacggtatgaaaaccagctaaaactgaccggttttgaaaacatagcagtgtgcacgtgttttccgtgtaacagacaaaacaaattaggtctaatgtctagtttcacgtaaaaccgttttgttctatcttcttgatgaaaaggctatcttttgctatttaactttggaaattgctatgcatatgacccaactgtccgactcacgtacgattgaatttgatcaacggttgtaaacggctgcagtgtatatgaatatgctatcatttgattgatctataattgcttgtctctagttgtacatgagttgtacaactggatctcatgagcaattttacggttcttaaggaggtaccaaaaatttagtataaaattttggtaccttatagtacccaggtatcaaaaggtattaaatttacaatagaaaaagtgatacctcatggtacctcctcaagaaccgtaaaattactcggatctcatacatatagcagtactcttttactttcctccctgtttatccctaattaactttacactgttaggcctaattaattttctctacattcgtcccgactggattctcaagtagacgacatgcgtacgtagcatccaaatacacgactcgtgcgcccgtaagacaccaaactcccctcttaaaacgacgcgacaatcacaagccgccgcgcccctgcactgcaccaccctctcgccgcc

SEQ ID NO: 1681 - DNA, 2000 bp, Oryza sativa
  misc_feature (1147)..(1147): n = any nucleotide
gctgctcacagtccatcatccatccactgggctacgagtgctggtttctgaatcctaggggggcaaacattttgctatttgagttttttttaagtagattttgttttaaaccaaactgttgcgaaactatagatacgtcgctaaatttgttatcagactattgatgaaaattttcccttagcgaaactagcaaccattttgagttgttgttcctctcccaaggaagtttactcacacgtccgcaactaaaaacaccacttcccgttcgacctgtatgtgttaagcatgccgccagcgtttatcttgagccaggatcaaactctctataatatatttagcaatttatttatggcaaaactgtgtatttaacaatttaaaccagacacgctaagaaatatactcgatccaagccaaccatcccatcccttaaaccaaatgcaaatgcacggtaggtgatcaattcaacgagtttttgactgccaaagtcattagcccatccaattctacattctacgagggaataagttcagtttagatctccatacgtcaagtttgaattacatcactacaccgtgatactagatacatatagcgtgtctctaaacttgcaaaataggtgtacctgaggtcctagggtaatatagtgcccaatcttaactcacgtggcgagtgggtctcacatgtcaacaacccactcttgtttcttctctctccctcctctcccctctcttccccaatcctcttcaagccaggagggggggcggcgagcgacagggagacactggtggtcaacatgagcgcaggagcttgaccgtggaaggtttccaaggaggcggcccacctcggggggctgaaattctatgatgtcgaggaggatgagctggcaggagcacgttgactactagtggaggtatgcagtgtgctagacgatgacgagcgtgtcctcgggactcaggaggccatggtcacgaggtggaggcgatcagggtgggctgcattgcgagcacgatagccgccgatgaccaacctgaagctgccccggcgcggggttgtccccaacccccccccctatgcgacgctatccattagtggtgccttttgccgcgccatacaaaacaagtggcttgtcagcgattgcccttatccncgccgctcggaggcctggtgatagatggggaagatagggaagagaggaagaagaatgctgctccctgcccttctagtttgaagaccattgtccttctagtttgccgcacccactgccccactctaagtcggcggtcgtccctctccttgctactcgttgctcacccgttagtccaccttgttggttggccctctccaagtcggtatccacccttctcgccgtcgctcgaggctaggtgagagtatgagagatgtggaagagagggaagagagtgagtggggggggggaagaacaagagttggccgatgacaaatgtggctcactcgttgcatcagctaaaactgggtactatcttggacctcacaccagttttataagttaaaagatgagcgttatatttggtattatggtaaaaaaacataattaaaactcggcgtcgaagatacgagagatgtaaagtgaacttattccttctataaaatgaatttcgttcttctctacgccaatcccctgcaggccatccgttcgtagaagatgggactaatgctggcctgcaaatttatttgggctggtaacgaggaaacatttcctttcccagcctcacagactgaggcccatcaagccgcggagagcaacccctcaagacgatctgagccgtccgatccatctcccgcaccgcatccgtccgcccgatgcgctcccgcgactagggtttcttcgagaggaaggataaaagggctcgtgggcagccgccgctataaaccctaaccattccttctcccaccttctcccttctcctcgctcctccccctccgccgccgccgcagcggagcagcaacagcaggcgagcgac

SEQ ID NO: 1682 - DNA, 2000 bp, Oryza sativa
  misc_feature (1907)..(1907): n = any nucleotide
aaacgccacaaagccacaagccaacatacgccaagacaagacgacggatatcgacttcagggataagcacggctagttccctacggtgtctccggatactgtcaggagagacgaaagcgctatctctgatctcgccgggtacggattcgaggaggaagactaccctgttgtcgactacgagtcagatcttcagaccgccatgtcgacaacagttagataagctaccctaaatattgtactggtgtgattatggtgaataagagcaataccggcttcggctaacaggatgtagggttattacctaacaattcaggggcccgaacttgtataaaaatccttgcctctgtctcttttacctcagtttcgcgtatatcctagtaccaacgatccccatactatacaaataccggaatcgcgacatcaaacctcgacagatagtatagcataaactaacaccgaccgaaattcaatgttcaaccccaaatttttgatccctgctacatatcaaaggatgtttttagatcaggggtgtaaagttttggcgtgtcacatcagatatacagacacacattggaagtattaagcgtagtctaataataaaacaaattacaaaatccgcctgtaaaccgcgagacgaatttattaagcctaattaatccgtcattaataaatgtttactgtagcaccacattatcaaatcatggtgcagctgggcttaattaaaagatttgtctcgtaatttacacgcaatctatgtaattattttttttatatttaatagtcgatgtatgtgtcaaacatatgatgtgatatggtgtaaaattttaccagagaatctaaactggtccaaagttgcactttgtggtgttgacaaaaggggtagtatatataaaatccaatttgtcacgtgtcaaccaaaaggccaggtttctccagcagaggtagctatcccaatacgcacgtacgtatgtactcgatacttgtaatacgcaaatactgaacgttgtatcacccacacaaatactgatacatatacctatacgtatgcgtcaccgtcgctgttgcacctgccaattgccataaatgccccgggtcaccacccggtctcttctccctccccccctctctctcactccggatcgatcagcttagctccacccaacccccagccgcgtcgactagctgagctgagctttcccttggcctatatactctctctctctcttctcgccccaccctactccttctagtacctccgagctaagccactccaccgccgattgatcgcgtcacggcggcgcagcccggccgccagcgtcgtccgtccgatcggcaggtgagggagtactggctactgttgtcttcttcttcttctccctcttcttcttcctgcagctgcctgctgctgctgcagcggattctgcaggtcgcgtcgcgtcgtgtcgcctctgatggtggtgtagcatctctctctctctcctgtggcgcgtgtgtcagttcttgggctgctgtaattagcctcctggcaagagaggtgttcagaattcagatcagggccaccccgtactactagagcactagctgcagcagcggtctctggtctggaccagcgaatccaatcgccccactagagataaccaaaccctagttgcatctgtatctctccttgcgtgtttggttgtccttagctggtgaagcaaagcgccggggcagcagcagaaacacccaaccgattcacagttaatttcttgatcgatttattgagtacggcttccccagccgccttcaatttcgtttgctttatgcttggttttttggttccatcgattgccgagaattcgagcatgcgatcgctagcggcaattgaaagaagatgtggctttaatttttggttgaattcatttcangggggggggggggttgattttgattagcctttttgtgttgacgcatgcagatctgaggagggagaaaggtttgctgctgcttgtgctaggacg

SEQ ID NO: 1683 - DNA, 459 bp, Oryza sativa
  misc_feature (4)..(4): n = any nucleotide
  misc_feature (7)..(7): n = any nucleotide
  misc_feature (10)..(10): n = any nucleotide
  misc_feature (96)..(96): n = any nucleotide
  misc_feature (98)..(98): n = any nucleotide
  misc_feature (108)..(108): n = any nucleotide
  misc_feature (124)..(124): n = any nucleotide
  misc_feature (133)..(133): n = any nucleotide
  misc_feature (139)..(139): n = any nucleotide
  misc_feature (150)..(150): n = any nucleotide
  misc_feature (155)..(155): n = any nucleotide
  misc_feature (167)..(167): n = any nucleotide
  misc_feature (179)..(179): n = any nucleotide
  misc_feature (203)..(204): n = any nucleotide
  misc_feature (210)..(210): n = any nucleotide
  misc_feature (218)..(218): n = any nucleotide
  misc_feature (224)..(224): n = any nucleotide
  misc_feature (231)..(231): n = any nucleotide
  misc_feature (246)..(246): n = any nucleotide
  misc_feature (259)..(259): n = any nucleotide
  misc_feature (262)..(262): n = any nucleotide
  misc_feature (264)..(264): n = any nucleotide
  misc_feature (266)..(266): n = any nucleotide
  misc_feature (273)..(273): n = any nucleotide
  misc_feature (275)..(275): n = any nucleotide
  misc_feature (279)..(281): n = any nucleotide
  misc_feature (286)..(286): n = any nucleotide
  misc_feature (288)..(288): n = any nucleotide
  misc_feature (301)..(301): n = any nucleotide
  misc_feature (307)..(307): n = any nucleotide
  misc_feature (310)..(310): n = any nucleotide
  misc_feature (312)..(312): n = any nucleotide
  misc_feature (333)..(333): n = any nucleotide
  misc_feature (342)..(343): n = any nucleotide
  misc_feature (346)..(346): n = any nucleotide
  misc_feature (380)..(380): n = any nucleotide
  misc_feature (394)..(394): n = any nucleotide
  misc_feature (402)..(402): n = any nucleotide
  misc_feature (422)..(422): n = any nucleotide
  misc_feature (425)..(425): n = any nucleotide
  misc_feature (447)..(447): n = any nucleotide
ttanaanttncccatttaaaatttcaattaacccattcatttaaaattaatgatttaaattttcccttaaaaatttaattttccattttccatttntnatttttaaanaaaaatttttcttaantccttaaancccccngcccaaatttngcccnacctttacaaancaaaacttcttnacccttaacccgaacacccaaacnntttacnccctttcnccgaancaaaacnccattttcccaaacncattggccccaanaancngnaaaaccnanaaannnaaaangnaaaaaaccacccnttaaanaangngccccgcgccccacgccaaanaaccttcgnnacngcagcccttcccgcaccggcacccgaccgccaanagggaaaaaagagnagccgagnagagcttaccgagggctgcngcngcaagacaaccatagggaggcnaccggcgccgaa

SEQ ID NO: 1684 - DNA, 2000 bp, Oryza sativa
aagaaatctctttaaaaaaactcgcatgctaacttgagacgatcagactcctaattgccgctcatgattctgtaaaactaaacaaatccaagcgaattctcacggtgaattttaccttaactaaaccatataataataatcaaaagaaacctcacgcgttgcaatgcacgggcattttttctagtctgattaaatatttaaattgccacatgaatgcatcaagagcatgaacttggtataaacagaaactaaatccgaagttccgaaccaaaccaaatttggcctattatttttagaacctcacttatgaaatatttcccttgcaattatgtacgcgttcctaaaatccttgcgttccaaattaaggaaatcgctgtgtacacaaaaattaaatccaaaattagttgcttaattattacaggtgatcaaaagtactcccttcatctcaaattacttgttctagatttgtccttaattggtcaatgatattaatctttgaatatgaatttatataattaaacttatatagtttgacacatcacaagatttatatatttagatttatcatgagaaatcctatcataatgttgccaaaccatgcagattttcaaaaattaatagtcaaagttagctagctagacacatttgatttataataactaatccgaaacgactagtaattaagaccacgtttgattcagtttaggattatgataatctgaattattaggagtaagctgaaacaaacagatagcttattatgattgattattataatctataagccggattattataatatgataatccactctaaaggtgctttttctaaattattgggtgaataacagctaataatccagagaatcaaaaggctaacagcttattctatgtcagtttattataatccagcttatagtaatctgatttaataatctatattataataatcttaagctgaaataaacaggcctaagttgaaacggagagagtacgtagcaaaatcaatcagagctgggtgcatatgcaacgaattaaatcggagatcgaacggtcgatcgaaactaaagcagtgtactgcatgcaacggcttgcaatgtgtgtaccagtctaaccacttaggtacttaaaccaaccaaaaaagtgtaagcaacccaacgaatccttgcatggttcgtcaaccgtacgtacatcaactccaaatcgggtccccgtaactatacggcattatggcggcgctatatatttcttctatctatctactctctccttctccagatattttgacgccgttgattttttaaaacatatttaaccgtttatcttatttaaaaattttaattaattaataattcttttcatatcatttgattcattgttaaatatgctactaccacttaagtttttaaataagacgaacggtcaaacatgtttaaaaaagtcaacggcgttaaatatttagggataaagggactaattaactatagattatatatataataagatttacttcggttcaacaaaaaaatatctcgagatatcggtaccaaatcattttctaattgttgaatctaacaatgcacatcctgaccagctcgatccaacgatcgaaaacaatttggtaacgtcaggtaccggtatatcgagatacttttcgttggaccggaaaaaatctcatatataatagccatagttagccacacaatgatgggttgcagctgacacacactgccagtactacgtggttatactgctaatgcgtcattagctcagttaattagccattgagaggcgagctcgatcgaggtgaggaggttagctcagctgtcgctgtgaacacggagctctctctctctctctctctctcctctctcctcttcacccgctgccgcccactactactaaaacgggcaactcatccacctcctcgacgcagcctcactcctcctccattgctacctcaagctccagctcgagctcgaggctttgctttggccgca

SEQ ID NO: 1685 - DNA, 2000 bp, Oryza sativa
tccatgtgaactctaaactcatctttcaatattatttaattttgaattttgaattttaggttacttataaattggttattcctatatggacttttagactcttcttcccatatttttttaaatttcaaattttagttatttataaattgtatttttataggactctaaactctaattttaattttattatgtttattctgaattttagttagttttaaattcctatattgactctatactctatttctaatattccttattttaaattcctaatttctattatttcttaattgtatttcgatatggactctataccctacttctaatattccttatttctattatttcttaattgtatttcgatatggactctataccctacttctgtactctataccctacttctaatattccttatttttaattccgaatttctattatttcttcgttgtatttctatatggactctatactattcttctaatattccttatttttaattccgaattttagttatttataaattgtatttctatatgaactcagtctcctcttccaaaatttcttattttttaattccgaatttcaactatttctaaattatatttctatatggactctgtttttctttttctccgattaatatgagattttctaggccgtgagagcgaacgtggaggctctttttctattcctttaataagataatagatattagtacttttttaagtttgacaaaaaaagtcaaaccacttatctgttataaaacaaatgaaggtgattctgtagccacattgtttatgggggtgttatccatgggcgtaaagttttggcacgtcacatcggatatagggacacatatttcaagtattaaacgtagactaataataaaacaaattaccaattccgcctataaaccgcgagataaatttattaagcctaattaatccgtcattagcaaatatttattgtagcaccacattgtcaaatcatggcgcaattaggcttaaaagattcgtctcgtaatttacacacaatctgtataattaattatttttttcgtttatatttaatactacatgtatgtgtcaaatattcgatatgacatggtgaaaaattttatcagaggatctaaatagcctctatatactttttttttcatccgtcaagccacttctgtcttcttacacggaatagttttgttggccgtccgtatagaagtcagcgagcgtacatacgctcggccgcttgggcctcagtctggagctaggccgtttgggcctcgatctggcgctgctgcttgcaagtcgcaagccatgccgtaggggctgtttgtccccaggtggggcctcagggtgtacagcaagaaatagtaatggcatattttaaaggaataagtttatctgaggtcccttaactttacacccgaatccgatttacgtccctcgattggaaaaccagacacaacgggtccctcacctatcaaaaccggtgtagattaggtccctcaacggttttgaggacggttttggctgacgtggcgcctacgtggctaatttgactcggtcttcatctgacgtggcattgacgtggcgcttacgtggcaattcgacccggaaaaataataaaacccgtaggacccacatgacagtctcacatagaaaataataaaaaaatcatgggccccacatgtcactcaaactcacccttcctcttcttcctcctctctccccatctccctctcttcatctctctcccctctcctctcctcttccggtgagagtggcgagttggaggggggcggcgagaccggcgcccaccggtgagagcagcaagttggaggagaaagccggggtgataaaaggggatcggcgacggcggtggacggaacagatgacccgggcggcagcaggtccccccggagcaacgccggcaatcgagatccggcagtggcggccgggagaagggcagtggccggcggggagaaggggcggcgtgag

SEQ ID NO: 1686 - DNA, 2000 bp, Oryza sativa
  misc_feature (20)..(20): n = any nucleotide
  misc_feature (62)..(62): n = any nucleotide
  misc_feature (193)..(193): n = any nucleotide
  misc_feature (348)..(348): n = any nucleotide
  misc_feature (354)..(354): n = any nucleotide
  misc_feature (362)..(362): n = any nucleotide
  misc_feature (419)..(419): n = any nucleotide
  misc_feature (495)..(495): n = any nucleotide
  misc_feature (705)..(705): n = any nucleotide
  misc_feature (726)..(726): n = any nucleotide
  misc_feature (741)..(741): n = any nucleotide
  misc_feature (1422)..(1422): n = any nucleotide
  misc_feature (1473)..(1473): n = any nucleotide
  misc_feature (1545)..(1546): n = any nucleotide
  misc_feature (1916)..(1916): n = any nucleotide
  misc_feature (1969)..(1969): n = any nucleotide
atacacttcaaatatatctncttagtcacaccaatcttactaattccactatgcaccaatanaacaattcaggtttagcaagaaaagaccaacatattgtctaataataatatgtactatcttaaggtttcatatgaataggtcagttttttatgtagcctagagcatttcaaatggagaggtccctcctctntttccctgattgcagcaagaatttcgtcatggaccttcagaacagcatatatattgtaacataacatttgcacaatagaagtgcaaagtatacataactgcagaactgccgaatgctacgattaatggtatgaaataccccaaaaaaaatgggcncactgntttctctnaatatttgcttgatactattctctgaagatattttttcttaggatctggatacctanttagatattcacatctcagaaatgcagaagctaatcatctctcttcttatcctctacatgtattaattacataaanatgattaaagaaaaacacatcataaggattatgcaaatttcagtacataaaaagatagcaattgtttaaagaaagtatcgctataactcaagatatgtcattagcctacagattgatgtatcagatgcatggtagccgtccatttagctactaatgaacggtcaaatgtgaaggttacggtaccggattcatccataagtcttcaacccntacccctagccttaattaatntctgcacaacaaacnaaactaaccaaaataataaatacctgtttatttgcgtgatgcaggtcgttgtgtctttcacaaccttgttggtcggtcatttcctttctcctcgtttccccttaccacaaggagtgccaaactggggagcagactggcctgatgacagtgttgagacagaggtgccgcattagtttgcaggaatcaaaatgttacttctagaagatcaatgatttgtatccagtgctcaaacttaactgccaaaaatgcaaatgctacaacactctcctttaagcatacctcccagtgcacgcccagtgccattgttgagctgagctgccgtcatcgcaaccgctctattcaactttatactccctgggccatgatggctgcagaattaaacaaaattaagcaaaatagaaatcaacacacctgccgagaattcctaataaaacaatcaatcaattaatatcatccaacaacaaacaagatcacctcacaataacaagctatccaatattctttttcctattataggctgtaaaacaactatgtaaactatgtaaacctgtttgttcagatgaggagtatggcccaatgaaaaccgaacttgctgctcactcctatcttgagacctatttagcatatggatggcttctccacctgatgacctaaaaatatagtaataaaaccaaggcaacnaagaattataccagatatgtattaggtaaagatgattagcaaataaatccntaaggattttttaacctgctagtaaagaaggacatgaagcataggcgtgtgatgatgcccattgaaccgtgnnagacggcgggtcgatgatggcagcagccccgttggcggaagtggccggattcatggcgccaaagatgaccagatggtccagatcttcttggcctcggcggctatggtgccgggcgtcgacagttgggggaagagcaagcgcggcgtaggtggcaatgtgggcaagcaccatgggaagaccctcgtggtagccattgatggaaaagagatctgcaagcatgttccctgtcgacatctcaggcgccaccgccgatcctctcccgccacatgctatcaaggtcacttatcgaacgcaccgccgtcgctggtgtccatctctacctcccgtatacaccgtcagctcagcttgtccgcctgatttggctcgatancggcggcttgatcctcactcgcgggcgctgttgatgggggatcggctgtaacnctccaccgaaggcagcccctgcccctccacc

SEQ ID NO: 1687 - DNA, 2000 bp, Oryza sativa
  misc_feature (882)..(882): n = any nucleotide
  misc_feature (1549)..(1549): n = any nucleotide
  misc_feature (1590)..(1590): n = any nucleotide
  misc_feature (1616)..(1616): n = any nucleotide
  misc_feature (1626)..(1626): n = any nucleotide
  misc_feature (1654)..(1654): n = any nucleotide
  misc_feature (1825)..(1825): n = any nucleotide
  misc_feature (1882)..(1882): n = any nucleotide
  misc_feature (1973)..(1973): n = any nucleotide
gggtgcgccaaggagttgggcgcctctacgttctccacgtcgagctggcgcaaccggtttcccttctcgcaaaggggaaggatcaagcctgggtctggcacgctagatacggtgtcacgcccagaaattttcgaatagaattccaagcagaatgtgcattaaaatccccgtccaggaccggccggggtacacaaacgacaaagttgacatacagatccacgtcttacaaacattataaaagttttacataaatgcagcggaaaaacaaaagataactggagctaagccttgacttgaactacagcgggaacaccactccacaggcatcctcgatggcacggacgaagcctactcctcggagaaaccaccatctgacgcatactcaaactctggggtttggggaaaatagagcaagactgagtattaccaactgtactcagcaagtcataccggaataggggtatgatgcagggaattatcaagggatagctataatggttcatttgcataaaacgagcatttataaacagaagttgaaagcagtaaagcagttgtaacaattaatcaatattaatcatccactgtccaacgctataccacattgcaacaggcccaaccatccacctatactatccaatttcattagactaaactagggtgagactaatcacggtgaatctggttgatcgcccataaccacgggcacggccatttgaatagttttactctgatcagaggtgtacaactgtacccacaagacacaaccccacgacacgttttcgtgcgccggcatgccaccacgacatactagaaagaggccgtgacaggacccttcgcataaccccctctaaccaagcacaccacacctcaggtttcaccccnactcctcgcaaggccgtgggcagtcccctctcgtgcctagatgaatccggaagccgcataggccatcgcaggacccatccaaactccatcacgcccacccttgcctggatgcgtcaggtagaggaaagctacactacaagcccagccgttgcccacactggcttgtggtaagtatgataagttcttacagggcatcccgcgaaccggtccttaactgctatgggtgcgaccaacaaaaccatgcacccacagcccacccatgtgatttattttaattaaccaataccgaagcggtggcactaatccaacattaccattagaatctacagtctatacattaataggattttcccctttgtgtgctagttgaacaaagcatggctaagcaatccctagtccaatatctagtcatgttataacccaagctaacaaaggagcatggtaccaaaatagcatggctgtaacagtaggtaaacatcacatagtattattgtaaaacaatgcagtatttgaaggaaaacattagaacatttgcaatataggatcaacatgttcaagtgaccggcatgacttgccttgctctactgctggaggaacctcgacgactatctcgaagtacaccggagcgtcggaagagccggaatctaagtgacatacatagcaaacnatacaacacgctataatactactgaaacagagacaaaccanttttaatggattctacatatttttcntgatttactnagacttgaatgggcttaaacggagctcngatgaattagttatgaattttagaagattcactgtgtttttactataaacagaaaaatccttaattgaattattgcgcaataaatgcccagggctgacgtcatcaaagggagcggcagcgcgacatgcggggcccgcatgtcagcggcgcaaggggagagggaggggcgcnggcacgtgggccccatggatcagcggcacaaagcggccggtccaccgtggactgggnccacgcgggtggtccaccgccggtccacgggaccgacggtccggatcggcctcgggccgatcggacggcgcagggagcagccgccgggctnggctcggcttcaaagccggccggccgg

SEQ ID NO: 1688 - DNA, 2000 bp, Oryza sativa
  misc_feature (24)..(24): n = any nucleotide
  misc_feature (1982)..(1982): n = any nucleotide
ataggtgggcccgaacgctttttnattttttatttgctgactggattgcaacgttgccgccacgtgtgcaagcttaagccaaaaccactcagaatagtgcttgggggggggttaatttgtccggtagtgtaaaatgtccggttttgttgttcaaggggtaattcgatcgactgttatagttcggggggtaattcatactttttcctttacaaaaccgacgaaaaccggacgcactattgaaaaatgattttttttacaggcactcctactgcacgagcggaccgagtgggtaactccacgactgcctgtactgaagtctgttaggggggagccgtcctggttcacctacgaagacaggattaatttttagttaaaattgaactttttgactggctcgagaatataaattgctcgcttttctgtccaaattttaaaaatggatttgattttttttcaaaaaaaaacttgaccagatcttgtctaaaacaaaagtttttttatgaaaaccaagtacggtgaacttgctagctagtatagtcaagcggtctcgtgtcattattattccataggtgtatgacacaatacgtgccctcatatatgcacatcttatatcaccgttttcttctctatcaataatgggtgttaccatgaacaatcgctagttctgcttgtaggggatgccatgcatgagcaatgcgtcatcctgagtttgaatccgtacaaatacaggttatctcactgttttcttctctattaataatgaatgcagtgaaaatagtaagatacaatgggtacttcgtattccaacaatttcatatatgcagtgaaattggatccaattacatttatcgaaaaattaatatgtacacacacagtgagagtgtgagactatagttagatgcatggggtgtgtgtgtgtatgacagatgcgtaaaattttagttatctcatttttcttcatatgcatgctgaaaattattgagttttcagattaagtggtgggtgtgcgtgcatgtcttgagatcaccaacccaaaaagttggaaacaatagcataattccattgccgtcctatacgttgaccaaattaacaagtttgagtaaaacttacttaaaagcaccgaattagcacacgatcgagcctcgatccatcctaagcgcgcaaaggaaacacacatgcagtggggcacaaatctaaaggcagattgatcgatcatgcagaaatcgcccccaaaccagtaaccgatggcccatcagatcatctacaagaggttacctagcatagcatagcataaagaacaaccccaagcacaacgatcgaaagaatcttcttcggttgagacgtagctttcgatccagagctctctgcctctctagctagcttcaattcccttcaaaatttaaagagtaaaatgcatttacagtccttaaacttgtacagttgtgtcatatagatcccaaaaattgtcaaaatgcatatctaggtaccaaaacttgtcaaagtgtatccaggtcccaaaacttatctcaaaacacgtcatgtctgtgtggcatgccacatcaacgccacgtaggattctaaaggggttgtggtgatttgggacctagatgacacactatgacaagttctggtacttagatatgcattttgagagtttagcgacctatatgacacacccctacaagtttaaatactgcacgtgcactttactcaaatttcaaaggcgaaattttaaaacccttttctttctttgagtacggacacttaaattcaattcgttcgctccactaatcttaaaagccattattactctcttactcgctttcatatctaacgcccctctctctctctctctctcactcagcaacagctcgcagctcactctctcactctactactcgtagctaagctagctcgcgccgccgccgccgccgtcgccgccgccatgagcaaggagaagcaccacaagcgggagcaccacntccggcgatgctgcggcg

SEQ ID NO: 1689 - DNA, 137 bp, Oryza sativa
  misc_feature (3)..(3): n = any nucleotide
  misc_feature (13)..(13): n = any nucleotide
  misc_feature (28)..(28): n = any nucleotide
  misc_feature (59)..(59): n = any nucleotide
tgnttacgataantggcgaacggcagcntcggcgagtgttccacggcaagggcggcggnttcctgtcgtgggatcgccggtacaggattgccgtcgaggcggcgcggggctctgctacctccaccacgactgctccc

SEQ ID NO: 1690 - DNA, 2000 bp, Oryza sativa
  misc_feature (112)..(112): n = any nucleotide
acacccaattgtattggaatctgtgtcaccaagatgtttatatcgtgtactttgtccattcaaaattctaaggcagacataaaaaaaaaatctaaagtatgttttatttttngttttttaaatgagatggacatatttgtaatctatatgtagtaaattaaattagtcatcttaatactaattggttagatgtatgcatataatttattggttttatcagacgagttaattttatttttatcttgatgaaaagaaattcaaccagtcaatcgagtagattgcattaaggatcatattagtcacatgagctaactattccactttacctatttgacccattcttactgctgacggatccagtttacttagcccaatcatcatgcggtgcagtgccagaaaggtgctagtagggaatccacttttgttctttaggtttcattccgacctgtcggaactcagggttgttgccacaccacacgttatcaaagaaaaactggtatcggaggggccatggatatccggtgcaccccaattctcttatttcttttaactccactttcatataatttaaaaaataaaccaatcaaaacttactattaaatctaaaacctcttgttcatgtcatcctcgttagtgacaacacaatcttacctaaaagaaagactttggcgtgacaacaatgaaaaatatttgactagcataggtggtgcggctaaaaaggttgttttcaaaatacatattgtagtgtttattttttatatttaaatgagacaggttaaaaaataaaataaactgcagccacgatcatgagcaatgctttaattttgctcgcgcaacttaagaacaaaggacagcggtcaagattcatggatgaatggcgatgaattgtttgacggaaatcattttgtgctggagtagtagtacgtgaagcatatctggtagtagtaatttggtagcatggatgttcattaatccagtgatattttcaacacggaggtgatttgcagttgtagagacatgttcttctttaacaatgcacttgtgcctttgtatcaagagagtaagagacacattttgtgcagttcattttgcattaatacacattttctcttcaggatttgctatttcacttgcgatatatttaggttcgtatctttcactttttcattcacaaaatcttgcatcaagaattatattcttatatatcaacttatagtacaatcagttacgcagcacttacacgcaattacggtgtatcaaaattagattttacaatgggtttttctgtagatttacgatttttgacatgtttattttttattgtatttaaaatgggttatatccattggtcagaaaaatttataggtaatcccttctccttaatttgcccggtacatgttccatccactattcagaaaataatctcattatactaaaacagagtgcctcaacagttgatgataacaacatactttctccgtttcatattataagactttttaacattgctcacattcatatatatgctaatgaatctagatatatatgtatgtctagattcattaacatctatatgaatgtgagcaatattagaaagccttctaatctgaaacggaggtagtaactaataattatgctatcataacataatttttgtctttaaaaaagagtatatcgaataaagacaaaaggcccaccggccgatatatctagtagaatccaagttaggatcgaaatcaacctcaacctagtcgtagtagcatcgcctcgctaagctttggttgctggctgacaccttgcacgtcgccgtccgacgcgccatggcgagtcaacgcgtcgcacccgacgacgcatggcgacggtataagtagccgaggcgaccccgccaggatgatccagcagcaagcaaacccaaagccaccatcaacacagcacgtacacgtacgtgcaacgtcactgcatgatgtcatcgtcgtcgccggtggtggcgtcaccgccgg

SEQ ID NO: 1691 - DNA, 2000 bp, Oryza sativa
gtgttggtgaattttattagcgtcaaagcactctggaaaattgaatgagacttccttaacccagcaacttagatttcgccaccaaggttatagggttattttgttttccggaaaaaaatgctttccctataatggtagctaaagattgacatcatcccaaacaaaagtctagcaaaaggtttaaatttctagccattttaaacataagaatcatctgaagaaatttttttttcaagaaagtttttgaaattcctataattttatcagaaaccataacatatgacacgtttaactactaattaaatttttaggttgttagagttttttttcgcaaaatgaccatccggacactataggactatagcaaaactcgtatgtggcgtcgctcctcgcctgccccttctgccagggttaatatttgtcgatatacgtgaatacttaagttcaaaataatatatcatgcacataattaaataaatgaataaaaaatgccaatgtctatgagatacacatgagaccacatgcagtgggcgggcagcgtgtcgagcagttttatagttttatattagtcccagctcccaacgcatgttttaccggtgacttctgcgtcgtttcgtctcacatgtgatttcctggccggcacatacatgaacatacgctccttccgtgtctctctttttttaaaatttatttttttcttattcttttgttttctttttattttccccttattctttccttttttttcccattgtttgagggttaaaacagtaggggaagctcctactgcacattttattaaaagcaccaatatacaagggggggtacaacaggagggaaagaaagaaagaagaaaaagacggcctaaaaggcaagctaattaagatatgctgttaatccattattaaaggtttttctgtctcctttactctatgcatatgcagagtaaactcatccttgaaatcagccttccatttgccaaagtttgcttgaatactgttgaagatcaagtcgtttcgtctactccagatatgccagcaacatattgtcaaaacttccataaaaaagggatgagggaagttcctatacgttgcaatgataatggtcatgaaattcaggtttagatcccaatttataccgaggatatgccaacattgctaggcaaaggggcaagcaaagaagagatgaagagagtcttctgtgattgagttgttgcatgtaacacatgaagctccaccttgggtattgaaatgttttcgttgcagcaactctttagtgtttaatctgtccaataaaagtaaccaaagaaacactttcaacttgagtgtgcatttgcttttccagataagagtcaagggaatttcagattgaatatgggtgaaaaacaggtcatagacacttttcgattgatattgaggtgagttccgtccattgatcttccatatgatttgaatttaaggtttgcagagtgctggaaagaaggtgccattcctgaattgcttggatggggagtggagtataaaagacctcttgtaagaccttttttttccattgtttgtttacatatgtgatgttcatgatatatttttgtttattcacactatctataagatggtctaggatgtattttgagatgttaatgtagtataagcagaattttccataacgtgtctttcattattcacatagtatgttggtgaggttatatggtatattttaggtcatttaagtagtatctatgtgatgttcttttgcttacttttctctattatgtagactttttccattttattattttccccttatgttttcttctatctttaattaattctttttttatttaagtgattcatatattttatttttatatatatttcatagcattagttattaatttttatttctattttcttcttcattattttactctacttaattattttatttaattttaaattttaattttttttattttcaaccgttccaagtccatggaggcg

SEQ ID NO: 1692 - DNA, 2000 bp, Oryza sativa
taaaaacatgacatatattttattggaacaagttcactgtagctctctcatttttatgctgaatttaaatcacgtgctcaatcgtagtactaaatataacgcatgtctcaacttataaaaccggtgtacctagagattttagacagtatagtgcctagtttagttgatgtgacgagtgagaccaacgtgaaccccatgtatatatatatatcctccaaccccctttctccatctttgatacttttctctccatctccgacactacccacactcctcctcatctgtgccgcctgccgcaaccgtggccttgccgcaggaaggagtccctttcttcggcttccccacgttgccacctagcagttccctagctctgcctccgacggcctcatccgctccttcaacctccacccgcgtgacgcctcgccctcgccctgccatggttgcggcgataatgacgttctgatcgggaccattgtcgagaggcccatccacactcttcttgcgccgtcctctttctcgcgtgagacttggccaaggcgaggcgaggggcatgggtccacagcgtggttgtaactggttgctgtgttggacgttcatggcgagacagctgcgcggagtgcgcacgcgggggatgcggtgatgccacgtggtcagctgttggacgttccacgacagcaacgatgctatgacatcagcgcttagtaaatactccctccctcggttgcatgttataagatgttggttaaagtcaagttgctttaagtttgactaaatttatagacaaatatagtaatattgatattaccaaattagttttattaaattaataattaaatataattttataataaatttatcttgggtcgaaaattactatttttttctataaacttggttaaactggagcagtttgactttgaccaaagtcaaaacatcttagaacctaaaacggaggaagtatgttcttgcacggcgcgcctggagccgatatgcaatggattccttccatggccacgccacacggttggtggtagtacactcgtactgcatctgcatgactgggtgagcgaaggccggcgaggcagagcatggcgagaagaagcggcggccagtgatggtgggaagatgatcttgttggtaggtgtaaaccttggagctcgggattggcttggaagatggtggttggttgtggtcaccttgcatgcttctgctgcagcggtaattaaggaggaggagatctcatcagtgcacgacgatgtcgaatgcgtgtttgcagctttaggagcttgccgccgagtggtatggcaagtagatgcttgctggcagaggagctcgcacggtggccgttgtcggcggagtagctcggacggtggccgcggcgacattgccgacgacttcgcttgcaatggggttagttgctgccattgcttcatggtaagtgtaacttgtttttattttgttattctttttgggaatagcccggaccatatgggtcccactcgccccgttagtcaaaaccgaacactagtgcctgagacattaggtacaccaattttacaagttgaaggcagcattatatctggtattgggttcgaggatgtaatttaaactcgcgtcaagatgagggatctatagtggacttatttctatttaatttgggtgaaagggttattgggctttttgattctggaaggaggccgagaccgatttggcctggtagcgtcatgggacggcccagagcggaggcctgcatcacaagcaatgtgatgtaagattctatctttttctttcaataatcaaaatgtgaggtttgtttgaaaacttttcagccatgacaatagatctaaaatcgtcaaacatcaaatcgaataacgtggctctgataccacttgcatgattaaacaagaccaaacaaacctacgagagagggggtgaatggtagggaaaaccaaaaaccctaaaatcttttgcgtaataaagatttacctcgaatggagtag

SEQ ID NO: 1693 - DNA, 2000 bp, Oryza sativa
gatgttttatctctcctttttctctttcttccatgtcaacaagtattcctaattagcaacgcaaagagaccactgttgacaaccattgtacatgccataacaagtgaaatcctacaaataaaaaacaaaaagagaaacgactgaaagttatttttattcgaaccagatgtccggttgtttgaaccatattttaagtcctcatattacaaaactgagaataaattgaggtggctgccaaacttgtagcttagcatgtaatttctggcatgaagaatcaagtaggaagggcagaattgattttttttctgtgatagattaattaattgaggaaaaaaaactaccagaagttgttaggaaaatgtatcaataataatcgaataggagcattgaaaaagatctcatttctctaataccttaaatcaatatcggtaaatccaatctctctaattttctctttatagaagaaagaccattgtatttataatgacctcactttttgacagaaaaccaagcaagtaaaatcctctgctaatttccaagtaccataagacatctttacgatgtcacatgtgcatatgcaagttgcacaacacagtaaattaaacaaacccaaaggtggacctacattattaggctatatgatgtgcaggctgatactggccgtttgggtttccgttttcaatattagacgacattattcgataattaaagtttcaggtatttcaaatctgatacccgcatccacgtgacatataccagacattttcgtttttgataccacggttttcttatagaaaaaatgaaattaagcagtagagtatcaactaagatcctattcgagattctaaagaaacagattgtgagtagccaactagtcgtaatctaaaaatatagatttgttactccctccatttcataatgtaagtcattttaccatttcccacattcatatcgatgcctatctagattcattaacatcaatatgaatgtgggaaatgctaaagtaatttacattataaaacggagaaagtacattctaaccttttaatttattttctggattatatacaattacatagttttggaatctagctagatgatttaggaaaaaggctatagagctgctagaagttcctgtttaaacaggacataggagtgttggactaaacggcacttcagcagtcctggcagtcgtactccatacgttttaaaataaattaacatctttgtacgagatatgtcacgtttcggtttatttttttaaaaaaatagtatgctcgtagcagtagcacaactgaactctgctgtcagctcaggcgtgtgctagctagcaagctcgagcttgccgttaaactgaatggccgctgcacagccacgactggggcaattaattaatagaatttcgctcgcgcagctcatcagatctggatcctcgacgacgacgtcaaccaacaagattacaagaaccaagtcaagtcgtcgtacgtccacctgtacacaatcacacacacagtctctcagtgcctgattaattagcaactccaatcgggaataacccgtcggccaagagatggatgattagtttcagacattaatttgatcctgacacagccaacgcgttccgtcagaggagttagtgcgcgtttgtttaattgggagattagctgcgtggaatgttcttaattacgtcgtcgccaaacctctctgctagctagtacggtggcgagcagtgttagctgccgcgcggcacggcttgccagcgcgtgttcccgcgctatataaggagctccccggcgtcgctttctcctccacagctttagctacgatcgcgacgcacgcagctagcttcagctgatcgcgaacgagctcacattggtcgatcggcgtttgcatctgcattgtgcattgcaaaacgatcgaattagaaagacgtgcaatcgtattgcgcgttcgcgaaaaaggatcgaattcgacggagcctctttaattcacgcagaacg

SEQ ID NO: 1694 - DNA, 2000 bp, Oryza sativa
attatcataaccatttagtcgacgtataagagctgagtgtgtgcttgaaagagtttccgtcgacgatctctctgcatgcaacgaatccggccagcagagccgccacacactggccggcatagcttgctttgctatcaaaatctccaacttgtcggcatccatcgagatatacttatatataagtacctacctagcaagtttattattcgatgtttcttcttcttctttccatggataattaataattaattaataaagataagtagataaccacgttcgttcgttcctcatgatcgatccgccctccctcagatagtaccggttttcgtacggttgaccccgctcgcaaataaacaatgatcttcttcgatcggaaaaagaaaataaaaaaagaaagaaaaggcaaggcgccccaacatttttctattcggcccgccgcctgtgtttcgatcgatcgatctatccggaagcgacgacgacggcgacgtacatacgcacacagctagatctagttattagctggagtagcctttcatgaaagcaacctaatctataattctatatagcttttgctttgcttaattatctagatcttaatttggcctctctctctagttcttctctagttctctgcagaatgaatgaatgaattaagccgatcgatcgacatatatggatggacaggagctagcagctagcaagaatggcaccacatacgatggatatgatcgaatcgatgcataggcagcatatggagcacatatatacgaggaagtgtacaattcaggaggaacatgcatgaactgatgaagtacatatattagttatattgaaattttaaaaaaaaatcctttcaaggatatatgttagtacatatatttggtcctttgagtatattttagttcacgttaaaattgaaagtttggttaaaattggaacgatatgatggaaaagttggaagtttatgtgtgtaggaaagttttgatgtgatggaaaaattggaagtttgaagaaaaaatttggatctaaactcggctctagctaagcaaccagcaacctgcagcagtctcctccatcaaattaacacaaatctatcatgtcgagcagctgagaaaagttaaataaagaagaagaagaagaaaaggcatagctaagctagattctctctctttctctgtcgagaaaacataaaaataaaggcaagtgaacgtcacactctccgcctgtctagcagcgacctatccagaagacgactggcacgatcatccctcatcctgaatgtgaagacatggcatatatatacttcctcgtatatatgacttgaattaacaaaataccttcagaagtaatcctttgtcgtttccaaggaagtatatatttgaattgaagtacacgcatgaacttgaactgatgaagtacaatcctttcaaaggaccaaatatatatataaaaaatccatatatgacttgaatttaacaaaataccttcagaagtaatcctttgtcgtttccaaggaagccctgtctgctaactactacaaaatatcaaataggtgtcgccactataggtgccggaagtactaaaaccggcacctatatgccttttcccacttcccacagcttgaaatcgttaaaaaccgacacctttaagcaactataggtgctggttctaaataagaaccgacacttattctataggtgccggtttttatagaaaaaactggcacctttaatatattataggtgtcggttaattaaaaaccggtgtcggttaattaaaaaccgacacctgtaatatattataaaaaaaccgacacccacgtaatcgagccgagccaggcgggtagatatttttccaacggtgggtcccacacccacgggagataaggacgaggcgtcgagcgctcaagctgcatccgtccagttcttcttagcttcttctctccttctctccatccttcttctcctctctctctctctctgcggcggcgggaggggcgt

SEQ ID NO: 1695 - DNA, 278 bp, Oryza sativa
catgtagacttgattttagaaaaatttagcaacttgaaccacctgaaacggatctacggttatttagttatgattttccgaagttttaatctattaaaagaaattggaaaaagaggagatgatgacgtcagcatgacgtcatccatggccggcccggctcggattggcgacctcgccggagctagggcagtcggccggggttttggagggcatgtacatgtagaggacgacgagacgaacccaacggtactcaccacaacgacaaacgacgaccgatg

SEQ ID NO: 1696 - DNA, 2000 bp, Oryza sativa
  misc_feature (508)..(508): n = any nucleotide
  misc_feature (512)..(512): n = any nucleotide
  misc_feature (514)..(514): n = any nucleotide
  misc_feature (602)..(602): n = any nucleotide
aaaacaaattttataaatgtatgacaacatataaaagaatgcataatctcttgtgcatgacaaaaaaaaaaagctgagaggacttatgagagtgagccattaaaggcactgcccaatcaagttttaagagaggcaatatgtttgcataccttgtgggccaacttctccagcttctcgtgttccattttctgcagtaagtcaccatgcatgttgttagcatagcgtcaagatacattctaaaacagaagttcgcaacgattaagaaagcgggtaatttcggaaaaggtttctatttgaaagaaacaatgattgattctaaaagaacatctacatctgtctgcagagttacaaaattccgagcatcaaatgtacttttagatatacatttgcggtccttaaaggcaatcaaagaacaaaaggaactaaaaaaaggccatgccttaaaaagaagaaactaatatcacaaagcataagcatcaacagtcagtcctgagataagactgtattnagantntccatccacagaaagccaagcaaaatatgggatgccagcaacgatccaattgaaacagcagtagtacaaatacataatggagaaaacnaatcagtgccagcagtacgtttgtgaggatcactagaataacatcaggccagctactgcagtgcttcaaaagagtataattgagcaaccggcatagaagatcacagatatagataattaaaacaagaacagcttgactattgtacaaaatgttgaatgagtaatatttgaacgatcttttttataaaaccaggagaacaaccctgctctgcttctcatgaagaaaaaaaaaacccacataaaactgaccttaaaccaattgttttaagctatttgttaagttcatttctcaaaatatttaatttgtccctataatcaagtagataatcggtggcaacaatctactcaataatgtaaatcaaacagggtatgttcaagtagcaagcaagaatctgtctcaattaggccaaaaaaaatgcaagaataatctaacaggaaagaattttgatgcaacattgcaaccgcaatagcatatgtgaagcaaggcacagggtgaacatatatcagtcataaattgctgtgctaatggatgagggacgcaggcaggacgacagccaactcaactgtattccagatcagtaaacaggcagacgtataatatattcctaggcgtgcactgcaacaatgcaggccgaaaatatttggggatcccagagctgagtgcggtgcgggcagggggactcgtacaggaaagaaagagagaccgcgtcgcgactctctctctctcaagtcccagatttgcggaactaggtgaaatccacacaccgctcaacccgagcccacagatcacagcgcatacgcatctcagacaggaatcgcgcgcccgcacccgagagggagagagatggaaggaagataccttgatgtagacgttctcggcggccttctcctcctcgccgagcaccttgccgccggaggaaaagagcctgcgctgcacgaacctcgccgccgccctggatggagccctagccgccgcctccatcgccgcgagaaaccctagaacacgagacgagaggatcttcgcttcgttggctccgtgaaactgtctctctctcccaactcccccactgatgatgatgatgactcgattctattccaccgctgctatgactccctgtgctactttgtaatttggccctttcaaatatgcttatttgaaaacattctacgtagtcctcccctcagggatggttaacgagtattagaggtttgtgtgggacttggatgaataatactccggatcagatcaaatccgacggccagaaacgcatcggagcgctgaaaccctagcctccccacctcccaagtcatatacctgcagcctcagcctgctcctcctcgtcgccgccatccttgccttcgcctgcgccttcttccgccgccgcatcgcgtcgtcgaa

SEQ ID NO: 1697 - DNA, 2000 bp, Oryza sativa
  misc_feature (1940)..(1940): n = any nucleotide
  misc_feature (1947)..(1947): n = any nucleotide
cgttggccatttgtcggagcatgctactgtccgggagcagatgtccctagccactccctcgctacatcccgacgtcccgccatccatgcctcgttgcagcccagtactgtccgtctactagccaccaaccgctcgagccagctaccatcgctgttgcttgccagttcggtgtgctggttcggactcctctacccccgtcgatcactggcatccttaccggatctggccgaatggcccagttctaggcagagatcttagagggagggataaagagccctgctcccaatgtccctggagttgtccaacttccaacgtccacttcggcggcgatgacgcgagggagaggatgcaggaaggttgtgtggtggtgagttagtcgtgttcgcgcgtgtagcctctggagtgggagcgacatctagcattagctatgtttgtcttggctgtcgaaagatcgttgtgcctatagatctcaccgttttcctaaactgaaccaaccgctcttaaattttaatttttaaaactttaattttagagtactttgaatgtagttttttaagcgttaaggatatgcatataaaagttttaccagtaaattattatttttattattaataaattcttttggtttataattagctctcttaaacaaccgacgatggagctacgattatagaactcgatcagatacacaaattcgggaatcgttcattagtatatcacactggcggtacggtagtgttgactacatgcaacctcgtgcaacacacaccacgtattatattagtatattacctagactatagtttgaaacgaagtgtgatgaagctaggttgacttctcgctgttgatgttctgcccccggccacctgatgattaatttgatattagtagttaattaagaataatatcacctcacatgcagagctaggtgattattgatgtataggccacatggggtcaccgttcccagagatgcgcgcatgcaattagaagcaacatcaccggagtcagcagtgagatcgagcaaactagctagcaaattactcccttcatccctaaatatttgacgcagttgacttttctaaacatgtttaaccgtttgtcttattcaaaaaatttaagtaattattttttttatcatttgattaattgttaaatatatttttatatatacatatagttttacatatttcacaaaagtgtttttaaataagaataacggttaaacagcgttaaatatttcgggacaaagggagtagctgagatcgcgtgcgcgcatgtgaaccaggatatgtgcaggattcatttttattttcagactcttttgaagcgcagggattctaaaactatagaaataagaaaacaaataggaaaacaaaggtttgaatcatataattacttaaaatgtgtttcgatggcacagaaaaagatataaatattgaaattatatgttatttcgagttgagtagtaagagaaaagagaggtgtggctttggaattatcatagaaaacaaataacacgaagtacgtacgagctcatgtttaaaatccttaatttggaattggagcataggaatgaatccaacgggattttaatttgcaagcccaaatcttaccaaccaaacaacctcttcataaagaaaaaaaagcctaaaaattaattaaaatccttcaattttcctttgaaaatgctttaatacaaataagtctttattgggttcaggtgatagacagccacatgtaagtgataaaatcacctgcctttgccttccaagtagacgacgaaagaacctacgcatgcgcgccacccagccactcactcagctcgcgcgctggagtacaattactaaacaaaaactcaaaaagcgagggcggcgtgagctacaagtatacaaggtgggggcatcttcttcctcccgctcgcttgtcttctcctccangcgcgcnacgccgtcgggctcgtgaccgatcgatcgatcgagagagaggtcgctcgatca

SEQ ID NO: 1698 - DNA, 1324 bp, Oryza sativa
  misc_feature (3)..(3): n = any nucleotide
  misc_feature (19)..(19): n = any nucleotide
  misc_feature (32)..(32): n = any nucleotide
  misc_feature (37)..(37): n = any nucleotide
ggngaaacagaattatggngctaggattttangggcncaacggcggctgcatctgtgacaactgacgcgagaatgcgccggcggcaagcttcgccgacggagaggagaagccgcctgcctatccgctgggatcttggcgagtcgtgctgggccgggccattgtgccttgggccggcccaggaaagcatggcctaaggcccagctctatgttactagtaggatctagccgtcagatcaactggattgaagcacgggaagcgtgaaattttgatatgaatgggttcccgtcatacagttggcgaagcaagaaaagtcagagaagatgtacaatatacaacttcaaactgaaaaatgaagaatttccgtatgttgtctcgcaacacaatctcactgcagcaaacaatatcttcgattatactccctccattctaaaatatagggcacaactaatttttaaaggtgtttcataatataagacgtgcatgcatgcatgacaattaattagcatctcttctcttctaaattattactttttaaatgatacactcacgagatgtttaattctattgggtgcatgtattgtattaattggattgattcaaacaaagaggtgatagtaattatttcttggtctttaggttaagggtggttgtgccttatattttggaatggagggagtaatatatgcttgcaaaaggaggttttacaaggtagtaaatgttaaaagcttaatactactataatttcattcgaaacaaaacgtgaaggttgcaaggaagttgcagtcagaaggctcctgatcagaagttgaaagtgctgtaggtgtagggaagatggaagttgtcgaggagttcagaaatgagtggttcgaattgccaaattgcatcacaacagatgaacagaatttgttgcctgcgtattttagaagtacacatatgtgtaatcctatatgacataaatgcatattttctttttaatttttggtgatatttgttaatcctagagacgcgaagacttgtgttacgtttccattttagtctaccagctgcatttcttctgctttaaggactggcaggagatttcgtggtgaattggcaaactctgaaattgggcaacaaaaagacatagcatgcatcatgtgggagaaccaattgggctaaaattatcagaaactgaacccaaattaaccaaggcaacaagtcctcttgtccacacgctgccgcggttcgcgccaacccgcatgacgccttatatataaaccgcacgtacgccgatgccggcctagccctccgcgtggcattccgtcccccccgcgtgacgccaa

SEQ ID NO: 1699 - DNA, 2000 bp, Oryza sativa
  misc_feature (312)..(312): n = any nucleotide
  misc_feature (328)..(328): n = any nucleotide
  misc_feature (331)..(331): n = any nucleotide
  misc_feature (337)..(337): n = any nucleotide
  misc_feature (340)..(340): n = any nucleotide
  misc_feature (343)..(343): n = any nucleotide
  misc_feature (584)..(584): n = any nucleotide
  misc_feature (1380)..(1380): n = any nucleotide
  misc_feature (1415)..(1415): n = any nucleotide
gatcgggcagtatgccgaaacagtataaatcacttaatatctaaatgtgcttcaaagtagagattgcgtatgctcacatcatagccgatagagcaaacctaacgtgtatcagctagtactccgataccaccttatactaagatatcagtacggatgaaatatataaaacacagatcaatctagcaagcagggtgaactagcagactgatggagagcataatatatttcaaacaggtgagattttaatataaagggtggatttagatgatcaagaaccaaatagggaaacaagacaactaaatcaggtaagancggctaaaaccctgangcnatctcnatnagnattcatagaaagagttagataatacggttcaagactttacttaacggatcaaacctaaccaaatgcagcattaagtgtgaaaagaaacgtaagatctaaacaaattgatgaagactcattcaagatggtagatacactatttaatctaactcgatgtcgatatctaaacctatcggcctttttcgatgatagatgctagccgatgaggttagacaacgaaatcgatctagattatacaacntatatgataactcggtgactcacatggacaggattagagtgtcataaagatgtaagcactaatcccgagaatgcaaaccgccataacaagctttcctttttcgtcggagatcgaacttgatgcagcccaactcaaaaggaaaaactcgtcgaaacaatgaaaatagaaaaatggtggcgatgcgccaaagtattattgaattgtcgtcacttgtttacaaggtgtcgggccatatttatacccgtagtagataacatgttcttgctggacacgactctatctctattacaatttaaaatacgaacaagtcccttaggcgaactcttaccaaaaatatctctaaggaaactaaaaatatcctaattaattgatataattgcccttttctggactccaatccttgcgtggcaatgcctatgaggtgctttgattgatcccgatgatagttacggggtcgtcttttcgggactggttgcatcggcttgtcttcattggatttggtgtcaatcgatacatacggcagccgatgccgctcgtagccgatacgaactttgatttccataaacggaattccttcaaatcggctttgactctggctttgaatccggcccacggccttaccaaatttgatcgttaacattgagcccatcaacttttgaaccaaatccctaccttgatttataaggttaaaaggaaaataaattgtaatgtaaccttagatgtcatattatatatttatatagttatgtaaagttaaatgtgagattctataattcaatattttcgatatcgtttnaattctgatcaagtcctcagtatagttatgttttngattttccgatatttatgatcctgttaccatttcgagccttactgtttttatttagttttcgagaaaaaaatatggttacttgagacgtttttcgaccattttcatccctaatcgtgcatatttgttcagaacataaaaggatccaatcatttaatttacaaactataaacgcacaaatataaacaaatatattgactatgtttgacaaatgttttttaagtatgatttaaaactttttatatttgaacaaattttttaaataagacgaataaaagtttgtcaaaaagtcaatagctttatacgttaaaaaacgtaggtattacgtaggaacttgggaaggtgtaaggggaactgaccacgcgcggtcatatatcagcatcccctcgatctatgaaaacatagatcgcaccggctttggcatataaatactacggacggagctcctctgacgtaaagtcagagagacttcataatgtccctctgacttaaagtcagaggagcctcgtccaagtactaccactagcatgttccatcgatggcgagagagattagtagagggggcactcaactttgccaaatcgccc

SEQ ID NO: 1700 - DNA, 2000 bp, Oryza sativa
cttctttttttctctaaacacaaacgcggccaaattactagagaaaaattacaatttgtttcattggaaaaagaaagtgtgcgacgatagaaaccagacctaaccaggcatggtacacgcatgtggcaagaatggtagtacttacttttagatcaattggtaaaataaaatatgatacccgatacttttagggtaaattggaaccatgccattataattttacaaagtttgagatatgccatcggtatctcaatgacatgtaggacccacatgagtcaatgacatgtgggtcaggatgatatatcttaaattttgcaaaattataatggtaatggttctaattttcccatacttttatgatacataataactccacaatacttaataattgatactatcttcattctaattgaaaaagagtttattttttttataaggatctgaaaaaaaacttgtccatatttatatataagtgaatttttgagatggaggtatcacacccataatattcataggtactataaaatttggtaccaaaaggttcaagtatcatgatattgatctccatgacaccaagataccaagatacttgtactatgacatttggtacctaatggttcaattatcattatacctaatatcaccatgatatcttaagatatcatgatatatatttgatacatttatgatatttaggtatcatccatatctatatctatatactactcgtacctgtttaatggtaccatcatacatgataccttcatgatacccaaagaaatcatggtatttaggtatcatccgatatttttatatttattgaagttatcataatacctgaaactttcataatatctgatgatactacctctatattttaatagataacgccattaatttttaggcagacgttggacccttcatcttattcaaaaattttagggctaattggatccataccattaaaaatatgttggttttgaaatatgacactagtattcacgtatcgggaaccatgccattataattttacacgtattcaagatatgccactaccctttggatgcatttacaaaaatctggaccaaactacccttttccccttattccttctcccttcttcccctttcttcttccgcctctcctccatggcgtgacctgactggcgatggtggccaccacagtcacacctcctcctttctctagcactctttcgttcgtgtctccctccaccttagcccgccgccggcctcctcatgcgcgtcatctccctccacctcgacccgccgccggtctcctcttgtgcatcagcgcgtcctagatccagtcgcctctcctcgccgtgtgaggagctctgggcaatggcgatgaccaaagaattaaagagcggccacttctctctggcaagctcctgcacctccctccctccctccctcaccgcacccgcagcttctccggttcagcagctgcctccaccacctcgacgcccgatgcagcgaggacggccttcgtgaagagcctcggcagatggcggacctgcggtgttctgtccggcgctccgagctcccgcgacggatgtcgcaggcgaagagaggtagaagatgagtgaagagagagagatagaagatgaggggatttttcgtccaatacatgcaaaatacgtatcttagtggcaccattgagattacgaacaagcagcagtggcattgttacaaatacacaaatagtaatggtatattttaaaaccggcaattttttagtggcacgtatctaattaacccaaatttttaatatgtgagtgtgtacgttctatgaatctgtcacaagtcatgacgccgcgagccgcgtccagctacaaaccactcaacccaaacgcatccaaaacccctcgctgagctgccatgcatgcactccccctcctcccactataaattatcaccacctcattcccgccatgtctcaccaccaccaccaccaacactgcaacacaacacaccacc

SEQ ID NO: 1701 - DNA, 2000 bp, Oryza sativa
tattacatttgttttttatactgaaactcaactctagtttggctgaccaaatgcgccattatattactcaatcatggaaaacatgcatgagcttaccagtgcatggttcgaaatatttaataacgtactactctgttgtgattccagtttttattaatatgctttttttaatcgataaatgtattttccttgtcaacagtgttttggcacatgaacaccttggggggctgaaatcaacatgttatacattgtaaaggatctgttagtagattttttttttaagaacaaacttctactatgtcatatggaaagccaaaagtacttggatatttatattttgggatgggaggagtaatatggaaattcgcattatatatgcacattgcacagctgcttatctgccagaacaattccatcttcagttggctggagtctggaggcatttttcgtacagtaccatgcatcttgcatgtgtatcgttgctcgttgggcattgcagcgttgacctgtatatttcctacagttttttcagcacgccccactgatccctctagtctgtacgaactaacgaacagtttattatcgctgcatttgtgtactgtacaaaacaagcaagtggtgatcccagagctagtgttattttagtactgttcttgtcagtacaggttgtgttatgttgcgtttatactacgtactatacatctctacatgtgtgccgctgttagtacaacctgcacgctaagcaagatgattatagataatctctctgaatatcttgggttgggctgcattgtagcgtttgcctggagagtggattttaaaatctctacttccatattatttaacacttaaatagttattaaaaaatttaaaaacattcagaaaatgtattaacatatgatatatcactctacaaacatgcaatttaaaatttaatttctacatgtcaaaacgaaaaaagaataaatttgactataaatatacgttaactagttataatttaatttgttttttttgttacgatatgtaggagttgaatttaaagttgcatgtttatgaagtgatatatcacatattaatacatcttctcaatttttttaatttttttcataattgtttaagtggcatgcaaatataactaggggacatcccctcaaaagtttattatagtttccccattggcctgtactttacccacagtagataaatacagtgatattcaacttcatttatctaatgtactactccctccgtttcaaaatgtttgacaccgttaactttttattacgtatttgaccatttgtcttattcaaaaaatttaagtaattatttattattttcatatcatttgattcattgttaaatatactttcatgtacacatatagttttacatatttcacaattttttttaataagacgaacggttaaacatgtgctaaaaagtcaacggtgtcaaacattttgaaacggagggagtacaaaacaggctagtggtgtttagtttagaaatccttattgtcagtataggttccatgttgttggtataatctacatgtgtgctgctgcctgctgttagtagataatatctgtatctgccttgggtctcctgcaacgcatgagcggttagttggcttgatgagaaactgaagcgtcacggtttgagtggtacgtgtctccagcgccgtggggtgggagtgggatacagtcaagactccttcaataatcttcttgtcaaaaagaaaaaggtcaacggtttcaggcctacttctcttcctcacgcgcgctgtcctggttgtagttgtagttgtaatccacaagaaactcaaatcaaaacgcacacacaattcaattctcgtctcatctcataccatacccctgtaaggctgtaaggtgtaagtgtgttcagcgagatgcgagcttcttcttgacctcgacgtagatccatggccggcaccggaggcagccctctgctccgctctccctctccggtgatgaaca

SEQ ID NO: 1702 - DNA, 193 bp, Oryza sativa
  misc_feature (70)..(70): n = any nucleotide
  misc_feature (89)..(89): n = any nucleotide
ggattaaacaatttaaaagggggggccggccgccgggaaggaagccaaagccgaagccgaaatggagggncttggcttcttccggaggntcctccaggcggcgcttgcccctgtccgtgcccagtccagccttttcgccgcggcggccgccgccgcgcccgcgccggagaatgccttcgccgccgccccgaag

SEQ ID NO: 1703 - DNA, 2000 bp, Oryza sativa
cacggcgtccacggctgccagcatcgtcgtcccggctacgtctcgccggtgataggtagaagcagaacaagaggcgaacaactcgcaagcatttgaacgaacacctcatgtgcgagtagagcagcactgaggcgttcggagccgaactcgtcctatcaccggccgcggaggcagcgaacaccagtgtggattggagggccaagtctaacgcgatttggtgaaacatccaacccaacatgcatcgactgcgcgcggcggcggcgtcagttgctgttgctctgtgtgtgtccaacgccgcgacggccggcggtggcatccgccatgtgctgtcgacggctacgtggcgacgattggagtggcaccgccggtgaggaaggtatcggcgtcgacggggacacaactccagatcagatcagctcaagtgctgaactgatttttgttcagtttctgctccgaagtctgaaactattgatctccacaagatatgggctgccttttgctttagaaaagaccgaaatcaaaacgtaaacatttcacttctccaaatgtatggatgatcagtcatatatcatactccatcatacagacagcaatccaaatgaccgagggcggcaaattacctggaatttttatattttggtccttattgaaaacttattttacaaataggtccctggaaaaacttaaaccgggaatgtcctttttggggcgccagagtggttgacgccgtcctccaacatggcgccaccagccacaatggcgccgcggccgtgccaccgtggcaccagagcctacgagggcttgctgactcggcagagcggggcgccaaggaccaaaatataaaaatttcagggcaaattacatttattccaagaaagaatacgatatacttgtcatgcctttggctcggcctggcacgagtgtacgacacgaacctattaggctgttcctagactgttggtatagcccatggacaggcacgacacggctcggcgtgttgattaggccgtgtttggtcgtgctcgggcccaatggcctatttgaccatctatacttacttgtcagcagcacaattgaatcaaactccatcggtctctattctctaaatataagggattttggttggatgcgacacatccaagtatagcgaatctggacggaagcatatccagattctttatactaggatgtgtcacatcttatcaaaaccccttatatttagggacgaagagaatacatattaaacaagaaaacaatagcaaatcagtttaccctcccgtttatcgaaaaggaaggtaagtggaacgtggttctaaaatatttttaatttattttctttatataaccgacgtgggcattagagagattcattatctcttgacatttcaggtagaattgttgcgtctcattaagtttttatgttttccttaccaagttattgtaattgaacgaaagcactatgtagacgtcacaccggatgaattcttggggacgtttcactagggccgagtttagttcgaaactttttcttcaaactttcaactttttcatcacattaaaacttttttacacgcaaactttcaacttttccatcacatcgtttcaatttcaatcaaacttctaattttagcgtgaactcaacacaccataggatatataaaatcgtcgtttaaaccatccagagagatataaatgtacatggtttcgatagttgagaaagccttcttaatttggttttatggttaagtggccaaaattagacctggactatcattgaaagaggcaaaatggactttgtttatcccacataggaccaacgcgttgccggaaggcgtccaacccgatacggaatccttcaacaatcaataaatccgatttaatctcagaatcagatagggagatcgtccctataaaagtgagttatatatactgcagccttatcacagacaggtgctaggcttactcgtgaactgggaactaaataatcagatgagagatca

SEQ ID NO: 1704 - DNA, 2000 bp, Oryza sativa
  misc_feature (167)..(167): n = any nucleotide
  misc_feature (170)..(170): n = any nucleotide
  misc_feature (261)..(261): n = any nucleotide
  misc_feature (302)..(302): n = any nucleotide
  misc_feature (329)..(329): n = any nucleotide
  misc_feature (331)..(331): n = any nucleotide
  misc_feature (339)..(339): n = any nucleotide
  misc_feature (341)..(341): n = any nucleotide
  misc_feature (366)..(366): n = any nucleotide
  misc_feature (375)..(375): n = any nucleotide
  misc_feature (392)..(392): n = any nucleotide
cataccgaccgagcgagtggacactggccggccgacccgatccgtcctccgccactatacgtgctactgctacctttctgccttttctaccgtgctactggtgcgcgtgactgacgtcacggtgacgtcagccggtaggttcgtttctccgtcgccggggctggtangtnagccgggccgttggacgtcggagcgggtctccggtccggtccggtctagcccgtggaagcaacaattgaagaagaattcctttgactctcntttaattaaactattatctctgatgttgttttgatcattcntttttcctttttaccccttccatagangntaaactgnanaagtccaagcttagtgaggtttggngaccatcgntaagctgatcggaaccntatttttttttttttggggttggtggtgttgttagattataatccgatttaggctatgttcgctccagcgtgttccgaaaaacagaacgatccattagcatataattaattaagtattagctaattattttttaaacatgatcaatatgatttttttaatcaactttcgtacaaaaacttcttaaaaaaacgcaccgtttagccgtttaaaaagcgtgcgcgcggaaaacattgaagatgagttgagatacctagggtaagaacacggccttagtattggatgtttccttcccttatatagtttcttacgtagtgtccgtttcctgtccgtttcgtaaatattttttttatatctaccaatggtagtgtccgttttgtaaatattttttttataattaccaatggtctttgagaaactctaatatatttcacaaaagatatacctatgtacaaattttctctgaatcgtttctcgttagttttatactccctctaattcatattataagtcgtttgactattttcctgattaaattttattagatttgatcaagtttacagaaatatttagcaacatctaaaatatcacattattatttttattaaatctcacataatatgtttattttgtcttgaaagtactattattttttctataaacaacttataaaaggaaacagagggagtagtaactgtttttgttgttatcgtcaaacttaaatttatttggtattaacacatgcaatgagggaaaaatgtcttattctaaattgggaaaaaaacaattatagccaaaagcttgaggataaagacactccctcatacacgatgtgtcataggtaaacaacaaatatatgaaaccgtcaattctttaggataaaaaatcatactcttgtaaaccaattctaaaaattcagcttgccacatatacacacaaaatgacatacaaaaccaaaatgtcacatcacatatatagaaaacaaatacctaaaaacttggatattccaaccacaccaaacttcttcgccaacagcttccatattttagacatgacatatatgccgtgcaaacgaaaaagatttactctacagcaggcaaggagaaaaggggagatacacgagataaaagtcagtggcctgagagagtgaaaggctgaaactcgagcacaacccaacactgccagcagaaaaaactgaaaaaaccagaaaagccaatggtcaccaaccccaacaaaaaagcgagcgaccaatgcgatgggggttccgtaaaatcccatccccttcccaccctacccaaacacccgctggtataatggggttggtaaacgacgttgacgtggcacccctgccccagtcaacgaaccccccctccctctcaccaacccaatgctcctctcgcttacaggtgggtcccacacgtcatcctctccgggccccgctcaccaactccccccaactcccttctccctcccgctcccgccagtatttaacccctcccaccttccattcctcccctctccaggagacctcgccgccgatcgatcaatcgccgccgccgtctcctcgtgtaaccctagcttagtggattagtttaagtgtttgccggaga

SEQ ID NO: 1705 - DNA, 815 bp, Oryza sativa
  misc_feature (3)..(3): n = any nucleotide
  misc_feature (7)..(7): n = any nucleotide
  misc_feature (16)..(20): n = any nucleotide
  misc_feature (22)..(22): n = any nucleotide
  misc_feature (24)..(24): n = any nucleotide
  misc_feature (27)..(29): n = any nucleotide
  misc_feature (37)..(37): n = any nucleotide
  misc_feature (39)..(39): n = any nucleotide
  misc_feature (42)..(44): n = any nucleotide
  misc_feature (57)..(57): n = any nucleotide
  misc_feature (60)..(60): n = any nucleotide
  misc_feature (62)..(62): n = any nucleotide
  misc_feature (67)..(68): n = any nucleotide
  misc_feature (71)..(71): n = any nucleotide
  misc_feature (73)..(75): n = any nucleotide
  misc_feature (79)..(79): n = any nucleotide
  misc_feature (81)..(81): n = any nucleotide
  misc_feature (89)..(89): n = any nucleotide
  misc_feature (91)..(92): n = any nucleotide
  misc_feature (96)..(97): n = any nucleotide
  misc_feature (102)..(102): n = any nucleotide
  misc_feature (105)..(107): n = any nucleotide
  misc_feature (113)..(115): n = any nucleotide
  misc_feature (117)..(118): n = any nucleotide
  misc_feature (124)..(124): n = any nucleotide
  misc_feature (140)..(142): n = any nucleotide
  misc_feature (151)..(153): n = any nucleotide
  misc_feature (160)..(160): n = any nucleotide
  misc_feature (164)..(164): n = any nucleotide
  misc_feature (170)..(173): n = any nucleotide
  misc_feature (176)..(177): n = any nucleotide
  misc_feature (179)..(180): n = any nucleotide
  misc_feature (186)..(189): n = any nucleotide
  misc_feature (191)..(191): n = any nucleotide
  misc_feature (193)..(194): n = any nucleotide
  misc_feature (196)..(198): n = any nucleotide
  misc_feature (202)..(206): n = any nucleotide
  misc_feature (209)..(209): n = any nucleotide
  misc_feature (211)..(211): n = any nucleotide
  misc_feature (214)..(214): n = any nucleotide
  misc_feature (218)..(219): n = any nucleotide
  misc_feature (224)..(224): n = any nucleotide
  misc_feature (227)..(229): n = any nucleotide
  misc_feature (232)..(233): n = any nucleotide
  misc_feature (236)..(238): n = any nucleotide
  misc_feature (240)..(244): n = any nucleotide
  misc_feature (249)..(252): n = any nucleotide
  misc_feature (254)..(256): n = any nucleotide
  misc_feature (259)..(259): n = any nucleotide
  misc_feature (264)..(265): n = any nucleotide
  misc_feature (270)..(270): n = any nucleotide
  misc_feature (283)..(283): n = any nucleotide
  misc_feature (299)..(300): n = any nucleotide
  misc_feature (319)..(319): n = any nucleotide
  misc_feature (339)..(339): n = any nucleotide
  misc_feature (347)..(347): n = any nucleotide
  misc_feature (349)..(349): n = any nucleotide
  misc_feature (361)..(361): n = any nucleotide
  misc_feature (366)..(366): n = any nucleotide
  misc_feature (379)..(379): n = any nucleotide
  misc_feature (393)..(393): n = any nucleotide
  misc_feature (404)..(404): n = any nucleotide
  misc_feature (422)..(422): n = any nucleotide
  misc_feature (445)..(445): n = any nucleotide
  misc_feature (455)..(455): n = any nucleotide
  misc_feature (458)..(458): n = any nucleotide
  misc_feature (463)..(463): n = any nucleotide
  misc_feature (470)..(470): n = any nucleotide
ccnaaantttttttannnnngncnaannntttttgantnttnnnaaaaaatatttgngtngncaaanngtntnnncctngnttaaaagngnngcannggttnccnnnttaaannncnngggggntttttaaaagccccannnttttaaacnnncaaatcncatntaaggnnnnttnnanngggggnnnnancnngnnnaaannnnnttngnaanggtnnaaggnaannngcnnaannngnnnnntaaannnntnnngcnaattnnaaaanggaataaaaaacntaatgggtataaaatnnggtacccgggtttaatagnttagtaagcaacttttgtanaaattggntnttaaattggttntagangatttggggctantagggggttaaacntttgaacttgntttaaaaactccctccgncccaaatgggccccaaagaccgngataaaaaanccntgtgnggcagtnacagggaaaaaaaaaaaaaaagcttctctaatcctagctcgtgacctgacacctgtccagatgtgaacgaatcgagcggaggctagcgaagtagtagcgagtgtagcatcttctcgcgcgctggtctccccaccgtctcttcgccatttgcacaattctctcactcctctttcccctcccttcttcttgcttcttatccccaagcaataacgaggcgtcatctctctcgtcatcttctactctccctcctctagtcctcttcttcttctactttgtacgcgccactcactctccgagcttgacggcggcggcggcggcggaggtcgtcgagtggtggtcggggag

SEQ ID NO: 1706 - DNA, 2000 bp, Oryza sativa
tccgcgcgcccttcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttaatttaaattaatgcattaccgctttatttaaattcccgcgttatcactgttttatttagccatgcctatttacctttgttaagacattattattgctattgttattattaccttgttcaccctaggataaacaaaaccccaactagtgtgtactctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatagagatggacgaagtcgggggtcgatggacatctccagggcaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccggtttggtctgaatcatcgtaggccttgggttaaggcaggttcgtgtgggttcacggccttgataaataatattgtatagttctagaatcgtgtttacaaaatagctttgagcaactaagtatctttaaatgctgtttactgcaaccctaaccctttatattataactcccttgtactcccttgcatttattatgcacttgtgggtgtgtcttgttgagtacggtggttgtactcagtcttgctcaatttttcccaaacccagaagaggagtctctggaagatgaaggttttggtgtctagcttgtgcctgccgtcaagcgcctgtggtcgtcgccctagtcttccgctgtttctcgtttgtctttgtgtgtgttgggccttcgctgcccatgtaataaattaactatttacgcttccgcttgttgaactctgaattgtatcaacttttggtataccttgcctcctgggacaaggaataatgcacgcacgtaaggaacgcccgttgggttatttccggtcgtgacaatggagatttacggattattggtgattaggttttgcaattataaaacatgtgtaagcgctagcctggaaaagacaggaaggctgcgccgttgacatgcagaccccacatgtcaacctaaaggaccacggtagaccgagtacacag

SEQ ID NO: 1707 - DNA, 2000 bp, Oryza sativa
gtatgtgtataaacatttgatgtgacggaatttttagaaatttaaagggaactaaacacaacctctatcgtctttccgcccacagagaaacatcttctactcgtcaatttaacacttcgttccttccttgccgttggaaactaatttttctcgcacgcaaaacggagcaactcattaacataactaagtattagttttttttaaaaaaaatagattaatatgattttttaaaagcaacttttgtttttttaaaaaataaacaaaccatttaacagtttaagaacgtgcgtgtggaaaatgagaagaataagttataaacttaaaaaaataatgcagttcttggattctaggcatctatcataggacgataaaaaattcaagagtaaagtgtacgggcagtctttaaacttgtaggggtatgtcttctagatccctaaactctcaaaatgcatatccaagtcccataacttgtcatagtgtgccatctaggtcccaaatcactaaaacctcttcaggttcttacgtgacgttgatgtgtatgcctcacggacatgatatagaattattttgactgacaaatgggacccatttaattttttttcctttttccttttcttttatctttttcccctttcttctcctttctctgtgacccgtgcagaaaaaaggaaaaaaataagaatgagaagaaaacgaaaaagaaaaggaaaaagaagaaaaaaaaggaaaaggacacgtcacgtccatgtggcattgccatatcagcgccacataggatcttagaggggatgtgctaatttgggacctagatgatgcactttgacaagttatgcgatccggatatacattttgagagtttatagacctatatgacacaaccctacaagtttaagtactgctaatgcactttactcaaaattcaatatcatgctgttcacggttaagagagaaacaaaacgagcatcgtagtacgtaaacttgtttgaaaaaaagttttgtaactgcgaacagaattacagaagactacagtaatcagtcagatggaaaaggtatacctgaggttcctctcatcatgtcacgagatacaaaatcgtgcttttcaaccgtaaaactggataaaacgtatcccccaacttacaaaactagtacagagtatgatctttgaggttttgctatttcacttgcgatagaattttgagttcttatactctgacttttcacccgtacgatcttgtatcaagatttgtgttcctatgaattcaacttgcaaagttgcaattacatttagttacaaagtacttatatttggttatagagtatttacacttaattacagagcaactacactcttacattaaaaaaacatattttacaacagcttctttctcaagatttatgattttctatatgtttgtcccttttcttttatttcattcaaaaatggctatatgtattggttggaagttctgtaaaatttgaagcttcaaatctattgaaatatcaatgggtagtctcgtatttttattggcatatatagagataaaaagtatataaagtttagtttagtgtaaaactcctgacaattagattttcttataatatataagcaggaagataagattgaactgctttatcacatggataagcgtaggagctgagcggccggcgtgattcggcccacatgattgggctggtcgtgtgggagcattttggccggccctggtagataggagtacgcgatcacattggaaaatcacagctgctcgctgcacgtcgttggagtacttcctaatcccaactgttactcggaagttaagggcgccagcgccgcgtgatccaatcacctcgcaaaatcaccttgagaatagtatattcggaacagatttgcagcctcgtcgtgtctataaatagggtggtaaacacccatgcatgcaaagccacaagcaattcaacgagttacaccttccaccgtcaaccgaggagctttcagttgttgccgg

SEQ ID NO: 1708 - DNA, 2000 bp, Oryza sativa
  misc_feature (449)..(449): n = any nucleotide
  misc_feature (522)..(522): n = any nucleotide
  misc_feature (631)..(631): n = any nucleotide
  misc_feature (648)..(648): n = any nucleotide
  misc_feature (664)..(664): n = any nucleotide
  misc_feature (671)..(671): n = any nucleotide
  misc_feature (699)..(699): n = any nucleotide
  misc_feature (833)..(833): n = any nucleotide
catttctctcagagagctagataaacgttggaggcggcggaggcgagtgcgtcgggaggcggcagacgagggcgagggtggcggagcaggcgaggtcggctgaggcggcggaagggaggagtcgcgagggaggttctctcggcatgggctccagatgcaggcgtcagttccagaacgaaagaagatagggtagctattgttataaagtgaaagtgacgattatatccctccgtaaataattttatatagataaaagtactctccacaattctactaccactaagtgaggtggtaataaaaatagatctgaacccttcgatcaaataagatcaacagttcagattttttttctactacaagtagaaagcatcggagtgaggctttagtaagtatatactgtattaatttgactggcctgtgaataccatgttatatgtagtgtgcatgancacctgaagttattatttcctttttttaaggctcctttaacatcattctttttttccctgaagaaacggccangaggtttaatacgtccgcgcaaaaaggaacacgcaagttagccccaaatttccaatcattacacattcgccattgcaagacagctacagtccgcccgcaaggtgccttngcggcggcggctgctantacggcgggccatggngccacgnaacacaattgcagcctccggcggccgtntcgccggagcgagattacgtcggccaagtgccaggtgcagcccagccgccgcgcgtgtgtcacccgctgattgctgttagaaacgattaagacttagaatttggttctaaagcagagatactgatgttttaagngcttctcttttttttcccgcctttgatttgctatactagagcattttgtttttctcctttcagctttcattttatcctggaaatgtagaacaaaaggcagacatgtttgcaacacatctacaaatacatataagtgctttgtatcatcatccgatgtaactatatttttttttcatgtcaataaagctaatggcctgttcactttgatgctatttttaaccttaccaaattttggtaaagttgtcaaaacaaaaaaaaaagtggctacatttagtttgctactaaattttggtaactatataaaaaatcctgccaaaattttgataagttgtcaaaattttgacaactataccaaaattttagcattgtccaaaatttagtaattttttttaacataaaagtgaacagctcctaagccgaatggcactccccgtaggcaccacccccaaaaagaagaaaaaaaaaacgagctactgtttgagcgttggttttggatcggacggtgcacaacccatccatttcctgtgccagcatatccccctcctgatcgattcggattcctccagctaccgacacgccgacacttgtcacccacacaaggcccatgtgcggcccaactaggcccacccttccgacacgtgtccctcccccaccctcaccgaccggcagtagcattcaccttctccgccctcccccctccgccgcctccgccgctcccccaccttccagaaccttcctttcccgaaatagccacccctaccctaccctaccctacccacccccgccaagatccccgccgccggcgagctcgagcccttggtggtgctccggcgggcgttgtcgcggtcggatcagctgctgctggtgctggtgatgccgctctctctttcttgcgtgtacttccgggtgggaggttgatggcgatggtgaggtgttctttggcgcggttgccctcgcccccactcttatctcctctcctcgcccatgctacctaccttcctcccccgccggagctgctctgctgctcgtactagcgtgggagctgcctcttcttgttgagccatttcttgcctacaaggacagggtgcctcgccgtcgccattgccggcgtcggagccggacaaggaggttcagtgtactgtaccgtggttttgggccttctgagct

SEQ ID NO: 1709 - DNA, 2000 bp, Oryza sativa
  misc_feature (142)..(142): n = any nucleotide
  misc_feature (228)..(228): n = any nucleotide
  misc_feature (516)..(516): n = any nucleotide
  misc_feature (525)..(525): n = any nucleotide
  misc_feature (527)..(527): n = any nucleotide
  misc_feature (530)..(530): n = any nucleotide
  misc_feature (533)..(533): n = any nucleotide
  misc_feature (536)..(536): n = any nucleotide
  misc_feature (718)..(718): n = any nucleotide
  misc_feature (1573)..(1573): n = any nucleotide
agtagtagtggattgcgcgagacgcactgtcactctgtaccgagggccggaacaaccggttgttttctttgcacccccaacctctgtcagtagttcagaactgcatcagataggactgtcagaaatccccatcgtaaggganttcggagatgtgtttccggaagaattacccggtatgccgccgaagcgagagattgagttccgaatagatcttgctccaggaacccntcctctgtacaagcgaccctaccgtatggcagcaaatgaactggccgaagtaaagaaacagttggaagagttgaaagaaaaggggtatatacgtccgagtacttccccatgggggtgctcctggtgaatttttgtagagaagaaagacaagacgaagaggatgtgcgttgactacagagctctcaatgaagtcaccatcaaaaaccaagtatcctcttccccggatcgatgatttgttcgatcagcttaaaggtgccactgtattctccaagattgatcttcgttccngatatcacnanttncgnatncgtgaagaagatattccgaagaccgcattcaccacgtgatacggactgtatgaattcacggtgatgtcattcggtttaaccaatgctcctgccttcttcatgaacttaatgaacaaagtgttcatggaatacttggataagtttgtcgtggttttcattgatgacattctgatatactcacnatcagaggaagaccatcagcaccatctccgtctggtgttgggaaagttgcatgaacatcaattgtatgccaaacttagcaagtgtgagttctggttgtccgaagtcaaattcttagggcacgtgatatctgctaaaggagttgccgtggaccccgaaacagtgaccgccgtcactgattggaagcaacccaagacagttactcaagtccgcagtttcttaggtttggcaggatattaccggaggttcatcgagaacttctccaaaatcgctcgacccatgacacagttgttgaagaaagaagagaaatttgtgtggagcccgcaatgcgagaaggcgtttcaaactctcaaggaaaagctggtttcctcgccggtgttaatcttgccggatactcgcaaggacttcatggtgtattgtgacgcttcgcgccaaggattggggtgcgtgctcatgcaggacggtcatgtggtagcctatgcctcacgccagctacgacctcatgaaggcaactaccctacccatgacttggagttagccgctgtcacgtcctgataaattcatcccgaattaaaaatcattcgctaaaaggaataatagaattaattaaaattcgaaaagaaattggcaaacactaaaatacgtacaagaaaaattcaaatgtggcccggagaatttttgttaaattctccttggtctaaaaggagccctcaaattttacttgaattttcagagcgccggaaatatttattaagcaacaaaaacaattatcaaagtttattaaaaagaaaaacctaaaaaaataaatcctcttcctcctttgggccaagcccagcccaaagtctccctctcctccntctctttctctccctctctttctctccctctccttctcttctctccttctgcttgggccttccctccccctcccggcccagctccctcctcctccttcctcccggcctgcctcggcccagcagcccggcccaagccaggccgagccgagccagtcgcgtgcacgcgcgccgcgcgtgcgctgactgcgcgcgctgaccgcgtgggacccacgcgccggtcgtcttcctcctcccgcacggcctcctctctcttcccgtgaaaaccctagttcgttcctccctcgaatccgcgcgatttaagcgttggattccaaaattaattgggggggaattaatcccctttccttcctctcccttttccccctaatctcccctttaatcgtgcactattttgaccggaacggctgcgccattcatggccgccttt

SEQ ID NO: 1710 - DNA, 2000 bp, Oryza sativa
  misc_feature (28)..(28): n = any nucleotide
  misc_feature (1343)..(1343): n = any nucleotide
  misc_feature (1353)..(1353): n = any nucleotide
  misc_feature (1378)..(1378): n = any nucleotide
  misc_feature (1452)..(1452): n = any nucleotide
  misc_feature (1467)..(1469): n = any nucleotide
  misc_feature (1557)..(1557): n = any nucleotide
tcatatgtgagattatcgatgacatgcncatacatctcagatgcaacaaatgcacatgtaatgttcctgtggtatttctgaacaccaggtagaaaacatgtatgcttggtaacaactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctatttcatatcttctgctctactataaatcgctccctgaataacctcattttctttgtactcccatctcacactatcctcttcagagacgatcaacccagaaaaatcctcactagcccattctgctggattaatatccgtctcatcatctgacgaatcaccttcctctacacgctcgttgtcagaatcgtccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcgccatcatccatgttcgtctgcacacctggatcctttgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctgaagcccctcattaaccatccttttatagaaggtacactcctctcagccggtctatcaattcccctttctgatacaataaaatctgacagatctaccccagttggcccgtaacgaacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacacacttctagattagtacaactaaaaccctaaaaatataatgcatttattcaaacaaatttttaaagaatacacactatttaactcaatagtcacatataggatctatgaatattacctgaaatcggtgtctgaatccggcagggcttcgccccttcttctcttctcctcccctctcttcttttttttttcactggaattgaggagagaagaatganggctgggggntgggcagcaggccttttataggcancgaggcctgccgcccggccagagggcggcaaggggccgcctgcaaaatagccggccccgaatggctttttttgnattcgggccccttgnnnccgggttttcctaaaaaaaaaccctccctctgtcaccgcccgttcctcccccgtttgccacgtcagcttgtcgccctagaggtgggcngtaggggctatttctgcaattttttggtcgatatattatttctgtaaatattaaaaaaaataatctaaaaccgaaaaaaattctcgtcaaatctatctcggcccaaaattgcgggcacctcacctaccaggacaggaccccggcccacgccacaggtggcggccgccgccgcgcgccgcagccgcctcctcggcttcccacggatcggacgggtcgcagactcgcggcgcacactggcacccgatttgttggtttcttacccctcctacaaggcggccggacgcccacagatcggatcgggtcatcaactcatcatcgccccccttcaaaaggccacccccctccccctcccttctcgcctcattccccacagccgccgcctccttcctctcctcgatctccctattcgtcgtagcctcctccctcgttcgctccgcccgcaa

SEQ ID NO: 1711 - DNA, 2000 bp, Oryza sativa
cctggacgcctttttctgcctccctaaacctctaaaacccgtcccagttcaaaaccatgtccaggtccatccaagagaggttcaaattacactggctgagccgcttaaaatcaaggtggcaaccggccggttgctaccgctttttgacctggtttgcattgtgaggttgttttttcttctccccgagataagaaaaagcgagcgtttgccgtttcggccggatcggcggcctcgggcaacgtgctcgagcaggcttgtgtgtgcgcacacgagtcagtcaagtcgccacatggccggaaaacacaatgcgttggatcgtttcgtggcagacaagttttttttttgagtgattccaaagaggagcaaccagggttcgtaattctgacaaaaaccggctgtattctatgaaatttcgaccttttgatatggctcggaattaatttttggttaaaattttgaaggttaaacattaagtttggtcgaaatttagtcgaaatttatcgaaaaccgatcaaaatttgtcgaaaaccgtgataccgacgggctcgaaatttagtggtcaaccggtaatataaaccctgggagcaactttggtgctcccttaatctcaaaagtatctctaccgatcttgcaatttcttgtgtcctataaaatacatagatatctttatattaggtataaatttggactatcttttcctatgaatttgagtaaaccaaattagacatgttcgcggtatagccgctatgtcacatctgctgacacaaagtgctattcgagctagctgtaccgtagtcgaatgagtgcagccgaattcataagtaaagatacctatatttttggtgacgagactaataaaagtttgcctataattttcctattttttagcacataaaatgtacaaattaagggtaaacatacaataagcacatcattgtattatatcaataaaatcgcacgatcacgctgacactattttgtttcctaaaatattgtgcattgaaattgcgatttttaacacatttgttgcaagacaggataagagaatggaaattgaatgaaatctactcggagcaattgagaattagagactccattttgaggagggaatgggcaaacaacacgccgaagataccgggagaaatgaatccgctatccaaaatcgagctaatatagcactgttactcatatgaatttctagatttttttcctacatatatagtgcaattctatcatacagttattattaatttgtaataggtgtatttcggtcttattaaactccgataataatggtttaacaattactccctccgtttcacaatgtaagtcattctagcattttttacattcatattgatgttaatatatctagacatataaatatggaaaatgcaagctagacttactttctccgtttcatcatgtaagtcattctagcattttccatattcatattgatattaataaatttagatagatatatatgtctagattcattaacatcactatgaatataagaaatactaaaatgacttacattatgaaacggaggaagtagatactaataaaaagggataaaatatacccaaacaatcgagccttgtatatgtattttatctaccttgatacgattgggatcaaagtaatacagtagtatattcttgctttcatgggaggatcaaaaaaatgataacggtataaaaaaagcagtgaagcaagctcgcagacaacacgccggatacaaaggggaaaccgaaataaaaccgccggagaaaaggaaatgaatatatatattttcaatttcgtaacgaaaaaagatatatatataaaaagaagccttgaactccgcctttaaatattcccacctcgcctcgctccccttccccatcatctcatctcacaccaaaaacgaatcagctcgtctccttcctccgcctccgcctccgcgagctcccattccattcccggattgcgccgccgccggtgttgcagcagcc

SEQ ID NO: 1712 - DNA, 2000 bp, Oryza sativa
  misc_feature (192)..(192): n = any nucleotide
  misc_feature (484)..(484): n = any nucleotide
  misc_feature (1933)..(1933): n = any nucleotide
  misc_feature (1965)..(1965): n = any nucleotide
ccaatacgtggaatattcatagtaaactaaactactattggtagtggaatcctgaagattcacttaataatgctcatggaatgacatcattcgtggaaagaaaccagacatcatcgcgcagtatccttcctttcaggtttggagggattgcagtagctaatttcattttgctgactaaccttgactaaaagngttatttaatttgtaaagcacaattgaagtactgaaagattgcaatttggagtattgaaagttcagagcgcaccagcgaggtctgaattgtaaacacctttttattacccctttttttttttaggaaaagcactagcgaggtgtcacgtctacacttagcgtagcagaagcgttcactgtaattgcgatgaaaagttgacaggccacgttaattctgcttgctccaatcgatcaggaaatgcgctattgtgcatgtcacgtccttagttggatcgaaaaagatgcaagtgcntcaccgattcgtttggtctgaaactatattttgcttccgaggagattaaaacgaatctgggaagaacatgttcttgtttatgcctcgttccaccggatcagctactattgttcgtccaaaaagaatgcaagtagcagattaattacactccacgcccttaagaattcgatcaaaatcacgcacgtaattactctgcagtttccacggaatccttgtttacactttcctcattgtgacagatacgaatcagggtgctaaaattaaacccgagattacagcggagtatattccgaagaacaggaatcttctgagtttactccagatataagcatttattccttgcctttaaaggcctgatatctcacagaatccattagtttcattttgagagtggaacggctgccatttgtaaacaaccttccacaatatttcgctgtgtactagtactatactactatacacagaaatctaatatgcgtcacaaacaggaaagaactggcagaaaaatatacgcctcccactttccttgcaaaactgtaggatatccaaatgcatcgcgaatcgcagcaaaccgagaaatcccacgggaaactattttaatccctcgagagaatatcccctcgttctttgtatgtcactcaaatggtcatgaaaaaaattgaaaaaaaatgagaatgtgtattaacatgtgatataatactctacaaacatgtaagttcaaattcaactcctatatatcgtaacgaaagaaacaaattaaactgtagctagttaacatatatttagagtcaaatttgtttttttcattgtgagatgtagaagttaatttttttacttgcctgtttgtacagtgatatatcacatgttaatatattttcttaaatttttaaaatttttttcataaccatttaagtgacaggcaagcaacgagaggatatccgtccgagggatcaaaatcctcttccgaaatcccacccaaatttcattcctgctgaaggaactagaagctttataaccgcgataaaaaatacaagcgacagcgatttaggcagtagaatcccccgcgacccgaggagattagtctaattaacaagtgcagattccctagcatctcgtgctgtgtttaactgcgtgagtgcgcatccgcccctgattcccaacttgcgcctgcttgtctggattccacagaatcacgcctcggatcttctgcgccaacgccgccccccttcccaaaagaaagaaaaacaaacaaacaacggcgttggctacagttgggtgtcgcccagcctggctcgaaaacacacacgcgacgcggtcgcggtcacgcacaaaatacacgacccatgcggtgccccctcccggactcgagttctccataacccaacccagcggcggaaaccctcacgtccgacccctataaatacccaccatctgccgcgccatcccatngcaacgcacgcaaattcacagcaacacaagcngaagcacagtagaacgcctaggaaatactacgtcg

SEQ ID NO: 1713 - DNA, 2000 bp, Oryza sativa
cttgcagaagtcgcagagcagccaccctgcgccgttgcaaccttcgcactctacaccttcttccttaggacaagaagaatcatcacagccaaggtagttcaacagcatcagattcgaatggtttttgcatcgaaaccacacacagtcagattctcagcatcagaagagagggcgaaggctaccaatggtgttgatctagggtatgtttggatccttcgctccgctagcctggctcagcaaggctaaaacatctcattgccagcttgctagccttgccgtacccctgtgtttggttggtttgcttccgagggcaaggaatagtggctagctgtttgaatccttcaaaaattattgctttgcccaagtttattttgcttcctttttttgtccaaaaattaaaaggcactggtcatgttaataatcttgcattgttttttttcccatagccattcttttgctagtagtttattactaccttaaagttatatggcttgtttggtttagtaccctaccaatatattggtagtgccaaactctacgcaagttttggcactaccaatattttggtagggtagaattgtaaatgagtgtctttagatcaatgtcaattgagagccaaattttgaattgtggtgaagaacattctagaattgtgccaaattgaatatagtcattacaaaatatttggcttcaaaccaaatcatcacatttactatttaaactaccaaaaaattggtatggcaacattttgatatcaaaccaaaatggcccataatattttaggattcacaaatgagaaatcaagagaattccttaatcaagtaccatcataataaatgatcttggcaacgcaaaggctgcatctagcacaaagcaaacgatctcaaagacgctcttttctaactctaccaacttcctgacagagcgattgaacaagacagcacaccatgtatctcagaaagaagaggttaggagctgacgataaagaagaaatcaaatctaggagtctacgcggatgagatcgcctccggattgagctgctgctaatgagttcgtctcctgatcggggagagaatatcagcgattccggagaagtccgcgtcgcccgcagacaatattttcacgcgagtgaagtttgacgtcgaaagcgagccaaattggctctccctagccggcaaggtttttctcgccctgtacaactaactcgcccttaaaagccaagctattttactagttccaaacggatagccttgccaggcaaggctagggtgacccttgcccaggatccaaacgtgcccctagtgatctgaaccgcctatggtagatcggacggcggagggaggtcaaggttaggacagttacaaatggtaagcggttggacttcctagagagaactaccacagggcaccactgctgtctcgctgacccgtgggcccgtcctgtcggtgtgaggattgcacggttgcaccacacactgctccggcaaagcgccggcgagctcagggagcatgcaagataactaacctctgtctcggcctcagcctccggcggcgccgccggctccaccgccgcggccgcggcgacctcccttggaacggacacgcagccgacgaccccgcccttcctcctcgtccgccgcgacggcaccggcagagccgccggcgacaaggtacaccgccaccggcccacccacctgtctagcccagccgcgccgcaccactgcgccgccgccgccgccgccgccattgttccgcctctttacacctcgcctctccctctccacctcttctctccctcctcgtgtggataaagccgcggggaaaacgaacggctcccgcgcctgacgcccgggcccacgcgagtccacgtcggatcgtacacgaccactcaccaccgaggctgacactggggcccacacagaatccaactcgagacatttttaactcacaagtcaacggctccagcgttgaacacttgaaccagatctcgccaccgcgtcc

SEQ ID NO: 1714 - DNA, 2000 bp, Oryza sativa
ccaataccccagttggtcctatacatatgacctgcgatcaggaaaagaatagcaatagctaaatgatggtgcgcaatatcgctcaaccatagaccgccggttattggatctagccctccgcgaaaactaagaaattctgcgtatttggaccaattcaaggtgaaaaaaggggttgctccttcggcaaaactaggataaagttgagccaaaaggtcgcgattcaagataaattcatgaggaagtggtatctccttaggatcaaccccagcgtcaagaaattggttaatcggtaaagatacatggatttggtgccccgcccaagaaagagacccaagtcctaataaccctgctaagtgatgattcaacatggattctacgtcttggaaccaggctaatttgggagcggctttgtgataatggaaccacccagcaaaaagcattaacgatgcaaaaatcaatgcaccgattgcggtacaatagagttgtaattcactagttattccggatgctcgccaaatctgaaaaaacccggaggttatttggattcctcggaaacccccgcctacatcaccattcaatatttcttgccctacgattggccaaactacctgagcactgggtccaatgtgagtaggatcacttagccatgcttcataattggaaaaacgggcaccatggaagtacatgccactcaacccaagaaagataatggagagttgaccgaaatgagcactaaagacttttcgagagatctcctccaaatcacctgtatgactatcgaaatcgtgagcatcagcatgtagggttccagatccaagtggtagtatcagggcccttagctattgttcttgagaaaatggccgggtcttggcccatttcctcaaaagatgtttttacaggatccctatccacaacaatttttacttctggttccggcgaacgaatcatcattaagtcctcctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctacatatgcgagctggcagttgacctgaccatgcagatggcctacggcgtacgtgtttgttcatgcaatgcaacacgtacgtaatgagctagttaataacgtcgacgtcgtcgtagactcgaaagtgtgggtggtaattaacaaattaaatttagtgtgagcaacgtagtaagtaagattacctgcacatgacatgatgagacaacacgcggtttctatatatcatattctgttttactcccaaagcaatgcaaaaaaataattataagtgctaattaagctagggaaattaaggcgttcaaccgatcgagagcagagcactacactatatactcctactccacatagttagcttagctatacctgcaagtgtactgcattactaattataattactttcactgccttaggtagacgaccgaaagaaaggaaggcgtagtcaactgcgttgctgacccatcacgaacgcattaatttcatggtcaacgccccccagcaatttgttccttatagctaagctagctagccacttaattaagaagacacagctgctgcattcgtcgtatatatatatcgatagatcactagctagctaattgagcataaccaaccatatatagtgttgttagtatacttgatcaaattaattaagcttttttccccttgattgatcgatcgaaagagtaccgcgaatcgatcaataatcagattcaatggcagcgccgcggtgggcggcgttc

SEQ ID NO: 1715 - DNA, 2000 bp, Oryza sativa
gctggtgacgcggtggacggtggcgagcaagtagcggcacccggcatcgccgatatttccccctcacgagtgaacaagtgcagctgcaaatgaggaccacattgcgctattcatcaggagcgttggatgcttgggggatggtggatcgaagagctactgccctctgacgtagttttcccaacgtcagaggatccggttccgacgagggagtaatagatccatgactctaaccgccatatataccaccctgtgcttttctgtgtacttacctactatactttattataaaacttaattctttcattgtatttaaatcgaataacttcacaatttatttactctatccgtttcatattataagtcgtataactttttttcataatcacattttattaagtttgaccaagtttacagaaaaatttagcaacatctaaaatatcaaattaattttattaagagggcagctaccctacgggattctgttgcaacgtggtagtcacgggataactaaatcccccgacatatttttttttgaccgaggaccacactgtccacgcgattccaccccagccaaaacccggctcggtatcacgcgcctccgcgtgcgaaacctcgccggcggcgctgccgccgtgactactccgagcaggagtgctccttcctccaaccagctagaaccctgctttgcacgcaatacctcgctggcgccgcctgcaactactcctaggaagacttccccccagccagagcaggagaggaggactttggttgcgacagcaaataggagacaaggatcgagtctaggtaaggcagaagacaagagaacacgtgtcgtgcttgatacttgatacctcgcaaccagccatgatacctgatgccttacaggtgctcggtactaggtctgatacttgataccttgcaggtaccaggtctgatacctatgggtactagccatgataccataggtactaagtatggtacctactggtaccatgtctgatacctggatatcaaacatgatacctacatgtaccaaagtatcatgataccactaaagtatcacggcaataaagaaccaaaaatcatatgtttatcaagagagagttgaataaaattaataaaggaaatcaataccatgaataagtcatcatagctgtagaatcacccatagaacatgtagaacccaaaatcaaacacagaacaagacaacacctgagcttggaggtcgcgagcctagatctgggtgtacagatcacaaagaggtctcttgtccttgatgacggtgacctcgtcgacgatggccacctcctgaaatgtggtgagcagctccgcctccatcatgtgcttgggcacctaccccacgaacagcttcacgatcttctcctctactccgcccatgcctccaccagcagcaatggcggcggcggtgatggcagcttcctccacgctcgacgcgccaccctgcaaggccagttgccgccgttgcctccgtgctccatgagggtgctagtcagaaggagagagagggagagaggagatggaagggaaagtgatgagaggataaggttgaatagatggtgtgaggagtgagagttagaaatttagtggcagtagttatcctgtgcctatggaatactgttaagtggtttttctatttaattaattaacattaaatttgataatatgtttattttgtgttaaaaatactactatatttttctataaacttgatcaaattttaaaaagtttgagaaaaaaataaacgatttaatatgaaatagatggagtagcctctttttgggtctttcaccaactcaaagccagcgtgcaacggtattccagcagatcaccctggatggtgcaccgttccaccaaccccacgttcccagctaatatagctctgaccgcttccgcaccgcgccggatcgaactcatcagcatcagcacatctctcttctccgctccccccgaaatcctcgcgcgagccgccgccagccacg

SEQ ID NO: 1716 - DNA, 2000 bp, Oryza sativa
  misc_feature (470)..(470): n = any nucleotide
  misc_feature (472)..(472): n = any nucleotide
  misc_feature (767)..(767): n = any nucleotide
  misc_feature (807)..(807): n = any nucleotide
  misc_feature (822)..(822): n = any nucleotide
  misc_feature (933)..(933): n = any nucleotide
  misc_feature (936)..(936): n = any nucleotide
  misc_feature (947)..(947): n = any nucleotide
  misc_feature (1058)..(1059): n = any nucleotide
  misc_feature (1895)..(1895): n = any nucleotide
  misc_feature (1917)..(1917): n = any nucleotide
  misc_feature (1960)..(1960): n = any nucleotide
  misc_feature (1967)..(1967): n = any nucleotide
atggcagcggcatgcatgccaggagatacttaacgatcttctccaccaagaaatagcacaacccatgtcataattaacatgcaacatggatctggctaggtgtcacgccccgaactaatcccgaccggaaatagcccgtgacgctccaaattaacctgttaatcgataccagtcccaggaaacagtgttggtatcatagggagatagaatgtcacagcaacagaggtctctttattatagagtagaggtacagtcatgttgggctgcggacagatcccgagctcacaactgcattacaaaagggaaacggaagccaggacttggaccaatcaacacaggcgcgacttgggaactaagccgaaaccctaaaactcatcgtagccggcttgctcctggaagaactccttatcagcgggttccgcttcatcttcttcagcaactggggggattatttatatagagcaagggtnantacgggagtactcaacaagccatgggaaataagtgtttaatgcaggcttcaaggaaaggttgttgtttttgcaattgattttatttgaactcttttctaaaaacaactaagtgagtgcttctcaaacgacacggatgagacagtgcgtctcgtccggtcggagtatgtgcaatgtatcaatctttaaaatagatcaagattggcacccggccaacagctttcaaacggccacccgggccaacaactttcaaacggccacccgggcctagctgatcccatcagctgcagattttcnaaacatcgatctcctttccaccacagcaatttcacaaacngtaggcaaacaaaantacgctaggaatcacctcacatccgcccatgaccgtgggcacggctgttcgaacagttagttaacctctgcagaaggggtacactttacccacacgacattactaacccgnatnacccagcccgnggggatcggccacgttgggagacctccaagctttcatgacaaggcatttcgaaagccgacacaggtttaccatatgccgacgagagggtcccagaccaacaacaagttagnnccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagagggaaaccgtacacccggtacgttccccggttccgcggttttggaaattcatttagttcgcaagcaccgacccaggtgtcgggttttccaagtcttttgtaaaacccaagttttacccaagttgtttttcagattttaagtttgaaggcgtccgtcgatactcgcacagggtgcacgaatatcgagacgcaactagatggttacaaggggacatgatataacaattaacaaaggaaggatcaaatgcaacgaattaggtaggtctgccaatctgccttgcagacgggacaacagattaagtgcgatcctatcaatgcataatatttttcaagcaacataattaaattcaaatataggctcaagatgttcaaaggtggcttgccttgctcgagatctggagcttgatccttgaaatcctcgcactgctggtcttcgggctccgaaactatacgcaaaacgggacaactcaacaaacggcgaaaataaagccctattaatgacctctaagcatgccattagatagatctcgagatttgaggaattttggaagttgaacggagtcaaacggatttacggttgggaagatattgaatttctaagattattggatttttggtctaaaggaaaaggatttaattaaatccnttttgaaaaagaaaagaaaagnaaagaaaagagggagggaaattagacttccctcgggtggctanggcgcgncccgagagaaaaggggcggctcggccgagctta

SEQ ID NO: 1717 - DNA, 2000 bp, Oryza sativa
caccaaaacacaggagtagggtattacgcttctcagcggcccgaacctgtatacatcgcccgtgtcttgtgtgtttccactctcgcgaaccttccacactcagaccaagagcttagaatctcacccagggcccccggccgaaccggcaaaggggggcctgcgcggtctcccggtgaggagcctcatgctccgtcagactggtatcgattaacaggttaatttggagcgtcacgggctagttccggtcgggactagttcggggcgtgacatcaacctacatccttctcgcaaccgtacttcagtacacttctttatcttctctcactatgattctcttacaccgtcatatccaccacgcatgcacatgcctccgcctcttaactactccaatgtaaaacttacctcgccatcaacactactctactcctcgcagccaaggtggcatcaccgtcgtcccgtcacaacccgccagttgagggtcatagacatctgatacactgtgatatgatcaaggagaagcgtctgtaacaagtgctctgggaatgtacgttttggctagccatgttaacaaatttaatatcgtgtctcgatgtttggatctcttatggtgttcttccatgttttgctaccaaagtcgatctcagtgttagttttataacataaatggaatgatataaatttgcatgattttgctccctaatttctatcaattgatgtcagctagtattttcttgtaaattaatgttttagaatttgcccacgaaattcagatttgtatccatatcttttataagtatatacaaattattgacgtgtattgcaattgttaatgcgaatgccgagtttgaggtgaattgtgtaatttaagttatgtttcgccttcgatatcaattaatcacgggtttagtggtctgtcattatgtggcgggacttgtgatgtaatatgagaacttgatcttgtttggtgtccgtatccggttcaggtttggagatattaggccggcagctgaagaaaggtcacgggccgtagtttagtttcaacaatataatccccatatctagtagtgaagatatgggcgtaatttaattgtaaacatttcctgtgaagttatattagcgattgacagagactatatatatacagtatattaattgtttgactcactttcatgttatggcagagacaagaccatttttttttaaagcggagacaagaccatttggctttctttctgtcttcgttctttttctttcgagactgccttaatggcatttgactgtaaaacatttcataaaatcttacaaatttcagaccattacatcgttttaagattcgtgtgttgtacgcctacctctaaccctaacgcctcctctctcgtcattcccagcaacaccgtcacgaatgaatggatcaattgggcactctcgatatcttacagtaaaagtactaactgctgtaagctaggcacggttaattaatcatgtcatggtatacacgatcgccttaattaaattgatttctcactatacacgggacgttgaaatggtaattaaattaagccgctctctctcaaaataaacaagtccttaaatttaagggattatatatattgacgatatatatctagctagctagcaaatcgatcaggttgtttgtaccttactgttgtcttgagggtatgtaggccatgtacgtatacgtacgccagatcgatcgatctttgcagcactaatctatgtatcatcgatcttatcttgaaggtctgcagttagtgttatatattctagtgcaacaagtaagtaataaaattagcagtggcattaactcgatcgatgatggctaaactgatccttccaaaggactgccctataaatcaatagtgagagagagaggtcataattaagcagaacagtagcaattagtaagacagtagcttgtggtagagcttgtaaagtgtgtagtgtacgtagatagcaatataatggctgcatcagtgaag

SEQ ID NO: 1718 - DNA, 2000 bp, Oryza sativa
cacccttctcatcataataaaaggtgctttaaactgggtaataatttgattagctcctggtttggaatggtatattcctggtttggagatagaactgtgcagtcggggtggttgttcagaatggttgggcctatgcaacagggtatgttgtatagtgttggtttaatattgtttaattatcacttaactgttttataattctcaaatgtttgctaaatgctgcttttgcaaatgaaaccctactatgccatcctttggtatccttgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttaatttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacactttgcggggggcatcccacttgaaggcgcgcggcggcggctctccttctctccgtccctctccccccactggcagcgcacagccgcccctcctcctctccgccatcgcatccagcacctccacctccaggccagtggatccactgccacgagctcgggagcagcctgatctggcctccatgagctcgggggcggccaaatccgcacctccgttgctccctcgacttccaccttgccatgggctgctggtcactgcgagcttgaggccggatctgaccaccttgagctagagggcaaccagatctacgcggttgctaggaaaccaccacgacaatggtggaggcaccgatggccagatccatgcgccacgatgatgaaggcaaccaccaccagtgtcacggctccttccccatgctctggcaagaggatattttatggatttctttgttgattttattggttttctcctaatcttgcttgttgacattggttatcccttcgatgctgcaatggatagctaatgcttggatagtagatgatcatttgcgataaactttgtgattcactctgtgattttgatgttgaaaaaaaattgtgattgattgataacaatttaaggctcgaacgcgaggtttttgtgctactcgatgcatcggttgattcgagccgatacattgagctggtttttttttattcctgaaaccttaaaggtgttcttaccgagtgtcggttagaaaatctagcacccatcagtttttcagtagtagtgtgtgcagatagcattaatcatatatgagtatatcccagggtttcatttaccgcgggtaaaccgcgcggttaccgcggttaccgcgcttaccgcgggggtacggtaaggggtaaaccgcggtaaccacgtcaaattcaaataaatttgaaaaataatttgaatttttgataaattttgtacggtttgtcgcggtttgtcacggttaccgcggttaccgtgcggtaaccgtgctttaccgccggggcgcggtaaccgcggccccggcggtaaatgaaaccctggtatatcctgcggaaggaacttctaattaaaagggctgcagcagtgtagcttcaaaaagtgaatttgccatgcaaggttatcctcatcatatcgatccatagggcaaaagcaattacaccagatcaatataatggtgtcgatcatctcatcaacagtagattccgcgtgcatcacacccacttgtccgcacacaagaagagaccagctaccaagcaatttgcagcggatgctaattcagctggcaagcaatccctccatctatatattggctgcagatgatcagatgatgcgctaaattaatcaatcatatactacacaatatgata

SEQ ID NO: 1719 - DNA, 936 bp, Oryza sativa
  misc_feature (38)..(38): n = any nucleotide
  misc_feature (59)..(59): n = any nucleotide
  misc_feature (111)..(111): n = any nucleotide
  misc_feature (141)..(141): n = any nucleotide
aaagtttaattgggaacgcgaacggttgttggcccttngttttggtccttgggttccgnaggacagcggaggtcctgagggccgccgtaaagggcgaacccgtcgcgcgcnatcggcatgaacagcaggaggaaccacacnatcggcgccggcgagcgcgagcacctggatgtggcggtcgccgagtcggtgatacggtgggcgtcctgcaccaacctgtcgacgacgcactcgctccgggcttcgctggtgtgctagcattttgtttatctgtgcaattcaccatgtgtcctgtggctgtgagagtgcttcgctagtctcttgccttcctccttgcacctgcgatgcaagctgaaagataagagtgagatgagtgatgagatgagatgagagtgtgagtggtagaatgtaacgtggacctgatgatatataatgctatagtagattaccgagtagtgtgcttgctttctgtttgttgaatgtgttccttatttttggtctcctttgtgcacttgtcactacttatcactaataccatccatcaacatcagcttggtgccatgctctctcttgaatgcttgcagacaaacttaaaccgaagttgacccccatgtaattagctcaagaaacatttcaaatacctcattatgaaaagatgatcgaataatatagtgattattggatagagatgacgtatttgctactataaagcaaagaaaaaatatggctcaagagatgatatatttggatcaagtgattaccaatttatgatcaagtcccctcttccagtcttccagtatctacaaatttgtgatcctatgggcctttgggcctggtcgctgacccagcccacggcccagccaagtcgtcgtcttcctcgatgccgctccaccgcttcttccacttcgcccgcgccggcgccgcccgtcgaacacc

SEQ ID NO: 1720 - DNA, 2000 bp, Oryza sativa
  misc_feature (26)..(26): n = any nucleotide
  misc_feature (68)..(68): n = any nucleotide
cccttcatctagttggagtatattcntgggggaaatgtacgtgttccgccccagttggctataagccnatataagggcactgtactgatcgcatgggctaatcaaacaacttgaatgaaaagaaaaaggcgaaacgaactgaattatcaggtcagagagcaaatactacatacacacaccagcaaaaaccacactatacataaatatatcgttgtcatctctgagttggatcgatctaccagagatcttccaaaaatcggcgccccaacctgtaaacatcctgaactatcccagcacgcaattaacaaagggttcttgatatctgaacagtgctgcgagatgcatgttaagtggttaattaacaaattcagacagcggtaaacgtgcgaggtagctagcagatcacatcgatctccctcccgtgtcctaggaagatcacgtctcgatcaaaaccattcgatcatccacccagtcgtcgtcgttgcttaattagaaaaatcgtcgcatatcagtttgagatcagcgaagatctctgccataataccagcgagattaccagttgaattagtttcccggacacacttgcttaatttgtagtaatccgatgctgatttgcatttggcagcacaagcaaattaaagttcagtagttaacctacaacgaggctgcagctagtagctagctaagccaagctgccaccgggaagcttcgatttgctctaatcacacacaataatcatcatcgatcgaacgatcagatgcttccgactaactgcaaaattaaaatatatcccggtcaatcccacgcgtatctctccggtccttgcatgaaatattagaaaattagcattatatatcatgcatgccctgtaaggatctagatacgatttcatttgcttcatatattcccattaattatttctggttcagagcagtgtactatatatattacgcagttgttgcgtcaactacacgagttgccaattgtttaatgcctgtgtgattagcagtctgaaaaaggccaagacatgagagaggcacgcacacacacacgcatgattgattggatcgatcgatatcaccaaattgatgatccagtttaatttgatcgatcgttagatcgagagatccaatccgtgctggatttatacgcagttggggctgcaatttgcattcccgcgacatgcgtggcctccttgaaaatgtgcctcaccggtcgcatggcgactatcatattgatatccaaactataaattatatgcaaaacccccaatctcgcctgctacggagatctcgcgaactggtagtcactgatatgtaggtcaggctaacgacggcaacattactgatctactccctctgtctcgaaatataagcacttttattatagtgtcaagtcaactatttttaactttgactattaatagcaaaaaaaaaatcaaaaaaatcaataatgtaaaattgatgtaactagatttattgttaaacaaactatcgtaatatgcaactatttttaattaaaatatcttatttttatacttattgttagttaaagtagtatcttgaagactgtgtaataaaaaatgcttatattttggacggatggagtagcaaaaatgatatagaaatatgcatgatttgatgagctcccggtgttgtagtattatatttgcacatcatgtcgcaaaagtcaccaacttgcattgcaatggcagaatggtttagctagctagctaggtagggatcgttcttggaagtagaactttgggagattagcgagccatagaaaatccgctggagcagatcggcctgaatctttcttaggatccattaatctcagcttaatttgctctgacgacgtccagctcttcctcccatgtggcttcagctaagctaagctaagctctgtataaataggcagctggtcgccatcgctgcagctactacaccttgcattgctcgaagagagaagacgagaacgtagaggttgttgcagctggt

SEQ ID NO: 1721 - DNA, 2000 bp, Oryza sativa
  misc_feature (1425)..(1425): n = any nucleotide
gcaacatagacagctcgtatacatccatccatggcaggaagatggagagatttaatataaggaaaaagtcctcgtacctgcaaatctagatagacgaggcaccatcggcggaagaaatcaaatttgggagcttctcagttctcaccacgagcaatcttgtgtccagtagcaatcttctgcaagaacatgctctcctcaaatcgagttggccttgctctccgatttactgcgtggaggccggaggctctactgcatttatatatgggcacgggattactgcagatgaatcgaggatgcttgaaagttcagcaaggggaggaggatgattgcaaattgactggatctgtgagccctatagttcagccaagagtgggggaagagagcgacgagatctgcaagcctgattctttggcgaagagtggaggaggaggacgaaattggggggctggttgttgaagaaggtaacaacttttgaaaaaaatcgcttcatccttatcaacaacttttttcacgcgaggagcttgccatcggaggcgagccgattcggctctcccttgtgagctagccttttctcgctcctatgggctagctcgcccccatgggctaggattttttttctgattccaaacgactgtccttgccaggccaggctaggcccctgctagccttggatccaaacgcaccctgagcctcctttactctgactcatccagatccaatggcttggaataaatcttcctttcatcagatggtcagtatttacttgatgacgtggcgcaatgtggtgaggaaaaactttagtattttcactactttagatacataatctgttgcctgtgataattagcaagcaacttcgttgtacaagctacccaacatatacatggctcagggcaccagggcggtcgcactgcccgtcctaccccaggaccagaccagaactgttcatgagtggtcgacgacggtcgagatgcgatggaaagtatggagacgataacctccacaagagtgtgcatgtagtgtctgaggcaaccgatgcgagtgtacatgtggctgaagtgtgcctgcgtcgcccgccgtgtgccagagtaggctggtggaggccgaggagaagtcgcgtggccatagaggattttgaacttgattaaataaaacatgtctttgtcttaataaaaaccaaagagaacaaaccataaatgtatttgagaaaactgaataagccttaaaaaagcacaattacttctaatattgttcattctgcccaattacttctactcttattcatcatcctcatcaagcccaattattttttatcttattcatcatcctcattaagaagcttgaggtaatcttgttcatcatcctcatcgaggagcttgaggtattgttccaacttaggtatgagggccatgacgcagggaggcngggggtgagccctagcgacacgggcatatcgcttctgccactccgtatccggatcatacctgtgcagcttccccgcccgtcggtactcctccaccacctcctcctccgtcatctccatgtactggtgcgcgtccgcgatcaacgcccgcaagaaggctttcgccgcttcctgttccgcagccgtccacttctccaagtaagcgtctatcccgaacggcttcttctcctgccgaggctgtttctcctcctccttcgcgtcgccgacggcggaattctccaccggcgtctcgccgtctttgcgctccatcgatctcaaaatcgaggatttggatggaggattacgctagtttttttttaggaaaaaattaggggacggtttggctttgggtcttggttgattgatttatttataggcgcggtctccgcctttccctgtacgcgttggcctacgagtcggactatgtttgtccgggtcggagttgagttccggctcgagatagcagcggagaccgtcggattttgatcgcacggtctgcggctccgtgtcggcctcgctggggttcagcgctgcgacg

SEQ ID NO: 1722 - DNA, 1912 bp, Oryza sativa
tttttttaaaaaatgcattatttaatactactcgtcccaaaatatagccacttttggctatgaatctagacacacagttgtccagattcatagctaaaaatgtttatattttgggacggatggagtagtttgaaaagcgtgctaacggaaaatgaggaagttgaagattgtagttgagaaatagaactaggccttagtaaaatttgaagttgttgggagggaagagatgagtgtgattagacttgcagacatagctttaagaggcttcgcctgcgtgagatcgtttaagagtctgcatgtgaaaataagcttattttcgtatgtggctctgttaagagacccacttgagaaaactgttttttatacgggtctcttaacaaaccgtacgcgaaaatgcaggtcaacttttgtagaggctattggttactaacttactatccgcctgcaaattgtatggttctcgtaaaaaaaattgtttatatagcagtgatctaccaacaaccagttttgttagtttcccatctgggacaggttataggatatcttgacaaaaaaaaaaacccgaactaccatagggcttgtttccaccaaggatcctcacctagaattgctcaactaaatgaaattttcgcgtgtccctgcggaaaatctgcattataatgctaaaactgagttatgtggatttgtcatttatgtgattatagagtcgtacatgcatgtatctgctggagttttaaatcatgacgtttataactacgaatttagacatagcacggtctagatttaacacacaatttataaaaaaactatagtagtacttttaacacaaaacaaacaaattacaaaaacatatacaatgctagattgagtgaaactaatttgatattttagatgttactatttttctataaacttaatcaaacttggttaagtttgattaagaaagatgttaaaatgacttataagatgaaaatgagtagtagtatttttgttctcttttgcaaatttggtgtttggtggaaaccaacaaaaaaacgtttcttgaacatgttttaatttgttgggaagcattaaactacaaaagaaatatgatagtcatgacgattttctcgagtcctcaacatatatacacataaatggcccacgaaagaatatttgaacttgggtccccttactcaggaaaatgacagggtgaaagcatattctgtctagcttagaatttaaatatgtgatatccaggtaattgaaccatgacaaaatagtaaatctcagtttagagataacacttgcctccacgtttccaaatatctttgcaccacattgctgtgcacaatgcaataaatccatttcacactttttggccgaaaaaaaatccattccacactgacctggatgccataaacctgattaacacgggtagatcggttgcattgaacttatatactccctccgttccataatataagggattataagattttgcttgcaacgtttgaacactcgtcttatttaaaattttttgaaattattatttattttatttgtgacttactttattatctatagtattttaaacacaacttttcgttttttatgttggcaaaaaaaaattaaataaaataagtggtcaaacgttgtaataaaaaactcaaaatctcttatattgtggaacggagggagtagaagaaaattaattccagccgtgtcatactactactaatcatctcaaacagaaaattgaaaaaaaaaacgggaaaaagaggcctggcccacaaaccaggtatggccctttgtttatcttcccgtgccacgtcgccactgcgccacaccataaaaccccattgccctctccactccgctcccctccaagcctccaactactccagtccacacccgcaccaccgcggcagcc

SEQ ID NO: 1723 - DNA, 2000 bp, Oryza sativa
cctcctaggggagtattgtatttatatagatagacaacttattctttaattagaatttgaatacaggcaaataagacctaggacacaggcaaataagaccttgccttcataggatcgagctccgacgcaagcaaaattggcaatcgtcacaatgtgatttagatagaggaaaaccgttgggagaaattatatcgatgccatgatagctagttgtgtattgccgataggctagactatatatatgggactggtacggtatcttgaaagagctaggaaagagatgctagagagttgggtctctttgatttggccagtgatttgttggtacatgaggcaaaacccctggcaccagcctatttatggttatcaggttttggctagctacaacttaattaaaaatgtttatgtttatgtttagaaagaagggagtaactttgtttgatattataaatcgttttgaatttgatttttatgtttttttaagtttcatcaagcttaaaaaaatacaataacattttcatacaaaataaacatattatcgaaatatgcttaatgctatatttactaaaactaatttgatgttataggtgttgtgagatctttctataaacttcattaagaaacatttgaaaaaaaggatcaaaacggttctaatatgaatgaatgaatgaatagaggggtacggcatgtgctctgcatataccgttactacgcctcgtacgattctgaccgggtagctagggtagggtgattaattattggtgcaaattaaccattggctatgcaggcatggctagctgctgtaactaattctccatcgatcattcgatctgccagatcggtgtcctcctgaattaatctcaaatctggatgtaaaaaagataattaatcaattcccctttcatgttgtcgactgcatgtgagcgaatgaagttcagcagctagctaatgcagttcttctgacttgcaagtcacaggaaagcaaatgcctacagttgagaaaagcacaaagctgatatctacattacacaatgctacagtttaatggacggatgatttctgcattacagcattagtacgtcttaattgcaactgtcggtcaactgctccattgatcgatctctcgtgctgttcctgcatgtgcatgcatgtatgagtacgtacgtacagctagactggtagtttaatttgattgtataaactgacgattttagttaattactatctaagcgtctatttagtttgctgtcattttcaatcctatcaaaatttagtaatgctgaattttgaaatgacaataaactaaacacacacttcaactatgtaccttatcacaatttggcaaatttaaaagttctctctctcaaaactccacttaactttggtaaaagcatcaaaccaaacaaaataatactatcaaaagtattgttgatttgataacaaaatgaacaagctgctttaaatttattcctcaggttcttagtacactgtacacctggatctctcgatcgatcccatataccagtacactatagattgctctcgccttaattaattaatttctagatctcaagagggcaacagaccccctggcaaggacagatcgaaaaacatcgctcgcctaaccattcaattctcactgaaaaagcttaatatattaggagtagtaagctagcgtgtgaggaagattcataaccatatatcatcttaattagcctttgtgatttagcttaatcacatggctaaggcacaaccacccatccacttaactcttcattactacgctagctacacgaggagagtagctagctagtacaggccccggcaagcataaatagcagcgtcccctgcttcctttcttcatcgtcctcagctcatcatctgcatgcagttcactgcacaccacacagcttagcttgctcagcttcactgatcttcttagctgcagctacttcactttgcatagtttgatcgaactaaataactcaccaagttagctg

SEQ ID NO: 1724 - DNA, 2000 bp, Oryza sativa
aaaaaataaaaggagagttcaagtaggaatacaatataaatttagctgaaattcggaattaaaaataagcaatatttaaagaagaattcatataagaacccaatatgagattaattaaaattcagaataaaaaataaaataatatccaaaattataaaaattaaaagtgagttcgagtaggaatacaattttgaaacaactgaaattgaaaataaaaaataaaaatattaaaagaacaataggatattaattaaaatttgaaaaaaaaactgaaattagaaaaagaaaaataagatttcatttaggaatacaatttataaataattaaaatttgtgataaaaaaaagactatggaaaaaaaagaccataaacatatgatgagataaattaagtaacaagcctataaatgagtagagtggtggcggttgatacgacatataaaaactattaataaaacaccaaatagaatcctaatgacgattaaaaggatggacgacaggcagaccgtgaagcaaatgaggtgattgccgggacatctagaaagtaaaaaaaaccattgataatcatattcgattaaaatctcaatgacaataaaaaagagaagcagcgggcagggtgtataggcgtatagttgcagagccaccaacggttgacgggacttttagaaaataaaaaatgaattccgatgatatttatgttcgatttttagaatcacaatgacaataaagagtaggcggcggacgggccataaaggaacatagtagaatcgtttgacgagacttctaaaaattataaaaaatgaaacccaacaagacaacaaactctaaaaactacaaggttcaatttttaaaggtttggaacttctaaaaagtaaaaaaaagaacgataatcatgttcgattttaaaatctcaatgacaataaagaagggaggcagcaggcgagccgtagagaagtacaatggcaaattaagccactaacggtttggcgggacttctagaaagtaaaaatgaacacgataattatgttcgatttttaaaatctcaatgacaataaagagaagagacaatggacgggctatagaggagtataatggcaacgtttgacgggacgtctagaaattataaaaacgaaacccaacgtgacaataaactctaaaaactataatatccaatttttaaaggttacaaggcgaatgaatagaaatagtggtagatcgagcaagcaaataaagaaggagatgacataagggatagtaactggtgtgacttttaaaaaacactccctccgttttttaatagatgacgatgttaactttttctcacatgtttgaccattcatcttattcaaatattttatgcaaatgtataagatataaatcacacttaaagtactatgagtgataaaacaactcataacaaaataaattataattacgtaatttttttgaataagacgaatggtcaaacatatgagaaaaagtcaacggcgtcatctattaaaaaacggagggagtataaaattagaaacacggggataataaggtttggtcttttaaactcttaagacaatgagatacttaataaattttaagtaaaatcatacttaaaaaaatatatgattttgtttaggtgctagccgcgcaaattgcgcggcccatccaacttgctaaccttcgttggattagcatcctatacgtggctgccctgcccacgttagcatggagtgggtcccacgtcaagctggcccccaggaaaagcgttcatggaaagagtaaaatatttcgaacccctactctttggtgggccctggcccatcacaggcgcgaggagaagcgaaagccccgcacgctgtgatcaatgaaccgataaaccataagctttagctttgcccatcaacttctcatccaagccaactctcccctcctctcctaggtttcgcctccgccgccgccgaccgccgccgccgtcgccgccgtagaccgatcgagcgggagtgggga

SEQ ID NO: 1725 - DNA, 2000 bp, Oryza sativa
actaccctgaccaagccaaaaggctgttgttgccaatgcctcgagtagttcaaaagatataccggacaactatgcatagaccgggtccatcctaaaaaagccaacctaacatgaaatgtgactcctatacaataaatctgagtcacgtttccttctaagttgttttttttacggagggagtatgttttccattatgatttagggcttattcggaataaaatagaaaaacgtaggagtagaaaaaaacacgagaatatgataagatttgcatgtgtacagagagaattggaaaataaagggattttttgttttttgtggcaccaagatttttacaaagagaataggtcagggtggattttttttcatgtgaaaacataagtagagaatagtgttcctcttaagaatcaaggtagccaatcctttgaaaagaatgagtacccctccatctttaaaaaaaaatcaaaccctatattagaatgattcaaatctagggtataatttttgtttgacagagtagctaatttaaaggaaaccctccatttattcttcgcatctcctggagataaagatgaagattaagtgtttcacgtaaaacgaggtggtaataacatgtgattaattgagttttaattattacaaacttaaaaaatggataaatatgatattttagaacaactttctatagttttcacacgaaatgtatcgtttagcactttaaaaaatatgccattttaataaaaagtttatcatctaatttttcgattagaaagggtaagggtcataatttttcgatttatatatgtggagtgtgtgctacaagagacgcttggggtgtgtgtgagtacgctggagcgtgcgtacatcttccgtgcaattgaaaaggagacaatgaaagcaaggccttgtatagttcctaaatttttttcccacaaacatcacatataatctttgaatatatatatagagcattaaatatagataaaataaaaaactaattgcacagtttgtatagaaatcgcaagacgaatcttttaaatctaattagtccatgattagtcataagcgctacagtaattcacatatgctaatgatagattaattagacttaataaattcgtctcacggtttacagacgagtcatgaaattagttttttaatttgtgtccaaaaatcccttccgacatccaatctaataccaaatactttcttttcgcgaactacaccagaaccaaatacgtctaatccaaccgtgagacaggccgtactccccccgtcgctggcgagagcttgccgtagtcggaagggagggggcatggaaaagtccacgatgattacgtcctgtccttcaggacagatcgttcgaaaccaacggcgcgctgttgcaagtccatcatcgaacgatcgacccgtccatctcggagaaggaacaacacctccaaagacaggccatcttccgacgaattgaccccctccccgctctttccagagggccgggggtagctagcggcgggcgtagcgccaattcgcaaacgtcaaacgagtgagatcccacgtcgcagcaaaagcaaaatgagtccctttctttccctttccctccaccctcgcgtcgtactcgcgtcgttctcttctccttcccttcccagcaaagccgagccgccgagcagggcagagcagagcaaaaccccccatatctccccgccattactcccctcccgtcccgtccccgagcggaaataaatgcagccgctggcgccgcccacccaccagtccaccaccaccagatccaagcccccgcgacgaggcgaggtgggagagggggcagaggcagagcgagatgagcgtggggcggaaaaattcaccacgccaccatacgcatttactccgcttccgcccctacccccacgcggcctcgcctccgcccaatgccattccgccgcttccccgctgagagatcgatccccaccgcgccgccgccgccgcagccgcagccgcagccgtcg

SEQ ID NO: 1726 - DNA, 693 bp, Oryza sativa
  misc_feature (8)..(8): n = any nucleotide
  misc_feature (14)..(14): n = any nucleotide
  misc_feature (24)..(24): n = any nucleotide
gccgccanttaatnggcgccggcnaggttagggggaaagtttccaaacgaatccgagggagagagagagggaaaaatggggggaaagggggagggatcccggggaatatttccaccctcttgattgcacgcggggcggacgggggccgcgggattcgcggcggcggcggcggcgctagggcgcgggcgggccgccggaacggcgggaggaaggggatgacaggtgggccccacccgtcagcgagggtggcgggcgggcccgcccgtcagcggcgcgcgcgcggggaggaggcagaatgggccgcggggaagagaagagagagggaaagagatgggccgagccggcccaagagggggacgggggggaaaaaaggactttttagaacttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcgaggatgtattttagagtcgttttgagacgcgacagagatcgaccctatccaaaacggacagccgagatcgatcggttcacgtcgggtctacggggacagcga

SEQ ID NO: 1727 - DNA, 2000 bp, Oryza sativa
  misc_feature (1300)..(1300): n = any nucleotide
  misc_feature (1304)..(1305): n = any nucleotide
  misc_feature (1307)..(1307): n = any nucleotide
gtgactaatgaattctttagagtgcaggattctccgtaaaaattaattcaattttatcgatattccttaaatctttccatttcaaaggaagcctaaatgtacagtgtactacggtacaatcggtaattgttcaaaatcagaacgcaactacgcaaggcattgtgatcctctgtcgtgactgggtgttaaggtagaagatgggcaaccctcttgtagttttgtgcctgaaaaactggccagacgaaactaattgcttttctcgacttattcggatcggagcatgcttctttcaaaatcgttttaattttttttgaaaaataggataaacctgacctctacgcatccaatcggatgtatgtactgccatttcaaaattgatatgccgtctaggttctggtctaataagcaacgctagtcaaatgagacgattatatagtttcggcaattgttgactgaccatatatatgctgtctctgtttctagaagatttgtagtacttgcttgatttgatattgccaataaagttatcttttcctatctcgagagatctcagttttattcataaatatcgttgtttgagtcacttctatgacaacttggttagagcatcgttgacaaaataaaaactataacacaattggcatattcaagttttatttagaatattaagatacctgcttaagatagggcttataaaccgaagctagttttatattatagaacttaattttagaatgaatttaagtacagtttaaaactggactccttccgatcataactatttaacgttcaaaataagatttgattaaaactctaaaattatagccatccatttatttatattagaacaaatatttaagcaaaattttaaaacccggacataaatctaccaataaatttatgatattattttttgttcaattctacttatactactttaatatcgatattaagatactgttgataggtgaaattttaatagtttggtcgaatcttatcctaactaagggtgtgtttagttcacgtcaaaattagaagtttggttgaaattggaacgatgtgacggaaaagttggaagtttgtgtgtaggaaagttttgatgtgatggaaaagttggaagtttgaagaaaaagtttgaaactaaactgggcctaaacgtgagatatctacgagccgcgagatagtaaaaagtaatcccttcgtcccctaatataaggaattttggtattgtgctcgcactgtttgaccattcgtcttatttaaaaaaatcttggaattattattattatttgacttactntccnntntgctttaagcgcaaacttttaatttttaaaatttgcaaaagttttttaaataagataagtggtcaaacaatgcaagcaaaatcccttatattaggggactgagggagtatagcagagtaccataagaatcgtttattaaaatttatattttattgtaatatattatactaacttattattaaaaaattgaaaatatttttgccggtactttggtacgtcatccgtgtataagtcggtttttaagttcgttcacctttggaaatacaaatccgtatttgagtccgattttaagttagttcgcttttggaaatacagaaagagtcgtggaagaaaactttcgaaaaaactcgcatgctaatttaagatgatcagatttctaattgcagttcaccttaactaaaccgtaaaacaataataagattaaaataatcttcacccattacaacgcacatgtattattttttcagtataatataatataacaataatataccactacaatttataaaaaaaaatcaccctcgctgtggggcccacttctggggctagtacccacctcgccatccgtgggccccacagccccactccgccctgcaccgcagttgcagcagttcgcacttcccagttcccaaccccggccaaattgaaactcttgtcgtcctcacctggaaggaaccccccgaacacacgcag

SEQ ID NO: 1728 - DNA, 2000 bp, Oryza sativa
  misc_feature (1955)..(1955): n = any nucleotide
  misc_feature (1967)..(1967): n = any nucleotide
  misc_feature (1970)..(1970): n = any nucleotide
gaactggaatccttgatgcggctatgtgtttctacttaggaaaatattcagaaccatgatttgtacagccaccggttggaagttcaaaactgcatgtgagctattatgctgaaaatatacaaacatatatgggctggtgttagtgagctgctagtgaagcctgtgaagtgaatttgtgattctgcaattcccaagttcttgttgtcttgttgatctacttctatggtgctaatttaattctcatacaacttgtggagtcatttcggtcatcactcatctgtcaaaaactgataaactgtttgtgaccagcaccaacttgttctaccagcaaagtttggtgaagagccatatagcagataggaaaccaacccctaatattcagaaatttagaatgcctgagccggccgtgtgccgtgaggcatctaccggggtaattcagtgcgaaattaagatcttggtgtcagatgttttggatgcataaatctggatacgtttaaaacttgggcagattagtgttcaatgagtttctgtctgctggctggcctgacaagttttaacaatgctataggtcaattgttagttactcctgccttagatcgatacgatattggagttgccaatactcccagttgtttaccaaacaagcagtgtaatcttcacgcagaggtgcaaccagagagttgatcaagcatattgacaaagcacacttcagtgaacggaaaccctgtgaatttactgcaaattcagtcaacagcttaaacctctctctctaaaaaaagttttaaagctctgaaagtctgaattactgatcacgtgatcatgtgagatcatgtgaaaatatatttgtttcagaaatgaaggttgaaaaaccaactctcttttccgtgcctgtacaaaaacattttcagatttcaggaccctctcttcctcctttgttaaagcatgtattgtttatgtagttacaccatttatcttggaagtgatgtttacagcggccaaatatattccagttttgcatatgcttagattttaaagattcaaattgaaggaattattctcacaattgtgtcgattatatgttgatctcgggcaagtgaatactagtgtgatctccttatcagtcaattcgcctcctttttcaagaaaggtaagaacagattcttctcgtgcaagttgtgctgttgctttggttccaatacttgtatagctatgaccagtattcataccttttcgtacttgatacgtcctgctgatgaaacaccggtgtcactctatcagaacagtattcaggttatagaatttttttgatgtgtccaattgtccatcatgaatctaaagctccattcaaaacagactattggacggatcgttgctatgaattatctactcaattataagaataaattaaataatttaaaacatgtggtctaaataatatagttaaaggaatatattttttagaaaatgtgtttttcaaattatggagcaataatttgtttcaacaatcagatggataatctgaaaataagatgcatatgtacttaggggtgtgtttcccatttcctacttctcgtttttttacgcccatatgtttcccaactgataaatggtgtgtgcttttttaaaaaaaaatctataggaaagttgttttaaaaattatattaatctattttaaggttttttttctaatatttaattaatatgcgtaaatacatgtttcgttttgtgtacctgaaaggaggatttccaacccttactctcaaacacagccttaaaagcctacaaatgtatgagcatattggcactaaaatttgtttcgatcactttgcttactgctatagctctagctcttcagttgtcaccttttgttttctccttgtctttctctgcgatgtcgtggttgctccactctcttctcctcttctccttgcctgtctgatcgatcgcctcgccancgccgccgccancgncgccgtcgtcgtcgtcgtcgtcgtatcggc

SEQ ID NO: 1729 - DNA, 2000 bp, Oryza sativa
aagcccaaacaaaggattttcggcccagcacagcctagctccacataggagaaagtacacccaaggtccctcaacttgtcatctaattacaaaatcgtcccccaaccgcaaaaccgcacacaaggcatccatcaacttacaaaaccattgtagactagatcactcggcggttttaaccctggttttgtccgaagtggtggctgagtcagcgtgagacccatgtgggacccacatgtcattgaaacattagtctattttcccacacttctttctatcccctcccttccaagcagatcggcaacggcgtggggagcggccgtccggccggcggagcgggcaggcgacggcgcggggagcggccgggcggcgggtgctcgtcctcctggtcatcgaggccagtggccggcatgctggtcggcaacgggcgcaagcaccaggctctgacgacgaggttctccaagacgggcgcttgtccccccggtctgcggcgaaacggcattcggcatggcggacgaaggcggcgcaacatccgggtgggggagaagcgagcggaggagggtggcggcgatgaagcggtggagggcggcggcgtccctccccctggtggcgatggagacccagcggcccttccacaggcggcgcaatgcacggtcatcggcaccaccatatgccggccgttcttgtgctgccgccaccgccaagccgacacgacgccggcggcgagcgcggggaggcgttgaccgagctggaggaggacgacaagatggcgcgcggcgctggaggactcctcatgcgccgtttgccgcttcctccactccgccgccctgctcctcgtcgccgtccgctccatccctaaggagctctcccctcgcctcctctggacccccgccttcgagttcatcgccaacgaccgtggccaccccacctcctccattccacgcggtggagctcgccgacgactgatttggacttgggaggagctcgccggcctccccgcgcctcctctgggccctcgccttcgaactcatcgccgacgaccgcggccaccccgcctcctctctttccacgcggtggagctcgccggcgatgaacgatttggacttgggaggagctcaccggcctctccgcgcctccgccgtgcctccactctcgctcgttcgctggcctccgccgtgcctctgccgatgctcaaggggagaaatgggagagagagagagagaggagtaacggaggggagggagaagagaaagggtgttgacgtggcatcctgacatgtggggtccacatgggtcgcacattgactcagtaaacacatcggacaaaaccgtggtcaaaaccaccgagggattttgcaatggttttgtaagttggggatgcgttgtatccagttttgcagttgggggacgattttgtaattcgataacaagttgagggaccttgggtgtactttttccctccacatacgatattcgtgttgcggcccatgaggccatagaccatcagttaccccagcccgacccatcgtgctgcaagcctttgcaaccatcgacagttgagcaggccccccaaacgcgatgggcgtgggccgcgtggcgataatgtgtgcgccccgctcccctcatatccgtgtccgtgcacgagtgaacaacccaacccaaccgatgcgcgacgcagtgacgcaggcacagcgagttgaccggccgcgccacgtacggttggttcctcctcccaacacgcggcgggacccgtctccacgagccgccgttccctagaacgcggcggcaacgagcatcctcctccgcgtgggccacacgctgcgtttacaagcgttcacaccttcggcctggccttttttatactcccccccttccccaaggtgatcacgtctcgtctctgtctctcggcccaccgcttccatcgttcgtcctcgtctccacgctaccgtttcgcaaccacccgcttcctcctccggagaccgctcggccgccgctcgctccagc

SEQ ID NO: 1730 - DNA, 2000 bp, Oryza sativa
cgcggtcatcccctcaaccaccaccgccattacgactgtcgccgagacaactgcaaagatcgatggcacaacgaactggtcaaaaagctcatcttcttcagcctcatggcgctggcctcaccattcgacctggaatacttgctacatgcgttcgcctcccgtctcctccattgccctcctaccgaatgccgatgcatgagtctccctgtcgttccccgccattgctcttctgctgccgcgcatcactcttgtttttgtcgctcaatccaaagaaataaataggaatacgaaccctcgtccccaaagcccgggtcctagactactacgaatagaaagatttctacggatattcttcgtatcaattttataatgcttatcacctccttctgagctattcccacggtgccttcgggtcaaagcttaatccttaatagccaaccgatgcctggcaccaccgctaagcacaagggcaagaaaaagattggctttaaaagatccaaatacttccttgtgggtttataaaaaaccatatcatatcgaagaacttgatggtctttctccacccgttcgattacttcttaaaaggattagatatagaaaaaaagtagtctactcaggagaatgagataatgctcataatatcgctagtaaccaaccacaaaagtaaaccaccgtgcaaaggaaatatgggaaagagtgaagtaaggaaggaaaggagtcactgacatgtggactttatatgttaacttacgtggttggactaggtcaatgaaaaacaccttcaaaaccactgagggagtcattttgcattggttttaaaagtttggggatcaagatatccacggttacggttgagggatataaatagaattggatctatattttgagggattagaagtggactaattctgaaagcaaactagtgtactccgataacaaagttcacacctattttggggaaatctgtgcatctagaaacctattttggtccacacttgagacgccggaaaagctaaatcgcgcacgtttccgggagcagcctaactaattgaattagttttagactcctaactaactgaattagttttagataatgacgataattaagataagatttttcttttttggaagattttttttactaacagattaaaaacttttatgttagatttaaaaactttcgacttaagatttaaactttgaagttgaattttaaaaactttcaactgaaactttgaaaattttcaaatcaaaatttaaatttatacgaaaaattttgaaaactttaaaattagatttgaaaattttcaactcgagatttgaaagtttcttcaaaatgaaaaacttgtaagttaacatttggaaacttttcggctcaaatatttttgaaaacacgtgtgctaacgattaaaagtataagggaaaaaaaggaaatacgcgtgaggggaggaagcgaaaaagatggcaaaaaaatgcgtggggagagtgagctcgagcgccaattagcaacccctagacgctgtgagtaacggcctaaggccattcacagtgcaagcacctcatttgcgttacctcgtatgccacgtaggatagatacacaacgaatccatacctctcacagtgcagggtacgatccccaaaccaaccaccccaacctattctctctcccgctttcccctttctctccttttccctttccctctcctactttcactcccaccgacccgacagagccggagcgcgcggcggtacaggtcgtcgtcgcccacggcggcgcgtgccgtccccgcgaatctctcggtggcgacgagaaggcggagcgaggaggacggcggcggcgcggatctggagcggcggcggcgcgaggggacaacggcggctggcggattctggagtggagcggcgcgcgcgtcctcgtgctcatgctcgtggtcgtcgtccttggagtggtcatcggagtggtcatggcgggcggcggcggcgcgtcgtcctcggagcgg

SEQ ID NO: 1731 - DNA, 2000 bp, Oryza sativa
ctttcctgcctccttcctaccttcctgtatgattgctatttcttgagtagattaaccctgttccctgatgtggggtttgtacttgtcactttgtcagcattcatgctagtttctagagcttagagccctagtttgttaatgcaaaagcatattataaatatatgtaccatctggttgtaaatgactcgatgaaattctctagtgaccactattctcgtgtacattgttttgaaccaaacacctgaataatttgatcagtaattaatcattcgcagctgccactggatatctatgatccaccgaatgattgccttgttctgtaattctggcccgtcttgtctggtgagagactttgttcatccggaccgctttgtagtaatgttaatctgttttggataatcaatcaggtttagtgatatcattgtgttcaatgtcatattggtataatggtgatgtgagagtaaatagatatatgattcatgtaacaatttgtttagcagctggtggttttgaaagacgaacagacggcgatacctgaaccgtggacgggccatcatttgttgttgtttacaaaaaaaggcaaattgctggccaagttgcatccataattggaatttggatgcgtatatatccttaatttgggattaatatgggagagggtaggaatggagccgcgactctatatctactagcgtgttgcagctgggccagagttgttctattattgggattatccaagacaaaagtcggcaatatcctatatagatatgattatccgtggacctaatataatactaagatgaagaacaaaaggacttctagttcatgacgattagtactgtccttgtttcctgaaactattaataaaaaaaatagtactactagtttgataatcaagtggttcaagatcaagtgtggtgtaggtgcatgcttgctctttatttcgtgatatttgggcgaggaagtgaggattagacatggctaaggcaagatagtactctctccgtttcataatataagggattttaagtttttgtttgtactgtttgaccactcgtcttattcaaaaaaaaattaaaattattatttatttttttgacttactttattatccaaagtattttaagcacaacttttagttttttatatttgcacaaattttttaaataagacgagtggtcaaacagtaaaagtaaaactcaaaatcccttatattatgggacggagggagtagtgtattaacgaggtactactagtaagatgcatcaatgatgattacaacgggctcccgtttcggcccaacgaaaagcaaagtaaagtgggcctcgattgcgccagaagcccatcccggccaactaaaatgggccgcacgtcagccgcacaattaattaatggaataagttcactttgggtccctctatttgtagcccagtccgattttcgtcccttgaccgcaaaaccgggtacgacccatccctcaacttaccaaaaccgggcaaacgagatccctcggcgatttcgaaggcagttttggctgacgtggcgcctacgtggtttgtttgacctaggtcttcgccccacgtggcattaacgtggcgcttacgtggcaattatatcccggaaaaataataaaaagtgtggccccacatgtcagctgcacacaaaaaataatttaaaaatgatggggcccatgtgggccccacatgtcagcctcactactttcttcttccctatcccctctctctcttcttccctttcccctctctctctctctccttctgggcagtggacggcgcgtgtgagcggctaagcaggcgagcgccggtggctgcggcgggcgtggtcggcatcgccccccgaccggagtgccgcggacagcgcggcgtatgcgcgcgggtgaccgaagaagcgcatgcgccgggcggtcggagtcggcgagcgccgcgacgtcggaatcggccggcggcgggaggatgttggagagcgggaggatgttggag

SEQ ID NO: 1732 - DNA, 2000 bp, Oryza sativa
gcaggcggccatgggagtagcggtggaggacacatgggagcaatgctggctggaggcgccgctgcggctgctgcagcctatggggcacacaagatctcttctcatggccatggtggacacatgggctatggaggccatggaggctttggtggttacggccatggctacggcggtcaccacggcggcaagttcaagcatggcaagcacggccaccatggcaagttcaagcatggcaagcatgggcacggcatgttcggtggtggcaagttcaagaagtggaagtaatgcgcatgatctgatcatgctggaactctgtttaggctttaactgaagtgcttgcgcttggctggttaaaagcctaaaaaaagcctctcgaatgtatctaagcaggatggagctttgctcagttgctgctcccatccttcctctatgatttggtactctagtatgtggctcagtgacaatatggcttgctaataattaattaaataccttctgacgcttatgcacatctgtgttctaatgttctatagcctgatagatatgatgtgttgaaaccttctttgctgcttttctttcttctgtgaaagtttatgttaccatttattggtaactgctgtctcctgggacataattgttggtttctgattgtgaatttataaatttttaaaattttggatgtgcaatgcaacattagactggggagatccagatttttttcagagatctgagctcttctcgacttctcctagcctcctgatatagttataaaagtggtcagaactaataagatagataagttgtcatatatgttgacaaattgtcattgtatccctataatttggatggaggtatattcttctttgcggagttgattgataagtaccctttatgtaattgtggttatgaattaaagtttgttttagtctggtgttgactagtactctctctgtttcatattataagattttcgtattgtccacattcatatagatgttaatgaatcttaaacacatatgctagaaagtcttgtaatataaaatggggggagtagtttttaatttcttgtgtcaattaaaactatacatttacataagcataaaatcaagaaaaggttttgttttaaaaaaaagattagccatgtcattctaaagggacaatgttacaacaataattttgatcaaagattaagctattttgactgcacaaattagaaaggaacattctttttgtgattaaacgtactactccgccgtttctgctcaaaacttaccgacaacgacacacagatttccggcgcatctaattcccccactatgataagataagcaaaagcaagggctatgattttacacggcagagttcaagattctcacaattaaataaggaacataaaaaagcatgctttatttatcgccaaaataaaccttactaatttctttccataagccaaacaaaccaaataggacctcaccattatgacctttaccaaaatctaataaagttccaaaaccaaatagcactttcacactaataaccttatgatctttctgctttacaacatattggtaagatttattttagcaacaaagtaaacatgccataaatgaaaaattagaacaaccagtgcaagtctccttctccaataaacatctccttccatacataaacaccaccaagtcaaaaatcagcacgtcactacggctatatatatagtacacgtgaagaacaatcaggtcgcaatttagcttttactattctaatcagcaactccaaccgatccactaattacacgtcagcttgcttagccgcgtcgcgctgctctgcttgatcatcatcaccttctccgatcgatcctcctcgacgccgcccacaaatataaatcccacacgcgtcctcctcctcctaataaactcctccaattcctcgacgaatcagttttctcctctgattttccaccacaagatctctagtttctttgatttcttgatcagacgacg

SEQ ID NO: 1733 - DNA, 2000 bp, Oryza sativa
ttttgcaaacttagtgcatcaagtagtgattacaagcattgcaaccctcttattgaacatataagcaaaatttaaactctattcgtttgcgcctcaaattccccctcaattatactatattcatgtttattttgggttcgtgaaataaacaggaaactggtatagcctgcaaaatccttcctaacaagctaatcttgctgaacccagcgcaaacaaagggcaatcaatttttgtagtgaatacaaaggggatcgatttaggcgatgcaagcgacctcgaattcgcgatttcgagtcaactcgtcactcaaacgttggccattgcgccgtcagggacaagcactggcacaatcgctgctctcctgctcgcggatcgtcttgccggcgccgggtggaggctaccccgagagctcaatagctcggagagacgggagctcaataccgcggacggcgagctatggcggccgcaagggaaggtccgccctaggtttgcggcggggagggagggttggtttgtggcataccgaggaagaggcggcgctggtcggcgaagtcgtggtactcctcgttctgcgggatggccggggtgacgagcatgagcacgacgaagatggtgaccgccgccacccacgccacccacttcttcctcctgctcacatccatcgccgcccgctgccgccgccgccgccgccgcttctcctcgtcgcctcctccctgtcgcgatggatcggtggtggaattggaattggaatcggggcgaaggcgtaaacccggcgtacgctttgtcattggggttgtttgtttttgactttttccgagttgggtgttcgcttcacgccttcaccctgctcgccttgactcttcatcgcaaactcttcttcctccttgagttcgaagcgagaagacgaagacgaagcaatcctcctcctcctcctcctcctccatggctacgtctcgagctcaagtggtgacgtgtccatgtcgtccctgcatgaggtgcacgtggccatacacgtatatggctctgcacagttgatccagcaggtttattttattgatttctttttcgttcattagcagagttgatcagatttcgttatctgatcaagtgctcgagttcatttcatgggctagtgaccctggaagattatggcattgggataatcatgagagatcagcgagcaggtttcattgcatttgcagttcatgacagtttcagataaattaagctctcatgtcagacagtcagcggctgaagctttgtgaacggttaaacgggtactgaagactgcgaatctgcaactagattaaccaagggagaacatgtgtagcctactaatttatgccattttgttgtggctcttcgtgatatgatggagctgacgcatcagtttcagaaactgttgcgtcaaaagaaaaggtttcagacactggtgtatctgcattctgttgtgctgacgctcaatactatttctcactggaatgttatatacttctggaatattctgttgtgctgacgctcaatattatttctcactggaatgttatatacttctggaattttggtctagttttaatttccctctacagaagatatgatgcttattagtattagcagtatctgtaaaagtttcaacttagaacaaaacgggtccttctgtccaacggggacgtctccgaaactaatcataaatcctgatgacggtagtactcaaaactagtagtgcctaataacgagagtcgtaaatcaacaaaactccaaatgcaattcatacattgtcactggatatattggattcaatgccgatccgggtgtgagagcccacagaggcatcgtgatcgatcataattcgtaatgaactctgatatttaaccaagatcatatggacgctgcagatgcacctccttgacgcaaatatctctccctccctcatcgatcgatccatcgccggcgaagagctaccttagctattagtatcatcgatcatctccggcgagaag

SEQ ID NO: 1734 - DNA, 2000 bp, Oryza sativa
  misc_feature (1984)..(1984): n = any nucleotide
  misc_feature (1988)..(1988): n = any nucleotide
gcttactagttaatatcccacgctttgctacagaacatattgatgaacacatgttacatattatagaaatggtacatgtatacgtttaaataatataaaaataatgtgaagataacgacttggcattgcttcgatattgaattatgaaaataaaacaaaattataaaataaaacgtatgtcatatttacatgatatttaaaataatttaaataataattactaatgggtgatgatgtgacgcacttgtatgtgatttaaaataccatagataataattgctaatggatgatatggtacacttgcatgttgagatttaaaagttagtgggcatcaactttatagcaaaacatgggtatgtttcattaatcagtaagtagccagaaatctaaaaaatattatcgataagcgctccaacgaatccaactttttaaaaataccatcgtataagcacatttatcccaaaaatataatcattgttaggttttcattagcaattattcgttaaagtgttataaaaagatcatttttacttctacgaattgttaaatgatgattaaaatttttgctctttttattagcttacattaatttggaattaaatttaaaatatactgttcatttgggtttttttaaaaaatattcgacagcgaacggtctcgctacttccttccttgtgcgacagcgaatgttttgcccagtgagctgttgtttaattagtaactaattacccgattaataattaattagtaattaggaataattattataattaacgattaattgataattattaatcattaatgaggataattaatcaatttgaatgttcggtctcgctcgccggtaatgcgagagcgctcaatttaatcatttccgtgcaacggttcagcgagatcgatggtatattttcgttaaacaatttgcataccgaatacttttttaaaaaagccaaataaacagtaaatttttaaatttaattccattaatttgtatgttgctatttatactaaattattgtaagttgacgtaaatagcaaaagtttttatcagcttttaccattttgtagggttgctaacggaaacataacgaaacccgccgtagtcacctccttgccaccactgcctcggtgccagctgtgtcctagcgacaacggcaccatggacgacaacaagctccaccatggcaaccttcctcgtgccgcccattgcgtggtcaccacccttgccaactccgcccgttggggggccatccttcggcctctgctctagaccgctaccgttgtcgggtcttatccataacagtatagtggggtggctttgtctgacatggcaatttgacccaagtcaacaacgctgagtcattgtggacaacatatgtcacaacctcttacctatctctctcttcctcccctattcccatctcagcggtgcctggtgaggaagacgacgtctggcggcgggtcgacgatgggcggaggtggcaatgaggggactacggcgggtacttgagggacctgttgtgtctgatatttcggttgaagatgaaaatcgaactaagctgtcaaattaagggtcctaaaatgaacttattcaaccacctaaaccagtccgatatcctctttgccaagctcacggcccagtacgcgaacccgtccgtcgtccgccacggcgccaccacgccgcccgcaccgcacgcgcacggcaagcaagcgaaccaagcgaagaaaagcacacatattcctctcctccctgttcgattcccctcctctccacgcctccgcggtgtccaaactccagactcccccaaaaaatcccccaaaaccgaagggaaagaggaaaaaaattactcttcgctctcgcgtcgcgcacgacacgaccgagccagcaaagccgcccatccgccatcccgccgctcctgcaatctacagccgcgtcgccgcttgtccgcctgcgctcgttctcgctagggttcggaaggggganggtngggatcgcccgg

SEQ ID NO: 1735 - DNA, 1041 bp, Oryza sativa
  misc_feature (3)..(4): n = any nucleotide
  misc_feature (11)..(11): n = any nucleotide
  misc_feature (15)..(15): n = any nucleotide
  misc_feature (17)..(17): n = any nucleotide
  misc_feature (35)..(35): n = any nucleotide
  misc_feature (37)..(37): n = any nucleotide
  misc_feature (44)..(46): n = any nucleotide
  misc_feature (48)..(48): n = any nucleotide
  misc_feature (61)..(61): n = any nucleotide
  misc_feature (63)..(63): n = any nucleotide
  misc_feature (68)..(68): n = any nucleotide
  misc_feature (78)..(78): n = any nucleotide
  misc_feature (91)..(92): n = any nucleotide
  misc_feature (95)..(95): n = any nucleotide
  misc_feature (112)..(113): n = any nucleotide
  misc_feature (115)..(115): n = any nucleotide
  misc_feature (144)..(144): n = any nucleotide
  misc_feature (148)..(149): n = any nucleotide
  misc_feature (978)..(978): n = any nucleotide
atnncgcgctntctncncacacagagagagcgcgngntctctcnnngngcccccccgggcncncccanaggggcgcgngtgcgctctctcnntgnggcgccccgcgcgctcnnanatatatatatattatcagaatataatcangtannatcttgttgtaaagatttaattgtaacgatcataacggtatatacagattataaattagataagtattttaagagaaacttctctaaaaatatatatatatagatattgagtgtactagtagcttcttttggaaagaagagtgtctctctttaacactatctaaaaagaacaccatgtcacatccaactaggccctcctcctctttgatcatctcataacaatgcggctatgacgtctcctgagggaatccccacccgatcggaatcacaagagagattattgacttatcaccgatcagcagaaaagagacggcgaaaagcaatgaagaaaaatataaaaacttcaagataagaaaaggaaagataaaaaataaaaaaggaagaaagattcttccaagccgcccatggcgtggttcgaacgcgaggtgatgccctccctccgcagccgtacacgtgtcccgatccccagaccgaatcgacggctgcgactctcgtaacacgccaccaccgcctcgctcacagacaggtggggacgggtcgttccgggacccaccgtcagtgtcacaggtggtgtcttccgcgggtgagagggtgaggcggaaacgttgttagcagcgtataaatgtaaccaaaccctaggattccaacgcgagcttatcacttatcatcaatcggcgcctccctctctctcgctcaccgcctccttctcctcgcgatctatccaaacaaggtaatttggggtggaaatccattcggatttggttcgtagtccaattgcttccgtaccacacttgctcggtttcttggtttgggaatttcgtttttttgngcaatcttgtttgatttgatgtttgggatttgattttgttatcaggggctcgctaagatcggc

SEQ ID NO: 1736 - DNA, 2000 bp, Oryza sativa
tgcagaaaagagtgatccagtaatttgcagagaaatgttggctaagaaaggtaattctacaggtttagtgagaatacttgaatagggagactgtttccagcatgtgttcctccattaatgactgtaattgcagggatgggaagtgtcgtagcgcttttcccaacaagttctgctatatgcttgtacaatggaacctgcacagaaataagcaaccaactataagaatgcattgccatatccaacaccttcttttaacccagaaccgtggtgattttatacagaactattacctctttttcagcagcacctgctttacaagctgcaattgatacagccaacatagaattcactccaatctcagcctacatgatgcagtgtcaatagttattaaagcaggacaattacaagcgatagaagctgtactgagctggctgctacaaagttaggcttgacagtaaagtgagatggtagtaaagaggagtagacattaaaaaaaaattatagaaaacaacacatcaattattttcatcattaaatctacatggaacaaaccaatgttaagaactgtcatgtggctgattatacagatcgatcgactgtttgtggtaaagcacaacccttgaataatctctcattataactctcatcaaatagagctcagcaatgtaggatcaggttaattccatagagtgagaagagatatcgattggggttttagggatttaccttgtgatgcgccttgtccaagtccatgatggcctggtcgatctgcgactgctgctgcggatccattcccacaagcgcctccgacaccttgtcgttgatcacccgcaccgcatcggcgaccgccctggcgagcagcttccgcttctcggcgtccctgacggcgtcggcggcggcgccctcgggggcgtccgcggcggccgcggaggcccggtgcacggccttgttggtgtggaggctgacctccacggcgggctccccgcggccgtcgaggatctggcgcgcccgcacgctcgtgatcacggccggcgccgcccggcgcatgtggttggagatgaagagcaccgggtcgggggccttggcgcggaccgccgcgttcacggcctcctcgatcttgcgcgacagcaggtgcttctccaggtactcctgcaccgacatggactgaggctgcggcggtcggcgtgcggcgtcccgcgctgctcctcctctcgccaacgcttcccccctctctctgggctctctcctcccgcgccctctgcctctgctcgtcggctcgtcgcctccagctgccgggatcgctaggccgtggacattggccgaactcgaggaaggggaggctcgagacgagaagtcgagagtcctcggaccagtgcgtgcgtttgggtaggcgtgggccagtttcacgatgggccggagcccatttgtgtaagcttgtaccatgggctgagtacacactgtgtctatgggccactgactaggagaagcccagcccggtggtcatttccttcccattgtcttcaaggaaaaaaatcggatcaagcactccaattttggactggaagttgctggatatctcgagtttggaagcagagaattaactgcacttgagtcagtcactgatatgtgggccccattttactatggcccacatatcagtgactcaactacacagcagttaagtcagagcatcctttccctcgagtttgttctggacgattcgggtcgtgctggtaacctgaactgttccgttcgtaatctaccgagcccagaaccaagtccagcattttcgagtctatccaggaatagaagagaactatcgagaagctgctttcctctccatccttatcattcccccgccgcatataagaacgccatcccctcctcgacagatatccaagcaaagcgagaaaagaagccagcaatcgaaagcccaagcttccaaaaatccgcttccaattcgcgaaactacactagtcgtaagcgccaaatccaaccga

SEQ ID NO: 1737 - DNA, 2000 bp, Oryza sativa
gcaataaccgtgcaaatatcgcggttatcacggtaaaccgtgcggtaaccgcggtgaaaccgcgaaactgccgagttttgaattcgaatttttgaatgtgatttctgtacgattttagacaattatcgcggttatcgtgctaccgcgaggtggcggtaacctcggcccaaactctgttgaagatctttatttatcggcagaaataccttcttaagtgacagcttctaagcataaaccactacaatgacgtgcatctaagctttatttaagataaaataatgaatagtatcaactaagcaaccttgtattcctccaattattcctggtacaatcatgaacactacatatgtatcttgcgcaacgcttagctcacagtgctatgttcttcatggccaagcatccaagacctgagatattcatctctgatacagcttctgataacactattcgttctctggttgttgctttgagcacgatgtgccgagcctaaaaacagacaccaagcactgttgaataattattgtttttatgcttgtgtgtttaacatctgaatcattttcttcttcttgcagccagattgttggatcagctattctagggggaattgagatcaatcccagccctttatttattgatccaatggtccaaattgtgagctacagtaaaattagagctgtacattttcttcttcatgcagctagattgttggatcagctattctagggggaattgagatctagtgcagttacacaatcccaaccctttatttattgatccaatggtttaaattgtgagatacagtaaaattagagctgcacattttttcattaaaaaacgctacactaatttgctacagtactaaagaggcatctaggccatccgttttaaatccaatgatactcttgtgactgcttaacttgacagtggccactgcactggaaccgaatccgtctaggggtcggtcaagaacacaagctacaacaaacttgtgcagatccattgaatccctgaaaatgtcattcgggtgaacatctcaagcaataatatacctaagctgtaagtatcacccaccttcgtgactacagaaccttccccgtactctgcaacatttgtagccaaaattagtatttaaccctaccctcaacatgtaaaaaatgaagcaccctcagtctgataggaaggggagagattaagggaataattgcccggacacctctcggtttgaccgccgcccattgtctggtctgaccggccactcagtgctgcactgttcactgacagaaaatattaattactatattttcaataaacactcgcatttaataattgctcatcgacaaaaattgaccgatcacatgattctagaggtgtgactcccatctaatttgggaaaaaaagaaatagaggttcatgcgactggttcaattgctttatgctgtgataatgctattgacaaacaacaggtgttataccattttagcgattcaccgtggaaggccggacggttgatgaggtcatacgctaagacattaacatgtttgtatagactttagagcaaaaagaaatagtagtagctcgattagcccagaaacaagtaaacaggccactctcgtgggcctcgaatcgggaatagcccagtttccaagcctgcgacttttactgggccatgagctaaactctacgaaagaaagcccaactgcccaaccatgaaaactcgtaatccccgcgcgcgcgacggaaaccgcctactcctcccgttcccgcgtacactttccgcgccgaaacgcatctcagccgtccataggaaaacaacaccaatcgtgcgccacatgctcctccacgtcatcgatccgcggcgcaccccctccgccaatcagcgcccacctctcccctcctttaataccatcgccgccgcctccccttcaactccacaactcgcaaccgaattcccccaaattttcgtctcccctttcccttccccgagaagaagagagcggcat

SEQ ID NO: 1738 - DNA, 333 bp, Oryza sativa
  misc_feature (27)..(27): n = any nucleotide
ccatcacaaataatataatgtatttanttttttatgaagaaaaagaaggagcaaaaatgaaaaataagaaaaaaagacaataataattagtaggagtacctaccaaccgtggactagtattacctgctgaccaaccgaccttgcaaaggaggcttatatatatactccagtaaaagctgcctgtttcatcgatcatcgatcacagacaaattaaagcatacagcaattgattcagagtagttagcttaactagctcctctgctttaattagtttgccccttccaggtagagtatatatgggtagtataggaggagtagcggtggtgctggtgg

SEQ ID NO: 1739 - DNA, 2000 bp, Oryza sativa
tattagaagcagtacgatcttatttggtggagttgaaaattataagaaacaactgacaagcaatcaaccaacatatactgaatatgggaaagtttcttttagcttttctaaattaagtactgattcttaaacttaagtgagaatctagcctgttcaggggcgacggctaaaggacatagcaccactagtctacgcgattgcaaaaaagaagaatgcaagcctgcaacaagtatcgctttcccgaccaatggttggttgacctcggtttgccggtaacctcaggctggacgacagaactaattagccaacttgtcaatgtctagggtgctgttcatagcctgcagttgacagagtacgaaaaggacaagatcacatggaagctaactagtcacggcgaatacatgacgacatcggcctacaacgcacaacttcttggcataaaagcttcaatttcaatgcccctatctggaagccctaggcgccgcgcaaatgtaaaacattcgcttcgcttggcttgttatccaaaatagagtatggacctccgacagattggcaacccgtgggtaatcgaaaatggctccatctgcccctttgtcgaaggaatcaggaaacggccctcacctcctggcggagtgtagatatgtgaaagaatctaggcgacacttgcagactggacaacatgtgaacaaataagaccaacgttatggcaacaagcctcgacgctactcaagtggtgggaggccaccgcatgttccaacgaagcgccaaagaaagccttgcagactctaatgctattagtcgcctaggatatttggaatgaaaggaaccgcagagtttttcagcaccaagagcttccggtggctagtctgatagccaaaattaaggaggatgccaaaacatgggtcttggcgggcgcgaaacaccttgataggtggcttaccttttaacatgttcgggccaaaggccttgagacggtaaagttttctatttgcgcttgcgcatgtacaattttattcctctattcaatgaaattggtggctcactggttcattaaaaaaaaaagaatctagcctgttcgggaagaagaggattttgttcgtgagagagagagagagagagagagagagagagagagagaaggaggaggaggattttcaggcttcgcattgcccaacctctgcttctgttggcccaagaagaatcccaggcgcccatgggctggcagtttaccacggacctacctagcctaccttagctatctaagcgggccgacctagtagccacgtgcctagtgtagattaaagttgccgggccagcaggaagccacgctgcaatggcatcttcccctgtccttcgcgtacgtgaaaacaaacccaggtaagcttagaatcttcttgcccgttggactgggacacccaccaatcccaccatgccccgatattcctccggtctcggttcatgtgatgtcctctcttgtgtgatcacggagcaagcattcttaaacggcaaaagaaaatcaccaacttgctcacgcagtcacgctgcaccgcgcgaagcgacgcccgataggccaagatcgcgagataaaataacaaccaatgatcataaggaaacaagcccgcgatgtgtcgtgtgcagcaatcttggtcatttgcgggatcgagtgcttcacagctaaccaaatattcggccgatgatttaacacattatcagcgtagatgtacgtacgatttgttaattaatctacgagccttgctagggcaggtgttctgccagccaatccagatcgccctcgtatgcacgctcacatgatggcagggcagggttcacatgagctctaacggtcgattaattaatcccggggctcgactataaatacctccctaatcccatgatcaaaaccatctcaagcagcctaatcatctccagctgatcaagagctcttaattagctagctagtgattagctgcgcttgtgatcgatcgatctcgggtacgtag

SEQ ID NO: 1740 - DNA, 2000 bp, Oryza sativa
  misc_feature (1706)..(1706): n = any nucleotide
  misc_feature (1724)..(1724): n = any nucleotide
  misc_feature (1959)..(1959): n = any nucleotide
  misc_feature (1977)..(1977): n = any nucleotide
aacaaaatctttctcaagcacagaaatcttctctactttacccttcaagtcagaaactgaaattgcaacataacacagataagtatctaaagaatgcacattagtgcaataaaaaataaaaagacaatcatttggtaaaacaatagtagaataagatgtttcagccatttgcatacctacattttccttgtcgccaactagacatttcacattaccgagtacttgtttcaccgcagcgacttcctttcctactgaactaaataaagccagatgagcattcagcttttctgaaatcacagcaatctgtttatccttcatctggatagtccattgcagagaacaagcagagtcctgcctatcaaacatggtatcatgagccgataatcagtttgattccacatacaggtaattcataattaatgcaaatgtcagaagcaagaacagggcagaattatatgacagattagacaatgtacaataaagcagactccagatacactctagtcttacaaatgcatagcaattgttaaggaaaaactatgatattaatggcaagtagcctcacataaatatgcaattattacaaagaccaaaagtttagcatggagagaaaacataaaaaatgagttcagctccatataaactactacagaaggaagggggaaaataaaggtaaacacctgcctcgtaatgttttatgaaagcctcctttgattgaagcagtccctccatgttatcttttaactccttttcgtttttctccagctgctcattttcattttcaaggcattttatctgtaaaaaaaggtattgcaatgaacctctgttgaataggtacaaaccaagcactaggggaagaatgaagcatccacggtgtgatgtgacataacatgcatatcaaaaatcaagtgctgcttctacctaatcaaccaagcaccaggactagtcattgttacgattcggtagtaaaagtacaaatctacactatgatagacaactggcccaaacagccccaaatgttggtataatcgccacgaaacacaacatggcaaacaccagcatgatcacaatgtgtttaagttagggactgtaatttagttaggcattaaactgtaacataatccaacacatgagctctacccaaatccatgagacgagaacacaagctacttggcgaaattgagagttgtgaaggggctaagcagaacgaaccctggactcgagccgacggagcgcgtcgtccctcgccgccacctccgcacgcagctcccgcgtctcccgacggtgcccctcctccgcctccttccatctctgctcaaattccacaccaaaacccccaccacgcatcagcaaattcgacccaaaaccctaatccccagcaaacagagaatccaatcacagtccgtagagtaagagagagagagacttggctggcggcgtggagctcctcgcgcgccgcacgctcccgctcctgcgaaaccgtaaaatggaagaggaatcagcactacgagaggaagaggaagatccgacaaggcattggatgatcggcaagcaaagctcacgcggaggagccggtgctcggagacgagcgagagaagctgcagctgcagctgcggcagcgccgcggcctccggcctccgccgccatcgccgccgcgccggtaagctcccgcttcctcttcctctccactcgacgagccaaaaaanaaaaaaactcccaagggnccatatactgggccttgccagcccaaacccttccggcccaaaaggcccatccgcggaagccgaatctccatcgaacgaactcgaccgtcgattcagatccgacggctgagatcccacccaaaccctagcccccactccgccgcctcccttataaatagctcctctctccctcctcccccaaaacctctgccctaatccaccctcgccgccgccgccgccgcaagtagccacccgngccgccgccgccgccgtngccggagaaggagaggagcagcc

SEQ ID NO: 1741 - DNA, 2000 bp, Oryza sativa
  misc_feature (41)..(41): n = any nucleotide
  misc_feature (1310)..(1310): n = any nucleotide
  misc_feature (1375)..(1375): n = any nucleotide
cgacgctctccgtctcgccgtcctttctccatcgcctcgtngtcggcaaagttgcggatctttcgaccccctcgagcgcctcctcccgcctaagacttcggcgagaggggggcggtggagtacgagctcgacggcgcgggttctgctccccgtcgtcaccgctagcactcagagagaggttgtgcgcttttgctcgttcggccattgggttgaacgggagaagcttggcgcacacgaaagaggatgagagcttagaaaaacacacgcgccccctacatggcgcgccagatgacggagcgtggggctcctcaccgagagaccgcgcaggcccccctttgccggttcggcggggggcgctaagtgaggttctaagccctcggtctgtggaatattcgcgagagaggcaatgcacgagacatgggcgatgtagacaggttcgggccgctgagaagcgtaataccctactcctgtgttctggtggatctgtgtatgaagaaactacaaagagttcgagagctagaacaagtttagactctagaactcgtttgctcctcctttccccttttttcttctccgtccctctctttggtgggcaaggtcctccttttataactcaaggggataccacatgctccacttctacctactcttcttttgggtggggacccaccctctcttgaccaaaaccccgttcgccttctcttggaagctaaaatatagcttgtctttgagtgtggcccagcgtcctcactcgtctgacataggggatcaccctgtcattccttcattaatgggcggagatttgcaatggctgctatccgaatgaccctccgatgggatgggtcatacctacctccactccgctggaaggaggtgcaaaatgggtgcgcggttgtctgcctatgacatgaccagcgtcagaccagtcacagaccggtcattgttgtccaccacgtgtcagtttagcaagctgcatgtctgcccttcttcatacaacgacttccttgcaatggttgcgatgaagcctggaatatatctgggcgggactgacgtgccaactccaggaggtagcacgccggctccggctagggacgagtgcctggaggctctcatcaatccgacgggacggggcgaggcgtgtgtcaggccgcctgttgccacctaacccgcgatctgaccggtctgtgaccggtcacacactgcgaccggtcacggaccggatgagcgctgcgctgcattaaatgcggcgtggcgcgctcgtccaaaccgcaataaatgcggttaggtgagccctgctgtgctcacctaanccatacacgtggcgtcaaaaccacagggggtcgggacgcccctgccctcggggccgaaacgggancggcccgacccctcggggagataaaaggcggggaggtctcgtcaccctcaggcccgacccaagggtgaccgcggctacccaaacctctagtcatgataccctcggccccatgtcatcgacaagtactacctttgtttcaggttataagactttctagcattgcgtactactaatctaaaatcccttttattaatctattcttgttctatatcctttataaacaaatattcctagagaataacctgacaataaactaataaaatcctacaaaagcataaaagatggccactttgaatctttgattatgttgcacctcaaaaaaatatatatcatatattaccctaaaaaaaccatacacttttccaatttcagacagccaaaagaagagagagtgagagtctgagagacagcccattcagaggttagttagagttgggccgagcccatatcatctcctatataaatggcccttccgagcgaacctccgccccctccgaaaccctaacgccacccgcgccgccatccccgagcaccaccaaccccaccccccgagcgagcggagcggagaacgcgaggcgaggcgaagcaaacatggcggcggctgcggtgtacggcgccggcggcg

SEQ ID NO: 1742 - DNA, 1648 bp, Oryza sativa
  misc_feature (3)..(3): n = any nucleotide
  misc_feature (8)..(8): n = any nucleotide
  misc_feature (16)..(16): n = any nucleotide
  misc_feature (36)..(36): n = any nucleotide
  misc_feature (41)..(41): n = any nucleotide
  misc_feature (64)..(64): n = any nucleotide
  misc_feature (71)..(71): n = any nucleotide
  misc_feature (73)..(74): n = any nucleotide
  misc_feature (94)..(94): n = any nucleotide
  misc_feature (103)..(103): n = any nucleotide
  misc_feature (143)..(143): n = any nucleotide
  misc_feature (147)..(147): n = any nucleotide
  misc_feature (160)..(160): n = any nucleotide
ggnaggtncaccccgnaaccgcccttaaacgggatncccgncttaaactccgttttcaacgaanaccaccngnnatttaaggcccggggcggcnacgggatcnctgctgctgctctcgatcgaaaggcccccggaagcccggngaantttctctggtggngtcttggggtttcgaaagggtttttttttttttctagaagcgtcgccgcgaggtcggtgtcggacacggtcactgccaggtaggccatacctggtccgattaaactgtacatcgaggccttgggccataagtccaactgcaagatgggccagattaaactgcatactaggccttggtccataagcccatgatcagtaccggcagtctaacgaaagccactcctgactgggcccatgcagagtgattgatctcgcgtgagtttgagattattgcatatatagacatttcatactccctttgtttcgaaatgtttgacaccgttgactttttagcatatgtttgaccgttcgttttattcaaaaaatttaagtaattattaattatttttctatcatttggttcattgttaaatatatttttatataggcatataattttacatattttacaaaagtttttgaataagatttcgaaacgaagggagtacttatcataacaaacaaaattaacgcctaccagaaacagcataaccaccatccactatctaaaataaaaactgatttgctaaaaacatgatgctacatttttcagcttaaccaaaaacaacacgcttccctacaagttaaccttaacaccaaaatttccgtccgcatgagctgcacctgcaccaaaaccgcccttatctgcaacggtaaaacaaatgcacgacttctaatgaccaaatcaacggtggagatgcggccagcaacaccaatatgacgtacggccatcctggcgtcaccgtgacgacgacgagtcgggcgatatgccattgttcatcttgcgagcaaaaagaacggccatatatacaagctggccacttcacgaagagctcggtccgtttattctcaccggagaaaaaaaaagattaaaattcctttcgtgttgcattttgtttcccgcttcgctcgcgaatattaaattcgaaccgaaatttcgtaaaaagtggccgagatattcgcggcaaatccaccgcccgttcgtgcgaggaggaggaaaagccacacgtgttcacacgagctggataagatgaaaccaaaaagtccaaattatttctgtgcagcaaaaaaaaaacaccacaactttttttccattaaaaaagggagaaacgggcggggtgcttggcttgacccggtccgcgtgcaaagtacgcggcgggggttacgcggggcccaaacccgaggcccgcgggccacacgcgatccggcgccccggacaccgccggccaatccggcgcggcccacagggttcccccccgcaggatagatccggacgtgacgccgacttattaaatgcgcttctgagacgccgcgctatatgagccatcgcgtccgcccgtgcaccagcaccagcacagggtcgtcgtcgtctccttcctctcgccagtgccaccacagctcaagcgtgatccagcgtcgggccgcgcgtgcgagcgagcgagcgtgcgag

SEQ ID NO: 1743 - DNA, 2000 bp, Oryza sativa
  misc_feature (527)..(527): n = any nucleotide
ttcaaaactcgacgatgtcgtctattaaaaaatggagaaattatctaaattatttttagagttgtggggtaaataatctgcaacaacaataatatagtgaagtagttatgaaagtattcagaaatgcactccgtgcatcaaagtgtaataacagagtgggggatgtttggctcaaacttcagctagatagtactccatccgctccatttttagtgtagccataagtttccgtatccaactttgatcgtctgtcttatttaaaaatgagtaaattgcattagcagtataagaacttggaaggtgggtgcgattagatgcaaaaatttgaaaaccgagcatagcagtacaagaaagttggatgcgattaggtgcaaaaacttaaaaaccgagtatagcggtacaataacttggctaggtgggtgcgctcatggtgcaaaagttgctacgccattgttccacctcagcgaaagtgccacatgagcatgcattgaccatctcattttacagaaaagtccctaataactttngtattccaattacttcttcagatatatctgttttcctcctgtatcacaatgatcaaaccagtccatcttctcatccaaataaattctgctactgccaactccaaaaaaaaaacccaccacgatacagttcaattgtgaattcttcttcctcatgacctgcaatacaaaataattgggttgatgtgttataccgcataaggaaaataatattatttgcagattattcaactaattatatctactgaaaagggtacaacacatctagcaagaatttctcattgccaatgtttctcttatatcatatacagttataggaaacaccaataattacagtaaaaccaatctagtggctagtaccattagatcacttcattgaattgtaataacaaataacaggatattcaagtgaaaacccaaaaaaatgcagccattgtacagatcaataaaaccttaactttgaaatcatccatcaaatgaacgaaaaatagaaatctacaaccatcagcaagtgatttaccataacaagctaggagcaaattgtcggcttgaattggtttggttactggtttagtgcttgaattaatgtggcacacgaagccctcgccgccgctgcgatgtaacggtttccctcgttgtcgtcgtcactgccgccgccaccatcgctgcgccgccatcgccaccaccgcagccgcctctcaattaggaacacgtcgagaaaaatggaaggagatatgcattcgtttgttctgattgtcgagttaaaaaggaaatgtgattggaaccaaaaaaaaagctatttgtggttttctataaaatgagataggtctttcatatcaaagctgatgtggcaattttgctaaggtggaatagcaacgtggtaattttttttacatggctacttttgcaccatgagcgcaacccacctaaccaagttattgtactgctatgcttgattttcaagtttttacacctaatcgcacccacctgccaagttcttgtaccgccaacgcaatttattctttaaaaaatttttatgattagtatttttgttattgttagatgataaaacatgaatagtactttatgcgtgacttatgtgtttttaatcaaaatttgacatggaaactcataactgcgtttaaaataggatggttggagtaattaaaaaaaagttccaactcgattaatctgcgccgttgatttgcaatcaaacggcccagcaactcgattagtcctctaaagtaagatcagagagaaacactcacacaccagcacacggcgacctcatcggctcatcctcctcgattccggcggccgactcaaatccgaatcgccccaagagagagagaatggcggcggcggcgctccgaccggcgatcctccgccgcatccgcctctccccctcccctgcggcggctgcgggggccgcggcggcgtcccagccccacgccctggcgcggtggctcgcgcggc

SEQ ID NO: 1744 - DNA, 2000 bp, Oryza sativa
agtagtagtggacttggccaagatttcccaatgcaccaccactaacgcatgcagttgtaacgcagaggataggagacctggcagcttctgatacacgtgtcacctgcttgttctttgcatgtggggtgtgtgggccccacttggtggtgctgtgtgggccccagagacttctcgcactagcttgtatgctcggcttcgatgtcctctccgcggatgcagagcaccacagctgcaatgcctgcatgctctgaatactctgatctgaatctgctgccaacttcgtgaaattcagatcgcaatgcactgtttctcaacgcaacggggacctctgctaaattgtaacttgcttctgctcatttctgaataatactgatcgttttatctgatgaccaatgttggaaactggtcgagaaatgcatcaagcagtgcatgaacttcaaatctttaatcatgtttggtataggccaggagtaagcatacaagggggcccaagaaagctattttctcctccatttcaggatgctagttgctgcaaaattccaaccatatccagcgcatcctcctctggctagcaagctagctcagatgttacatccgtgaaacggctctttgtggaaacgtttttagactttctagtgaaagaggactagaggagtgttctgttttcagggatcagacaaatccaagattagtaaggattgacaataagcgtaccgtttgccattctgttctttgttttatctttcctttttcttgcgttggacaacgcatccctctatcactgaatattctttccttgcacacagatacacagtagtaggtttttggtagggtcggaaagtctcataatagaaaattatcaatgaattaactatgtttaatagtcctacaatttgatataataggatgttttttattttctaagtcaaactttttaacttgatttaatctattaagaaaatatagcaacatatataatatcaaattatttcaactaaatatgccattggttatatttgtatagttttttcttgaatactataaaactatatccaacaacgaattttattaaactaatatggcattgttgatgttgttacgattttttagaaatgggacaattttttaaaaataacttataacaaacaaaaaaaacacttgtagtataaaaattggatgaagtaaggtcattgtctacggctgattataagatataacggcatattagcgataaaaaataatttatagaactttttttactatatcctttgtgacttaaaaactaattacaatgcttgaaaaaaaaactatgttgaaaaaattatcaaaatttaaaatttaaaatttagcattgctttatatgtcacagatcaaaggaagcttttaaatcaaaagtatgctaccaccctaatctgtatttactactatggcctggtttagttcccaactttttctttaaacttttaacttttctatcacatcaaaacttttctacacacataaacttttaatttttttcttcaaacttctaattttagtcaatggaaggcatatgtccaagacgaaattggcagtttgtttgcctgtgttggcacctacacaagtgtgaaccaacaaatctactcgtgttttgtaaccacgcggccgactagcagccttagctagtgcatgcgtgtgcgcctgcctgcttacttccatctcgaattaccaatattaatcactttctgtgttctgctgttaattaactaacctcagacgacgtctcgttaatctgagttgctatagctttacgaaaggccacacctcggattataaatactacccagctcatggcaccaccacactcttcagtctcacacaaacccaaaaacccaaagcttagccaagctactagctagctcctcacttcttccagcttcttacactaatacagctcgagccacttcgtcttctcctctcttgcagcatagtttaagtttgagataggattggcgatagat

SEQ ID NO: 1745 - DNA, 2000 bp, Oryza sativa
  misc_feature (224)..(224): n = any nucleotide
  misc_feature (347)..(347): n = any nucleotide
  misc_feature (387)..(387): n = any nucleotide
  misc_feature (409)..(409): n = any nucleotide
  misc_feature (501)..(501): n = any nucleotide
tgatctgaagtatagctcgaccctttcctaggcaccggtggcgagggtgggcgtgatggagttgggtcggccggggtgtccggttgtccagttgccagattcaccgcggcgcaagaggggaccgcccactgccttttgaggagtgggggtgaaaccttagcgtggtgtggatggttaggggagggttatgcgaagggtctcgtcacaatcactcgacatggtgncgcgtgcatcatgggacatgatgactcggtgacatgtcggtgggttgtgtcttgtgggtacagttgtgcacctctggccagagtaaaacctattccgaataggcccggtgcccgcggcgggcnatcgattggggccgaatcggacccaggactttcacccggntgaatttaaggttcttcaacancgttggttgggcctgttcaacgtggtgtagcgttgatcagtggagatttaatattaccttaattattcaacagttttactgtttgctaaatnaaatattttacaaccgcctttatgcaaatagccacaagccattcttgaatccccttgcacgtctgcatcgttggtgtggcctgctgagtacggtggttgtactcagccttgctattattcccctttttcagaagtgtagtgcttctgagctgaagatgaagttggaagaccaaggctcagaccccagttgagttttgcctgtggagtggagctgaagccccgctaggatctcattttccgctgctgctgctcttgtttcagtgtgaggactaagtgcttcttctgtaagtattttacgctttatttacgtttggaactgtatattacttgtcgttttgtgtgccctggctggtcctggacagggatttaatacacagaatagtctggaaatttgggctaaatttctgggcgtgacataggccgactggcgggctaggccggaagggaaggcaggcctgagagagaaagaggaggtggaggagtgaacttcggcccgcgggaagagaaagaggagaaaacgggttgagcggggaggaaggacggacttgtaggggaggatgggccgaagacggcccaaggacagggaagggagattctaatttgtttttctatttgtttaattgattaaacaagtcacatctaaatgtactctagcttattataatccattcagtttatactttatagaaatccaactcaaaaatttagattacaataacgtgaagctgaaacaaatcggatgttagtaacattacgcggatctccccaaataaacgaacgatattatagtacgtaacagtaatctgtaggagtattattgccctttttttaaagtaaatttcacaaaactacatgttttatggttcaagttacagaaaacaacacatattttgacacttggcatttaagtacatatattttagtagtttagtttcacaaaatcacactatcgatgaatggattcacccatgagataacgtggttgttccattaaggatgaggacgtggcattctattaattttgtgcgatggctggtaataggatgccatatcctcatcctagatgaaacagtgaaatagtcacgtcatctcgcgggtgaatctatttattgatagtgtggttttgtgaaacgacactaccaaaatataagtacttaagtgtaagtgtcaaagtgtgtgtggttttctgcaacttggactacttgtgaaatttaatccttttttttttcgcggaaaggaagaaagaaacgctcacccaaaccctaggaaggagaagggggagagagagggagggaccgcgcggcggcgccgccccggtggaatccctgccctgatgtcggcgacagcgaagggcggcagcgatagctccgccggaagctccggatccaccccctcgtcgccggcgacaggcaggggcggcagcgatagctccgatgccaaccagccctcgccggtgaaggagcggggtgttgtgctgtcggagctgctcgggcacatcc

SEQ ID NO: 1746 - DNA, 2000 bp, Oryza sativa
tattttgttttgctgtaaatgaatcagataaactgagctcaaacaaaatgttgtcgataggcgtcatctacttttgttgcctggatcaataaattgttttatgtatcattcaatgaatttacaagtccactgacaccataggtcttccgttccaatctgcagtttggcgttggagtttactcttttcgttccgtaaaaaacaaaatatagtaatagatatgatacattataatattataaatctagatgttactatttaaatttatagtactagatatttttatactacgtttattttttataggacgtagcggatacttgtatattaggaaagagcccatcattataatcccagagagcccacacaatcatctgaaggatgtgtgtgtcgcaggattgaagggtccaaaggccaacttgaatttctcgtgcaccacttggaaaatgctccaaacatggtggttataactgtcgatacgacatatattgcgggacaatatggcccatgcgtaaacagtaataagaaagaagatgaatacgtggctgcagttcattggacggctaggagacattttgaaggaaagatttcacccagctgttcactaaaattactttagagatggttgttgttataccaactaccatatttgcctcactttaattgtaaaaagcttatttgaggtaaattttcatgtagctaagagtcagagatgtggaataaaattttcctccacaatttgggttcctcgagattatgtggaatttgctttcttgtccagtacaaaggacatgtttcattgtgattttttttttcaatgttattgtgaaattgaattattgatggtcttggaactgatggtggcatggtggttggctgctccggttgcttgtgccctggggtccagttatgtaccactatcattactaaactatttttttgcctaattgattggatctcaagtaccatatttctcttttaaattcagcattgtagcactatagggagagagacattttgtaagcgatgctgcatatatggttctgcttcattctgtcgaaaatgtaagtccacgattgtggctgccgttggactgcgtggacgttgctgcagacggcatgtcgctgttcttggggtcccgtctggttagcgatttgtgtcaccacaaacatgtggggtaattgagggaaatatatatacttacgttgaaaagttacctgatatattggggtagttcatcttcttttccgttgaaagctgctacctacttcgatcgcatgctcgctctgaccgcatcaaaatccatttttctgaccattccaattcgaggaaatttgtcacggggaaattgcttgattagtcgaatacgtaaccaactacttcctccttcctaaaatgttgatacttagaataaaatttaataggtgtgtccagatttaatgtcctacgatgagtcaaatcttattttagatagcaatattttagaacggaggaagtgctaccaaaagagaaggggctatatggaggaggagaatggaagaatgtgccattgtcacctcctacctaccaattagaaatttagaattgcaagttgcaaatttgcaacaaagcacacagctcaattttccttttactttgatttttttgggaaaattggaaccatgccattataactttataaaatttgatatatgtcatcctgacccacatgtcattgactcatgtgggttctacatgtcattgagataccgatgttatatctcaaactttgcaaaattataatggcatggtcctaaattacccttgattttttcacgtcaaactgtgcattagaaacgttcagttcaacacaagaacaggaattcgtttgtactagtaatatttactgcagattaattatctggagtggaacaattacacgtataatgacgagaagaagaataagaaaaaatgaaaggcaaaattaattactcccggcaatggggggaggatgagtaggacg

SEQ ID NO: 1747 - DNA, 394 bp, Oryza sativa
  misc_feature (107)..(107): n = any nucleotide
cggcggcggcgggcgcagccttgtagcgggcagtgggaaaagggggcagagagatggccgcagtggcatgtgcgcgttggtgcggcgacagagctcgaccggctgcntcgccccaatttgccactgacaacctccttgaagaggagaaaataagaaaaaggaaagagatgtgggccccatatctttcttctcacttcacttacatgtgggacccacattgtttttagttttatttgccacatcagtgaaaccaagcatttgtactgctatgtgacttaaattgtatggttgggtgaaaattcctggtattaaagataagaaatgtcaatcaaactcggtgtaaagttgaagggacggtaggggtgaagttattccgcaggcagaatcatcgatc

SEQ ID NO: 1748 - DNA, 2000 bp, Oryza sativa
  misc_feature (124)..(124): n = any nucleotide
  misc_feature (325)..(325): n = any nucleotide
  misc_feature (330)..(330): n = any nucleotide
  misc_feature (360)..(360): n = any nucleotide
  misc_feature (367)..(367): n = any nucleotide
  misc_feature (382)..(383): n = any nucleotide
  misc_feature (393)..(393): n = any nucleotide
  misc_feature (425)..(425): n = any nucleotide
  misc_feature (443)..(443): n = any nucleotide
  misc_feature (445)..(445): n = any nucleotide
  misc_feature (681)..(681): n = any nucleotide
aacttgcatgaacgttaacatcggcaaaaaaaataataataaatgttttttgaagctctataactgcaaattaatgtgttgaaccaaaatttgattacagttacatatacttgataaaaatgtnaactacaacatcttggtattgcaaaaatttgtgttaactattcgcatgattatagttgcacaaaattataattaaagttgtacaaatttaaaaccaaaaagttgcacaacctttaaaaatggcaactataggaaacatgacggatgcaatttttgcatataggacgatgaaaaaaattgttttagttagtaaaaaatggtntactntgtataccatatttcaaagtgacacgactntatttanatatttgtacaaacnnagcttatctncatataagtaaatgtcaaaaacaaacatcttngtgttgcgaaaaaaaatntnttaactattagcatgattatagttgcacaaaaatcataattaaagttgcacgaatcactaaccaaaaagttgtacaacattaaaaaatgacgactgtaggaacaggaaggtgcaatttttgcatataaaaaaagtaacaaaactggatggatatgacattattcaaccacccacatgtccaagctcagcagcaaatcaaaatcttagcagaaggaaatgtactcttcttgccctgnagcaaggtcctcccccccccccgcggtagaatccaacgctccctgaaaacaaaaatcgtagtgagctactacatctgagcatacaatcagtctgaagttgtgcttgtttataaccaaaattaggaaaaaaatcatatagtagtcagctaaaaaagaattagttgcacaatttaataattgaaaattgcatatatttataacataacttgcgcgaaatgtatagtattagtttattttgctatttggactatgctgctgggatgtagatggttcaagcgggaaaaaacagtacatgagaaaaaaagaggcacacttgctgtcgtgtgttgatgagaaaaaaaaagatacaacataaaaagtagtatgggttgcaaaaagcaaaaacacatgaaaagttggacaaaattactaagaaaacaagttgtctaccaaaaaaagtccccagttgtatgcatgttttcccaaacacaaacgctatttatcaaagtaaacggaaaatttggctcaaaaaacattagttgcacaaacttattacacgacttgcacggaaaatcaaaatggctactacaatagtcagggagtgcaactagcatagatacataattttcagaaaaagaaacaatgaaaattttaaggccatgtgctgatcgaaagcataggttttagttaaggccatatttaaagcagcaaataagtgaatcattgatacaacataattgtacatagtgtatgaagagatatgctttatactgtcaatttatacagtactatagcaagttatactgtccatttattctctatattttagtttcagattaatcctactgttaacgaccaaatttggtaatatcagcatcggaaaaggagattagatcaaggtggagtcgaaggcggagattgatctgaaacagagcaagaatcggctgaagtccggatcggctacgattaggatcggctgggtctgagtcagactaggtgagccgatgtagccgattctgacagtataatttggtgtatgacattgggttgaattgaggtacttcaagatgattgccgcacatggatagagtcctgagaaggcaattgtatctattaattaggatgttttatgtaacttccttagatatatgtttgggcaaaagtctgccgcaaagtcggctagcccaagcactgttaaagaaaagatccagaagttggggttgactgacgtcaatgaaggaaacgtcgtgcccatcgatccagagaaattcacacctgaacagaagaaggattttgaagcaatgttgtagcatgcccgggatcagttcttgaactcattc

SEQ ID NO: 1749 - DNA, 2000 bp, Oryza sativa
caccttgttggttgccatggcatcctatgcatctatcctttggtctctttcttgtgtgtgcttgcagctgtactgtatactgcccaaaaggcattattatgtgagtggtcaaaaggctaaaaaaaagtctcaaagagaggaggccaggggaacatggcattgcttgagtatcaagatatggaattgtgccactcactcaggccggggatcaaccctcatgagtgttgcttcagttttaagatggaaggaggaaaaaggtgatagtgttagctagtagtaccctgctattataccttgctgaaagtacacatcacaggtagctagctgcattggcacaactggtaaaatatttggagtatgtttaagagaaaaaaatatgaactaattgtacttttaattacttttttttatcttattataatgtgttttgtttgagctttgtactactagtataaatggtgtgcattttgcttttggttctactgagatctgattgcttcgcttcacttcactttccacccaatctgtcctgggagaggctcaaaagtactacagtgctgcaagccctgcaacacacagcgatgcagcttgtgtgtgcttcaagttttttttatgtgcatgtgggtcccagtgatcaatgactaactgcaggagccaactctgtcagtctcacacacagatcagctgatgtttgttgtatgctccccttctagatctgccatacttcgatcatccatccatatgcaggcaactcactcctgctgtgatagtggatctcctctactcatgtcacttcactacaacccccatttgcatctctgttgccacttggcaagaatggatcaacaaatataaaacagattaatatgcagatcaaataaaaatttaaatgaaatttcatatagtattacacttatttatttattttgcaaaaaaaagatatacaaacaaaaataaatggaagacatctttggacccacgattcccgtctgaatttcaacgacatgttcgaatactaacaacatttcttacattttttaaaaaaacgaagatcagatatttgctttaagatccgtgcaatgcaatcctctgtaaaactctctccctcaaacatacttccatccaattaaaagggaaatgccatgggattccatgcatcaaaatgagccgtgctgcatgtacaaggatcttgtagcatatcacagggttttttgctttgtggatacgtacaagtagtgatgcataaacatgcaaagataccttggccaaatagtggctatctaccatggaagggaagctggttggaaggtagagggtactacaaggatggatggatggtagtagttgggttaaagtggccacattttggatctacacaagctgtcttaacccaacaacaattttttaattaacttattgagggagaatcatatgggaggaggtggttaatgcttgcattggatgcaaaaggcagcagtagtatagtagtagtaagcttaaagtgaaagatggcactagtctcagtctcagatccaaatcctgcttacatcaccctttaaaaaaaacacacagaaagaattggttagttaatcatcttatctttatctgcaatgtacatgtctgcaatgatgcaaccagagatggtgaaaacacattggtaatcagaagatgtgttgtactttggttgatcgaaattgtttagatctattactactactagtacatgccaatgaccactgaacacagcctgattaatcagcgcagctagcagacagtttaaatgatctgatctctgaacagatttgatcagcttacggtaaacaagtggaggataatggtgtgtggctgcgtctgtcagagagaatgttgtagtacatcaagctaggcttgcaggggtagtagaaatctccccccttaattaggagtatatttactgcttcaccaggtagtacatactactgctgctcttaattaccccgcacgctgggtgcagagctaag

SEQ ID NO: 1750 - DNA, 1035 bp, Oryza sativa
  misc_feature (4)..(4): n = any nucleotide
gaanccttatctgaaggaatctggccgaagttcgggtgtcgtctgcgtggaagcttgaagaggatgtcgccgccacgttgccggtgagccctccccctcacactcaggtagatgtggactatgatggatgagccgttcgattcttcatccaacaccatttagcattggggtgaaatttagggaagtttaaattgagtgctgaattgtggaggggttaccataagtgtatcaaaatccctgcccccccctccgggaatcccaatccttgaagaggtcgattgttgttttggatatcgtggcggcataaaatttgatgatgggtaaataagtagggccggcgctgggcagggcaggcagtgttgccgccctgagccctaggcatcagggggccctacggccatgtacagctacgtgcatacacagttcactttgtgctactgccttagttaatctcttttaaaaccagataaaactttgacgtttctattatattatgttctaaaaatttcaattaggagagtaattactaattagtgtcttagtatatatgtagcaccatcttcctggttgattcattcatctcatgacactgcactaattttctgcatatggcttgatttttaatttttttagccataatagatgaagtttggttttcataaattcctatttaaaacaatagtttattgttaatgatgcgttaaagctaaacatttcttcctattcgaagtaaaaacttattgcccatagatattacacacgcggggtggaatttaaacaagaatttagtgaggctatgaatattccgttgatctcggtcactttgagcgtacgtgaacttatgggatacgtgtgtagtaatatgtgcctatgtgtcttccacataataaaaagaaaattattttttcccttgtacatctatataaacacactaatattgtagggcctctatattttttctcgccctgggcctccaaagttttaggaccggcctgtaaataagctattactttccgaaaagaaatctaactcgcg

SEQ ID NO: 1751 - DNA, 2000 bp, Oryza sativa
tacacttaaaatagaacgaaggtagtagcaaacagccaaacaattagtaaccagagtgagttagacaaaggaataaagtagctagcctagttctttgtttatacaggaggacagtactccatgtacgaggaccgctgccgcgggcggcccggggcccggaccctccccgtccccttgccctcttcctgttgcgcgacgggcgcagtgacgagcgaccgggggccggaactccttttaaatctttcatatcaaaattaaaattttggttgaaattgaaacgatgtgataaaaaagtttaaagtttgtaaatgtagaaaaattttaatgtgattgaaaagtttaaaaatttaaagaaaaattttggaactaaactgggccgtagtgtgattgatctggagcgcacgcagatgcagatgcagatgcagccacgtgaacgtgacgacgccaattccacgcgcgaggtggacgccagccgaaccggaaaggtagccgttgttagcgaaagctaagcgacgaggcgagtagtcgtatatggtttctgcgcgcgcccgccgcatgtgcactagtgagcctttgctcccttggcaccaatcgtggcgtgggtgaccctactaccgtgccgcgtcgtctctccttgtgggcgcgcgcgcggggggctccacggccgatataacgaccttgtggaggacgcgcgcacgtacggtcgactatctgcctggctgtgtggatcgtagcttccacgcctgcgacagatctcgcctaacgtctaggagtactactagtcctgctcgctcacagatgctgcgattggagtatgtccaagtgtaggatcctgtcactctcggggctgaactcagccagcgctagatactgaagattaggcaggcaaccttggacttcatttttaatatgatactcgtatatactccaacttgtgtgtagtagctacctttcccatgcattaattcacatctagtagtagaagcctcactttaccttccgcgcgccaatcaagcagcaaattcctttcttttttcccttcatgatcttgtgcagataatctgccgataccatgtcattttcctaccatatagcattggcattacttccaaccctccaggccaaggatatccgaaattccaaaccaacttccaataagcgttcgcttgctggccaacccctacgtttgctgggtaacattttcccatcggaaccatattcattgttaattcgggtggaggttaattggaaccattgcaaatttagaattatcgtatgttcgcctagtaagcatgccgccaccaacattgttgataatgcaagccacgttgttttctttttttccccttatattatcttagaacaacccaacaaaaggatctaacatttcactatactatttaaaagcttatctcactactactctattcgtttcatattataaattatttgatttttttcttaatcaaagtttttttaaagtttgatcaagtttgtagaaatataatccctccggtttcattttaattgacgctttggacaatgacacgctctacaagatatacctttgaccttatttttctattataatatatacaataaataaatgcatgtttacttttattatagtgttttgaaagacaaatctatatacatttttctagtttctttaaactaaatatttttaaagttattgatggtcaaagttataaagtttaacctcaaccttatccaaaacgtcaattaatatagaaccagagggagtatgctaatatcttctattatatactaaaagtccatgaaacaccctataaacgctctcataacgctatgtggcattcctataaacgctcctaaattaccacgtggcgttctaatagattagaaatatctagccattgatttttatttaatttggtggggtccattaatttagaccattagatttgatttagattaaaaacagaatttaatctctccctctcctctccgtcacgtgt

SEQ ID NO: 1752 - DNA, 2000 bp, Oryza sativa
ccctctcgcacgcgcctcgccgccgccgcatcgcatcccctcgtcgtcgcagccgctacctcctccgcttagtcgcctcccccccaccccggcacccccacctctcctctccgcctcgctgttgcctcttccatgatgtccctagtgagagcacggcgagggcatctcctcagacctcacacatgccggcgagccgccatctgctcctcgtcgttgctggatggggaggaagaactcggtgacctcctcggcgcccacgccgtcgccgaacgccgatgaggtccagcaggagatggccgtgggccgctcggcgtcggccaggatccgcgaccgggcgtctcgttcgctgctggggcaggagccatacatgacaatgtaacttattcttctcatgattttgctgggtgaatagcaaatgattttgcttttttgctccagtaaatgggaaaattgctctggttactgagcaattagggagttgatctggttgattttgttttggtggaacatagaagaagctgtcggtggaagagaagtgcttttcactgcatagtagctgatttatgctagatttatgagcgcgcagctgttcttgagttttggccctcttgttcagctattcattcagaagctgtcaccgaagaaagttgttgagcttagactcactgatttataagcacattgctctgggaaaatttataagcacatagcgcctcctctgctcctcacattgctctggtaaaatttataaacataaaatttataagcttcctgtttagcaagcagactcatcggtgtgtcacattcagaagataccagcacattccaactggaacctagatctgttggcctattgcatcatgtacaggcaagtctgaaaactaaataagggtaaaaccgtcttttctcctctagttaacaccatcaagtgtaaaaactaatggaagtgctacataggggaagggaaattttgagggtgcatagatagagaacttttgaagtttgggtggtagagatagaagaacaactttttttttatactacatagggaattttctctacaatatatcagtttgcgaggggtacggcgacggagatagtggcaggcctgctcattggaggacagcacctcaccgtcgtcagagctcatcgttgctgcccagctcctcctactctctaggtcagcccaaacggatgattatcggctctgggttctctattcggaggcaaatgctggccaacattcaaagattcatctgctcggtaggcatttattttccatgtaaataaatcttcaaactctcttcatcgttgattgttaattgctttactgctttgaatgacacaaccagatttggagtacgaaaccacctcgccatcacaggcatactgcctgccatgtggacttcgattataaatctacctcgccatcgcgcccatactgttcggtgtggtgtcgatgctcctgttgagaagtagcgcaattggttggttgcttacttaggcttaatattgggttaatgtagatatgaccctatggccttttattgtctttattttaaaatatatatatatattctgaaatacaggaagtatattttgtcccaaactaaatacatcacagtaacagcatggttgccttttttcttagattattttttcttcaactcaacattagggaactacctgttggtattaaaattttacactaataattaaataagtcaacttataaagcgattcatataaggatgtaatctaactcaatttatttaaagattgttttgtgttgctcaaacctacaattatgatgcattaataattttgtacaagatcatcggcttcatgatatacacttatgtaagacttgtacatatcaatgtagtttttaagacatttatgaactgtgttttgaaacaatcatgttttcaaattatcaccttgcaataaataactattgctacctagcaaggtgagaatgtatagccacctcctcaagg

SEQ ID NO: 1753 - DNA, 2000 bp, Oryza sativa
acaatttataaataactaaaatttgtgataaaaataaaaactatagaaagaaaagaccatctaaaacacatgacgagataaattaagtaccaggcctataaaggagtagagtggtggcggttgatacgacatataaaaattgttaataaaacaccaaatagaatactaattgacaccaagtaaggcggttgccaggacttctaaaagtaaaagaaataaactccattgataatcatttcgatttttaaaatctcaatgacaataaaaaggagaagcagcgtgcaaggtgtataagagtatagttgcagaggcaccgacggttgacgagacttctagaaaataaaaaatgaattctaacgatagttatgtgtaggatcaaatcacaagaactaagccaaccagatggggggtgaatggttggtataccccaaaaaccgaaaacttttagcggaaataaaagttaccctcgaaatcgatggatcgcggtctaaccaaagtagttgcgccggtctgatcgcctaatgaacatcggtctgaccgatgtagatcgatcggtcgaaccgccgagaaagcctgccgccgactcctgtcaccgccggtctgaccgccgtgtacccgccggtctgaccgtcggtgcgccgccggttagaccgccgaaacccggtgaaacacaaatcgaagaactcttaaagtggatgacgactttatttattctctctgtgtttacaaagtgcaccaacagcactccttacaaaaatttcgactaaactcgaaaccctaactcaaaacttcaactcaattgctctctaaagcgataccgggaagcctcacgctccccctctatttatacatgaggtaggcagcctaaagccacgaaccaaacttatactaggagtcctaaacaccttaggaaaccctctagtacaagaaagaaactttacataaccagtcgtaccaaatttggactccttccaaattcgactccgcatcccatacgcacacaataactccatcgtatgccatatggaatctccatcaaccacgtgcatcaactctagcctaagtatcccgcatgatctctaaccaccacggacgtcgtcttatccccaagccgactcccggtccatcaccgcaaatactctcccgagacatcgagtcacctacacatggaacaaacaaagaaaccatattccgagaccaagctatctccaactagactcattagcaacaaacaatagtattacatacgtatagtatccatctagaagtcataatcatggaataaactcggatatccaaataaacaacccgaaaccgaaaccgacacagtgtccgccggttagaccgcgggctgcgccggtctgaccgcgcattacaccccggtctgaccggcagcacaagcccggtctgaccggtccacataaaatcacagcagtacctgtatattcacatgtgaaatccaatcatctccaaaaccacttcgtgaataaattccaaataacaaaaccaataatctccaatgcccaattgttcatcatagaataataatcaaaaacacctttgattttacattatgttcaatttttagaatcacaatgacaataaagagtaggcggcggacgggctgtagaggggcatagtggcatcatttgataggacttctgaaaattatagaaaatgaaactaaaagagtctattttttaaaggttcgtaactttctaaaaagtaaaaaaaaaaccaattttaatcatgttcgattttaaaatctcaatgacaacaaagaagggaggcagcgggcgagccgtagagtagtgtaatggcaaagccgctgatagtttgatgggacttctagaaaataatgatggttcattttctacgtacatcccttaataatatataaataatagatagatgggatttatttaggtcctcatttggaggaagcaaatggatcggagcgcataaactcgtttcaatcatgaagtgatggtgcaaacgca

SEQ ID NO: 1754 - DNA, 2000 bp, Oryza sativa
  misc_feature (535)..(535): n = any nucleotide
  misc_feature (1076)..(1076): n = any nucleotide
  misc_feature (1097)..(1097): n = any nucleotide
  misc_feature (1955)..(1955): n = any nucleotide
tacattcgtaaatactcaaatatatcgatttgtctatcaatacatgtaacataatcaattttttgtataaatcaattcctgggattatatttaattatctaatcttataggattaattagtcacagtatttcgtattacatacaaatggacaaataagatatttcaccatccatttttaataagatgatgacatggcatgtctacatggcgttttaggtgggcctaaggttcatattggaccatatgacaaagtttaaggatctgattggatagaataaaatatcaggaccatattgaccttaaggcgaaactttagggaccaaatggggctattctccctatcttaaagcatttgcacgtaggatttgtaatttcgatgtttgaaaattttgaatttaaatttgaattgtgatgtttgaaattatgaatttatatattattgaattctatgcgttagaaatatctatgcttgaattatggtggtgtaaaactaggtatataaatagagcttattttgaaatatttagagaaaangaaagagggactgactgactgagaaataatggatgatatttatggagttggagatagtttttggatggaagtaactacacagctctggtttgtctaaaccagctaccattccatctataagaggcaccatcttcatatacttcaaatacaattttctcttaaactactcatccgatctacgatccgattacaccgttgtgttcgtaacaattaaatctttacaacaagatctcacatgattatattttgatgaaaaatcagaaattacttttatgatatgtttaaattacttttagatttcactaagttacttattagatatataaaagtaaattcagtaaaatctataagtaatttacatatattatagaagtaacttagaacaaatcgaatgtatatttagcatgtcatttgaagtaaatctgttgtagagataaaaacatgactctatctataaattaaattaatcagcacaaattatggaattaactaaaaaaataaaagtaatcacctcagagaattatgaatgtatagagatatnttaatcaaatccaaaaataanatatatatatatatgataatttgttcaatgaaaaaaggcattaattaaagttactttccttttgttataatttacttctataatatatgtaaattacttttagattttactaaatttacttttatatgtctaagaacttagtgaaatctaaaagtaagttagacatatcataaaagtaatttgggatttttcatcaaaatatagtcatgtgagatcttgttgtaaagatttaattattacgaacaacagtgtaatcggattgtaaatcggatgagtaatttaagagaaaattttatttgaagcatagatgataggaatattttccctacttgctcaatggattaatagcaaccaaaactcctaaattactagcacgtgggtgtctctcgttaagactaattggagaggtctccccaattagatttaccgtttttagatctaaagaaattaatctgtacggtacagtgtcgatttctcatgtcgcttccaacatatcatttatttcccgtttcaatcaaacaatcgatgtattctgtgtaggaaacaaaaacttccgatgaatttaattaggtgaggtgtccagctcgcgatcggtccgcgaaaaggctcgtacatgcgtgcgtggtacgtgaaccccgagaataaaatcatttctccgaattaactttaaccaagcatgcttctcaactgttttttaggtggccaaaaacaatttttgtaggcggaggggatgaccgcctgcagaccaacgacggtgaaaccattttcgcaggcggggccatggctcgcctgcgaaaatccaataaaaaaccaaaaaaaatcgccttcgcacgcgctgcaccaggagccgcacggccntccccagcctcccttcggccggatctaggaggggaggggagccgc

SEQ ID NO: 1755 - DNA, 2000 bp, Oryza sativa
  misc_feature (1974)..(1974): n = any nucleotide
  misc_feature (1986)..(1986): n = any nucleotide
cataaatcatcccaataaagcacgtcatttcccgaatccaagacaggtttggcaattcctctgaataagacatcatattagaaaacatccttccaccaaaaggagccatgtcacacccagaaatttagcccaaatttccagactaaatctctgtccaggaccagccagggtacacaaaacgataagtaatatacagttccaaacgtaaataaagcgtaaaatacttacagaagaggcgcttagtccacacaccgaaacgaaagcagcagcagtggaaaaaggcgatcctagcggggcttcagctccactccacaggcaaaactcaactggggtctgagccttggtcctctaacttcgtcttcagctcagaagcactacacttctgaaaagggggaataatagcaaggctgagtacaaccaccgtactcagcaagccacaccaatgatgcagaccgtgcatgggaatacaaggacggtttgtggctatttgcataaaggcggttgtaaaacattttattgagcaaacagtaaaacaatagagtaattaaggtaatattaaatctccactgatcaacgctataccacattgaacaggcccaactaacccacctgaactacggtgcattgagttgatttattaaggtgggactaatcacggtgaatctagtcgaccgcccataaccgcgggcacggctattcgaatagttttactctgattagaggtgtacaactgtacccacaagacacagccccacgacacatttccgtgtgccgacatgccaccacaacataccggaaagaggccgtgacatgacccttcgcataaccccctctaaccgatcgcaccacacctcagggttcgcccccgtccccagcaggcaacgggcagcccctctctcgtgccacggtgaatctaaaagccgatcaaccgaacaccccggccgacccaactccataacgcccacccttacctgggtacatcagctagaggaaagctacactacaagcccagccgttgcccacgctggtttgtggtaagtacaataagttcttctagggcatcccgcgaaccagtccttaattgccatgggtgtgactagcaaaaccatgcacccacagcccaccatttagtcgcattttagttggataattatgaccatgaagcatggccagatgtctcgagcacgcagctcattctaatactaaaaaggtctaatactgtaattatcccatcaactgagctagtggtaattaagcatagctaagcatatagttctagctaggtcacataagtaacatgagctagtcgatttattacccaatgttgacaaaggacagacatcaagtaaacatggcacaagcgagcagataggtgaaaccctgatcccatgtaattagcaaaacatgcatatttatttgcaaacagtaaaacatttgtaaagtaggctcaatatgctcaaggggaatatgtgacttgccttgcttcttcacaacaaccttctgaactcttatccttgcgaccgcggacttccgaaacgacggattctacacgctggcacgcaaaacgaggaaaaactctaataaaaaccaagcaaacagtacataaaaagtaaacaaacatgtagatctcaattttagatgaattttgcaagttgaatggctcaattcggagttcgaatgaattagatatgaattttagaagttttgagccattttaatagatttctagaattattattgatttattgcgcaattattgattgtttttccaaagaaaaaaagacatgctgacgtcatcaaagagggggccggcaccgacaggtgggccccaggcatcagcggctcaagggggcggcccacggtggacacggtccaccgcggcctcaggcgcgccgtggaccaggaccacgccggtccacgggcggccacagtgcagggcgggcgcagccgagaccggccggccaagcggcggcnaacggcggcganagcggcctagccgg

SEQ ID NO: 1756 - DNA, 2000 bp, Oryza sativa
  misc_feature (654)..(654): n = any nucleotide
  misc_feature (663)..(663): n = any nucleotide
  misc_feature (877)..(877): n = any nucleotide
  misc_feature (1978)..(1978): n = any nucleotide
taaaaattggcagtgatggcaactaacgagcatgccgtgattctcgtcctgtagtagttgagtttgtatgcaatatgcaatatgagagtatcatactactgtcatgcccagaaatttagcccaaatttctagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatactagcggggcttcagctccactccacaggcaaaactcaactggggtctgagccttggtcttccaacttcgtcttcagctcagaagcactacacttctgaaaagggggaataatagcaaggttgagtacaaccaccgtactcagcaggccacaccaacgatgcagacgtgcaaggggattcaagaatggcttgtggctatttgcataaaggcggttgtaaaacattttgttgagcaaaacagtaaaactgttgaataattaaggtaaattagatctccactgatcaacgctataccacgttgaacaggcccaaccaacccacctatactacagtgcattgggtcgatttattaagtgtgagactnatcacggtnaatctggtcgatcgcccataaccgcgggcacggctattcgaatagttttactctggccagaggtgcacaactgtacccacaagacacaacccaccgatatgtcaccgcgtcatcatgtgcccatgatgcacacgtcaccatgtcaagtgattgtgacgagacccttcgcataaccctcccctaaccatccacaccacgctaaggtttcaccccnacccctcaaaaggcagtgggcggtcccctcttgcgccgcggtgaatccggcagctggacaaccggacaccccggccgacccaactccatcacgcccaccctcgccaccggtgcctaggaaagggtcgagctatacttctgttcaagaagttacccactcccgcttgtggcaagcgttgtaagtcttccagggtttcccgtgaaccggtccttaattgccatgggtgcgactcacaaaaccatgcacccacagcccaccattcagtcgcattttagttggataattacgaccatgaaacatggccagatgtctcgagcacgcagctcaataagatactagaaaggtctaatactgcaattatcccatcgactgagctagtggtaattaagcatggctaagcatatagttctagctaggtcatcaaagtaacacaagctaggcgatttattacccacggttgacaaaggacagatatcaagtaaacatggcgcaagcgagcagataggtaaaccctgatcccatgtaattagcaaaacatgcatatttatttgcaaatggtaaaacatttataaattgggaacaacatgctcaagggaaatgtgtgacttgccttgcttctccacttggattttctgaactcttttcctcgcgaccgcgatcgtccgaaatgacggattctacatgctggcacgcaaaacgaggaaaaaccctaataaaaccaaggaaacaatacataaaaagtaaacaaacatgtagaactcaattttagatgaattttgcaatttgaatggcccaattcggagttcgaatgaattagatatgaattttagaagttttgaaccatttaaatggatttctataattattaatgatttattgcgcaattattaaatattttcacaaaggaaaaggactgccgctgacgtcagcaagagagggggccggcgccgacaggcgggccccacctgtcagcggcacaagggcgtcgatccaccgtggacagggaccaccgaggcggtccaccgccggtccatgggaaccaacggcccggatcgctcaagccgatcgacgccacgagcgcgcggctggggcatgggcacngcatgaaaccggctcggccgag

SEQ ID NO: 1757 - DNA, 2000 bp, Oryza sativa
ctgagttcttggcccattcatgcataagtctgattctcgacatcgtctgattgatttatcgtttgagttgatgtcaattctcctccactttatggttattctctgcaaaaggttagtgaaccaaacactagtggaatattattactctaacatgtatatgcattgcaagcatcactagttctcctttattttggtaatattgacggtcgaaactgatcaataacgaccgtcaacaatgggccgattgatgagttccacaaatcccttcatgaacttctcccatagcaactttagattgatcattatctaatcactttaatagcacctcatctatacttcggcgattcaactcccatcaagcaaaatacatttgaatgctcgccgccgaattttctgatcaaccctaagactaggatctttcaaatattctatcaaagggattctccagttttcttctaactcttgggcacaaatatccgaatttacaactaattcggcctctaaatcaattgtctcatgccccccagcttcatgtctgggatcggtaatgccggtcaaaccgccggtcatccgcagttagaccggttataatgcgtcggtcagaccgcccccaatatggaacttcgccaatttatcccaaagatttaaaatcaaacaccggcttttctaatataaaaaatactcctttcttcacattttagccagatgcttggtgtatcaaataactggacaaaaattccttctttctggatatatgaaaaattataacacccaactaatatgtctagatgaataccaattcaagtggcttttgaaacaataatcaaggtatcaaaacacttagccacttgaagtatgatcaataatgaatcaccaaagtcataagcctcacacacatgaattccaataaactacaaatgtaagtaatcggcttgagcatgtatgcaaaatattaacaatgccaatgatcctaaagaagacaactctagaacaaatcatcacattggccattgacattagccaaattactaataagcaaaactttcttggtgcaataattatgaaatctatatcttatatggtgatccataaaaacacacatgatttggcttttaataaatatcaaagactcactagccaaatcatacttcaaataatttatatgccaacttgacaattccaccacttagaactggcatttgcaacatgcatgtataatatcaatttaatgagcaaacacatgtgctagatagcaagcaatgttctaacatgtcataggcatataatataaagatgaacaccataaacccatgccttgccttagcatccaacaaacggtggctcaaagatgtgacgttgtatccttcgccattcatctctcttgatttccccataagcatattgatgtcttgcccccccaagcaaaatcgtctttcttgacttcacgatttcgaaggcaagacgaataccgcaccaacatccatagcatcatgtgaaggagacttttctctaatgaccgatgatttttctttcatcaaattggatttatcactactataggaaatcaccggtctttggacttttacctccttaggtctccacacttgcttatgtactgttcgaggctctaaatctttacatgtttggtcccttatgttttcggcctccttttctttttgacctatggcccgaaaacgttgtagcctcctcttttgagagcgagataagctggaaggtatccacttcggctgctgttgttttccaggaactaagcaatgattcttgatatttttgtttgaagtggaagttactgtgtcgctctcaattttcctactcatctctaatgcccccaggtcagatcggcctctaggcccagtcagaccggctacaagccgtcggttagacctgccaggagagtcggtcagaccggccatagactggcggttagaccggccaggagagtcggtcggaccggcagtaagccaccggtcagaccggcc

SEQ ID NO: 1758 - DNA, 2000 bp, Oryza sativa
gtatctgctcttcaagtccaatagggaatctttcgctcagtttgttttctgagtgcaaatgttgcaataactacaccaaatgaattgcaattagtatagaaagatagtacccttaaatatgaattgatttagcatgtgtcccaagaggaacaatcccttctcagaggatgccctaaaaagtggtacagagtaaaataattacttgcctgacaatcaacacgatactcgattgtgttcatcatctggagctctgaaagaattgctcttctctctttctcaacacgagaagaagaaaattttggatgaaaagctatctgggagaacaaaaatttggcagaaagagaatttgttaaacaggctacccaaatgcatgtaaaacttttatcgccaaatgaaagataattgttatttgaaaggcccttaaccaaaaagaaataaaatggtagcaaaagctgcgcatatagcctatacgtaacatcccacctcattcaatgcatccaacacagaagggagcaagtcttcaccatattcctgccacataaaagacaagctaatatgttaaacccttaaataaacaagagaagacatcaaatttggaccaccagattgaaatacctacatatgttaagcgttgaagacatgttatgcacataatatggcagtcaacagtttcccagttgattttcatatatattcttgtcaaagaaaatattcaaagcaatagaaaacagagatagacttaaagaaacaaccgatgactgcaaaagtacatacctttgttttagttggagaatgtatatggaacacggtatggtggaaatctgtatatgcattagaccttgcacctgtccccaaaagtttttcacgctttttactgccaagaaatgcaacatgctcaatcatatgtgcaattccctgctcatcttcttcctcatcaattgatccaacatgaacttccatgtgagcctcaaacctgcaaaaaagattagttagaatcttgcatcagcattgcacctaatcaccggttgacaagcatattagaacattgtgtatatgctctacatttagcacaagtttgtagtgtaatttactggcatgaactaggccccaagccaccgtataatatttgtcaatatatcaatatactgaaacaattttgatgtccaggaatcaacactaaagtatattgaatgtttaaagggtccaaaatccaaatagttatgttgcaacgaaattaacataacaacttgtcaaaagtcaaaactgtaggcccccacactgctaggaaatacaactcacggcatcccaaatcatgtaaatacttttgttatagcagctgaaggttatgttggtactgctgcaaaagaagggtttataggtggaaatgaaacaagtttcttcacctgtttgctggaactttgtttggtagaataagatatcggaggccattcttcaattgtcctcggactagctttggatgagaaggaagcggtgtgttaagaaaaccttcaagttcctccttcccaattggctgatctacataatgtttatccagagcagtttcagaccaagttggacttgcaacatgtggttcatcaggtccagcagcatgtaatacatggcgacgcctgatctgaaaatcatcaaacatcgtggtcagaattcatgaattttattccattgaaccactttaatcaagaaggggaactatgggatcatgttatactctgtagtgccatataacctttattaatttattatttcctgttttataacataattgaagctggattctttgaataaatacaagtaaatgcatcaaaacaaacatatgaaaagacgtgttcctaattctcgagtgtgttcactgttcacatgccgttgagaaccagccctgaagaatggtgctttaagcgatgatttgcagtacagtacttctttctagcttcaactttgatgttaattcaacaattagcttgccatttgtgctgtaaattaaa

SEQ ID NO: 1759 - DNA, 2000 bp, Oryza sativa
  misc_feature (1965)..(1965): n = any nucleotide
  misc_feature (1968)..(1968): n = any nucleotide
gcgcgggctcaggcgcgtcaggcgctgacggcggcggcgactggccggtcggccaccacggcgcgcgcgcgggaagcaacgggtggtgcggcgttttgagcggcgtcggcgggaagcggcagcgagagcagagagggagggggaagagaaagagagagagcgagctctctctcgctcagcgcctgagcggcgcacgtgcctcgcacgtgcgggcaaggatggagggggagggagagatgggctgagagggaatgggccagggggagggggatccggcccatccaaaattagaaggaggcaaaatagacttctgccaaaggctaatttgaaggaaaaaggagtttggaaatggaatttgacttcgaaatgggaatttggatatttttggagccgggcgaatatttggcaaggttttcaagagaggatttgaattttggaatttgatttggagacttgaattggaagaggaatttcgatgagggggaacaacgggatttgaattgagatccacgacacgacttagactcagcactcaaagaacgaaaattttcgcaattaggattttgccgaattagtttttaacgtctcacgaaaagcggagcgttacaccggatttgctataaatgtgttgccatatttttttttataaaaacatagtcagcatgtatttacattgcaagtccctaaaattcatatgtagttttagtatatttataatataagttactaaattacatacgttagttcctaaattattaatacatatataattacactaattacatatgcaactacaatagatttatactataattacatttgatatatttttacttcgcaatatttttaggtagaccttttcttaatttaaaaatcgtttgacttttaaggcgtttgacttttaaatatgttgctataactcccgatatacacaccacttcctccatctcatattataagtcgtttgattttttttctaatcaaatttctttaagtttaacaaagttttaaaaaatatagtaatattttcaacccaaaacaaatatattatcaaaatatattcaatgttaggtttattaaaactaatttaatatttgagatattgttatttttttataaattttattaaactattaaagtttaactagaaaaaaaaatcagacgactttaaaaatgaaacgtaatgagtattaatgtattatacagattgtttttaggacagccaccgattaagcccgggcggtcgatacacgacggattttgccggccgtcctgcaaatcggctgccccctgcacggggcacggcttgcaccacagcaccactcatccagcttccagccgccttcgcgcaccacggcaccacgcagttgtacacagttgtacgcgtcgtcgtgcgcagaaagtggaaaaaactcaccaggaaaaagcccgaaaaccaatcctctccatccgcgccgcagcagagcacagccgcggacattcaggtccgcgaatttccccgaattcaacacccgccgccgcggagcggggcgcgtttagcctgtagcgccgcaggcagcagcagcaaaggggggtcccgcgcggcggccgaaagggaagacgaggcgcaacaaatccccccaaaaagcagagatccgagagagcgacgaagcgacgacccgcggactggaggcaggcagggcaggcaagcgggcggaggcctccaagcggagagagagcgcgaggaggagccatgtccgcgtcttcccctcctcctcctcctgcccccgccgacgcggaggcggttccgctcttctactgctacgagtgcgagtccaccgtgtcgctgcccccgcctcccccgccgccgtcccgcccgctcttctgcccgcgctgccgcggcgagttcctcgaggaggagaaccctaaccctcctccggagccggaggaggaggaggaggtgtcgtcccttccccggccccggcntcntccccccggcttcctctccgactcctcctccg

SEQ ID NO: 1760 - DNA, 2000 bp, Oryza sativa
  misc_feature (461)..(461): n = any nucleotide
  misc_feature (464)..(464): n = any nucleotide
  misc_feature (1456)..(1456): n = any nucleotide
  misc_feature (1603)..(1603): n = any nucleotide
  misc_feature (1636)..(1636): n = any nucleotide
  misc_feature (1656)..(1656): n = any nucleotide
  misc_feature (1676)..(1676): n = any nucleotide
ccaaaagtcaactcaagtacagaatattttttgaatagctaagtactactacatcacttatatttaatgaatcacttatattaatttgatggtctctaccatgattatattcctttgatcattctttaaccttgctctgattgctttgatgccttgacttcagattctaagaacctaaccaaatccagccattgactaatttaggagcaaaacagcataaactctagtgatcaaagatgactagatgaggacctcaaatgacgtataaactctagtgcctggatggttgattttcggcccgaaaccaatgtaatcttccgggtttattgagcccaactacgaaaattctactgccttctttttaaagtatatatgacgctatttttcgtataacatttaaccatttattttatgtaaaaattttaatataaatatataaaggaataagttaaaattatatnggntttaaagataaaacaaatcacaacaaaataaatgatgcttattttcttgtaagatgcatgataaaacgttatgtcaaaaaatcaacgataccgcacatttaaaatggaaggagtaatacagtattttctccgcacgagtactatctcgatcctgcctcccagtccctagcattgatccgctcaaccagtctctgttcatcgtcaatgtccttcggctagtgctctttcggcgtcgatccgcgcggccagtcaatggcgagcaagagccagcaaacaattcatcttcctcaaggaggtcaagaattccctctttcccctccgattatctccctctgttaccgttcaaacaaccttgcaagcagataggaaaacatgtgtaatggttttacaggggaaaagaaatacaaatttcccaagcaaggctcttagtattaagcagtaaccatgcgctgtcacaccatcctattacctccatcccataattaaaaggattttgtgtgtgtatctcacacatggaccctatgatttttattatttttcagattgaattgccacataagcatcacattaatgacacgtgggataaagactttcaaaggagccacttcaaccaaaaccagagaaaatattataaatctcgtttgcactgattttataagtttgaggatacgttgtatctggttatgtggtctcgggatgcatttcggactcaacaaaaaatgggggacctagtgaacttgttcttattgagtaggaataagttcatctgaggtcccttaattttacgcaaatccgattttcatccttaaaccctaaaaccagatataaccggtccctaaactatcaaaaccggtgtaaatgagatccctcggcggttttgaaggcggttttggctgacgtggcgtctacgtggctggtggctggtttgactaggtctccgtcccacatgatattgacgtggcgcttacgtggcaattatatctaaaaaaatnataaaaaccatgggcccacctgtcagctaaaaataataattttaaaatagcgtggcccacgtgggccccacatgtcattccctctcccctctcagctctccctcttcctcatcaagccatctctcgcgccgcggcaccgcctcacangccggcaggagcatgccgacgaagcggagagcngcgcggcggcggcggcgggnccggcaaagccccgcggggntcggtgcctactcccgcgccgccacatcatgttagatgctgcacagcggtgaggaggagaggcggagttcgagctcagtacagcgaggattagtgtacagatcgagctaaacagccaacaggattagtggcaggcaccaacaagcagttgctgctgctgctgctcgagacatgcatgagctcgtgttcactacagtgaggccggccatctgcaagactgcaaccatgtcagatttggcacggagacgaaaaacacacatgttagtgacccaagttgttggtcgtcgtccatgctcgccaaggccgccgccattgccgccggtgt

SEQ ID NO: 1761 - DNA, 953 bp, Oryza sativa
  misc_feature (7)..(7): n = any nucleotide
  misc_feature (714)..(714): n = any nucleotide
  misc_feature (716)..(716): n = any nucleotide
  misc_feature (857)..(857): n = any nucleotide
  misc_feature (863)..(863): n = any nucleotide
taaatcncctctaccatataaggctgtatttacaccataaatttggtaggattaatatatcattataactacgcttaacatttgttaatattttttatcactatttacatatgtttggaagcacttattttgacaaatactttcatactttggtaatggtgtcattttaaagttgtgtcggtcactttttgcatattatattttgggatttaaagagtaggtataaatgaaaatgttcctattacaaggggcaattccttctacccgactcatgtgtaactgaaaaacacaaaaatcttgtcccggaaaagctcaaagcgcgctggccaggactcctgcccaaccaatgctaacgtgtatccatcccggctcaacccctctcctgcccaactacgatgggcctccaagtcagttgcaacgtgtatccatcccggctcacgatctatcatggactctcatgcttgtcagagtcgccttaaagcccatactgaatggaccaagtattcctggaccatctcttccagcccacacagcatcccaagacgcccagaactagtagtattctggaggaatatgttcactttagatccctcaatttgtcgcccagaccgatttcatccctgcacagcaaaaccggatacaacacatcccccaacttacaaaaccatgtaaacaagattcctcggcagtattgtgcctggttttcgctaatgntncgcctacgtgtttcttcctttgatggggtctttgtccacgtggcattgatgtgacgcttacgtggcaattcaatctcggaaaaaaaaaccatggactcacatgttagctacacaccaaataattaaaaaaatggtgaggcncgtgtngccccacatgtcatcctcactccttcctctcatctttcccgtgcattgcaaggagaagggcggagtagtggtaggcgacacagaggaggg

SEQ ID NO: 1762 - DNA, 2000 bp, Oryza sativa
  misc_feature (12)..(12): n = any nucleotide
  misc_feature (1359)..(1359): n = any nucleotide
  misc_feature (1372)..(1372): n = any nucleotide
  misc_feature (1767)..(1767): n = any nucleotide
ccaagcagccgntctttccgtcacctcggtacgtgttcaatatgttgcgcatatttgatctgttcatgttatactgtgtagtttacatgtatagatctaatgatgcgttcatgctagttttcatctgtaatgtcatgatttatttatgggatagattaaatcattatatgtctataatctcaacatcaacatccctatcagctttaaataatttgttgcattgaatacacttagctgcaagcaccaatatgccatcatatatgggttcaaagtctttccaaatctccgaagtaagttttctctttatagatctacgagatggacctatatattgccataaaatgaaattgacatggaatttcctaggaaaagattagggtcatgtcataggacaaaatcaaattgacactgatgtatggggcttttaactatttgccactcttacgaatggaccttaacgatttgccactaggcccacatgtcatagacacatgagggcccacgtgtcattgacagagcgtggcaaatcgttaattgctatgtcacaagagtggcaaatagttaaatttccccaaatgtatttgcacttaccatatccctgagaaatgttgtttgctcagatggagactttggcaatgttgtcgatgtggatcttgttactcgtgctagctactgattggatgacatcaacatggaggaggctaccaggccatcggacgtctgataaaaaacgaaatatcggacgcctctcatagcccttagtagcagcgcacctagcactatatttaaagcgcaagagcatgcagccacatgtgctagcctatgtatgcagcatgtacggctactagtactgtattataatgtacacatatatttttattctttgaactcttttctcttaaaatatatatttgatctgtgatttgattacatcattggatttgttataataaaatctttataacaagatctcagatggctatatttcgatataaaaaaactactgaaacatcgtgaaatgcttattgcaacaacaggtagtaccatatgtgacatttcaaaaacccattgcaacaaaaaaaaaaactttaaagtgcaacatagtccaattctaattgaaacatttgtttctcattgagtcaaacactgaattttaacgattgaaacatatatatttttttcgtcataatataatcatgcaagatctcattgtaaagatttaataacaacaaatacaccacagtaatcggatcatgaatcgcataattagtttggaagaaaaatggttttaaagatcatgtctcaatttgcatgttcctatatacttgcatgcaagttgtgcatgcatacggctgaggnaaagtaactgggnaagagaaatcaggaaaaacaccaggaaaggtgaatcaactttagactagtatagaggaagctggcgtccgatgtttgtcttcccgtcggacgcgcgacacgaagcattttcccatcaacatccgtatcccaggggaaccgacaataggaataattggggactttagttgctttgctggtggggaattctgtccctgcaacacacgatgcttctgttgagttgccgaagatattccactaccgtcttgagcctccatgcataattcctacggagtaaaatagaaaacatcaaaatattttacaataatcctacttactttttttaacggtataagacaacaataaaatagctatccctgaaagtaactgtctcaatatccaatgaatttgcacagnttgccaaaggagctggaaactatatctagtactaagtttcatagagacttttttgtaactattaatttcagaagttcatttgcatatgaagagtatcgaaatgacaactattacataatttcagacctataatgtagcatgtgcggcggtgacgggaggtcgcactagaacgggattgtttatctgtgacgggctgaaagcatcatcactatcgggtaaggccccccatcacg

SEQ ID NO: 1763 - DNA, 2000 bp, Oryza sativa
  misc_feature (1703)..(1703): n = any nucleotide
tccatccaatccatgacagcaaccaaagcattactattctatcatcttttcgtgaccagaaaatcgatgtgttaggataaaaaagaattacaggcaatactcttgcatgagttcacctcgaaaatgtgcagttctccggacaaggatttctagctaccgttatcctctcttattacaaggttacctcactatatatgtactaaactacaaagaacaagctagtttttttggaagcaatggtgcaccaacgactagatggaatcgtcaaactatcaatcaccattcaggacagctcgaaatggctccgattagatgaatgaaaatggcagtactaaggataaaagaaatctcaccttggagctgccgcaggtgcatctcgaagcaatcttacccagcctctggttctccctctccaactcctaatcacacccaattataattcaccagtagagaaaaaaaaagagaagaaacaacttcactaaatccaccgaaacagccgcgcaagaagagaaaaaggaaaaaacgaacgctggtccgcgaacctgtacgcggagccggagcgcggcgacctccgcccgcatcaccgccgcctcaccatcgcctcccgccgccgccgccgccatggcaacgttcctatcggagccctagaaccgaactgaacccacccagaagcgcaacgtcagagggacgtcgggcgtcgctccttggtccgtccgttccgaatcgcacggcgctgctgctgctacccttcgtttcgcggccgctccaatcgagcgagcaaggccgacgacgaacaggctcgcgctcggcccatgccagtgaaatcggcccaccaacatcctcgcgctccaccatggctgccgtgcgccgccgttcgctgctcggagaaagggggaagggcggaaagaagacctttgagctgatttttttaagttctaacagcgacgagatggtcagcgaacaactaacaaaacatctatctcgagggaataacggagaatcaagtattctctcatatgcattttagtagtgaagtcatgttctacagaataacccaagtttagtacaagtatgatagagttgggcaaaaaaaaaaaaggggcatattttgtgtgtatggttaattttgttttgtctagatcctggtgaaacacttttgttttggggaaatctgtcgaagttatgttcttggagtccgtttggtaaggctctaagttttaaatttaactatagtaattagatttgtactggatttatagagctatctaaacctagttttgcttctttagtttattttgtgagagtatcactccgtgccatttttaagtggagctaaaactatttgactgggatctagcttcaagagaggtagagttggagctgaagcactacgaaacatcttgacacgatagtactcaatgatgtatatatctagctttcttttgctattttagaagaaaattttttaagacaaatactaaggcaccagatgtccaatgtagcaagaatcacattctaatgttcactgttcactattgtcgaagagtgaatctcctctagcagggaagtaagaactccccccccccctcccctttgaaattcggctaaggggcgagttgagatcaagcttcgttcgtacgatgaacaccaaacacaaccaagtatacagatttaggtcgctcgggagcgtaatacccctatgnactctggtgttttagactatgtgggatgggcctgttcggctgcactcatgttggctgcatcgcagcagaaacagtgcttcgtgtaagcaagtaagcaactgcggcagcatcactgtgttgtagcggctgcaccttgcagccgaacaagcccgatgtatgtgttacagagttcttacaacgagagaaactagagttctgctccagatcatttctttcaaatgtctaatcctaagtcatcagactcctccttttatatcttaaggagagataacaattatattcttgcatggacgagga

SEQ ID NO: 1764 - DNA, 2000 bp, Oryza sativa
  misc_feature (1412)..(1412): n = any nucleotide
acttctcgagttcttcagcagttacagcaagtcggatggcagtaagaacaacatccttgagtctacgttcctttgattcatcctaattcttggttctgaaacttcttttttgtcagttttggctttcctcaaatatgcagcagctaactggatatgctcgcacagagaggagtatgaaccgaacatagctgggcttggaggtggctacaccctggaagctgttagtgccaatatcacttcccttgctcgtttctgaacttgcaacaattccttaacacttgatactcatttcactgtacctgtttgcttgcaagcagtggtgcgaaatctatcttcttcagcctcgtgagcaaactgaccatattcagatgacggccgtggcagccgcgcttggggtgcctctccgagtggagaacctgcataatggaccagctcaagatatctacactgccgatggcgttaacattcctcgcgtcaccttgctgtacacaggcgtccactatgatatcctttacccacgccatccttctggtgggagtgggagtaagagctcgacacaacgggctggttgctttcgtcccttctggtagggagagagctgagtttgattgctgcagatgagtatgaacattgccgaaataggtggcagacaaattttgactttttggtgacaaggagaagagaaatgtgatgatcttgattcttttgcaacttaactgtgattaagttctcttaagtgtctttgcagcagaatattttttcatgtagataaaagaaaattatattggaatcctgattggtttggttgtgctgaccaacttatgcacacccttgttgtccatatattgaatatttgcctggacaagctttctggaactgatggtttccctggactagtttggtggggagaatgaggatgaatgagatggtgtggtacaaggtgggtgaaatggtttaggatggaatgctaatcattgactgcttggttgcagttataaaacaaacaaaaaaaatggtctaattgcattagttgtatgggatgatataggatggtacaacaaattgtcctttgatagaagtaaatctatatataggtggtgtatgcatacgcctgactcgtgtttacaatgtaccagtcctaagtaaatacctcttttaataaataacattgttaactttttggtaatgttctataattcgtcttatttttaaaaattaatataaatatgctagaatgtaagtcatatttaaaatttctttgattgtacaatatatcacaacaaaataaataatatatgcaatttttttgaataggatgatgatcaatagtcggcatcatgtataaaagaacagagtgagtgtaaaaggaaaaaaaaaatctatggattaaaattaaatttgtaaacaatccncatttgaaagcaagaccttgtggacccgtggtcatttaattggtaaaatcttgtgcaaactattacatatacattactccctccattacacaatataaatcattctagcatttcccacattcatattaatgttaatgaatcttagacatcaatatgaatatgtaaaatactagaatgacttacattgtgaaatgagggaagtattaaccaagtactccctccgtattttaatgtatgacgccgttgattttttaactgacgtttgaccactcgtcttatttaaaattcttatgcaaatataaaaatacttatgtcatgcttaaagaacatttgatgataaatcaagtcacaataaaataaattataattacataaattttttgaataaaataaaaggtcaaatgtttattaaaaaattattaaaacattaaaattaaaatacagagggagtagtattcttaataaaatgatgcaaatgtcactaaacatttatttagtttgagaggaacattatcttctttctttgactgctcccttcttctacctcctctactgtatccagtgctgctgaaggcgaggcgagcacac

SEQ ID NO: 1765 - DNA, 2000 bp, Oryza sativa
  misc_feature (1762)..(1762): n = any nucleotide
tagcttttttcctaacaaaactttttaagatttggttaagtttatagaaaaaattagcaatatctactatataaaattaacttcattaaatgtaacattggatatattttgagagtatgtttcttttgtttgaaaatgctactgtatttttttataaatttaatcttttgtttgaaaatgctactgtatttttttataaatttaattaaatttaaataagtttgattggaaaaagttaaaaccacttgtaatatgaaacggaggtagtacaactgaaagagtagaagagtacacgttttaatttcaacaaaagctataacttgagcaccaccgtggcagaaatctatatgtgctcatggaggatagctgtatctcctggcactcaagctcaagtcgatcaccgtcgggcttccaccattgcttcagaccgtgcccgtcaccgtcaatgctcgagttcttccacaacctcgccgatggcaggagatgctgcagcgctccttctcgtcgtcgccgatcaaggagaagaacatgccaaagtacgacagcatctcattgtcgtcatctgcacctttctcgaagtagtcgatgtagcttttgcagatgatgtccccctcgtgcacgtacagctctggcgccccgccgcccacgacgtcttgaacagtttctccatctgctccgtatgagggcatgcttagttcgcaaaaagaacatttttaggtgtcatatcggatgtttgatcggatgtcagaagggattttcggacacgaatgaaaagatttcataactcgcttggaaaccgcgagacgaatcttttgagcctaattaatccgtcagtagcacatgtgggttactgtagcacttatggctaatcacgccggctcgccttcgccaccgccgattggtgattttgtctccacggctggtggattctgccaccattaccgggtgtcttcgtcttcaccgccgaccgcctttgcagccgccgactggtgctttcgcctccacggctagtggactccgccgccgttgtcaggcgtcttctttttcaccaccggccacttttgccgccgccggctggtggttttgcctatatagatggtggactccgtcatcgttgatggacatttttatcttcacagccggccgcctcagttgcgtccatggttgatgtttttgttgctattgatggacgaccttctccccacatcggctacctctgccgtcattgatgggaatattacaaagctaaatcattattaattttcttctttatatgatatttttattttactctgcctcactacatcaattggttctccattgagtagtgagtcgtgggttatatcatattttttcaacaattttcatagtatttatcttgattgcttgcgaaataatccaagtaaaaaaagtatcgatcgagttatggagctcaatttccctattcttttcgtttagtttgtcgatggatagttgcctttgggccgattcaaaccacgtggggacttgttggatggagtgtataatgcaaggttttaagtattactcgcaagaaatcaaaagcagagagataattgtgaagacgatgaagtctatcaacgacgatgtaatagaccagctgtgtagacgaggacaccaagagattaatctcgtgaccttctagaaactgaacgagattgaagtgatctttgagcgtagtcctgtaggagaacacattcgttgacagccttgatcaacttcatcttgccgttggcctgcaggntgtgcaggagcagctacggggcgggtcgatgcctgcagcgacgcagagctccgggtgcgtttgcagcaacatctcggcttttcggcacaatatatacatgcaaacaaatataatcgtgattgggttagcatataaaataatgcatggatgtgttgttgattatgggaacaggtaagcaagttaatttgtttgctccctccatgtcttgcatgctcccctgtacacacattggtcgacc

SEQ ID NO: 1766 - DNA, 1574 bp, Oryza sativa
  misc_feature (9)..(9): n = any nucleotide
  misc_feature (1283)..(1283): n = any nucleotide
gagcaaggnaatcttgtttttaatcatttccttttcctccaaaaattattaaataatactgcgagtgtccagcagccaattacttgttttttcgatgccctacagcaaatacacgtttttacggtgtcctccagctaattacacgttttttggatgtcatatagcaaattttgcctaaaaaaaatttttagctatagtttgtctattttcaccatatatatactctgttagttcaaaattagacacccgtatcaagctaaatttaattcaaatcagagtaaagcaagcaagtggaaccctctttattttgtgctagctccgcccctgctcaaactcatgtgcgtccataggccctaggtgacattcatccttcacaatcatattgtgttttataatacatctcgtcattatattgataatgcccgattgctcccataagtgagtaagagtagtgaccacctcgaaacaggctattaatataccaaatgcacattcaacatcttttctcgttgattcttgatgaagaggaaacattttttccttctccaattgacgatgccagatcgactgaacaagagttgcccattctagatagattccattggcgtatagtatcccaaattatattaatttccactgtgtagcgcatccttatcgatatacccatgagttaataagtgaatgtatgggattggttcaaaacactgatctcatcatttgatcctgctacaccggaacaaacaatgccaaatccaccggtcacaggatgccactgcctccacgatgattgttgctgcaccatagtctccatgtgtgtacattgctttctaactgtttgagcacttcttccacttcttctatgatatgttgaacatcatcaacggtgggtttcctcatatattccagtctgaatattgcaatgatgccttgatgcatgtgtgcggttgctctttttttttttagataatggaatatacacggatgcccttgtgttcttgttgttgatttgtattgtggatgcggaataggagggcatcgatgtgctgggctgtgaattttagagagccgcttgaagcatcgacttgattcaagccatcctctatgtttttatttattcgagggaacacatcaatgtcggttttaaaatgggtaccgacaaccccttcatcagtgcctaattagctgtagtgtcggttaggaaaccggcactgatatgccttttcaactggtattgttgacgatttctgtatttgtggcaaggtttagatgaggaaaggctcctnatttgacggatcgatcgaatcaatcgtgcccagcaggcagcaaagtatgcatgcatggccaaaccatagatggtgggcccacacactctggctctcctccctccttctaccgtacctcaacgccgtttcctatatttatgtcacctcgccttcgactacgtacataccaccctgcgcttgtcatcaaacaacggtcgacctcaaaccaccatcagatcgatcgagcttgaaacaaattaagccaccaaaagcaacattcccttggtgaccgtagctagactcatccatcat

SEQ ID NO: 1767 - DNA, 600 bp, Oryza sativa
tttgcggagggaggcgaagtggtttcgtttcgtttctctctcctcgttttgtaatttttcggttttggatttgtgctgaatttggtcgtaattttgggcggggagaggaatcttttttgaaaaagggtgagggttgtgtgactgctaggtgggaccgggagtttcgaggtggggatgcgattttttttggtgtggcccactgtaggtggcgtgaatcgcagagaaagcgaagcccgggaccaccaccaggtgggacattggttcctctttttgtgagttgtactgctgatgagtgagagcagaaatttaaaatcgtccgtgcacagaataagctcggtttggattagagatgatcgggatcaacaaataaagttgcatttcagccctacaaatttctctccaacattttatcaaatacggaggaggatagacttcaagcggaattaggaaaacagaaaaacagacttcaagtggaatttggaaaacaattttaaaaaatttgattataaattaaaataaaactcctgcaaagaaaaagctggaacgggatacacacgccatacacctgacaagacctctcctacttcgagcaagttagca

SEQ ID NO: 1768 - DNA, 1083 bp, Oryza sativa
  misc_feature (2)..(2): n = any nucleotide
  misc_feature (11)..(11): n = any nucleotide
  misc_feature (16)..(16): n = any nucleotide
  misc_feature (53)..(53): n = any nucleotide
  misc_feature (66)..(66): n = any nucleotide
  misc_feature (72)..(72): n = any nucleotide
gntggaaatgnttgcngcggcatgggcggttggagctttggctccagcggccngaggtgggaaacnaccganaggtggggcccacctgtcggcgtcccgagagagaggagggaggggcggcttgggccggcccacaaggaggagggaccgcgggagagggatgggccgacggcccaacaaagaaaaaggagggaaaagaaaagaaaaagagaaaaaggattttcctgggattaaaattgcactttggtgatttttaattggtaaaaaaaattatttccaaggctctgaaaattccactaaaaatcttgttaatgcattggagcatggggaactcaagaaaaattccaccacaccgaattcaattattaattgcatttattaattagggaattagctctaggttaattaagataatttcttcggacaatttatttaactaattttttttttaaagcaagcaaaaggggaaacttccgggcgtgacataggactccggatagagaaggaagttcctgcgctagtattagagtagtaattaaaaacttaggcgtggtgtctatgttagagataaccattgttagttgtgtatcccacggatttgtcaaaggtaggcggcaggtggtgatagtcctgaattccgtcctagtaatccaccaggttcgaatacatcatagagctatagccggaaccacgctggcagaccagcaggggtcggtgcccgaagcaatagatagggaattaccttgcttagcgtagataattaaagcacatagaaagttctctctagcctgcctacctatagttgttgtccttggatcgtcttaaccttagatagattacacacgttccttgagttcgatatccttttggggtcacccgaaggtgaagtgctacagcggtattccgtgtgcttgcagatttatctgtggtcataagaaataccaacactctctctctctcactctctcacctctctatcctttctcactctctcacctctctcttctctcctgggcacggccggcgcgggcacggccggcggcggccggctgcaccgcctcacttggcggcggcctcggcggc

SEQ ID NO: 1769 - DNA, 2000 bp, Oryza sativa
  misc_feature (1039)..(1040): n = any nucleotide
ccggaccatgattacactctccgtcgatcagggtctccatctgacggctatggcgagatgagggcacacactacagtctgggcacgcacagcagctggctcctgtactcatgcaagtgatagctccttgtgcataccaaaacgaacgagatctgcaaaccttaattatgtctgatcgtgaataacccgcattgcaccctagaataataagtgcatctgaactgcagtcagggtcagagtaacttattggagtgaactggtgttgtagggaacttcaattgtacaacttggagggcgcaatacaaatgaatggattaaatagtagaaagttgattttaaaagggctttcaacaaatgctgatgatttttttacaaaattgtaatgtttttatgagcttggaaaaggtaagtttggaaaaataaaaaaagataactcaaaactcatggcatcagcttgcattgagctcggcttagttcggctcgaactcataatcaactactttggttgcgttcggcactgcttgttaccatcctctactctctcgtttttcatacacatgttttccaaactgcttaacggcgtattttttgcaaaaaaaaaatctatagaaaagttgttttcaaaaattatactaacccattttttaagtttttttagctaatatttaaatttttcgtgcaataattcatcgctccgtttttcgtgcagaaaatgagggctgccaaccctcactcaagaactctgccttagtttggctcggagtaataataataagtcaagctgatgtgggatttcaagtcgtgagcataacaagccagctcatgagctacttgtttagttatcttcgaatacttagttctttcagttacaataaatcaaagttttgtcatcggcaaaaactcaaatatatttataataaatctataacccaagttgacaagaaataaggtgattctcatttttagtctggtcttatgaatgtcaaaagtactttcttaaatatgggtttttggattgtcaataatgggaaaccaatttnnattttggaaagataaatgaattggtaacttggcttttaaagataaatatccatctttgtatgcaattgttcggaggaaaacatcttctattgccaccgttatgggatcgatctgttccgcttaatgtttctttcaggagagctttagatggtcataatcttgtttgttggcatgagttgtgtgcctctatagtacatattcaattgaatgattcgtatgatagttttagatggaatttcaatcagaatggcttgttctcggtgagatctatgtaccaagctttaattaataatggctatatcgagagaaacaattgtatttggaagcttaaattgccacttaagattaaaattttcatgtggtacttgcttaaaggggttgtgttaaataaggataatttggcaaggcgtaactggaatggcagcttaaagtgttctttttgtttaaagaatgagtctattcaacatctctttatggattgtcattttgcgaagttcctatggagagcagttcagttctcttttggttttattcttccagttagcatatctcatatttttaatgggtgacttttgggagttgataagaaaatgagtaaactgatacttgttggagcttctgccatttgttgggcaatatggctgagtaggaacgatatggtttttgacaaatcaccatcattttcctatatgtaggttattttcagggcaactcattggctccggttttaggcacaactacaaaggtgtgatgaagatgaagagtttctgaaagttgtatgccgaaagttggagaccacggttgtcgaggagtgatcctctctagcgggagatcgtgagaacccccccccccctcatgagttcagccgggggaagaagctcgcctctagaaatcgcatataccgtccccaaggctcctagctagctcgcacacaaccaaattatacaggttcgggccgct

SEQ ID NO: 1770 - DNA, 2000 bp, Oryza sativa
tctatcttgacaattttttttaaaaaaaatttgataactttttgagcgtcatgcacaaaacgaggagatatcctctcgaggaataaaaatcaacttcccaaaacatggaatcttcatgtcaaaggggcgcaataaagaaaatatttgtgattcaataacacatagagtaattatgtgaggcaaaaaccagggataacttttctcccctttcccaacttctactctatcgttttcctcacgcacatttaccaagctactaaatggatgttttttataaaaggaaatattgaaaagttgctttgaaaaattagattaaactattttaaagttatttttgctaatacttaattaatcatgcgcaatccgtcactcgattttgtatgttaggagaaagtgttccaacacttgcaaaagaacctgtagcgtgatgcttgcacgtatgttttgtcgatgactttggggaaataaagagacttggaaacaacatctcctgttaagagcagccgctacttgtttggttgctatagttattcatgttagctcaagatactactctcttcatctcaaaattttacaatattagacccaattctatcctaatactctagatctaaacagaatgtctataggtccaatccaatattttaaaatggaggtagtacataaaatttttcatccataatatatcggtaatttgttggttcaggggtaggggtggacaggaagctcgtaactcgttagctcgctcggctcatgacaagcttggctcggctcgtttgatttttcctaacaagccgagctggaatttcagctcgttagatataacgagctagggcacatgagctgttggcctttggaattggatgttggcagagaatggtggcccaacagcccaactcggcagcccaaaaaaaaaccctagtgaccttgagaccttgacctattctcccccccaccctatccatcgcgatccggttgatctctgactctctcgatccccttctcagcttctctcgaccttctcttgtctcaagtctcgaccttctcagcttccccgctgacagccgccagccaccacccgccagccggcaccgccaagcgctgccgccagcccgccagctgccgccaccaccagccacccgccacccgccgctgccacgccatgtatgctctcgccgccgcatccggccggtgtctgccacgcaggagcgcggcgctgctgccgcatccggccaatcctcagtcaccatccaccgaaggaacttgacgcccaccaagctatggaggcagctggagcgcgacgtccacgccacactcgacctcgtcgcgccggtgaccagggccgacgctcgaactcgcttgttgtcttcctattgttgaggctcgcgagcctaatgagctagctcagagctttccaacgagttagagccgagctgggtttttagctcgctaggataacgagccgagcccgagccgagctagctcattattctaacggagccagaccgaccgcgccgaaccgagcttggctcgctctccacccctattcaggggtacaacatgccacgacaataaaaaaaatttcctgtttttcagtttggcctcactaatctttgcaacctcgaaattaataattcttcaacagctaaccaaatgtaatcagaggcaacagcaccagctattaacgatgaggattcagtacggcattacctgccatgaagacaactcatcattactggagagaaacagacatgaaaaccgaagccagttaagcaccacccaaacatcctttattaatttccatctccagcctgcataatcaaggaaaattattaaaatttaaaatttaaattaaacagcctcgttgatctgatcatctcacgcctatatatattccccaccctcctgcatcctctcgcatcgcagaaactagcactacttctctgaaaaaccctctgcttcatttcatttcgtgagtttatttcgacgatctgaaaacg

SEQ ID NO: 1771 - DNA, 2000 bp, Oryza sativa
  misc_feature (314)..(315): n = any nucleotide
  misc_feature (335)..(335): n = any nucleotide
ccgcgttatcactgttttatttagccatgcctatttacctttgttatgaccttattattgttgttattgttattattaccttgttcaccctagaataaacaaaaccccaactagtgggcactctattcatggttccactagtatgaatttaggtagatgcttcgctgattaattaggcaacattaggtggtttcgtaactctagactttgggaatattcatatcacttggacactatggaatggttggattattgtggaattggacgcacacctccccctctattcaaaactctcaaaatggttttaggctggnnttggggtgacatggattttnatagtagcacctcgagccacataaggaaccggatcttcgggcctctgttgcaaagcactaccgtacttccacatgtctagtgggtaaggcttagtttgtggctcagtctggttataaacaaaagtacacggatagagatggacgaagtcggggtcgatggacatctctaggacaaatgaaggctacacggggctgcagcccggtagtcgagatgtcatagcacagggctggtgtcctgctgctaggggctcaattctgcctgccttgtccgggggttccggccgtaggtgggttgggtcggtactcttgtctatggctaggatgggttggaaactatgtcatgtcttccgtccatatgccgtggtggtatgtggcacgtggttgcatgtgaggaagacgtgtcttgtgggtaaagatgtacacctctgatcagagtaaaacctattcgaatagccgcgccctcggttatgcgcaagcctagcaatgtacccaagttagtgttttaaattcttaaaacctgcttaataactaaaatgtggaatggttggcctgggttcgcttgggacgagctgggacccagggtcgggttgccagttcggtctgaatcatcgtaggccttgggttaaggcaggttcgtgtgggttcacggccttgtttaataatattaaatagttctaggatcgtgttttaaatttagctttgagcaactaagggtcttttaaatgctgtttattgcaaaacctaacccctatattataactccattgtactcctttgcatttatgctgcacttgtgggtgtgtcttgttgagtatggtggttgtactcagtcttgctcaatttttcccaaacccagaagaggaggccctggatgatgaaggctttggtgtctagctcgtgcctgccgtcaagcgcctgtggtcatcgccttagtcttccgctgtttttcgttgtctttgagtgtgctgggccgtcgctgcccatgtaataattaactatttacgcttctgcttgttaaactctgaattgtatcaacttttggtgtaccttgcctcctgggacaaggaataatacacgcacgtaaggaatgcccattgggttatttccggtcgtgacagcaaaccacgcttcgggaactttcggaacgacagaaactacgcgaagcacacatgcaaagctataagcctgtaaagaagcgataacaatacataaaaaagaaagcacatgcttctttaggttataacaaatattaggagacttgaacgggtcgattcggggttcgtatgaccaagagatgatcatccgaagtttaatgctgttatatggagatttgcggattattataattaggttttgcaaccataaaacatgtgtaagcgctagcctggaaaagacaggaaggctgcgctgttgacatgcggaccccacatgtcaacctaaaggaccgcggtagaccgagtacatagagacggtccacgggtcgacggaagcggaccccatgtgtcaaccgaggcgagtggccaacaaacggactccactagacaccacacgggctgcacaggtgaaaaccacgcggctaccgagcgggcacactaacacggtcaccacacgcacaagcgaacgactaccgacaccggtacacgggtaccggggccgacaaccgca

SEQ ID NO: 1772 - DNA, 2000 bp, Oryza sativa
  misc_feature (1151)..(1151): n = any nucleotide
aattaattccttaattatatatatttttgtcaagtcatggtgtgacttcggattgccttgtggtagaactgaagtgtgacagatttgtagtagcagaaaatctttatgcagattttttttgtatgtgggtaatactaatacttatgtatatatcgtggattttgtattggtttgatcactttgatgattcctactacctttttaataagcattggaattcagaaacgtgtagtacgtttctctctctttccaacgtaaaaacgtgtagcagtacgtgaaacgcgattccgccagccgaagttcgaattaattcgaattcggtttagaacataggaattccaagcaaatagtttattttagaaaatggattaaaaatccagcctttataccttaaaggatgtacgcggtcacagtttgaacaactattggtacttaggccttgtttatttcagtctaagctgcgagttgtttgtttctccaatatatgctcttatattggaggtatataagggcagtgggtcttatagattattagattatactaatctggcttatagattataataatctatcttaataatctacttatttattttagcttactcctaataatacagattataataatcatagactgaatcaaacagggccttcgacgtaatccctccttcctattttaaatacaatcatgagtttacatgtccaactttaattgtccatcttatttaaaaaaaataaaaaatgtaagtcgcgcataaaataatattaatattttatcatctaataaaaataaaaaaactaatcataaaaaaataaaataaaaatcaaataagacggaagatcaaagttggaaacgaaaactcatggttgcgttaaaaatggaacaggggagtacaccttaaacaagtctttccaaacaaatagtttacaataacatttgaaaaatgcaacgcatcatcacaccaaacaatgcagattacccaattagctttagctctctcagaatcaaggacgcaacttgtggttgcggcaatggggagtaggattacctgcttatgttaacacatcttatcgatctggaagcctgaagagtacatcggatcagacgtcgcaaatacatacggacgcaacacaacacaacacaggacacnaaaatcgctgtcaaatcttcagtatctttctcaccactcgattaccaacccttctccatctccttttcaattaagccctgcgctttgggttagtggacacaattaacccggtcgttgcgtctacgtagcactgtaccctgtttcgtaggtgaaaggtacaagtggttctttacttcttttttttttttgcctcttttattattaacccgttacctatagagtcgtcatttgttggcaccttgtcgttgagctattggactcatgcttaattatgctgtatttgtacagcagctagcactcgacgcagcaacgtccttcattctcgtacagtctcactgtacccaaaagggcacttgtatcgagatggggcgttaatcttgaccgctgatcacagcattagagagctcacgtggccttgacacgagatgtgggtttgcggagttgcagcccaagcccacgtgagcgctctgtacgaatcgccgtacaacttaggtgggcccgtcttgtcattgagtgactgaaaaagttcatttgggccccttaatttgacaccgaatccgatttacgtccctggaaaaaaaacagatacaacgggtctccaacttataaaaccagtgcaaacgagatccctcggtagtattgtccctttttttggttgtcgtggtacctactaggctaatttgaccatgtcttttgttccacgtggtattgacgcttacgtggtagtttacttcggaaaacaaataaaaggagcaaaattgaaaactaaataattaaaacaaaataggggcctacaaacaagataaaaaatggtgggacccacatgttaatgggtcctacttcctccac

SEQ ID NO: 1773 - DNA, 2000 bp, Oryza sativa
  misc_feature (128)..(128): n = any nucleotide
ccggttttaagttcaggatgctatatggacttccatccaaagtttagggtgggttggaccttttcctccacgaaatattggatagaaaatgatagtaggacttctaaaactcaactcagagagaattncaaatgggacaacggaaggtcgtggtacaagaagaggttgtcggactaataacaaaattggatatagatcatgtgtgattcaagacgacaccacgattatatatcttggagtaatacgttgttgttgccccattgctacaatatcgatatgaagctaagtcatcatgcatagcacatagactattgccaatcaaaatagtctgattgtttttttggaaaaaaatgtgtgtgtgcgcgcacgcgcgtatgtgtgatgttgtgtgttgtgtgtgcacgtgtgtgtattggaatacatacagattattcacaagcgtatatatctcaattaacaaaatgattttcggcaatacaatttttcactaaaacaaaattactattattatatctcatgattcatctcattagtaaaatcttctagcacacgcatatttataaaagaaaaaaaacactaggttcacaagttttgccattaattttacagtgactgaaggatcaatctctatttgcaacacttcaataaacagtcacaagcaacaacattaataattaattagattttacatgatcaattagtgcacattacagttataatcccatcaaactagcaagcatcggacttataattatacattcattctgtaattcggaagctagcatagaaaacttgcatcagcataacttctttagtttggcggaacaaatgtatgctaagggagatgaggctccatggaggatggcagaccatgacattgctagggaagagatgcctcactcgctggcgcggctggcggctattggcagcaattatgtcttgtatcttcataaataatcttcatttaacgcttgtatcttcctgtgtgaaaggctgcggggatacattgtatagatgcaaattgacggatcgtgatttgtaaaacaacatagagttaaatgtagaatacattcaatgcatttaagtgtgctctgattgaatttttagtacatttcgttttgcatttcaactaaaaccataagatatttgaaaaaaatatttttatgtgtgaaaaactatagaaattgttacgttattacatttttgctcaagttaatgtgttcaacacacatatagaagtatatagtatctgagatatgattgaaatttccagcaaacctattagtacatatctcttcaggaagaggaattacatgatatacacataaatttttaaccaaaatttacacgtcaaatcgtcaattccatgtcgtcttatgtgaaaaggtatatatatttgctaagcacatcactcttcaaaagttatgccgagtcaagctatcttttggagacaccatcacgagaagtccacatctcctccttgtgtttccaactatgggaggccaactctaccggatccgcactaaaaaaatagccttgcatgtagaggtatttttcaagtgctgtagagacattattttaagggacaattgctcattggactctatttcagagtcttaagtactaatctgaccctactttttagagtttactcatttgaccctgcttttgaaaaacgaagttaccttctgaccttcttttcatcacaccattaagtttcatttagaaaaaataaaaaaaaacaaattattatttgaatggaccaaaatacccttcatgacctatccattcactcctaaccctatccattcaccctaatcccatctctcatggttggcgcaaggcgagtggtggtggcagcgatggcatgcagaggggcggtggcgtcagtgcgcggaggagcagtggcgccgcctgttgccgtgcggaggaagggagggaggaatggtgttggcgggcggagggatgaggagtggcagtagcagcgtggaagggtggcg

SEQ ID NO: 1774 - DNA, 2000 bp, Oryza sativa
  misc_feature (977)..(977): n = any nucleotide
  misc_feature (1948)..(1948): n = any nucleotide
tatattgcctgattttattatacactgccaatacgaaacgtctaatggggattggggaacagtccccatcacaggttgatgtctgtaactaatggaggtttgtaatgggcaaatgccactctcagctcagctcagctcaatattcctagccctattttcttcttcgtttttctcctctcctccccttgatctcagtagcgcgtcttgttttgatacagagagcactatgaaaatgttctttgcacagaatgaatggtttatctgatacagtagtctcatgttttatcagacactcttgttattcaccagtatatcgcccatcactgtgcgttactacttagttactacttacaactaacaacggcccctttggttggataaacaagtgcgtgttgatcccttgctactcgtggttcgcatgatcagggttgaacggcttgttcaacgtgatgccaggcttatttctggtgtgattgtactttccctccagctgatatgagcgtgaagtttgatcttctgatagtttctagcggtctagcaggtgtcaagcctgggcagccagatagggaactttttaacttacgtaacttgtgtcactaacatataaattctttatctaacaatccatatattagcgaggaaagtaaatgagaagatcctcttcccagggaagttcctctggcggtctggcctcaggctcagggtagccctgtcatttagacgaacagccccatcgtttatatatatatctaataagagaaaaaacgaaatgggtatttttgcaaatgaaagataatttgtgaataaaatttttatatacatgttcttaatggtctaagatttatatacatgttcttaatggtctaagacgaatagccccatcgtttagcgaataagagaaaaaaacaaaatgggtatatttgcaaatgaaaaaaaaatgtgaatacaacttttatatacatgtatttaatgatctnaaaataaaggatgaaaaataaactacgattaataaaatcctaaaatcaactttaaatttaaaattaaaattcaaaaattttggctgagaaaggatgaggcctgaagtccaccgagagaaacaagcagcttaccgcttgcggctccgtcgacggccgccggcgcctctgcgtagagggggaaaaatgatgaaacgaaatggcgtctcaaagattcaagaaccgcgacacgcgtggcggcacgtggcgcgcgcgcgctgcccgcacaaccccacgagtacgagtgggcgtcttctccgcggctccgcatcgaggagcagtgggttcctttggattcgacgattcgagtgggccgccggcttttgtagcactagtttctgtttgcccaaaaaaaaaaaaaaaacgccacgtcccgacgcgccgacctccatcctgtgaccatcccacgttatacacacggtgattggctctgttaaaaccgtaataaagcagcttaaccacccagacaatgacgagcactaatctcattctcatctaagcaagtgccattctcttctcttctcgcactcgcgctgcaccaccaccaccaccacgcttgggcggccaaatttagccgcgcaactctctccggcggtcggcggcgagcaatgccacccccacctccgccggccgcggccatcgggaggaggtcgtccatcctcagcttcgcggcggcgcgggaccgctgcttcagccgccgcttcctcagggccggcctccgcccgctcgccatcccgctccccaccggagtcgacgacgacgcgggcaccaccgtgcacgtctgggtccccgccaacccgccgcggaacccgctcctcctcctccacggcttcggcgcctccgccacgtggcagtgggcgccctacctccgccccctcatcgccgcgggctacgaccccatcgtccccgacctcctcttcttcggcgcctcctanacccgcctcgccgaccgctccgaagccttccaggcgcgctcgatcaaggcgg

SEQ ID NO: 1775 - DNA, 2000 bp, Oryza sativa
  misc_feature (238)..(238): n = any nucleotide
  misc_feature (395)..(395): n = any nucleotide
  misc_feature (397)..(397): n = any nucleotide
gttatagatcagtctatactttgcagtgtatatcttttgaaagagaacatgtaagaaatgcatccagaattccagattgatatatcatcaaggaaataatattcatgggattctattaggtattatatgaaaaaaagattaattcctacttgtctgatcagctttttcttaaaagctaaaactattttaaaattctaaatttcgacttttaagaataattttagaagaattgaatttnactctcttttcttatccatcgtgaaaagagagctcattatcttaaaaaaaatcgtgaaaagagagctttggtagtgagagtggcaaaagaacccttaaaataaatacattctgaaattcaaaatcaaatttccagctttgcaaagcacacaaagagncnaatgattcgtacatgattgaggtcatgacgtaggagtataaatcttggcgtatttacgttacatttgatcacttgtgtgggcatataattaaggcttgtttgctcaagaaaccagaggccggagcaaatgcaaatttgcttggttcagctcagttcaactctcacaagtcacaaccttctttccatgactcctggaatataatccctctccatgtggggcggcgcatttttttcacaacaaaagcaacgtgtccgtgatcaagggtgtttgtcaccatgctccaacggattatcgatctgttggttcttttcagtattgattcgatagttcaaaattttgaaaacttcgtctcatgtgaaagttgaacgtcccaagtatttagggtgttggatctcatgggatttcagaattaaaattggctaactaagggcacgtataacggtgtgtaataacggtctctattcgttgccacgtaagtaaaatatatgacatggaagagagataggggggtggttgctacacatgacaatggttcgaagttgactcctaacatttgttaaagaaaattttgttgtatgggcgtggagaaaaagaaagaagtgtagaaaaaatattttggtgcattaatggttaagagtttttgttatctcaattattataggagtatagtttctaagtgatatgtattaactaagactatacctgactctacattttatatatgcctaataatgcgattgctaggaaggatagtcaggtgtggcaacatggaggaaattttatgcagcctagttgagagtttcagttccatcgtttgcttttcggcttattagtcgtaaccaaaatttaaattttccaacttaatttagaaattttttgaggttttcgtcatagtttagttttagtattggtttttaaatagttaagaatgtgaatataaaaattttacccatcaattattattatttactttctagggcttattagcgcaacaatgagatcgttatatgaagtgatcatagatgaactggttaggtccctttggtgaaaccagcctactcgaattaaagtcctagcttagacacgtgtgctcatatttatagctaattatttttacagtgttagacgatgtatccgttgacagtaaggcgctcatgattacttcgttaatttcaagatatgttagccctctcattgtgtgctcattagagtgattaaacaatgagatcattagcatatgcaccatgttaatcgagaccatttgtcaaggacctgactggcaatgatgactacgcaacggcccaaacatttcgaacaggaaaaggttctcgtaaaatttctgcaatttcatcttggcagtttttcttaaagaatttaccttgaaaagctacctattactattctgatattctccaaacaaaataggtctatttggatcggaagtaataaaccatctatatctatactaatataaaaaggaggagttggcctcctccaatcctacctgcccaatcacccgatcaatccctagcgtccatttgcatatctacttatccgtaccgtccatccgagtatcacctattcatccgatcccatccatca

SEQ ID NO: 1776 - DNA, 2000 bp, Oryza sativa
  misc_feature (702)..(702): n = any nucleotide
  misc_feature (782)..(782): n = any nucleotide
  misc_feature (867)..(867): n = any nucleotide
  misc_feature (879)..(879): n = any nucleotide
  misc_feature (934)..(934): n = any nucleotide
  misc_feature (943)..(943): n = any nucleotide
  misc_feature (952)..(952): n = any nucleotide
  misc_feature (1116)..(1116): n = any nucleotide
  misc_feature (1205)..(1205): n = any nucleotide
  misc_feature (1250)..(1250): n = any nucleotide
  misc_feature (1357)..(1357): n = any nucleotide
  misc_feature (1425)..(1425): n = any nucleotide
  misc_feature (1560)..(1560): n = any nucleotide
ttcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcatctttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaacatacaagcttntttatagctgttttgctatgtgaattttcaataatgtagccaagctttaggtatatcactcatcatcattttacaaagcngtcggtatatcactcggcatcatgttattcagggatttacactcgcatagttgcttacgattattaatatcaagtcgcttggttnactataattatngaagccactcggttggttggattatttattccttgactatatgcttggtttgttnacttaaccncatagtcgngggctacacctattaggtgcatctagtcgatgcacctgactttatttttcagccctccacagtcttcagatttggtaaaagtactcgggagaccatggcaaagatgattgaagcactcggctttggagtaatctggttcgagagaagattatcttttcgactgngaaggtctcaggggctactgtggagattatgggtaccccatacccacacggcatggttatccgactagttataggggataacttatatntatggaatatgtaacagatcatgacttgggtattacgtttccttntatattacggaacggcctaaagtcctggtttgataatattgtaaagtagatttaggaaaccgataccgtattggttaaggtttctatcttgtaatcctgccccccancctatataaggtgggcaggaggccctctagggggcatgagacaacctaatcgtcagatcaatacacanccggcggattcaaatccccaaacaggagtagggtattacctctcattgagagggcctgaacctgtctaaatcctttgtctccacatccatccacttttaggtctcgtgcgctaccccgttttattattgccgaantcatgtttcgacaaacagattttgcaaaatgccctttgttctacagggggcacatattcgatgaattgtggtctaagtatgccaatgttgttctagagatatatttatacactcgtggaatggatgctagaggagaattattgaacttggttgcatccaaaaatgacactactaaaaaatgattttcctgtacaggacccatttagattgcagatgggccataaattggtcgcgtctggaaaaataggctcatttttgcatgcggaccatttaagaggaccgcatagaaaaatcgattttttcgtgtggtcgattttatcgcgtgcggacttatcaagagagtcgcacgcaaaaatacacactccctcttttccctcttacccactttaaattttcccctctttctctcgtctcctctctatctctttttctcctcactc

SEQ ID NO: 1777 - DNA, 2000 bp, Oryza sativa
  misc_feature (486)..(486): n = any nucleotide
ttcattttatagaaggaataagttcactttacatctctcgtatcttcgacgccgagttttaattatgtttttttaccataataccaaatataacgctcatcttttaacttataaaactggtgtgaggtccaagatagtacccagttttagctgatgcaacgagtgagccacatttgtcatcggccaactcttgttcttccccccccccactcactctcttccctctcttccacatctctcatactctcacctagcctcgagcgacggcgagaagggtggataccgacttggagagggccaaccaacaaggtggactaacgggtgagcaacgagtagcaaggagagggacgaccgccgacttagagtggggcagtgggtgcggcaaactagaaggacaatggtcttcaaactagaagggcagggagcagcattcttcttcctctcttccctatcttccccatctatcaccaggcctccgagcggcgnggataagggcaatcgctgacaagccacttgttttgtatggcgcggcaaaaggcaccactaatggatagcgtcgcataggggggggggttggggacaaccccgcgccggggcagcttcaggttggtcatcggcggctatcgtgctcgcaatgcagcccaccctgatcgcctccacctcgtgaccatggcctcctgagtcccgaggacacgctcgtcatcgtctagcacactgcatacctccactagtagtcaacgtgctcctgccagctcatcctcctcgacatcatagaatttcagccccccgaggtgggccgcctccttggaaaccttccacggtcaagctcctgcgctcatgttgaccaccagtgtctccctgtcgctcgccgccccccctcctggcttgaagaggattggggaagagaggggagaggagggagagagaagaaacaagagtgggttgttgacatgtgagacccactcgccacgtgagttaagattgggcactatattaccctaggacctcaggtacacctattttgcaagtttagagacacgctatatgtatctagtatcacggtgtagtgatgtaattcaaacttgacgtatggagatctaaactgaacttattccctcgtagaatgtagaattggatgggctaatgactttggcagtcaaaaactcgttgaattgatcacctaccgtgcatttgcatttggtttaagggatgggatggttggcttggatcgagtatatttcttagcgtgtctggtttaaattgttaaatacacagttttgccataaataaattgctaaatatattatagagagtttgatcctggctcaagataaacgctggcggcatgcttaacacatacaggtcgaacgggaagtggtgtttttagttgcggacgtgtgagtaaacttccttgggagaggaacaacaactcaaaatggttgctagtttcgctaagggaaaattttcatcaatagtctgataacaaatttagcgacgtatctatagtttcgcaacagtttggtttaaaacaaaatctacttaaaaaaaactcaaatagcaaaatgtttgcccccctaggattcagaaaccagcactcgtagcccagtggatggatgatggactgtgagcagcagcagcaacaacgaccaaggagctagcaaagcaaacagcggtgaaaacgaccgggggcaacgaggcgtcgaacatgtggcgcggccgcgcggggcaagcgacgcgccggggtcccacgcgcgcggggaagaaaccgaagaatccacgagcaccaatccgcgcaatccccgcctccgcgatcaccaaatccgccgtcgcaccgtctccactcgtcccggatcaacaaaccgcctcttccacacaacacgccacgccacgcctcgccgcgccgcgccgcgacgacacgcgccaaccaaacgggtggcaggcaggcagcagcgagctgctgatgccgctgccgctgccgctgacaccccgcccgcccgccg

SEQ ID NO: 1778 - DNA, 2000 bp, Oryza sativa
  misc_feature (829)..(829): n = any nucleotide
  misc_feature (930)..(930): n = any nucleotide
caatcatggttaatagctcaactcattgtacatatcttctcaatttctactttctacctctctcaaacagacaccctaaacttccatcgaggaagatcggaatctgatctgttagttacgcctaagtgcacttgcgcggctttgttgatatctttccaaatatttgtagtttttttttgttaaaataaacgagtaattaaagtttggaaaagagcactaccaaattcagctattaaaaaacgcgagtctcaaataggctccagattcttcagttggcaacgggagaagctgatatggcgtggaatctttgatgtggaaaactgagctgtcgcattgtgaaagccattactactcctatcccaaaattttgacacattaacccttaaaaaaaatgaaccttagcaaaagttaacactccctccattccgtattataagtcattttctcctaataaaaattcttttatttgatcaagtttgtagaaaaatttaacaacatttacaacaccaaattagttttattaaattatatatatatatattttgtaaatttgatcaaacttaaaaatatttgactatagaaatcaaaaccgcttattatatgaatatttaatcttaatgccaaccccaataacattgatgttcatcatcttaattagcgtgagtaaggccatctacaatgggtaacccctaggtcgtcccctcaccgacgggcgttcgcttttccgtccgcgtctgctccctacgatggagcgcgtcccctggctgatggacgcgtctcttgccgctttttagcccagcaacgtagccaagagacgcattgggggganggggggccggggcgatgggctcctgtggacatcggttccccagctcgtattcctattccaccccttggcagaggtagagtctctgccggacgtcgacgatnaagagggagagaggagcttcgtcgcgaccaccgggaccgggacggcgccgaggcggacccacaagagagagagagcggcgagcggcggcgtcgatggatccgcggcggaggcgacggatccgcagtggagtaggcggctctccttgtcgccctaaccgacgaagctccggcagcggcggcggtcctccttgtcgcgcgacccgcgcgacgctcgctgtccgctgcctcgaccgccgcgacatgcgcgccctcgccgtccgctttgctgagagagagagagagagagagagggatagagcagagagcaagttgagggagtgagagagcagagagaaaggcgacaagaaagagggaggagtgagagccgcgttgccgacaggggtaggagaggaaattaatatatgtggctttttggttgggatacccactgtgggatagagtgttttcattcagttgcttcgagtttggaagaacccacttagctgtggcctccattgtgagctgagttcccttacaagtatcctcagttagtaagaacactttagaagtagctcatattgtaaatgccctaagatagctgccacctaatcggattgttcgagttggctagctagccaacgtggtgggcgcacgctagctaaccacccgtcacccgatatcaacgctaggccttttggtgccgttgaaatatatggcccttaagcaccatgtcagtcctgttggcgttgagatctatgatcgaacgtgatatgaatctagtattagatgtaacacgaatctaaatatatctacccttcagatttatagtacaagcatatattttttccgctattagattgctttacaatgattagattgctttccaatgggacggggagtaccatataaaggaccacacgacctagcttgtgattgctatgttccaaagcagcttgcatgtggtagctagctagtgtgaaacaggccaattcaaagtcacgcgagcaacgcgcggccaatacaaagcgagagagagcccaacttgctatctgccatttttgccaacttgctacctgccacttccagcgagc

SEQ ID NO: 1779 - DNA, 2000 bp, Oryza sativa
tctgtccttactccaaaggtgtgtttagttcacgccaaaattgaaagtttggttgaaattgaaacgatgtgacggaaaagttggaagtttatgtgtgtagaaaagttttgatgtgatggaaaagttgaaagtttaaagaaaaagtttgaaactgaactcggcccaagtggtgtgaatattgtgtaaaaaaaagggggaaaaaagaatgacgcggaggcagccacgagaccgctttaaatgcaatttacaccaaccaaatatccatggtgtaaattggaccagaccaataattgtgaaaccaaaaggaaaccgcttcgtgctgctctacgtttttttaagcaagtataggccctgtttagttcgtggggagtaatccattactctcttcccttttagtccctaggaatccaaataagagtgactaaaagtgactaaaagtgtatattggaactaaaatccattagtctttccatagggactaggcgtgtttggaggtgggtgttaggaacccatctcccatacacagaaaacggagcgatccattaacacgtgattaattaagtattagctaatttttttttcaaaaatggatcaatataaatttttttaacaacttttgtatagaaactttttgcaaaaaacgcatcatttagcagtttgaaaagcatgcacgcggaaaacgagagaggagtgttgaaaacttgctcttgcaaacacaccctaaagtggcagcctctctcttctctccccctcggtccacgtgcctttagtcctttttagttcctagatccaaatagtagggactaaaaagtttagtccaagaactaattttagtccagggaactaattttatctttttaatatactagaaaaagtgtacgtgtgttacaacggaaaaactaaatcgtgacatattttttatgcagtatttgagcattgtgaattgtgaaattgtctcacgtggctggttattgcattgcgatcgcttcatcctgattatgaaaatctcacaaaaaaaacataataggaatattctaaatacataaataatagaaataatatgaagatatgcctacatggttgtttatgcagcaacctttgaaaaatagccaagccatatcatctcatccatatcataatcggatcaggaagagcatgcagccggtgctagctgcgcttctttctaaactaataaagagagatttacgtatgcatagtattctagcacgaatcgatctgatgacctgttctcttcttctatacatgcaagcaaaaaattcgaaacagacatgtacatttgaacttagactaccgtattcatactcgaattggacgacgcaccaaacaatcagtaaaaacatcttcaatttttataatagtagagatgtttataaatagcttatagtttgctatctactgttttgtgatttgttcgaaattgtgctagttccaaccaaaatacacccaaaatatgttgacatcacacttcccaagttgatgctgtgccccccttaatcgcttgagctgtaacccccatatgatccaagcgtgatgcgtcgacgtcacgaaccaatctgcaagggacatccaaaggtgcaggctcacgtcctatcatgaattttgcctttgtcgtcctgcaaccatccaacccaatcttcatttttccttcacccaactcttcacttatccccgttctatcattttctttcatttcatatagtatatatcagtagagagaacagtaaaagttatcttcatggagtagtacacaccatttgacatcctgattatgtatagtaatttgaaacacggagatttcaagtggagttccgtagtcatttcatttgaaaatggttcggccaaaattcggtgaatgtttgttgggggcttggagtgacgtttgctactactgacggattttcagtaatagcggtgatccgttttgtcggctacggtctgtgatcttcagcacgccactcgcgctgcgcccaccattatgc

SEQ ID NO: 1780 - DNA, 2000 bp, Oryza sativa
  misc_feature (205)..(205): n = any nucleotide
  misc_feature (1848)..(1848): n = any nucleotide
  misc_feature (1864)..(1864): n = any nucleotide
  misc_feature (1966)..(1966): n = any nucleotide
  misc_feature (1977)..(1977): n = any nucleotide
ataatggcccgatggaccctccgacaaacgactactacagctgttaaattaagtcatgcgagattgctattgggcgatcagtcgcgcgcctccctccccgcgcgactgcacacgtgtcgcgcgcggagagagggcggcgacgtgccaggagtgagtttttcgttttttttggtttttttccttttttttcgtttatgtttgtttngttcttttcttcggttttttttctgtttggattttttttctccggtttttttatggtcggtttgtttttcccagtttatcttctttcagatttttcccttttttttaagatgtataaatacaaagtttgtattcgtatatataccaagtttgtattcgtacgtatagaaagttctatacgcgcatacaaactttctatacgggtatacaaactttttatatgcgcatacaaactttctacaggcgtatacaaactttctatacatatatacaaactttttatacgcgtatacaaagtttatatacgcgtatataaactttctatacgttatgtattttctattttttatatttttttagtgcatatacagactttgtgtatgtgtgtatatattttttatgcattaaaatatattcgtaaatatatacgtatgtatatactatacacacacacaacatacgtatatatataagatgtatacagtacctaggagagactagaggggggggggtgactgaccgcgcgcgtccggctgatcgcgtatcagcacccccctaagtcatgcccaagcgatccaaggaaagcaaattctgagtgatttccaagaaaaaaaatctgtcgcgtgatgtttagcaaaaaggatatggatgactagggaaatgggcacgatcagaaagtttaattttctgtttcatgttaattttctgtgcgagacattgacttgatcgagcatgcaactctttttgtttgtttgtgttggcttcgggactctttttgatcgatggagtatggtgttggctatgtatgatcatgttcttcaatctggaatatgatgtctagaaactgactttctgaaacaatatagatgatttcgcatttcatacatagccaccaaattcatggtttttgagaatgatcagctattattgtttgagaattatgagcatcttattgattgccgaatccaggataagaaccatcttattgatcggctattattgtttcattggtggaaccatctacctgagcagcagatattttgcactgaacatttacccagcctcacctacgacgcccgtggccaggagaagaacacgggagaggaggcacggcggcagaggagatcgtgaaagagcgagccgacgacgtcgaggagaggcgattacgatccgatggaggcgagatgggaagggagaacgcggcggcgggaatggggaagcggagttgcggccggaggaaaggcgagccgtccagctcgttgactccggcggaaaggcgagccgatacgagcgagctgagctgacccttatcgtgctgcggctccaggcgtgtgggcgcgccatcggatgcacgcctctttcacgcgtcgcgcatctgactcgggtatgcatgggctgagatttgaatccggtatgcaccaaatttttttccggtgacccacgttcgatcagcccagtacgccgcagtatatatactcctaattgtgcattacacgctcacgcatccacgcgaccagaaataacccaagaaaaaaaaaaagaagagaagaggagatcgaaatgggagagagaaagacacgggaggaaatggaggatgattacgacgaggcgctgtctcagctcagggagccggaggttccgtcnccgccgccgtccccgngcctcctcgcgatgctgcagtccgcgggcttcgcttccccgcccccgccgacgtcgacgcagcagcagcagggaatcgagctctgcagtgtctgcgctgaanaggcggcggcngcggcgttgcggcggcgcggggg

SEQ ID NO: 1781 - DNA, 2000 bp, Oryza sativa
  misc_feature (675)..(675): n = any nucleotide
  misc_feature (1226)..(1226): n = any nucleotide
gttctcggtaggataaattagcctaaagtatataagtcacatttaaggtttctttaataataaaatatgtcacagtaaaataaatgatatcctatatacctatacaaatcatcctcactattagaattctttgcttcctgctgcttccatgtcaccctttttgtcctcaccgttggatccgcatcggccgttcctcccgcatcgctcctctcctctcctctcccgcatcttgctgcggcgccggccccacgcgcatcgctccccacctctcctctctcgcatctcactgcttcgccggccccacgcgcatcgactcccctctcccgcatcgctctcctcgatcgtggcgggcagccaggaagcgcgaccaccgcgcaaacgtcgtgcctcttccattcaccgcgccacttgctttgctgattttatggcgactctcctcctcccagcgctgttgtgcgtagtagttgagggatcacgacctcctgtggttcgctccccattcacccagatcccttcgtttacacttcgatctccttcctctcacatctgtatatcattggcaataagcataaaagccatcgaatccgtttcctccgactatcaaatcgtcgcccatcttctcaaacttcccctccactttcatctccctcacatgtatgtatgtcggggcaccangttgagtccagctgcacatcgcctactcctcttcgggctaaagaacgcacttttttttatcaagggtggcccttgctgtgcccagcgccatggaggtaagcaccaccaccgcctttctaatccatgaaggtaagcaccatcatcgtcaattttgcagcccaaatacagaacagaaggaggtcgctggcactgggcaaaattgctcaacttgccgattattcagagccgattattcagagctgaaggagcacgccaatagcaggatgatgccttctgattcatcactatatctatgtgaccaggtctgaccgtctgaggcattgtccaactttcatatgtaatttttgcatactacaaatggattcagaattgaagacactattcctaacacaaaggtaaccatatcttccagcgtttaaacacttatttacatggatgcttctgttaagaaaaaaataccataggtacaaattcaattgctggttgattccaaaaatatatcatggaaaaaacattctcttccataaaattttcaggctgcaaaactgcantgctaatcttctctttgtaactcatgacacatgaacaacctaccaacaacggttcttctcctcctagattgtaacccatgtgtttatcctccagatgtgttccctttcatattattgaccctttatatgaccatcatgttatcccttctcctaacacaaaagttgcactaccgcatctggaggatcctaacataaaacatcatgacactaacaaccaaatttagtatcctcatactattaattgccaattttgtttgatttacgaaaaaaaatcctcatagacatagcactcttgaaacaacatagaagttttttaatcatattcaagttattacaatttatctgatttagctattacaatgttccgcagcaacgcagcggggtatcatcagtttatataaacactcttccccttcccactatctgccaggtacgaccgcacgagcataccaacgactagcaccgcttcctcttcctccttgttgcatctcgcccagtgcctattaggaatactttgccatatatgtacagattgtattgtattgtttctttccttgtattctcctctaattgaggatcctgtacatgtgcttcctatattaatacatggccacccctcccattgggtgtgtggtgttctccccattccattctatatggtatcagattccaagttttcttctcctcttccgctgctccagcgctgcttcctctctggtcgctgtgtccaccgagcgtcgccgcctccctggctgccacgcccttcttccctca

SEQ ID NO: 1782 - DNA, 2000 bp, Oryza sativa
  misc_feature (92)..(92): n = any nucleotide
  misc_feature (177)..(177): n = any nucleotide
cgcgggcctccccagggcgccacccgccgccgccgccgccgccgacgacgacgactgctggtgcgacgacgccccgccggccggcacggcanacggatccgaggtgatgagatccatcagcgtcgtgctggacgagtcctgcccggaggccatggccgccgcgggagtgagatctcnctccggcgagcaaagaggcttttcttgtgtgctgctgtgtcgagggatttttgcgggtcgggttggttttgtcaggttggggcaaatggagcactgaagtgccgtggccgcggcgctggctcgatccaaccgccaatttggatttggtgtactgtctgggctttggttgattggttcgacccggaccgattttgtgaattgcgaaggaaagacgaccttcacgccgatcaaatattcaaattcctccactcagctttcaaattcaaattaactagtatggcgttattcagattaattttatttcaaaccatacctttttaaaaaagttatcaaatatatgcatcatttagttttttaccaaactctaggaaatacataagaaatcatgccaaaacgatgatattgccaaattgtcgattgctaaaatttgataatatttgttttggctacaatctgaacagatcctatatataaatacttattatgatcgacatagcatgctccctctgtctatttctttttttttctttttgcaaaacataatataaacatgtatgcttatttacatgttcggtttgcctccatctacctattactgctatgtttaaatatataattttttcacgacaaggaccgtgtttagttgttttggtaaaaaaaattaacgtatacggacacacattttaagtattaaacgtagactaataacaaaataaattacagttttcacctgtaaattgcaaaacgatccattaaacataattaatccatcattagcaagtgtctattgtagcaccacattatcaaatcatggtgtaattaggttcaaaagatttgtttcacaatttacatgtaaactgtgcaattggtttttttatcgtccatatttaatgctttatgcatatatccaaatatttgatgtgatggaagagttggaagtttgaaaggcactaaacaggtttctctcttgttatatgcggttactccatatgttcttaaataatgtagcctttgatcaataattattgtaatgtttgaactactatgaaacgactaatgggggtttcatgtgcatatacattacatcatgcattttacaattaataatatataatgtgtttttaagcagggtacctttttttaagaaagagagggttcgtctcccatttctttatcgaaacgcatatagcaaagtcttttaacagagtttatatgacctgtaaggctgagttcggtagccaaagttcccagctcacttccctctttttttcacgcgcacaccttttaaaactgctaaatagtgcgtttttataaaatttttctatacaaaagttgtttaaacaattcatatcgatcaactttaaaaaaaaaactaatatttaactaatcatgcactgatggaccgctctgttttccatgcaacagtgattagttgccaacctcaggtgccgaacttaagtctgtaactcaacatacccagtaactgcatgctaaactaaaatagataatagacttccattatcaaatttgaatccccaaaggacttgcaacagacatatacgacaacacgacaaaacatgatctttcttcatttcagcctcaacgtttgcagcttccatccattttacagagttgtatagctcagcggctattctccttagcagcactaccctcagttgtagtcttctttcgctcgtcctcctgtatctgcaaaatggaccaagattcgatccaataacatacttcatgaattagttcaacgagatcatcttaaattttcttatcattgaaacatgctgcatttctagctttccacatagtcc

SEQ ID NO: 1783 - DNA, 2000 bp, Oryza sativa
  misc_feature (1119)..(1119): n = any nucleotide
  misc_feature (1124)..(1124): n = any nucleotide
  misc_feature (1126)..(1128): n = any nucleotide
  misc_feature (1132)..(1133): n = any nucleotide
  misc_feature (1135)..(1136): n = any nucleotide
caaggaccactcgtgaccattaattccaggccactcagaccatatgtttagtgttgcaaatagacgtagatggataacctagaagattctagtgtacataaagcgatttttgttttagaaataatacatttttaataaaaaattgtacaaataaagttcgatcattcaaaatcataagtttaacatcctatcgaacaactattcttcgatagatgacccatcaaacaacggttgttggatagaggttgtttgacgagacggtaggatttttttgcaattctttatgatgcatgtgtgtacgtgtgtgcatgggctaatgtgcatgaggtacctatagaacgttgaatgttcgagaggcctcctgcgtgcgtgcatgcatgcctgcaccttttactatttttttctcggaccaatgatcttatcaaacaattatggtccgaaccaatgttattcgataggctatctgatatatatcctgtcacacttcagttgtttgatatgatgctaaacttataattttatctggtatacctatatttttttcatttttccattaaaatcgtattatttctaaaaaaatgttgacatatagctataaagtggtaacggtgatgagcagtgaatttatctcactaattgacatgtgggaccatagagattgttaaatttggtaccaactactcctaacgtaaggtgacatttaggagccactaaacaatagtccacccattaggcattagctatggaggatgggataaattatattcaacctgctccttacaacgcattgatatttagctagtactcccccgtttcacaatgtaaattattctaacatttttcacattcatattgatgttaatgaatctagataaatatacaggaaatgctagaatgatttacattgtgaaacggaggaagtatgatttataattgtaaggataaggctgcaatggtaaaaatacaccccttcctttcctttttattttaaccagtgtaattttatctttggccaataaaaacttttaaattattatgttttgataaatgaaagtactataattatattttgcaagaaaaatacatgaaaatatgacatattttcaaaaaaaaaatatnaaaangnnnaganntnncaaagtttgtacaccgagattagtatatatttggttactacgcggtgtgaaatatgtttataaataaacaatcggatttgttagaaaacctttcaccaagatttttacccctcgaaaccttttagatttgtggccattggatcgccttgagatttgtatatgaagcgaaaaatgatagaaataaattttcacacatgtcaacattagattccattgctagttacccaaaccatagttgaatgcaagttttatataacttatattgtagtttcaatacaattatagtgcagttacaattataattcaattatagttacatctgaatcttttatactcaaaaaaaatttatagtagttttttagatactcccataaacatttttatttgtcaaagttactactccctctgtcctactcactaagacgcgcacgttttaagagtcaacttttaaatatttgaccaataaatagtttatatattattaatttaattttatttgataaaaatagtgttattggattgtcatttaaatttattttcctaataattatgattttatttctacaaacattatagcatatgagaaatttaaaatcaaatattagttttgaagactttatcaagtttgaccgtaccttagtgagtgagacagtgagacagagggagtaccaactaaagccttgttcagtttagaggggcttgaatgtgaataattctataccatgggaagtacgcaaactgatcctacgagttactcacgctcttataaatgaagttcgctcgatatctctttggtcaagtctcattccaattaagctttagcttcacaggctcacagctacactctttttggctattgttgca

SEQ ID NO: 1784 - DNA, 2000 bp, Oryza sativa
  misc_feature (1254)..(1254): n = any nucleotide
gagtccacacacatagggagctattgattgatcgagtatataatacgaaaatatatactttcaagtgttctgtttacacttaattttcagctgatggccctccaaggctgcatgccaactgtacatatactccctccgtttcaaaatatttgacaccgttgactttttagcacatgtttgactgttcgtcttattaaaaaaaattgtgaaatatataaaactatatgtgtacatgaaagtgtatttaacaatgaatcaaatgatatgaaaaaaaataaataattacttaaattttttaaataagacgaatggttaaacacgtactaaaaagttaatggtgtcaaatattttgaaacgaagggagtatattgttttattcagcatataatcctttttaattatttttgccgtttggcttagtagtttataaaacttgtgtgatatgacatatatatcctgacgtaacaaattaatctttaatttggtcatcgatcgtcgtctcgacctgcttgtcttaatccgacgacgagatcatgacattgcaattgcgctccagttgctgtacttggtatcttctctctcgtcgcatttatctgttcattcttcaaaattggggcgaatcaatttaattagttgattcaaaaatactactccataacaaattaataaacagtatagaagttgtactaattaaaatttattacacatgacggcacacataatataatacccacataattgcggcatcagccatctgcactggtgaggagtttgggctgcacaaaagctgctcagaggcccataagtcttctgggccgaaagtccaaacggcccaaactttgcggcccatatactatttctccagttagctcaggggtatcaagttacagtgcacctagcatttccaaagctaatcttgtgcttgatctcttcctttctggagctaattcttgcagcgtaagttgatccagttaattgctacgtacgaaggaactagcaactctacacatgctcacctttttttcttcttcttcgcacaaatcaaatgcatttgattctcttccaggaactaaatactagtagtattgcagtccaaaattggaattattttgtaaaactctgccgaatatgaaatcgggtaaaaaaaaaaatcttctccatcaattgataaaacgctgtaattatcttccggttcattacatattgccctatggatttattatcaaaggacccccaaaaccaatacgcctaacntaaagtgaataagtcttgcttcccttatctctcgctctgattgaatcgtcgtcctcaattacaaaaccgagtatagcacttcacccacctttaccaactgacgcaaatgaactccttcggtggtgttgagaagtgatttcagctaacgtggcaggttaattgcgattgactcactgagttagtaggtgagcccatatgtcatagactcatatataaaccccttgaagggaaaaaaaaatcagttacccatatgttatccatcctctctctacttctcttccttttttttctccgtctctcttacggatgggcggcagaaaggctgagagaggcgggcggcgacgaggttgagggagggaggaaagacctattcctaaatctgggccagaagtacatatgacttctctgcaaggcccagaccaacaggtccggcccacgtatcacttccgatcacgcgcacggcgcagcatggagctcgatttgggtaagaagccgtggggtgcagctagcatttcgaaacccaaatttcccatttgatcagtctctattttttcaaatccattcttgcaatacaagttggtccggccaactgctacgcggacacgaggaagtccacacgacaacccagccctcctcctcctccgcctcgtcttatacccaccaccgagacccatttccttttcatttcctcctcctcccccaaaacccactcctcctccccatcgccgccgccgccgacgagggag

SEQ ID NO: 1785 - DNA, 2000 bp, Oryza sativa
acaggagaatgccagatgtgcgggcacccgatgtagtgcgcatgcattgggcgctgctaccgcttgggcgcaccacgccgcctgttgtgccacccacgtctctcctacacgcgtcctcgtgctgccacgtgtccccaccacgcggcaccagagaggttggcaccgtcccattgtatgacggtgccaacgactctggcgccccgataagttttttcagggttctatttatgaaataagtttttttaaaaggatcagggaggtcactttggtgttgagtacgtagtatatcactagaaacaacaattttaccgtcgccattcttccaaggttggtgtttacactctgatattcttcatatctcttatatttgctggtattaacataagagtaaagtgcatagacgggtccttaaactcgtagggttgtgtcatctaggccctaaagtctaaaaatgcagattcgggtctcagaacttgtcaaagtgtatcatttagattccaaatcgatatagccctttagtatcctacgtagcgccaatgtggcatgccacatggacgtgacgtgtcattttctttttttttctttcctttttccttttcctttttgttttctgatctcattcttctttttgtttcctttcttctgctcggctcacagagaaaggagaagaaagggaaaaaaaagagaagaaaagaaggaaaaagaaaaagaaaaaattttaaatgggttccatttgtcacatcatgttcgtgtggcatgcgacatcagcgtcatgtaggatctcaaaggggctgtggcgatttgggatttagatgacatactataataatttctgagacttgaatatacattttaagagtttatagacttagatgacacaatattacaaatttaagaaccactcgtgtactttactcttatcataagttagtagtcttcagtcaacggccggtaacctcatagaacagaataaagacagggaacaaactccagattcttcccgtcagctgacaaagcgggaagaattctagttttagtgaagcggtagaagtaactattttcaaccaaagtgtttgagccccaaatcctcgcttttgttgaaaacaaaaacagtggtagatgtaattataacatgtactccctccgttttaaaatgtttgacaccgttgactttttagtacatgtttaaccgttcgtcttattcaaaaaaatttataaaatatgtaaaattatatgtgtacatgaaagtatatttaataatgaatcaaatgatatgaaaagaataaataattacttaaattttttgaataagacgaatggtcaaacatgtactaaaaagtcaacggtgtcgaacattttgaaacggagggagtattatcaatatgttttgatttgcctctcaaaataatacgtccgcatctcggcagtgcgcgtccccccttcgcccgtcacagtcggcgcgcgtgacggccttggagccagacgaaaagcaggtcgagaccgctccaccgcgcatatccacgcaacgcaactggtacgtgctgccttgacgcgcccagaaaagcggcacggcttccacatttttcggccaaatattatatccggccgtgtaccggagcacgtgccgagaacacgtcgccgtcgtcacgtctcccgccgtgatctagcgccaaccggggacgaccaatcacgtatagccggagaggtcaatagccgagtaggcgaccactcgtttggtctattggccagttagaatcgctgcaggttttaagcaagggggataaattaagagtcctggacgcgttggcgggacagggacgtgtgtttcgtcttcgagagctcgacttcactcgcaccgtgtccgtgtgttgcgtgtgtatatatagctgggcagccacgctctggtttccatcaaactagaactgaactgagcgagctagctgcttctacaactgtgcaggtagctaattaatctagcaatcctcccgtagattggaata

SEQ ID NO: 1786 - DNA, 2000 bp, Oryza sativa
cactttaccagattgcatagtttagaaggaaggtgggttagcgcctccctagcctaggccagatctgaggtcctgtgaggaggtccacgtgtccaactgtccaccattgatgccgatatgtactctaagagaggctaaatattcaggctagactctgtttgggtgaactgacccaagacgaggtcgtgccctcggagcttcttaaagacagtctcacatcctcaaagttggtgcataggaccgattggctggccaccggaaactagctaggttgttgcaccattttctgttggggaccatgactctaggttgctcgggaaatgccagatatgcattggacaaaacaggtcaagcagagcaggtgggtcaccccttccatgggatgttttgctgctaaagtaaaaccagtgtagagtttaatgagttagctagggtttatgattatgtacaatatcctttgcctcggggtggtggtggttgtgggggggttatctataatgtcctataagatcatttgggactctatagacgatattcaaagatagaatcaacaagaaatgaaggattcattcatagctagctcgagtgctccacaacttagtacaaacgttgttgatagtgacctagaacagtagtagggttgttatcattcgggaggcccgaacctgtatggttcttctcgctcccaagcactcccaaacacaccgagtgcacccagagccccttatcgatccctaacatgtgatctatcacgtcagcgatcccgaatcaaattgcatgggaaattcgactattgtacctattataatatattctacaaaaccctgtagaaaaccaaagaatgatgccgacgacattggccaataaaaaactgaacccataaaatcattggctatcttctcctagattccattgcaatgcatggacatgtctctaagtaggagagcatcctaccttattggctatcgtttaggagtaggaaaggacatctatgatcctacaactgaagtctggctaattcaagatctttagcccattggacactagggtgtgaagacccgatagatcgtgggtgtctgctggactgtgagctcgagggaccgttgatgtacagtgaatggacagtgaacgggtaagaggcaccaatttatatgaatagagagattgttgaatagtctcacatacttcatgtgtgaaaaaagggccctctcgatctccctcaacggcaaccgcgaagccctgctaactctgaattctgaataaagaattctcgtacagctagttcgctgttggtcccaaccggtctactggggccaatccactttcatgtgatgtcaagttgggcactccaggggaaactattttcatcctcaaggggatatcccctcgttgtttgtatgtcactataatggttatgaacaaaattgaaaaaaaaattgagaagatgtattaacatgtgatatatcactttacaaacatgcaagttcaaattcaacttctacatctcgtaacgaaaaaaaccaatttgactataaatatacgttaactagttgtagtttaatttgtattttccgttgcgagatgtagaagttgaattttaacttgcatgtttgtggagggatacatcatatgttaatatatcttcttaatttttttaattttttcataaccatttacttcctccgtttcacaatgtaagtcattctatcatttcccacattcatatcgatgtcaatgaatctagatagatatatatgcctagattcattaacatcaatgtgaatatggaaaatgttagaatgacttatattgtgaaacgaagggagtaagtgacatgcaaataacgaggggatgaaaatccactcccgcactccagtctgtgtttgcttgccttctcaaggcactaactaacttagagttaagctataaaagcaagcaaacatacactattatctactagtacatccttaacatcgatcaatgcaaccaccacaacgtac

SEQ ID NO: 1787 - DNA, 2000 bp, Oryza sativa
  misc_feature (1317)..(1317): n = any nucleotide
  misc_feature (1809)..(1809): n = any nucleotide
aaatccattttgaaaccactaagtgatttatttctttttgagtttggatcgaaaagagacttgtgtctcgattcgacttaagagacgcttttcaacaactcaaatggtaatgtaccgacctcccgggtcagatcattacttctcggctcccagagccatttcacttgattaagcggctcccagagccttattcattttctcggactcccagagtccagctgcccagcagtacaacaatccgcttccactcgggaagcctagtctatgatgcctgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccacccatgaccgtgggcacggctgttcgaacagttagttaacctctgcagaggggtacactttacccacaagacacgaacttactccagacactggccggtgtcagaggttcacgacaaagcctttccaaaccgagtctgggttacctcatgccacatagaaggatcaaatcctcacataaatataggccattttagttttcacaaatcaaactccaaccacctcgatcggtaatctggcaagcttcgcgttcttgccttaccaggaacccgggttggctccaaccgaccccgccccggcgttccccaactattggcatgcgaggttttctcgaaccgactagatacttagctaaggtgtcccatatcaccttgtggttgcactttgttatgcttgatgagtttcccacaggaatcgatccttatatgcgaatacgggacagcgccacgcaggcaccaccctcgcatcgcgagttttcacaattcattttatttttaaacacaccgacaccacatgtcgggttttcaaggcttctcaaacccatttcccaatttttcaacaatcaacggtgtatgtgggatatttggtatacgcgcttagagagcacgaataccgaagtaccgcaagggtggagcgacaaggaatcagggtagtacaacctacaggaattagtgcgactactgggtaggtccgtcggtttggcacgcaaaccgaggccaagtaagttaagtgtgtgattctaataatgcaagttgcaaacaaagtaataatgattttccaattataggagaaattgatcaaagggtgactgccttgctcaaggtcttcacgaagcttcgcgaatcctcgagaaaacccgcgatagacgaaaatccggtaaccgcaactatacgcnaacaattaaaacctaaaccaagacccaggaaagaatcatattttagactaaataatagtaccattaagtatatctcaattttacagaattactgaaagtggaacagagtcaatcggacgaatggaacgagagatatgaattttggaagtttaattggatttttctggacaaggaaatgatttatcggaattatctggaatatgagaaatggcttatggaatttatcaagaatattattgatagtcatggacgagcgggaccaggggtgtactgtacaaaggggagattaaatggacttttgttggctatgggcttggattagggagtaaaagtacacttttctctttcccttatgccaagaagggggtggctgatgggccaagcccacgagcggaaggggctgaggaggcggctgattgggcgctgacggggcaggctcgtccgagtcagcttgacttggtcaagctgacgtggctgccacgtcggggagcnggaaggggaatatgagaccgaacagccgatccgacggccggcggcgagcggcgtattccggcgaacggcggcgaatcagaggaagggtgggcaccggtagaaggagggggagaagtggaatcgatccaacggagtggatgagggagagacagcgcgacggcagccgtgcggcgagataccgagcgcggtgg

SEQ ID NO: 1788 - DNA, 2000 bp, Oryza sativa
tttaatgaagatgaatataaaattaggacatataaaaacaagaaagtcattattgtaaaattaggttagttttagttattacaaacttaaaaataattgatttaatatttttaaagcaacttttatatagaaagtttatgtacgaaatacggataaaatctgtatgttaatcagagaagaaaattgtgtttatcatatcacgagatgtcggcaagtttacgattgccatgcttaggtctgaagaagctacccaaaaattgtcctaccatttttagcgtgtagaaatgatcctttttctattactatgaaattcttatgtaatggatcggtccatttggaaccctatgcatttggaattgaaatttgtactggttggcatttgtggacggagggagtacgagtaactcgtaccgtcggccctatgcccggagcaatatgaatgccgctcagtggtgacgcgacgagcgccgtgcagccggtgcaggcagcaggctatcatctggtcccagccgcgtcaccgattcaatccacctgaagaattcctccagctagcggagcggtccagcccaatctcacgcgaagccatgcacacgcaagcagctctcgggcagagcgcgcggcgccctcgtccgtcctagagctgcccgacgaggccgatggcttcaggctcgccaaagccgcgctcgctatcgctgcctttgcacggagtagtgtctaatctgaccccgcgcccgccaattgcagtacacgacgtagggactgacggactgtggcctgtactactccagagtgtagtagagtctgtagagcatgtaatacctggactggagtagtggagtcgtgtctcgatcggcgcatggagggacggtccgtcgacgtacgtgtggaccatggaggaggagacgccgcctgcgacgctgagctgagccgtgtcgtgtgggcgtgtggcaatgtgccacgcccacgcgcaggagcgtggacctcgcgaattaacggcgctcgtggcctcgtgctttgctcgccccgcgctgcgcgcacccatggctcggctggctcctggcgacatcgtgggatgctggaaacgtgcccagaggcctcgtcgtttgcacctgcctacacacgcgtttgctagtacaatgcaaggatccaagagtatacggcggcaatgtaacgtaaattcctccaaggatttctactgtaccaaccacgttttgtgggcttaaacatgtactgtacatgcaacagagagatgcacgctgtcacacttcctcaactggctcgatgtcacacccttcaattctccttttttttttttcagaggtactcctgacattagtgaagcatcatctagtctagcagtaacaaggttaacgaaaggaaaaggtcaactttaaccgactcccttaatagtacgctgaatttaattcgtacctctcaacaaaaaaaccggatagaactactcctcaaactattaaaatcagtgcaatttgactctctcagtggttttaagtggcggttttactggcatgacactgttgacctgatattcatcccaggtggtgtttatgtggcattagagcatctccataagtgactctccaagttaaattttagcctacacatgaaaaaaactccctccatcagcctagctacttggattgccaagccatatggctggccaaacgagcttctcaactggccaaatttggccagcctcctcccagttgccaaacggtgggccccactgtgggtcccacctaactctttctttgcttccctcttctcttagccgacggccagctctcatgccctctaccgacggcgccgatggctagctcccacggaggttcgagatggccggcaagtggcgcaaggtggtcggcggcggcaccaacggtggaggaaggcatgcaatggggcggcggagggggacgtggcgaccgtgagtgagagagggcgcagagacgacggacttggagggacgtggcatcgagggaggg

SEQ ID NO: 1789 - DNA, 859 bp, Oryza sativa
ccttattaattgctgttgtctctgcactctagcaatctctcttgctgctgctagtgtttgtgccggagcgaaggaggcccttgtagctttccattcccggccacccatcatcgtcggagttgacgtcgaggggggccatgcctatcctgaagcactaccgttgtcggatctaataaagtggtacgggaagttggtgaaagggtcttacccgccggcgggggaaagtgaatcggcctgcgacatgaagtccctcgtgccggagccgtcgccgtccatctccggctaggtcttggactggtgcggcggacgagttcggcggaggtggaggcggatgcgggcatgagtggtggcagcgacgggtgagatcagcggaggcagagccggcatgagcggcggcgcgagcggagcaagggtgagagagcgagcggatagggaaatttttgggagcggatgagagagagagagcgagtgaggggcagtgcgcgtcccgcatggggcccaacgcttttttgccaaatttgctgctctggactcccaaatgataaatgtcaatttgtctactttttactactagtgtttagatctattttgctaaaatattgtccaaaccgacaaaaaaaaattactattttagtggatctaaacagatcctgaattttctttgtttgctgagctgatgaagaagtccgaggtcaaacaagagacaagtcacatcacttcaatttcttcttcaattttgtctctgcagcttcatcaccttgagagcagtaggggtcctatacgtcagtcacagcccgcacccggtcaaacgaagcgacagtacttagcttgacggagagcatctccgcagtccgcagcc

SEQ ID NO: 1790 - DNA, 2000 bp, Oryza sativa
cttttgatgggccatatggagacaaggtgtcctcgtacggaaaaagtacgtccgaggtccctcatcttgtcaccgaattacaaaatcgtcactcaactaaaaaaaccagatgtataagatccctcaacttacaaaactagatcattccaggtccttagacaacattgatcctggttttgtccgacatgacgactgagtcaccatggaacccacgtgaaccccacatatcaaggtgaccacggcattaccctctctcttatcctcttctctccctttctaccctttctcgtttttcttgtcgtcatttgggtgggctggctgtccggtgcggagaggaggaggtccgacggccgacgacgagcgacatggcggcgctgggtagagggaagcgtcgggagcgaaggaggctggcgaggtgaggtgggagaggaggcaaccacggtgaccataccatggaggagggcaccggcggtgaataggagctggatggcgcagaggagatgggcggggtcatccgcggaggagtggagaagcttgggagagaaatggggaagggcaaggtgcatacctcgccatcgtcctcatgtccttccttcctgtctgacgcaagaaaagagaggaagaagagagaaaaggaataaggggatctgatcaattggcccacccatttttattattttataatttgtttcttgatgaaaccgtcacataagcgccatgtgagatgaagatctagtcgaaggagccacattggtgccttgttagctgaaactggggacaataccatcgaaggattttgtttgcactggttttaaaagttggaggatacattgtatttggttttttggttaagggatgattttgtaaatcggcgacaagagtaggtatctccggtgtactttttcctcctcacaagtcacagagaagtatttggtgggagcctgggccggcacacatgggcgcggcggagaattcacaaaggaaactaggagcccgaggccgagtagaacacgggcattctggcccatttatggcgtggtcccgtagcgatccatgaatccatcagaaaaatcccaacaaatccagattctgccggcgatgaactggagttggtcgtcgcaagccgaagggatgaagaagataatgaagaagctgaggaagtggaggatgctgcaggagcagatcgaccgcacatcctgtcacgatgtccgccccgcgaccgtgttacagagcgaagatctggcggcgagcgaggcggaggaggaggcgctcctgcagcttggacgccgacggtgcggaggccatatatacggcacctgaacgagtactggaaggagcagcaggagtgggtcaaggcggagctcgctgcccatggctacgtcgagtgcgagatcgacgacaacggcgacaacccttgcacctgcggctgtgcacacgccggtcgtggagaagacgaagaggaaggctatggacagcgactgtggatgcgatgacgacgatgatggagaagatgaacgggaagcaaccgaagagacgaaggaaatttgagaatttgcgggatatggacagagaatttgagctaattggacatgattttggccaactaggattacatcatattaccattaccaatgttcaaatattcaagggtcaaaatatatctacacaataaagaacagaagcttttacatatggcagaaatttgcaactcttgagtcatctgcacttctctttcagtactttggcactcttattacagtttgagctttatcaaacaataatttatactagtagtaaaactaaacaaacaaattgaaataaaatataactccacagccactgtgccgtgtgcaacttgcgaacaacttgtccttaaacattaattaatggcgcgacagatttgtcgcattggtcacatcgaagatcaaagcaccacatcactcctgcaattcactcaaaaagaaaaaaaaaactctcctccacacttggtgcagcaagag

SEQ ID NO: 1791 - DNA, 2000 bp, Oryza sativa
  misc_feature (178)..(178): n = any nucleotide
  misc_feature (198)..(198): n = any nucleotide
  misc_feature (347)..(347): n = any nucleotide
  misc_feature (365)..(365): n = any nucleotide
ggcgaccgccacatcggattcgccgccccgcctcggcgcttcggcggtaaccgccggcaacaacaaacacctcgcctctctctctctctctctctctctctctcttcccctttctctctcgctcgccgctcgccggcgacgcgggcaggaaaccgcacgcgatccggttggtgaagcntttcggcgccggagcggccngagggaggccctggccagtggccacgtttcatcttggagcccatgggcacgcggtgcagcccgggggatagctcgtcgaccggcaggtgacagccctcgcaggtcgcagctggagcccggggccgaacggatccgcggaccgcggggcntgggcgtggccgcgggcnggggcttcgagtcgatcctcgacctgctgcgtcccgcggggctgggcgtgtcgccgatcctcatgcgcggtggcgtgctgcggcccacgcgggggcttggcgtggcggttgcgccgttcgagaaacggccagtacgtgcggctcctcaaccgcggccgcggcggctacctcttcgccgacgagtcagatattgacgctgcgtacgagtactacgcgcagctgcgctatatccagatattgacgctgcgtagggaaaaaaaaaggaataggatcagacaattccatcgacacctccaccattttactacagcaaacgggatggctccagaggagtaaaagtttcctctgtttttctgaaatctgaacagtccctggcaatggattagtctactgtcactactagcattaggttaatcagttaccaaactgtccaatttgtggactcttctttcacatctccttttgagacattaggagatcaatctggttcttctgatatttctgagttctgacatttcagaggaaccacgaatgtgttgcttgctcataggaatgggatgaagtccctacctctctgtggctgatatgttaacttgatagaaattggatagttcggtatgctttttctccctcaattcgatatttcaattcctttttaggccctttttacatgcgttcgtgaaggccttgcagtcttcggttggtgaaatctgctgcactagtcttctgcccttcgaagaggacattattttcttttgaagctttgtaggagagctaagctaccaccttcgttctcttgggccttcgaatatgataccaagtttctcagttcatttccttcggaaaaaaaataagcacgcaaatatataggagtagtacaaataacgtcaggaataaatgctttgtatcaaattaccatgacatttgatctcaacactgtgccactcaacaagtcaacagaatagggtttattcaatttagaggaattttaacccctataaataggaaaaaaaagaaataggaatgcatgtacactttaatctattttttttaaaaaaaggtatgagttgatgaaaattttcaaatgatttctctctacaacttctaggaaggaaaaatttctaatggttttctatacttacattcctacaaaccaaatggcacccaaaggaattaatccttagtaatccaaatcctttgtttttcctccaaacttaacaagaagaatgtattttctccaagattaatttttgatttataatttctcatatactataattttataacaactaaattataaccatataaagtaaactaaaatatcaaatcaatgatattattttcagtaaataaagtccaattcatattatactaattgttgaccaaaccttttaaaagttgattcttaatatatatgcatatatcatattatgagatggatgtagtaaataaaagattaaatttgcaagtagaacttgtttcaggatccccagaaacatgccaacccttttcttgtatttttcgacttcatatcagtacaatggcctgatcttggaatttcatattagttctgtataaactaagttaaaactatagtttgccggatcaatctctagctagggaaatcctccgagc

SEQ ID NO: 1792 - DNA, 2000 bp, Oryza sativa
  misc_feature (1820)..(1820): n = any nucleotide
catatttgacaaggacatgataattattttcgttgtcctttttacctggttcggggaactaaactgcaaagaaggctagatcatactgtatcctaacacatacagtatttttctaattatttatttaatcttttggttgataatgttcccccacaattgtagagacctgacaaatcattaccaattcaggtttgttgtaatgcattatcgattgttgtgtgccttgaaaaaatactactcctagtcgtgcaatcctcattctggagtctccagatttgtttgcattgtcgacgtgacttagctgggcaagaaagccttggtatcatggtatgccagtttggcggtacactgcatgcaatgctgatactggagcgaacccagttgtgtacacatgctaatttatagtgaaatgcagctgctttttctggtaatttgttgccatattattcttatctcccttgcttcaatagcttatgttcttgattagtcagcggcaacctatttgtgcatgcttgtttgagccgaggtaattttgagttttagaattaattaaggatttttattatctttttcgtcacttagtttcagctgttactagatcactgtattcgaaaattattttttttggtagatctgtcgtatatatttgatttgtgtttgtaagtcatagtgaacaaaaaaaaatattttcaagcagtacacgaagtagggatggtaattttgcccatgggtccggcgagaacgacatatttactaataataagttatgatgtaattcaaattattgttaataaatgataatttggtaaattattgattttatttctctttattaaattatgtatctttcgagttactccctccattacaaaatataagtcacaaccacccttaatctaaagaccaagaaataattattatcatcttgtagtttggatcatcctaataaatactaatgcatgcatccaataggattagataacatgagagtggaggatttaaaaaagtaataatttaatggagaagatgtcatagttaattgcatgtttgcatatatgccttatattatggaacatctaaaaaaatggttgtgccttatattatggaatagagggagtattattcatgtgagatccattaggacctgccgggcatatccgtgcctgtcgagcatgggtacgggcacggagttttacccgctaaccctattaggtagggttcggacaggtgacgacgagcatgggatcgggtatagttttgctctacccgtgccccacccaaccctttgccatccctggacgtgagtgcacctcggagacgctgcgatgctgtggtgactgatgactgttgctgccactcgccaccaaacgggagtaagagcattaattgcttgattaattcgttaattaattaactagtaggctgctgatgctgatcatggggacaaaaggtcagcgtttagcttacggagatccacatttgatggcaccggttccgggagaaatcccatgctctggggttaaaaatttgggagctggccttttacagccgtaaaacactacttaaaacacactctaattaaagttacatcaatactaataatactaataataaaactgcactagaggaaaaaacataggtgaaatttgagaatcatctgcaaaatcactatttcctttttaaaaaattttggtttggacgaattttgtcatttcgaggagtctctccatcgtttgacgagctggaggaggatctcgttccacgtgtcgatggggcccgggaggcaccagtgcacgcagtcgttgggcacccgggccctntggccgccggcgaacgggaacgcgttcatgtacggcccccgggtgcccgtcgccgcgaagcgccgcaatcgccgtcacctccaggcgcctccaaccttctagcgaccgggggcgcgcaccctcgcgtccgccgccgccgccgccacctcctccgcctccgcgcgccccatctcccggtcc

SEQ ID NO: 1793 - DNA, 429 bp, Oryza sativa
tgaaattcgagaatcgcttggatatatatatttttggaaaatcatgagctgtaattagtagttcaatcatttcaaattagcatgcgagtttttttaaagatatttcttgtatgactcctgtatttctaaaagccaacgaacttaaaacctaactcaaatacgggtctatatttgcaaaagcgaacgaacttaaaaatcaactcatacacggataacgtaccaaagtaccagaaaaatatcttcaatttttataatagtggagatatatactttttgcaactaatcatgaaacgcgggaatagccctatgcgatttattcctttacgaatatatatattagggtcctttattcttgtcgttataccatcctccacgagtaaacttcaatttttttttatgcagcttagtacacgtattggctaactcaca

SEQ ID NO: 1794 - DNA, 2000 bp, Oryza sativa
  misc_feature (1704)..(1704): n = any nucleotide
aatcataattaaacttgagttgctatcctccgaaaaaaaatattagagttgctgaatgcctctagcatagttaagaatatatagtggcctaaattaatggttggagtgtccaacttgaactgtttgatacctgagccgaaaaactatagctctttccatattaggcacatgcttagttaaagccttcgagttgtgtgcattacgtcacatgcaaacaatgcaggccaattaattgcacgtgaaaattcgaccgaatgaatcgtgcaacgttgaaatcctattctcaagcatacacaaaagaacttcaatctctacgaaccgacgatactttagttgataaggtttcttggcagaatttgttcattggcagctcaagttctagagtgagtacaagtactcatatttatgattatttatttttttttagtaatgagcgatgtactaatcagctacaagacacaagtaattttatcaattttaagttatatcaattatttgtataagtacatgtaagcccctactcatgagccaaatgatgatcagtggtttgcaggtcacctcgggctcggttcgtttcacaaacgagctacgaaagaggcttgagcttagctcatttggctttcaagctgagctgagccgagttggtcaaacgggcctaagctttttatccacctatgttcgtgtgtaacttttagtactagtatatttatgttaccgctattcattccaccacagatctaatggttgaaaatggttacaccacatgtcaagtcacaagtagggagataaaacattttgggtagtaaaataggatcccatctcgctcatgacgattagtccttttacttagtcatatagcccattgccccacatgtccttggttttgctctcgcggggatgagaagacattgaattaggttaggcggtgaagaaaatctatggaaggagactcctaccaagaaatctccttgctggtagtctcaagaggtgaacacggagcttaaaaaaaacattgctaaaggcattataagagagatgatggttcttagagttgaagaatcaaggaaagaaacgagatataggaaaaggctaaccaatggagaaagatgatatagagttagcgatagagaaggctatgaaagggaggcaccgatacaccagccactagaaacgaacaaggaaagggaagagtattggagaaggtgttatcacaaaagtagaattgagatccctctaccttctgtctttaaacgcactgtgttttaatcactgacatatgggtcagtgatttattaggcttacacgtcagtgacaaaattaaagtcgcgtgacttcaaaactagaggagcttgatcctcatagagtgataccttggaaatacccagagctacctcctccaaaagcaaaaccccaaaaacatttttttaaaaaaacacgtatacagccaaaatacgttacacggtggcctagccagtatataagttgaattgaagccttgaaggtatataggcaactggttagacttttttttccctttgcccataataaagccatctctcataaagccatcgacctcatctcctcctcctcctctctctgtctctctctggctgttcttatcagtttacgttgtcctcatcgtcgccggcgccgccctccaaagcttcatagatagctcgatcgatcgatcccgtcgtcgtcgancgtcgtcgacgcagcagcctcgccggcggccggagactggggagatcgatcgagagggagggaggttgagtaaggtggatccacgggtcaggcatggcaagaggcccctaccggccggcgaggaggaggaagaagaccagccaccgcctccgacaccaccagcaaagcaggagcagcaggacgaggaggagctcgccgcggtcgtcatcagcggcggcggagcaggagcagctccggcgccggagacgtacgcgcagtactactacgcggcgcgcgccgaccacgacgcctccgcc

SEQ ID NO: 1795 - DNA, 2000 bp, Oryza sativa
tgccaacagacaactgatcctggtgaaggatccacgtggctgcctgggagtccgttaatctaaaaaagaaattccttttgttggctggctcaatggaacattgtcgtcccatgatatgatggtgatcaccatgatcaactaattaatgatgtgaaaccaccgaaggaaactatgaagtgaattagagcaatgagtcaattctcgatgtcgtagtgtcataggtcagtgtctagatgagagagcacattaaatattaatttaaacctaacctccccaatacatagtttcttcatgttttttttctataaaaatagatataacaaacatttgtgtaggggtcaccgcatttctataggaggccatgacaagaaaactactagcatgtcattgtgcagttttcttgagtcgtcatattttaactctcaattagctcaggcgccacatcaaatttttagcttatgtggcagcataattaaatctatggaaactatcctacctagagcactggagcactaggactgcccttatagattactcgtttaggattcacccttcttttaaaaacaaatgttaagagatggccgaattcattaattaatatacaaagtttcaagttaaagttatatttttcgctcattactaagtccggttagtgctggagtagatatacttagttttgttgttatgttagttgatttacattgcagttcgtggaagctttgtccgtgatcgaaattgttgcttctgtacggtagccgtgatcaagaggaatatgacattatcttacagagcatcagtgatctataaatttccaggacaaactgatctagcacagaatgaagcagcagagaaaccaaaaatgagatatttggagcctccacccggagcggaccaccagagagatggcggagtcggcgaaagatggaggtcgcggtggacatcaccaccattaatgggaaggtcgatgtctcaggcttgcggttgcagctgagaaacctcacagagttttcagctgtgaccacatttgattgattgaagtgctaaggactaaggtaacgtgatttctgcaataacgctttggaattttgggtcgctgccgaggttcttcaaacccgaatactctgttcacagttctgagattatatttctttttcctagtatatattgcggttgtgatattcttctctcgatgtttgcaaaaaaaaaacagagaaggaaaataaataactttcttcttctgatgttatagctgcacgctatttgtttgaatgaaatagctgagtggacagctacgtgacatggtccgtatgtgcataagtttcataaatatttgaaacctcttccaaggttatatagtcatatggaattcttttttaatataaagcaactatattgttgttggaccattcattgtgttggcggatggcattgtgttgacggatggcatgaggcccttcgaccaaatctgccgaaacccgtggcgaaggctatggagcaagaacggcgtgaggcgaagagtcgtacgagtgtcttgccaggccagaggcgtctcaggcgaagggtgcaaggcgaagactatctgccgaaggaagacgacttcgccatggcaagttcgcccccgcgagggccgaggaagcctttccggcccaacaagcttaggggctatagggctagcgatcgccagacggcccatcaggggcccatgagcccctataacattatgtacccctgtaaatgtccctttcgtaagggtaatcatgtaaattcccctgtacaacctaaaccctaatagtaaaaacctgtaatggggctattaatagtctcctagggccatgtaatggggggaggggaaaaaaagaaagaaaacaattcaaaattcaatacacttcgtttccttccaaccactgttgagtaaccacgtctttcgacgtatgcagttgtcatttcgacaacagctggcgccgaccgtggggacctccgagcgaaaccactgagagcga

SEQ ID NO: 1796 - DNA, 2000 bp, Oryza sativa
  misc_feature (1049)..(1049): n = any nucleotide
  misc_feature (1983)..(1983): n = any nucleotide
aggtcaccaggattagagtatgagtcggactctatcctaggatctctcataaatagaggggcgtgcctgttataaccgtatgacgacttagcatagcgagagggagcggctgccggcggcgaccgatcgtgagtcgttgtaactctgatatgctgtatatgctggattggggaggagcgtcagtaatcagtgcctcggagatgtaggcttcagctgaactccgttatcaaatatcgtgcctcggtgtcgtcatcgttttggatctcctatgacgttttcttccgcgtttggtttccgatgtcgttttcggagctggttttataacaaaaccattgttcctaaacaaagttgaaggccagataagtgaagactagttcatactagagggaacatctcgcacaaatagttacgggaaatcgcaaaattcataaacaattgctgctttaggtgaaaaaagatggctattcagacccgactatataaaaataccaaatcgctacaatcacaaagtcagttaatggccagagctggattaagtgaaacgttcagttcatcccggcaccatataaagaaccagtaaagatagtatgatagaccgaccttttttctcaaatactccctccgtttcaaaatatttgacaccgttgactttctagtacgtgtttgaccattcgtcttattcaaaaaatttaaataattatttattcttttcatatcatttgattcattgttacatatactttcacgtacacatatagttttacatatttcacaaattattttgaataagacgaacggtcaaacatgtgctaaaaaatcaacggtgtcaaacattttgaaacggagggagtatattgaaactcctatttaagaagactgaattcttggcccatccaacatccaggaaagagataccatcctgggatttaagtgagaaagaaagaaaaaaaattaaaataaaccagaatttatggattataccctaagcaagtgtcaattgtaatactagatgtaatactagatgtttggaaaaatattttcttcccccntccctccgctccttatcacgatgaaattttttttaagagcatcaccaagagattatatataatctctctaaaaatttgttttatgctttctaaactaaaaatagaaagtacaaaaaagcttaactctccaagagaaacactaaattttatcttaaaaaaataaaagtgagcatttctatcaaactaccaacaaaattctcagttttcctccatccgtgtgaaatagatcatgcggtccttatggccctcaaaatcagttttgaggataatattggagtattgttggtgatactctaacccctaggtttgtgttttggaatgatatacaggtggggaagctctcccctggtgatttggtcaaaagaaattgtttcctccatttcctcctcagcacctcaagctttatatttatccatcgcagctatctcactcgtttcgtacaacagccaaaaagtaaaaattgaaacgggggcttccctcagccgttcatcgcccctttgtcgtctcagcacttgctgttaattgtataccccacttggccgctatctttgacaggttacctctgacaatgacaccccaaatcgtcattatcctctcggcgaaacctcattatcgccgacagctcacaacgccgatgcgacctcgtgcatctccttgttgatgcttagtattagcgtgtcctaatcaccttgcttacgtggcacttgccgattcctcacttaatcttaatccctcgaatttgtttttttttcaccgcatttaattaatttagcttgcatttcaattcaaatttaagttgattcgttgacttgttctttgcgcgattaggaaaaggggatttagctgttggtgtagtgggtggaaggctagaaggcgatgggcgcggtggattcctcgaggtgaggaggaggtgatgtgctcggcggcgacggcngcggcggcgcggcggcg

SEQ ID NO: 1797 - DNA, 2000 bp, Oryza sativa
  misc_feature (830)..(830): n = any nucleotide
  misc_feature (1407)..(1407): n = any nucleotide
gaggctcgggtgtcgctgcggcatccccgcacgcgttcctccttgctacggcctccactcgggtgacacggcgagcatccccgcgcgcgttcctcctcgtcgccgtcacaagcgaaggtggcgctgtggcgttccacaccttgctactgggatcccacactaggcgctggatcacgccggcctcactcaacacaggcgggagaagggggcggtggcagcggtgaagacgtgggtaatctcgtcgggcatattatttattaaaaaatgtgagacccacctgtcatactctcttcccctcttcctctctctcttctctctctcgcgggtctcgcggcggcaggtgttcggtgccgcgagacacggagcgggcggctgcggtgaactccagctgaggcggcggcggctacggctgcgtttgcactaatggataatctcgttactgataggcgatgatggcggagtcgcgtgcggcacggtcctgcgcgcgcggcagcctcgcgacggctgcggctgcatctgcgctgatggacagccttgtaactgatacttcctccattccaaaatataaggcataaccaccataacccaaagaccaagaaaataattattatcatcttatagtttggatcatcctaataaatacaatgcatgcatccaatagaattagagaacatgagagtggaggatttaaaaaagtaataatttaatggagaaggggtcatagttaatcgtctacatgcatgcatgccttatattatggaacatctaaagaagtggttgtgccttatattatggaatggaggaagtattaccgtttgtttttaaaaacnaaaataaaaggcgcctgatttgtcgataatgattacaaccaggcgcccgacgcggggggagccggatcgggcgctccccccgcgcggccctcccccacacgcctgcatatatgctactgggccccaccatagtgcctgccccacctgcaattgcaacaaatcaaccacatattttgaaaaccctctattaaaggaatttggtttattttttgttccaccaaaaatgtttcacctagtgtactcacaatgttttactatgtatagatctaatattgcagtgaactgaaatattccattgcaacaaaaaacccacatattttggaaaccctctattaagggaattcgttttatttttttttcaccgaaaaatgtttcacctaatgtacacacaatgtttcactatgtatagatcaaatattgcagtgaactgaaacattctttcgctatttgctgaaacattgtttttatataaggtgaaacaacacccggtttaaacgagtgaaacattttcgatctacttagtgaaacaattccgatatacctggtggaacatcgtgcaacatttaaaaaaaattcnataataagctaatttttttttcgtcggaatatatccatgtgtggtcttgttttgaagatttaattgcaataaatttaatgttgcaatcagatcatgatttggataagtaatttaagataaaaataagtttaaagtagttttgcacgtaaatcgggtgctgacgtcatgctgacgtcagcgcacgattttttaaagatttttatcgggcgaccgatccctagtcatccccctgatttgtttaaaaataaaagacataagttagttcctgtttttcagttagcgttttcttgtgactaagatctcgctgatcgatcgtgggatggcgcggtcaagtgcgcgattttggtatgtgtttccgttttgtaacaaactcctagagttcggagtataaataagagatgagaaccgggaaaagctgctaagtcgttcgctgcaccaaaaaaccctgtgttttgctctgtttcagtttcgtcagagttcttcagttctctgtagctgttcgacaacctaaagaaacaacgagtttttcagtgaagtccaattagagagcaggtgagattcgagtgctaggttagccaattccaacatgcacc

SEQ ID NO: 1798 - DNA, 2000 bp, Oryza sativa
gagtgtatctgtttatggctggagcagtgtgtcctccccaccagctcttcttcagaggcttgagttgttaccatgtgtttgcatcttttctagccttccgaattggattgggcagcttggaaatctctgtattttaatgattgggattagggaagtaacaagctatgatgttgatgttcttggaggattacctgctctcactgttttgtcactttatgtccacacaaagcctgcagaaagtattgtctttgataatgcaaggttctcagtcctcaaatacttaaagttcagatgcagcttagcgtggatgaaatttgaggcaggtgcaatgcctaatctccggaagctcaagctaggttttgatgtccacagagcagatcagcatgatgctatacccgttggaatcgaaaatttgtcaggacttgaagagatcactgcaaaaattaaggtcgattttactgctggtgatctttgtagaagatttgcagagtcagctttgactgatgccattaggatgcatccgggacgtccaattgtcaacatacggtgtgtagattggacctttgatgataaagataataacaatgtcaggacacgagatgaagaacataggactactgaaaaacaacaccttattgtgaaagaaggcttgaatgagaaatctgtggttctacaaaaggaccacggggaaggagcatgtaaatctgtcgaaggagaaaggcgcggagtcttaacggcaggatcatggtggcgtaggcagccccagttcgagcgtttttataaatctgccgaaagcaggtatggattaatttgtcactaagatactctagccctttatacaacactgccattttattatgagccattgtgctagattatcactgttaactcaaatataatctataactttggactaactagtggtggatccaggaaagtttgaggtgtgcccacgcactgaagagcaatgtgcaatagtcttccttcacatagacacaaaataaagtttgcattcgattgattcaacttgatctaagtctacgaatcgcaaaaaaaaacacatctctaattaatctttcaacaccctgatttcagtttacagtgaacaactaggaattcatactagaacactgctgcggaaaaattcaggattgacaaacttatagtacgtattaggtcgatcatatacaacgagtataaagttaggtttttaagaatatatcaaaataaaatttgtgatcaacttatgaccaacagaccatgacatccatatacagcaccacatatatttgcttgcctagctagtgattcaggctttctctgacattaaaaatctgattgatgctttgatagagctgacgacggcggcggcggcggcagcatcatatctggagcccaaactgttcccatcaagaacttcaccggcggctggccggctccgccgtgggaggagggctccgggacgacgatgccgccggtgtacatcaatgaaggcgagtacatcaatgtcatctactactcgcccccacgttcgtctacgacgacgtcgtcgcaggacgaaagtactgaagccagcgagagggagagatccggatcaggaacaggaagcagcgaaggcgggttttacggcccgacgttccaggccgtcggccgctacctcgaccgcaagttcgggctagacagagaagactgatgccggccgccggccggccacgccattgatgtgatggtataccttgcatgcatgcgtgcatgtgtcctacggatacacatatctacacgcgcgctttcgtccatgagagcatgtacaatagcatactataagtcagttataaacacatttcaagaagataaaatatgagagagaaaagtagtggactatagatttgtagccagctgcagcacgaagatgtatgtgtgtatgacatatgtgacaagatattagtgtagtatatatttataggtaactaactaactattgtatgctttgtatagtgttg

SEQ ID NO: 1799 - DNA, 2000 bp, Oryza sativa
  misc_feature (1858)..(1858): n = any nucleotide
  misc_feature (1865)..(1865): n = any nucleotide
  misc_feature (1918)..(1918): n = any nucleotide
  misc_feature (1966)..(1966): n = any nucleotide
  misc_feature (1974)..(1974): n = any nucleotide
  misc_feature (1984)..(1984): n = any nucleotide
  misc_feature (1986)..(1986): n = any nucleotide
ctaaaatctcttatgctttatggcgattacgcaacaattttgatcgtctgcttttatgatcaatggttcacactaaatattatagtaccatttttgtgaacagtgctttatataaaatattatacgtctcattatctcatgcgtgcatgtgaaacttgattcaattatataaataaaaatgtgtagcgacgattagtcactaattcttaataatattctaaacctagtccaatagagatatcattgttgcattatcgtatccgccgaagagtttattcgaaaataagattgaaccatgaatctctatacaatccaaaggttggggatttaattagtagtatgtgatgtatttacaattatgtataagatattacacaagaaaataatttgttagttttgtaaaaataaaatccatagtccaatctttacacaacaatggcaacaaaacactcaagaaaggcaataggcataggagtgggcagaaaaagactaaaccgaaaagatcaagactgagaccgaaaagactgagatcgagaaattcggtccagacaatgaaagaccgaatttcagttcggccaattcagttagtctcctcggttaaccaaatagaccgaataacaaaaaaaaagtctaaatgcaacctacaatccactgagttcaatatgattaaactatagttttcacatccctacttcttctaggcatgcaacctaataagagtctttattcatacgtgcttacgaattttttttgtgatttttgtgttgaaaatttctattatttctttgcatatatgaactattgttgaatttcggtcaggaccgagaccgagaccgaatttatcggtcctgatatttttgttttgaaattcgatttaactttttaaagactgaaagattgaagttcaagaccgattttcggtcagaaccggatgtcccctccctaaataggcatcattacccataacaaattcacacaacacgggtcgtgccatagacacgaaacgctagccaccacgccaagcgcccaaccccaactccaactccaacccgtcgtgctcaccgagaaaggcgaaattgaaaaccaccccaacccgagaaaattgcatatctaccatcgcataagattggcttcgcagaaataccatcacttaaatcggcttcgctagaataccactcccaactagaacggcttcgccaaaatgccattttggacaaaaatgaccctgcatctatctcttccacctccggcacgagcaaacgacaatggtgcgcggcgcggtagcggcaggtgagatgaggagcgaacgacggtggtcttctccggcgagttcgtccgcctcacctagcctcgcggcccccaacgccttcagtctccgcgacacgccgcctccgtcgccgacgagttcgacgaatcatccccattgccagtgagttcatctgttgcctcgacacaccacccccatcctcaacgagttcttccgccgcacctcaacgcgtcacccctatcgctggtgagttcgtccgctccgcttccgtcaccgatgagtttggccccatcaacgttgatgacgtcggctatggcctcctcttagcgcggcaggcatgatgaaaaggtggggacgacgaggagggcagcgcccccatcgtcgccgacaaggtggcactggtggctgccgacgagctcctccaacattggcattggaggaagggagaagaaccagggttatttttgtccaaaatgtcatttggcaaagccgttctagttgggagtggtattctagcgaagccgatttaagtgatgtatttctgcgaagccaatcttatgcaatggtagatatgcaattttctcccccaanccccaantccgtcggccgcacgagcggcggaatcctccaaaccgcgtccgcgtccccatnacccccgcgtcaccgcctcctcctcctccgccgccgttgcccttgggntcgcggtntcctctcctngncgccttgccgcctc

SEQ ID NO: 1800 - DNA, 2000 bp, Oryza sativa
attttttttctgattacgttttttttttcatatactccggactgttctagataagattgtgcattttgttaaaaacccttcttaaacttgcaatttatatttaggtccgctaggccttttctcaccgttcgtatgtaatcggacggctatgggacagttcgaatgcgtggcatgttctccggccgagaatctggtcggtgagctattcgtgaatgccacgtggcccaatcaatagcaagggttctaaccctgcaatcggtattaaagataggtttaagtctaagacttgatatgcgtgctttactcagtgtggtagtttatataaggcgtcagtggtgactttgttaatcgcaaaatataccgactcagtttttagaacgtgtataaaaaataggatgtacatgtgtatcttcatataaattagagagaatcccttatatgccactgaaaattggtctgaacccttatatgccattgaaaattggctcttcccttatatgccattgatacaaatttgcacaccctctcatgccactcccgtcagttgaccgttaattctcaaggaaaaaagacgtatttacccttctaagtataggacatgcctaacaactcagagagggcaaatatgtcttttttacttgagagttaacggtcaactgacggtagtggcatgagagggtgcacaaatttagaccaatgacatataagggaagagctaatttttagtggcatataagggatcagaccaattttcagtggcatataagggattatctctataaattaatagcacacacacattatgagtgtttgcgtttataggagatatctaactcctccgtcacacaataaatcaatatagaatcgtgggcacaacctagctagtggaataaatcgtctatccagatttgttgtatattatgttctcttcgattctacggagtactatattggttttcgcgatggatagagtactgtcttactacaagaaatggcacgtaggagtaggcagatgggggtacgtagccacaggcgactgcagtagtggcgattacgtccacgtcactgcacgctctcctgtgagcggcacacacgcgtaccacgtggccgctgccacgtaggcggacagcgacggccgccgtacgggtggatggaaggatagctgcacgcagctgggcagtcagtgtcgtcgatcgaccgagaccgatcgatgagaatgcatgagatccaacggtgcatgcacgtacgggggtgtcgtgattgattgatcgatcgatcacaaccgagcgttttctagatctttctgcgcctacggcggacgaaattttaaaaatcttgaaaagtacggcttgatagtaaccttcgtgttggtcgagcttccggacaaaccagccaatgcaaacttcatttgtaccttttcccacttttattactttgaacgtatttggttcgatcttatggacaaccaggttcaaaactccggaatgaaatttccaattttttggttttatcgaacccatcctccataggataatatttcggccaaaaattttgaaatttttcatttttttatgaatttgacaatatttattcagatttgctcattttatgttaaaaacaaataatttcgtccgaaatttcagtcaaattcatagggtaacaattccctagggtaaaaacataagatggacttgtttggacgcttcatcatgcacgctccctatggattttatgttttttattatagggtaacgctcgcagcgcccactgccatgtgggccccacccacacgtcagcaccaccatccgctcacctacactggccccaccaccccccacccaccactacataaatccccccccaccccccatcgccacgcacccgcgtttcatttccatttccacctcttcttctccttcgcgcgagcgacaagcgcactagccgcggcggagatgtggagctcggattccgaggcagacctcaccgccgccgcggccgcc

SEQ ID NO: 1801 - DNA, 2000 bp, Oryza sativa
  misc_feature (1491)..(1491): n = any nucleotide
  misc_feature (1493)..(1493): n = any nucleotide
tatcctgatacaatcaaattatattgctccttaagcacagcgagtactgatacaatcactttttttttcaccttcttataatagagttctttcctctcttttttttcccatgccccatccaattcagttcaagatccgtaactaaggttgtgtgactgttcattggtgtccctagctagatgtcttgctcatcggggtatttcaccaaacacaacgaaactcagcatatggtatgcctacgctaccaccagccttgtagttcagcgtcgtacgtgctaccatacgcggtgtgtccacacgtatgtacgtacatagcacacccctgccatcttataagaacatgcatgtgggggtgcaaaagatgaagcgaccatatcctacacgcttacacggtgtgtatcgctcacatacgcctcagtcaccatccgaaacacacagacgccggcagcgctcgcacttgcaatcactaagctcctagtgcacgacgcaataattcgatcgatagtatatatattactctagatatccacttttgcggtcttcagctaaatagcaccctcgtcataactcatgtatttatttaatttaaacattcagaaatatacatgagtggtttacagtactttgaaccggactaactgtcatacatccagtttacaaatgaaccccttaagactgggcaaataacacattcgagcagcattttgtggaaaagggctaaaaagaaaactaaaaagcaatcaagtccttgtcccatggcctgccttgaacgtcgacagcaaggtgatgaagctggatgccggcggaggaagaatccaggtgagctgcataaggtgaagccaccgcacaatccctaaaaagcctcatagttatggaggttcaggcgatggcgagcaatgcaacgaatcagcaccaccccaaaagatttccatcggagatttgagatgaagtcgatgtagaggcagcccaaccaaaggcaacaacttgatcttttcatccaccggcgagaaaaacctagaaagcatggcaagctgcaaatggaaccaagtacgtagcttacccaaatagggcctccacatcacggaggttgaaggcacctcggcatagctaaaatatatacttcagccgctacgagatgattcttcgccagagatcaagaagatgcatggctacccccttggaaagacctcactggagatcaaacaaaaggccgacacaatatgtttttgtcccagtttggaagtaccccagctgtcccagtttggaagtaccccagctgtcggttaggagtagaggtttgacggcgtggagatccacttctagaaagtctagcgataactactgctgcttcctagagatgaaagccacctccgaccacctcgtgcaaaagggaaatatcaatggaattgacctgactaaacaggagaagctgacaaagaagacaacgattactactacttctactagacaagcaaggacgcacgacccctntnacaccctccgttagtggtgagccaccaacgagaagggatgagaggattcggcatagctagaatactttagttgttgcgagatgattcttcgccggagacgaagatttccccacagggtaatcatcgacgtaccaactatcgatcgattgaaatggagtgtatatcctactgtgactgcgtggcagattgtcgatgagggtgagcagccgcatgtacggctcagcctcagccaacgatctcgtccttgccggcgcacaaaaatgggctgcggacctttcgctttgcggaattaattcgaggcccatactgtgcagctatgctagggggagaaagtacaccgaaggtccctcagcttgtcatcgagttcccccaaccgcaaaaccggatatcccgtgtcccttaactaattcaaaaccggtcataatagatcattgggtggttttgaccccggttttatcctacgtgacggctgagtcagcgtgggacctatataaaccccacatgtca

SEQ ID NO: 1802 - DNA, 2000 bp, Oryza sativa
  misc_feature (1258)..(1258): n = any nucleotide
  misc_feature (1275)..(1275): n = any nucleotide
  misc_feature (1282)..(1282): n = any nucleotide
  misc_feature (1296)..(1296): n = any nucleotide
  misc_feature (1341)..(1341): n = any nucleotide
  misc_feature (1641)..(1641): n = any nucleotide
  misc_feature (1856)..(1856): n = any nucleotide
tcagttatttaaaattttgtgtgcttcttacttcagctagtgccattgcaagaagcacatcatgaacatatggcctagaatctgggcgtcgtagagccgcctgaccaatttccaaaactagcttctcttctccaacctgaaatgaatattgtagcatgtaatacaccatttcattatgataatggtacattcaattttaataaattcaagctgctaggtgtcttgtattcatgatcacttagaactcacaaacatcataatggtgactaacctgcatcccctgcattttacgctacccagtcctaagaaagggcaaagtttaaaacctacgcgctcctcaccacattcctaaggataatttaccctgaagttagcataaaagttttctttattagttaaacattattgatcctaaatcttcttgatccctttcaaatcattcagtgaattgagaatagtattctgacaaagaataaggcagacctataaagaaacataccgggcatggtcatggtgacgactatgactatgtcatgtaacataaaaggtgacaaacctaaaccaaacttggtggttttcctttatttgttcacaataataaggatgtctgtgttacacattacctcctgcaagacacaaagtgcagcaggcaaccaactccaaggtatatgaagagaggatctgggtggaagcttttcttttatgcttcctgcgtactcctgttcaaagagaagtttgtctctcacatctaccagcagagcctaccaaacatgaaagaaataagcaaagattaaccacatgaattctgcattccctacattaaacaaagcagtatatccaaatatatttccagaattccttgattcagcgagcaacctgtctgcaggtagacacctctgccatgtacccgtcttcaatttctgcatttttcagctccattgctgctttgacaatctcatctttctcagccttctctgtaacaccaagaatctgcattggccatttgaaacatgtcactccaaaaatcagggaggcgtgtcacgcgtgtgaactaccagtgcaaattacaataggcatcgtggtgcaaacactaaagttgaattatggtcaagaaacgactatctaatctgcaactgtatcattcgaacagagaccagccgagctaaactagatccatcgacgatataagaccacatttccaaaattcggatccataaacagtacgagtggccaaaaaaaaaaaaaacctgatagcaantgacggggatttccacnatgggcncggcgggggcctcntgcctgttcccttccggggccaccggcggggctttggcaaccttngcgcgcgcaacccacgcggccgcccttcgccgtccgccagccaggcatccacccccggcgtgtgcggacgcattgccatttcccaccccaacacgccgcgtcgaggacccacatgcgaccccggggacaaccgccgccgccgcggccaccgtcggcatcgccatggctggcctgaagacctcacccccccaaccctagcccaccctcgccaacgccaccatgtgcgagcggatggatgctttagggttttgggaggcgggcgagtcgtaggcccccgcgaataaagggacaaagcgtcancgaggtggaggaggagaggcgtcgtgaaggcgaagccggaggccggagagagagagagaggaaggtcgatgatggcgatggacttggtccatgcgctttgtgctagagcctagacgttgacaggtgaccctcccagacgccgacgcgtgtccttacccaatgggcttcgtttctgggcctacatgggccaggccgaaaacttgcttggtgtggtnaagtgggctgaattccaggcctcacaaacggaggggaaaaaatccgcttcgtcgcgaacaaatctcgcggaggggggaggggaactggtggccggagtggcgccttcgagaagattcctcatcccccttcccttctcttccctc

SEQ ID NO: 1803 - DNA, 2000 bp, Oryza sativa
agtaattaaaataacagctgcggcagacatgcagcgctccattctctctctgtatcagctgtatactttatgttgcacgctccctgtgtgcatgttctatcttaattttcttcagtatgtacacgatctgtgcgtacgtgtaatcctatacgttttatgaattgcatgttgtccaaatgtcttggtcctagctactagctactccagcttcttgctgaggaaatctgcagtagtagtactccctcgttgtgatacgcaacaaaattgtttaatgtgatcttgctatatatagaaaatcatctctattattttacaggcataaaacaagcccactctaaaaacaattagtgcagccggttgtcttaatagacccgtatgtgaaaatcgttttttacgagcggttccttaagacaacttcatgtatcattatcgtagtatgtcaaaaaagatgcaccacactatgcacagtcgtacaaaatggcactactacacaactgatattttatcgggatacccatttcggttagatttagaacgggtactagagatatttttaagtaccggttctaaaagtccaagtacaaaaacatctttaattccggttggtgttacaaccggtactaaagatgtctacagggttagtttaaaaagaaagcatccatatccatgtctgatgggtggagttggtggatggttacacgcgtgagggctgaggtgagagatcttgagttcgaatcacatatcctacacattttttttatttcgtatgcatctttagtaccagttatttcaaccggtactaaagatcgagatatttagtctcgatttgttagtaccggttctacatccgatactaaaaacggttcccaactggtgttagaaatgggttctccactagtgtggcaatacatttacattcacacattaagaattcacattgtcacccatattcacattgacactgtcttttaaagtataatttaaatgttcacattgtgaatattcgacaatgatagggagcccaatccctatctacaagtctaaacctaaaattaatttgatcgacatgagctaatgaatagataagcgcactatctattgcttgaaatggtagatccattaatttccttttcatatatagattgtaaaaagttgtcgttggctgattggaaatagacttgggcatgaaacctataccctctgcaactccacgtaatcgaaaatcatcctggaatagaccccaaggatgaaatttagaccaaggaacgaaattgggcatctataagtgtgttgggagacaaaaataaacggtttcatagagttaaatgatcaaagttggaacaatattgcaatagttgatgattaaattaattaatgtggacttctctaaaccatatataggctgtgttcggcagccctgttcccaacactaacagtacgcacgaaaaacggagcggtccattagcgcgtgattaattaagtattagctaattttttaaaaaaaaatgaattaatttgatttttttcaaacaactttcgtatagaaactttttgtaaaaaacacaccgtttagcagtttaaaaaatgtgcgcgcgaaaaacgagagaggaggttgggaaaaggggtgccaaacatagcctgtattgtgcgccagatactggtaagggcattgttgttcatcctcgaaagtggcacaaatataaatacgacattatttcttacacgaaaacgaaacagggaaaactaatttaacaaatagagacatatgtagcgctgccgctagctagctttcagagtccactttttgagagagctcaatccaatgtgtggtttggctgcagcgacgaaccagaataatctcactctgctggtgcacccaatccaatcaccaaatccaaaggaaattcaatgtacaacaaaattaaaagaacatcttataatttgtctcctcctcctgcatatgcttgagctatactagcttaactagaggtaccagccag

SEQ ID NO: 1804 - DNA, 2000 bp, Oryza sativa
aggagaagtaatagacctgtaaaggagtagattgctggccgttgatgggatatctaaacactataaacaaaaccccaaatagaatcccaatgacgattaagaggagtgacgataggcatgtcgttaagcagcatggtcacgatggttggcgggacttatggagagtaaaaaataaaccccaatgataatcatgttcgatttttaaaatctcaatgacaataaggaggggaggcagtgggcggacttcagaggagtatagtggcaaagccactaacgatttgacgagacttacagaaagtaaaagagaacacaaacaataattatgtttgatttctaaaatcccaataacaataaagagaggtggcagtggacgagtcgtagaatagtaaattggcgatgtttgacgatacttctaaaaattttgaaaatgaaagccaacaagacaatgaattctaaaaactataaggcctaatttttaaagttcaaaaaagtatgaatagaagtagtgttaaattgagtaagcaaataacataggaggaagggcgataatgcttgtcgccgggcgaccggcgtggggggagccggatcgggcgctcccccggtgcgcgcccctcccccatgtgctacctgttggcccacccacttcttcctcccctttttcacaaaagatgtttcacctagtatccatataatgtttcactatttatagatctaatgttgcagtgaattaaaatactcttttgcaataaaaaacccacatattttggaaactctctattaaggaaaattggtttattgtttgttctataaaaaatgtttcacctagtgtactcacaatgtgtcgctatgtatagatctaatgttgcagttaacgaaatattccattgtaacaaaaaaaacccacatattttggaaacctattaagggaatttggtttatttttttgtccaccgaaaaatgtttctgtttaggatggaaaaatacgaaaatatatccctctatgtttagagagaaaataagtgcgagcgtgccagtgtaccaagatacacaatgtaaacaaaacatagggaacattctctttattaatcttaaaagatcataaatataaattcccaatgtaatatatatgtatgtgcgctccataatttgtcattggacagatctaacttgtgcgatgtggtctcctggttcctggggcctcgataagctcccagttaattacctccgcaggtttaggcctgtaagagaacctccattaagctgcttgtggtcgtctcgtcgtcttcgcttcacgttctccatgcatggttgtgatgatgatgtagatgtgtgtgtgagagcgccggcagcgatccgtgcgccctgacgacgagaaccaaccaaaagaggtgttctccatagccgctgccgtcatccggcgccatgacgccagcgcacatcgacttggccgcacgagtgtactactccatactctagttgatgcctctccatgcatgcgtatgtacgtgctacatatgaaataagaaggaaacagatcttaattaattttaccttggaagaccatcgattccatctccctcctcgtgctcccctgccggacgccggttcgtccgaagccgctcgccaccgtcggtgtgctccggccgcgcacgcgctgttgctccggtgctggatgatggatgtgttgatgacgagggaagattgtgttgaggatggatggccgcgtcgaggatggatggctgcgttgtgtgtcgatcgcttgtggatgctagatgcgttggtctatgaatgtgtggagaagttcgtcaatgcccctggctgccgaggggttgacgtcttatataggcatctgaggtcggtgctcaccgcatctgcacgccgtttcctccgcatcaagttcgctgtagataaggcttgatcgaccagtttgttatctgttcatattcttctttgattttatctcttagcttctcccggcgtcaaatatctgagcatcgggg

SEQ ID NO: 1805 - DNA, 789 bp, Oryza sativa
  misc_feature (5)..(6): n = any nucleotide
  misc_feature (10)..(10): n = any nucleotide
  misc_feature (33)..(33): n = any nucleotide
  misc_feature (37)..(37): n = any nucleotide
  misc_feature (53)..(53): n = any nucleotide
ggggnnaagnggggggctaatgggcgatcgatngccnagcgatcggatccggngcccaactccctatactcctccctcttctccctttctcctcctcccattctcctctttctactacagtagaccacacaaaatttttttgaaaaaccaaaattagaaaaatttatgtatagaaatactatatataaaaaaattgaactcaaatttaaatttgaattaggtatgtaaacttttgacttataaactttaggtgtataaactttagatgtatagaaatactatatatatagaaaatatcggaaaactgatcgctctgggcgaagcatttccgtgaaattagctcatgcttgacatcaaagcaatccgtaaaaaaaaaaagaaagaaaagaaagaaagaaaaaaccagcccttggtcctacacgcgtactactctcgtgatctcgtccaagactacgcttgggcacaagttccgtcaagcggcgacggcgatatctccccctctcttcattgaagatcgacgaaggactgaccccaccaccaaccctacaggcaaagcacacacctagcccgagtcactgcccgtgggccccacccaaaaaccagcccgagtcactgccagtgggccccacccaggaaaaaaacccatcgtgaggcactgctcatggggcccgcaccgctcatgtgatctacccctctccacgcatcattcacacatatacccctcgccgctccgcttcatcatcactcccacccctcctctcctctcctcttcacacgcagcgcgcggca

SEQ ID NO: 1806 - DNA, 2000 bp, Oryza sativa
gtgaacgaatgagcgacggggagaggagctcaccgactcctggatctcgtccttgacgatgtagaagggatcctgcgcggaagccatcctgttcccccaagctcgcgaagggaacctggagagggagagctcggccggatcgccggagcggggagtgacgcggccacctcctccggctccgcccactccggtgtggcgtcgcggacgaaaagggcggagacgaagatcggggagatgtctacacacaccaattcgtgggctggcctccgatcctccttgctgggctttaggcccatgtgatctattgggccgtaaataatccttttattgcgcattattttgagtaaatttgtatttcgctgggtaaataatactccctctattccaaaatatagggcacaactattttttaaagtggtttcataatataaggcgtgcatgcatgcatgcaattaattagcacattctctcccctaaatcattattattttaaatcctatactcacaagatcttcaattctattggttgcatgtattgtattaattggggtgattcataataacgatgagatattaattatttcttggtctttgggataagggtggttatgctttatattttggaatggagggagtaaatacgtactaggttataagcagagactttactctataccccctctgtactcgtaaagaaagtcgtttaggacaatgtttaagtcaagccttgggaatacaaatcataaataactctcaagttgttgagtttgaaaatataaaaaatatatgaatagatttatcttgaaaaatactttcataaaagtatacatatatcacttttcaataaatatttttatagaaataagaagtcaaaattatgttttggagaccgtgtcgctgtccaaaacgacttcctttacgagtatggagggagtactagtttgcaccaaaaataagtttacaatgtgtttttcctatacgtgtgggttggtgtgtagtaaaactagatgtgtaccccgcgcgttgctgcggaagaattatgtaataatatagtagatatgagttctaaaattttctttcaaaccaactatatgatttcttttcatgtgtttatatattttttacctttattaattatccaaatgtcataaataattgggttgtatggtgtatcttttggtggaaagagatgcaatttacacttttgatgaatcatccaaagtcttaaaagaattgagttgatgtggcttcacgacagaagagagaattagcattaactacacgtagtggggatgaacttgatagatatatatagatataggatttgttttcgtttgccataatatgaagagaaaataatactatttgtttattaagcctgtaagaaactctgtaatatagtaattttgtgcggtaaggatatattatcagtcgctgcagaaacgctatagggcagcattttgctgggtaaataggattgaagcaaaataggtgaggaagccaaactgattactttgcaatagtttgaagcaaaataccaaaaattttatttttgccattgacacactaggtgagcaattttgttaccacgtccatgtgctgatttaaagttttttttttaaaaaagaaacttattttttttctttgccacaatataaagctaaaatatttgtcattaactgatcctgttgcaaacaatgaattttaccccaccatagctaaattaactcatgattaataaataagcctgtaagttacagaactgaagaaactctgtaataataataattgatcactaagaatatgatcagtcgccgccattgatcactaagctagtgcagtgtaatggcaatggacgccactaccatcaacaatggcagcgatcccatccccttccccttcctcgcgccctatataaccacagctcgccggcgatcgatcactggcaccatcagctcccacaaacccagctaaccaagtttaattgccaccaagctcac

SEQ ID NO: 1807 - DNA, 98 bp, Oryza sativa
gaggcggtccacggctcaccccgggacgacgaggacggcggaaacgatgaccggagcggaggaaggcggcggcgcggctcgggtcgacgaggacagcg

SEQ ID NO: 1808 - DNA, 94 bp, Oryza sativa
  misc_feature (7)..(7): n = any nucleotide
  misc_feature (9)..(9): n = any nucleotide
  misc_feature (11)..(11): n = any nucleotide
  misc_feature (29)..(29): n = any nucleotide
  misc_feature (31)..(31): n = any nucleotide
  misc_feature (34)..(34): n = any nucleotide
  misc_feature (66)..(66): n = any nucleotide
  misc_feature (69)..(69): n = any nucleotide
  misc_feature (72)..(72): n = any nucleotide
  misc_feature (85)..(85): n = any nucleotide
aggtccncngncgccgatccgggcggaananaancctcgccgccggatttggccccttgcctcctnctnctnctcggcggcggcngtgaggagg

SEQ ID NO: 1809 - DNA, 2000 bp, Oryza sativa
ttacaagaaatggatcttgaagacaattgaagattcatggaatttgttccacaagaagtttgtcgaattatggaataaacacaaagatgggaatggggaagcatacctgccccctatatacaacagctcagagcttttgtgccttgcacagaagaagtacatgacaagcctatttcatgacagtcttggatttggttcagcaaaaatgatcaggtaaataaatgttgaatagtataggaagaggagattactgcgaatattggacacattctattgagccttaggagcccgcatatataggaaataaatagggtagagataaggaagtattatatttaacatggtattagagcctcaggggccagtatatagatacatgagataaggaaggattacagatatggaaaaaatccacataaatcaatcatatcctaatatgactctaactaccatatactctaatattaaacagtacaattatatagtctatactactaagttaatttgttgaatcttatttacgtctagactatgaagatatactagacctgccctttttaactgtaaggaactcaaaggcacgctaatttaggccaaaagtagaggtttccgatgtcaattttgatgcagcacttctttttcataaatgtatgtcagtatgtggtgtcctaaaagagatgttccagaagaccacctttgacaagcataaagtatgactgaaaaccgtcataaatggttgaattgaggcaattcaggatattatgttgtgagaagctaagtgtaaagaacttaaaatcacatttaaacaccattttcaaattttttatctgtattccgatgccttgtgcatgatcctcaagcgacttctgtttactaaattggaccatacatatgtaggagaattgttggaattgctcatgttgaggattttgagtcgattgaggatgccagcaagagagcttcgtgtgagcgacgtgcccttaattgtgcaaaggcaatcctgaagggaagacgccagtttgaaagcatcgggcaagtgattgtgcatgtacaatcgtttgatcgggactgataatgccaaccatctacacgacctttctgattgaggagacaaaagttttcatctgtttaccataagcgattatctgtgcctattacaaagcagaattggccagttatttgtgcttttagtactttggatcatgaaaagtgtgtgcactctgcaagatcgatgttttttttcaccacttggctaagccttccaccagcttccgggcttcttagtttatgagctgaataatggaagttcagcacaaacgtttgtccatggatatggacgagtgtgttattacaaataaagttgatagttttcggcaaatagattgttgttgttttatttcaaagagatgtagtcccccttttgttccttttcatcacttaggctgcgttcaagcgcaggagaaagagagaaagatagttttgttttccgcgtgcatgcttcccgaactactaaacgatgtgtttttttgcaaaaaatttctatatgaaagttgctttaaataatcatattaatccatttttgaagtttaaaataattaatactcaattaatcatgtgttaatggctcacctcgttttacgtatctcttcaatcccctccttctcaaacacacccttagacctgattacttacagcttgtacaagttatggttggaggttcagtaatttcagctgtaccttttcactcttcttttccatcttaacataaaccaggcaggaccgcaggagttgttttgttggcacaatttgcgagttggatggggaagcttgatatatgaaattgtacaggccatcaaagtcaagccgctctcatgtctcatcatcagtcaacagccacgggaagtcagaaaccgatggaagaatggatgtcaactcatcagccacaataatcgaccgatcgcctcgcgctcttctcctcctccggaatctcggatggtcgg

SEQ ID NO: 1810 - DNA, 41 bp, Oryza sativa
  misc_feature (4)..(5): n = any nucleotide
aagnngtttaataggcgaacgttggctttttgaatcccttc

SEQ ID NO: 1811 - DNA, 2000 bp, Oryza sativa
ctccacttgggcatgttcttttacattgctgatttatcactttatttttgtactttgattatagtgaacttcatgattgctggcgtacttttaccatcatgttctcccatacaacttagactgcgcagggtgcaatgctacgattgattttcttttttaccttttgaatttaattgtacaatgaattggatgaatgcccaaaaagcaattggaagttttctgcagccagtcttagttttagcacgattagatgtgagctcatgaaaatttcgtcttttgtgatctcaactgctcaaggttcttttgctgccttttctttggactcaactttgactaagttctttgagctactgatgggcattgatgtttttcttggtgcaggatacttgataatgtaacctaaaaaagcaggatggacaatgaaactgaaagaagcaaagttgtgatgatgagatgagttaaactactggctgataacaaagttgcagtaatttctatgatccccctcatgctcctactctgtctttatatctctttatttgttttttttttcctttgcaactgtgcccttgctttggaacaaaactttgataaccatttaacacaatcgtcaaagcagaaggaaagcttatttgcaattcccttttggaactaatgacatctgtttaagtaacaacgaccaacctcaaaacttctgctgcaacattgtgtactttgttgctagactggatgaacatctagctgatgttctgttttagcattgctttacttgagacttgagagagcctgctaccagtttcacttaaccattcgtgtttatcttcccaggatttaatatgctggaattaggaagtctgaacaacattttgtggaggctactttattaaactgcggtgctgctctgtccaaacttgcgctaactgcgggagagaaggggggctagcgtgaaaagaagaggtaaagaaagagaaaggcaaaggcgcgacatgatgcctcgtccaagctttttgttgtcacgctgccaaagaggacaaggatttggccctgcttctcttcttcttcctcctcttcttgcggtaagatcactactactattaccatcaccatcaccgcatcatttgccaaaccatggaccagcttgcctttttccaggttgcagctgcctgacgcagtttagccagccactgtaaagtgcaggtccatttatctgacaaatagagtatgtgagcttaataattgtacagttttttcaaggtcaattttaggggagtaaaacacaattagttttggaggggaaatagcttttgacattgctgtgagatgaggggttggtttggtctgtggcctaaataggtattaccaaattttgtcaatgccaaattttggcaagttttggcatgactaattttggtaagtcaaaattgtgtttggattgaagccaaaatagcctaagttcactattgaaatggcatattttcttaagcatgccaaaatttggattcaaaccaaatagacactaaacactgttgaaattgacaaatattggtaagtctaatttattcctcaaaccaaaccagcccgagatggtttgtgtaggtgaactggtgaacagtttggcctgcatctgcattggtaggggcctaggagcagacaagaacagagcaaaagtgaaaagtggaagcatccagtactgtcaatctgacactggcgccacagctctcgcgaccactcctcatctcacacttaccgaagcaacaataaaaccgttctatcctcgcttcaaaaatcgatcaaaaaattcaaaaatcaaaagtgaaagaaaggaaagcacacgatgcttctcttcacccaatgcagatcgatgggggtcgtaccagtagcagagatcatggctgtgagcctgtgattgagtgatccctttcctccatgccaatcttgaatctttctagctaaaagaatcatctgtgctcttgtgctcgcagctagctgcacagtggtga

SEQ ID NO: 1812 - DNA, 1733 bp, Oryza sativa
  misc_feature (58)..(58): n = any nucleotide
  misc_feature (673)..(673): n = any nucleotide
  misc_feature (827)..(827): n = any nucleotide
gttacatgagacatggtatgacggatcgtggggctcctcaccgggagaccgcgcaggnccccctttgccggttcggccgggggctttgggttaggttctaagctcctagtctgtggaaagttcgcaagaatggaagaagcacaagacacgggcgatgtatacaggttcgggccgctgagaagcgtaataccctactcctgtgttctggtggatctgtgtatgaagaagctacaaagagctggagagccagcgagctcttactctagaaaccctcttctccctttgtgtgcgctcccccttttctccttccgaatccccttcctaagtgggccagatcctccttttatacctcaaggggataccacatgcccaatctctctcttttgtctggggacttatcctctctttactcaaacttcacttctcttcataaatggacggagatttgtaatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccttcttcatacaatgtcttgcttgtaatggttaggatgaagcctgncatatatctgaccgggaccaacgtgtcatctccaggagctaacacgctggctccggctagggacgagtgcctggaggcactcatcctgacgggatggggcgaggcgtgtgtcagaccgcctgtcgccacctaacccacgatctgaccggtctgngactggtcacagaccggataaacgagcgcgctgcactgcgttacatgcggcgtgacgcgctcgttcaaaccgcaataaatgcggttaggtgagccccgctgtgctcacctaacccatacacgcggcgcaaaacctacaaggggtcagggcgcctcagccctcggggccgaaacgggagcagtccgacccctcggggagacaaagagagaggggggggcggccacatcaccctcgggcccgacccccccgagggggtcaggcttcgtgggtgattgctcctgcccaaacctctagtcatgatactcccggtcccatgtcaccgacagtagcccccggcgttatgccagggcgatcgccctccttgagggaagcggtcgggcgtgacgccacttcctaaggcctggtgacaggtgggaccggtctccacagttgggcagaaacccaacggtcgcaaatcacgcacatcggcaatggttactcggctgtcaataatgagcggtctcttcaagactgccacattactcgagtagcacgcgaatcgggacgagccggttcgttttgcctggagatatggtgatggcacttcggtcagcgagcgcaattaatgcacgcacgatatgttccatctcgactgccacaaccgcatatccacctcatgcgccgcaagcgggcgaacgggattagtggaagcgtgggcgcgagaaacgagggagcgagatagtgggcgcgagaagcgaggagccgggcacagcgttggcaagggtataaagacgccgaggaggagatttgcttccttcctttcgccattattccccttgtcttcgccgcttgcgccctaactcctcctttcctgtgccctaccttcgccacacgcgctcgctctcaatcatctcttcctccggcgtc

SEQ ID NO: 1813 - DNA, 915 bp, Oryza sativa
  misc_feature (3)..(3): n = any nucleotide
  misc_feature (5)..(5): n = any nucleotide
  misc_feature (9)..(9): n = any nucleotide
  misc_feature (757)..(757): n = any nucleotide
  misc_feature (883)..(883): n = any nucleotide
aantnaaancccccgggggggggggggggctcgtactcggccgcaattgtgttgaagcccggctagaaggaagggccgaatcccgaattgggaagaggaaggagatcgagaggggtaagggtagaagagagagaatgacacgtgggctccacattcttaattgtggaagggccaagttaacgtgccaagccagtgaaaaacaccatgaaaactgttaagggagtcaaattgcatcgattttaatagttggagggtcaagatatctgatattactgttgagggatgcgaataagatccgaccactaattaagggtgtcaaagtggacttattattttatcggctggtttattttgggccgcgaaaaagtgggtgttggttgtccatctgggcagaggcctgctatgtttgggttttggtctactcttagtccattacgcttttcgaggccctcgtgcacgagcatattctcaggcccatctaaaaattgcccgaccaacggttgggctgcgggcgtgatagaagtccacagaacaaacccgttaactgtagaacatactggactgttcaacgtcacggagggcagggtctcaccaactcgcgtcacccgccgacgaccccactctcccctcctggcgctggcggtggcctctgcgtaccatccagacccttccagaactcccatccgatctcaatccaacgtcccagattggcgcaccccgaacattctcgaaacaccttcaaccccaataaaaccantccccctcgcctccgtcccccaactctttgcaaaagaattccgagctcgcaaggcgaagaaatctcgcaacaatctcatcagatctcgagatctcatcaggtttggtttgttcccgtcggattttncttttccactgttcgatcttcctgttcgtgcg

SEQ ID NO: 1814 - DNA, 2000 bp, Oryza sativa
cagttatttaaatccagaaaatattggtataaattttattttatctttttttttttgcaattgtcatttagacaatttgggacaacttttgaatttgcaaaaaaatttaaatattagctattatttgtttgaattcaattcatacgaatagtcaatctttttttcaaagttatatatgtctctattggaagatggtattggaatagggtctctttttttttaaacaatagcgtgcttgacaatacaccacaaccgaataatgttatagcaaataccatgaatctagagtatcctgaagtcaagagacctcaatcgtggttcctctcgtgcgtaaactctgctaatcccataggatcaatagccttgataaggacagattgagcatatataaggctatgtttagctcttagggttgggcattaatcccttgtacatgtaaaataaagcgacttgaacaacttttttatagaaaaaaaattgtaaaatacacaccgtttaacagtttataaaacgtgcttgcgggagagtggaggttacgaaaaataagaaacacacacagcctaatacatcatttaataataggcaacaactaggagctacaaatatcatgctcccttcagcttttaatatttgacgtagttgacttttgaatgtacctttaactattcatgtaatcgtgttatttaataattttgtgcaaatatgtaaaaatacgagtcatacttaaaagtacatttagtgaaaaaacaaatcacaacgaaaataatattacacatatattttaaaatttaatgacgttaaatattaaacataagagggagtactatatactccctccttatttcttattttaatgtatgacgacgttgactttttaaccaacgtttaaccattcgtcttattcaatttttttgtgcaaatataaaaatacttatgtcatacttaaaaaatatttgatgataaatgaagtcacaataaaataaatgataattacataaattttttgaataagacgaaaggtcaaacgtttatcaaaaagtcaacagcgtcatacattaaaatacggagggagtattatgtagtgtgtgcaaggcacatttctttacgtagaaacaaatcttgtttttcttatttcactcatcatcaatgtcaggcaaaattcacccccattatttacctttgtacatggcctaatacgattgttttgaatcgaaagaggttcaaataattacacttgactaaatgctagtagtagctatcatgttgatccagggatcgtggcttggggtggtttccatgagaatactctcgaccaacttgcattattcctcctttttcctctttcagacgattcagacaatgaaacggacgctacctacgggctatggcagcattgcatgcatgttgccaacttgccaaggaggcttgtactacttccgcagtatcttatcctaaaatgagttacttttttacctaccatattttctcaactaatcattaatattcttcaattaatttattcaacaatttttttctcaatcaaccataatctttccttcaattatttatacctatttccttaaaatttatgttcatattaaaaatacttacaattttgaaggaggaagcatccttttttagcccgattcccgaagctagctaccgtgttaattcgagctactccactatttagagcaggcacaataatagactataaatcagttataaacatattttaaagagataaaaaaaagagaaaagagcagcagactatagatatgtaaccagctgcagcacggattccaagacgtaatgtgtatatgccagttgggattatgtattaatagtgtagtaaacaattattatatgaattggctattatattggctatagatgatttagagctagtagttagctatactattaaacttatactattaaacttgctcttagcttcattccatcccactgcccccaaactgctgcatctacggcaaaaa

SEQ ID NO: 1815 - DNA, 2000 bp, Oryza sativa
cgttttgcagccaagaaaacatttagtaagatactataaaccctttatcctagtgatttaaaatttcaccaatttgcacaatttacaataatcttcatcctcaaacaaggtgccgttccatgttgaaggagggcagccttcctatctgatagttgctggccttgtcttcacacctttgacagaaccatttatagagtaagcaactgatggctttcccttttaaaccctctgccttggtattgggaagcttatagttgtcaatttctgttggtttgcagggaggagtgcgaagaaactctaggggttagatcaacatgcttgcaggttacctttccaaagctctgaattttctcatcattattaacatattatcttcatttacagttgaaattgctggcaaaggcacgctattctctatcaacatttgaaggggagcaaatcgttattgtatcacaggtatgctgcattcgatggttgtaccattgactagtcctccatgcttcattgttattatcaagtcatcttcaattcaccaatggtatctaggttttggcacacgaggttaacattggctatgaacacatgggcaatcaacaagtaaagctcttccacctttgcttatactttttacgagtttgaattaaatcctatgcgttctattaaccaacaatattatcaggtcattaagctaaatggaaccgtggtaaagaatattcaccatcttgcccaccttgttgacagtaagtacagcctcatgctgaataaccttttagtagtaatatcttacaattcatgctcaactttccatggctaaatgtatgagttttcagactgcaaagacaagttcttgacgttcgaattcgaagacgacttcctagttgttttggatcgggaagaagcgactaccgcatcatcagatatcctaaaggaacatgcaattccctctgtaaggtcatctgatctatcagagccatatgtcgacacagagcaagaaatccaaaaaccaaacgatgattttggtgacagccctgtcacaaactatgaaatgggagttgactgtctcctctgggcatgaacagccaaggatggaatttgaatttcagttcaaacagtgacaatgccggtgaatttcatgcatctggatggcaggaaagagcatttccccaccatgttgaaatccactccatagaggcgaagccggagtcatgtttgttagtgtaggaagttcagagttatgttgtaccttagaaaaccacacaaatgcttgattcatcatcaatttttttaggggatgggactatgggactgtgggagattgggggagggctgtagaatttggcagggtgtaatcctgtaattttttgggcatgcaataaatcgtccagaaattttgttgctttatttttacctcttgtttgtactcccatcatttttagagaacattttatgagtgctagtattcgatattcacataaaaaatttcaagtttcccagtactcccttagttctaaatacaagcatatctactattcgaactttgtttcacaatatgcatttttaatataagcatttttagcatgatttacaatactaatcatataattcacttgctgcgctcccccattttaccttcaatcactctctcatcctaacaatccattatttaacgtgggtaccaaagtattttctttgttaactttgatctcatgtaaaaaaaagataaaatataaaaatacttatattttagaacgtataaatactcaaatattaaattttttatgcatcagagttcatgaccgttgctttctgatctgacgcttaataagtatcctcatgagtaatctgcaccaattttcccatccctttcgcgccgtaactcatcatcggccatcgccgccgccgccgccgccgcctttccccttccggcggcgtcgtctccattccactcccaccggaacagtactcccgacttgcctgagcccgagtctcttctgtagggc

SEQ ID NO: 1816 - DNA, 832 bp, Oryza sativa
  misc_feature (160)..(160): n = any nucleotide
  misc_feature (247)..(247): n = any nucleotide
acgccacttcccggccaacccggcctctccccatcctctcgtctcctctcctcccttccaccacgacgcgaccgacgcggcggagaaacccgcgaagccgcagtccagccagcgaggggccgccagccgaagctgaagcgagagctagggtttgctccancccttgaacccgcccgcgcccccgccgccacgaggccgatcgaggtgcgtgccaccgtaatctccgcgcgtgtttgtcgtggggttnggttgggtttggttgggttgggtttggtgtggatcagggaatgcgggatctggtggggtttcgtgcctcgctcgctcggggatttcatttggtggggtggtggtgatcccatcctcccccactggattttgatggatgcgacccccttccgctgaaatcggagggattttggttgccatgcgctgctccttctgtccgtacggttcggtgaatcgggagttgtagattggtggtgatgatgacccagtagttggttctgatgctcaatactcgctgcgatttcgctcccctttatccaagggaagggaagggagaggggcttcctttgcgttcaaatttagcaaagtaggaattgtgtgagattggtggtagcgctcacttttttcagctctagatcgttagttctgcataccatgaagattcttgtatcaggagaagattattatatttattctgtggagaacgatatcagagatgatttgtgggggtgatttttggctgatttctgctctgcagggttctgcttctgaggctgtcaagcctggcggctaattgggatggaccttgtgggatcgctgctggtga

SEQ ID NO: 1817 - DNA, 2000 bp, Oryza sativa
  misc_feature (298)..(298): n = any nucleotide
  misc_feature (409)..(409): n = any nucleotide
  misc_feature (416)..(416): n = any nucleotide
  misc_feature (419)..(419): n = any nucleotide
ggcactactcatcgattaattaacttgtactcaagacactgatactgatcaatcaatcaatcaatcagtggttagtgctcgtccgatatagaaaggcaaaaggcgtaggcaagaacgaggagaggacggacatgaggttgcatagccatcagaaaaggaaaagagacgggagagagagagagatcacggtgatggccggagatgcggaggatggtgacggcgaaagggtgcagctgttcgtcggccaggtgcccagctgcatggcggaggaggagatcctcgccgtcgaggcggccanggcgttgtgcacggcgatggacagcgccgtctcgtcaagaggaagatggctgggccccgcgggccggatgccgccgtcgtggacggcgcgcagcggaagcacgccgccatngccgctncgnccgccgccggcctcctcactgaataagggaagagggaagagagaaaagagaagagaaggagatgaaaaaaacgtgcagctgacatgtgggtcccacgtactttttaaaaaaaaattgctaagtaggatgccacgtcagcaaaaccacctatatatactgcctagtgactttgactgaacggttttgtatagtttaggggtcgagatttctggttttgtggttaaggaatctcaaaaaatctcgctgttaagttgagggatctccagtgaacttattccaacatagtattcatgattcaattcggcggagaaagtccatttactcgccctcacttatagcccgaagcccgattctgattttcatccatgaacaacacaacagtaaaactacagatatcgaagcttccacaatataaatcgatgccaattgactcctttaatggtttgtgaaacaccaggaggtggtgtggtggtgattaaatttattttttaatcagttgttaccctgttctttattatgtgagactgttttttaacttttgttcggggttagctctcgtgctcctgcaagtgttagaagtcaccttgccatggcaatcagatgatcaaggagaaattttattttaaaaatgtgaaataaattaccaagtccttaaatttaaaccattatataacttagatatatgaaattataaattacatgtttgcgagtatattgttggtttaacgtatcacagcagatccattcctcgtttgactgtggatggctgccgatatggcactccacgttaatacaaagaatgtattcaagtgatgtaaaacttacactaaacctcttcttgctatagggttgaatcccctttcctcaacgcatgaattccccttgttcacggtgaaatgtactccatatgatgtactactacattaatctaaaaagatatgatagaggcgtctcgactggaaaagtttggaagaacatagcatcgattccaagcacgcaagctgcgaaacaacatgagcccaaaaaacccaattgtccattaatccatccatccattttcgttagaattcagccatgttgatcagggcaacaagaagacgaccgcccacctcaccatttccacgcgccgcccccacctttccagaaccttccctcgtcccaataccgtcgaatcctcgccgtcgatccccaatccgtgggcccaccacaaacccgcaggcgccgcatcttctctcttacccccggctccaagccaaaccccacctgaaccaaacccactgccatctgggccccacgcctcccggccccacatgccagcgacgcggagatgcgaatattcccccccttctattctataaagaatacctccctcctccatcgccgcatcacatcgcaatccaaaccttcgtcttcgtcttcctctcgccgctgattcgattcgatccgatccgatccaaggtgagttccctcctccgatcgcgcgctcgatcttggatccgcgggtgcggaggattgctgtgtgcttcgcgggatctcgtttgacgctcgcggggccggatttggtgcaggggaggggaagca

SEQ ID NO: 1818 - DNA, 1059 bp, Oryza sativa
gggaggggaggaagagagggaggggaggaggaagaggattggatctgagaagagcaagagaggggatgttccaatcttatgtaaatatctgtctgggacttaaccgatcagatgtgggagagaaatatttactcccggttgataacttcaaccaggactaaagatcgatctttagtcccggttggtaataccaaccgggagtaaagatcacttgatctttagtcccggttggtgataccaaccgggactaaagtggtaatttttatagtcccggttggtagtatcaaccgagactaaagattctcgaccccctgacatacatctgacaggggatgaaccgggactacaaatcatctttagtcccggttggtgttaccaaccgggactaaagatcaaaattttttaaaccgggactaaaaatcgtttttagtcccggtttttaatggaatcggaactattgtgaaatttggtcgaccgaccaaagatggtttctccaccagtatttctagcactcattccttatcactgtcggttctaggagacgctggggattttttagatgggtgtttttgtgctagtgccagaacaatgttcattgccatattaatgcaaaaaggatcatattaacaatcaatggtgtgtacatgtgatcaattgatttaggaactatttgttgtgtaagatggatggtctttgttttggctcttgtaacaattatctaccatggtcaaaagtttggttccaaatttacgaagataccggtatatgctacaatgagaattttgtcagtttattgctgttaacttttcttttcgtgtagccgttatttaatgctgataaatgaggtgtgttgacctcggcaagccaaccaccaattagtgactgcatacatggcctgcataggatgcagctagctattgaaatattaaaagttcacctcgaaaaacacatatctacacgcagtcatgcatatataaaacgttacaaagggtcgatttagcgacgtcgcgctgtggaagaaaagactagagaagattgacaagtgatcatatgagagag

SEQ ID NO: 1819 - DNA, 2000 bp, Oryza sativa
  misc_feature (1559)..(1559): n = any nucleotide
taatgatctctacagtcattcatatatgaaatacgttgtatctcatttgtgaaaatagattccaatagttgtacatcaaatctaattctgttttttataaatcgattgtatacaaaacacaaacacatactatatggaaacaaaagctcagagttgtatatcaactctaattctacagcttcgtgtaaaattacctaggaaagtcagctggtccctcttaaaaatttccttgacatagttccgaacatcatgtaatcacttcacctaaaagcaggtagcactgatgagccaagtcatatttaaaagcgcaatgaatttgatcctgcccgttgctgttgagagctgatctgtacccctcctcaagtatctatacgcagcttcatactgctaagcgctaaaaacaccctggttggtttggctcgcacgtggcgcgtcgtcctacgcacgtgcacggccccacggaccatcattcgtagggctgcgcgcctctctccccctgcctgcgcggctgcgggcctgcggcttccttcgctaggttgactactcccaccgactggttttgcgaacggcccacgcacgcaggtggcggcacactcaaccagccagccagaacaaaaaatttacaaccaaaaacggaggcaagcacagcacgctgctgcaccaatttcccttgctgttcctcctccctcacatccgtcctctctcctctcctctccaagagacataaaaatattgggaaaagaatcccactatctcatgacatatgagaagagagagagatagaaagggagagcaattcaattgaggccatccacaagacattcctcctctccttgactcgtgcctgcagctagctactcgagacatccaggagctcctcatcctccttgcctctctctcttctccttgtgttgatagcgagaaatcgttggcgaggatcgagcaattgggattcttcttgcatggatgcggcccactggcatcaggtaattaagctgcggcggctgatctgcgctcgatcctttctcgaatcggtgcatgcaacaccggcgacatgtctacaattaagatctctcaccgggggcccggccgggtcgattttggcttctgctcttcttctggatcttgttgatgtgggtgtttcttggtcgatccttcttgtttaatctgcctgtgccttgatcttggcgcttgcttttcctctggtgggatacggtgatctctattctctctcggctttgtttgctcttgggaaccgccatggccaaccttttattctttgtgcagatctatgcacggatcggccatattcttctcgctctgtgtgtatgtgggttagtttctgtcttctccattggcttcgagctgagggctcttgttgttgttgtttggggccttttaattctcttgctccctcctctccttccccttttaatccttgaaaggagcacacgacgcaccgcttttcttttcctttgttcctcgctttctttcttatcctccctttcctttttatcttttcatctctcttttcctcatggcttttctctccacccttnaccctttcgtctctctcctcaagcccacaccttgcatcaaaagagtagccatgtcttggaggatgatgtagtagcagcagcagcagtactgctacgccacaaacacaaccctacaagagcacaaacaaagttgtgtgttttgtgtggtggtgtgttttctctctcatctttactttgctttttttttcccgctttatttctatctttcacctttccctcttctagctttaatctcgctttgtatccatttgcttggttctttgttgcaccataaggatcctagctcacatcacacctcatgctcattcatcttcccccattcgtctctcatatactacatgttcttgcttcttggttcttgctaattgtctagtattgcataacttagttctaggtttgtgttgatacttgcaattgcaacatctaatggagtgcaacgac

SEQ ID NO: 1820 - DNA, 1169 bp, Oryza sativa
  misc_feature (960)..(960): n = any nucleotide
  misc_feature (1019)..(1019): n = any nucleotide
  misc_feature (1035)..(1035): n = any nucleotide
cttctatggctggtgtatcattgccattgatggacgactttgttcccacatcggccgtcaccaagggaaagactagaaagctatgtcatcattaatttttttctttatatgatattttccttttcctctgcctcactacatcaactggttcgccgttgactagtgagttgggggctacatatgttatatcatattttttttaataattttcataatatttatcttgattgcttgcgacataatctgagtacaaaagtgcctattgagttatggagttctatcttcctatgctttccgtttggtttgtcgatggatagttgcctttgggccgattcctagcacccggcggctcgttggatgaaccgagtaatgcaaggtgctaagtattattcggaataaatcaaaagcatagagataagataaatttattgtcacgtcctgataaattcatcccgaaataaaaaatcatcctctaaaaagaataatagaattatataaaattcgaaaagaaattggcaaacactaaaatacgtgccagaaaaattcgaatgtggtccgaagaatttttgttaaattctccttggtctaaaaagagccctcaaattttacttgaattttcagagcaccggaaatatttattaagcaacaacgactatgatcaaagtttactaaaaagaaaagctaaaaataatcctccttcctccctttgggccaagtctggcccaaagtcctctctctctctctcggcccgcggccaaagtcctctcttcctccctctctttctctccctctcctcctttccctccttctcttggggcctcctctccttcccctcggcccagctccctcctccctctcttccccaggcctcctctccctcttctcctcctgggccggccgcccggcccaagccgcgccacccagccaccccatcctcccgagccgccccccccccttaangcgcgccgcacgcgcgttgcacgcgcgcttgaccgtttggggccaaggcgcctgtcgtnttcctcccgcacggcntcctccctttcccgtgaaccctaagctcctttcctccctcaaatccgtgcgatttaatcatgggattccaaaattaaatagggagaattaatccccattgattcctctttgatttcccccgttttcccccttga

SEQ ID NO: 1821 - DNA, 430 bp, Oryza sativa
cagtgaaaaattgaaggggagagctagctactgcctaccagtagtagtagtagtagtagtagtagttagggccaggcaatcaggattagcacggttaattaggtaattaggacagtttcggctcggtgaaagacgtgaagccccaccccaccgtgggggcgaggcgacggaggcttcggccgcaagccgcctcggcacggctctcctccgcgtcgagccttataaaagccgcccctcggttcctcccccccaaccccaagtccattctctcgttcccaaaccctgcatccttctctttcacacaagcctctctctcgccggcttcggcgtccgtctcctcctcctcctcttcgtctagccttgtggcggcgtgcggtgcggtgcggtgaggaaaggagggagctttgaaggtcgggggagggcggaggag

SEQ ID NO: 1822 - DNA, 2000 bp, Oryza sativa
  misc_feature (363)..(363): n = any nucleotide
  misc_feature (1770)..(1770): n = any nucleotide
  misc_feature (1780)..(1780): n = any nucleotide
  misc_feature (1809)..(1809): n = any nucleotide
aagaatgaaaaaacggaggaatagaaaaaacatagaattatgatagaaatgcaagtataaaatagaggattgcaaaacataggaaaaacacaacaatgtttgtttgattggatcacatgaaaaacacatgaatcggataagagagatatactcaaaggatttttaccaagaggttggacctcttgctaagtttcttctaaaacctatatgcaataagccattccataggaattttgtaggatttgggaaacttcaattctttaaatcaaagagctacataggaaaatttcttataggatttcaatcctatgaaaattcttcataattcctttgattcaaaggggcccttaatttttaccatgntggtaaatttatagtccctattcctttattaagatagtagattttatgatctaggggcgaatcagtccgaaacgaggatatggtatgcacttttagaaatccagcgaatgtggattatccgacatttctatcggattatccgataggccgtttgtcagataatccaaaattatcaacaaatgtaaccactctatatattgcatataatataagttggttcatccaatgacctaatttatcaattaacctagatttattagcctaaggctttcattgtctcgtgtcacacttgcgtagctatatttttatattatagacataatgtatttatgttgttcagcacttaagtacataattattacaatgggtcatttattaactattgtattattgttccttgtattgctaactcgatgttgtattgattgcatatacatgtaacacccgataaatttaatccgtttccgaaccgattccacaccagctccgcaccatttccgacatccgaaacaatccgctccgcattcgcatccgcatccgtacactatccgcacccgctccgaatccgcttaaaaaatatggtttaggatatggtatgaaggccatccgtccgaatccgctccattttcacccattttttctcaatttttagcacgttttttaaactgctaaatgatatttcttacaaaactttctactttaaaatatcaaaatgactttctcgtcttatgctgacttcatcttcattttaatatatctcaaacaccacgatagagttactactaaataaaagactcctttgacttaaattactgggcggattaggattattacggcggatgattgacttggttgtagatacaaattgaatattataaaattaatttagtataaataacttaaatcaaacagtctaaataatgcaacagaaaaacaatttgtttcaataatgagttatatctgttttaataattcggtaaataagatgaaaagcagctgaaccatcacggcagtaagccagtaaacgtggcgttttgatagcgaggcgttagttcgctgatcacccaatcaccattcggtcttccattcactcacctgtcaccacccgtccacccccgcgtgctgatgcgacgctgtcacaaggcacacgtatgcagagcccgagcgcgacgggggcgctagggctagcggcttgcgtgcgcatggcgtcagcgtgaccgccgccggccgcaacagctgcagcagctggcacagcgtttcgaaaggaaacactttttctgttgagagcgcgagctatgcggcgagcttttatatatatttccccgtagcggagagaggaaaaaacgccaagaaaccatctgtcgcttttgaccccgggaagcagcagcagcagcagcggcggcggcntatcggggcntaacggaatcgaggtgtgttgccgctatntaaagaggaagaaaataggccccaaaccaaaccaccataccctactacaaaccataggcatcgccggcaagggaggtcggaggaagaagaaagggtcgtcgaggtgttcttgaattctgaatttctgatcaagtcgatcgttcgccggcgacggcaaaggtggtaactggtagtactatatatgacgacgt

SEQ ID NO: 1823 - DNA, 2000 bp, Oryza sativa
aatagtgtcttcataatagatgaagaataaatatgattggtagagaaaagagatgatgtatttattaatggcatactttaagaatccatgggttgtagagtgtagtttctattgtgatgtcttattgacatggcactatagacactgcttatgaatactatgggtttggactgcccttagaattgaaaagtaatagctaatcacaatttcaaaatgtcggaatccagtcatcacaaatgacgatcgaagatggaagcagctgtagaatgtcaacaggttacaggcccctaatgtcattttcgctctaatgttacagttcatcaatgtcaatcaatgaatatggtttaggccatgcttagaaggtgggttttttattgcgagtttgtacggaagtttgagttaggcttttcgagtatgacatatgttgttttaattaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagcagtatatatttaatactctaaattagtgtctaaagacagggacttaagttaagtccctggatgtaaacaccacctaaatgttggcagtttgacattcagtgcatttcaataaatagccggtgtggtatgtaagtacataaccaactagtagaagattttaatgcacatgacgggtctataattcaattttttgcagaccggaaaaacaataacgttacagcaaaatatgatggttagtcctaaatacatctaattattatcaaacgcaataatcttcaaccacatatgctaagttattttaagctataattacccatggttatagtcactaatcacagcgtccaatagtcacaaatgaggataaagaagatggaagcagcaacatgtaacaggcaaagataagcatttcactccactttgcagcaaagtcaatccatgaacatcagtacatcacataggtcatgtttagaaggctggatatttttatgagtttctgtagaagactgagcaggttcaactaaaacctaacttgccaagtgccaactcaggcaacgtaatcatcaacaacaagtcgcatgtggtgatttcatcaatcttaagatatgtcggctctgttttcaaaggtgtttataggggtagcgcgtttataggagtaaatgtgcacgtgcatataggcgtatgcgtttgtgtttcgaaaaaaaaaagttaatccataaatatgatataggtcatgttcgaaaggctagatacttttatgagtttctgcagaagattgagcaagttcaactgaaacctaactcgacaagtgccaaccaaggtaacgtaaccatcgacaacaagtcgcttgtggtgatttcatcaattttaagatacgccggctcggttttcggaggtgttcgtaggggtagcttgtttataggagtgagtgtgcacgtatgtgtaggcgtatgtatttgtgttttgaaaaaaaaaagttaatccataaatatgatgatataggtcatgtttagaagtctggatatttttatgagtttctctagaagattgagcaggttctactgaatcccaacttgcaaggtgccaaaccttgatgattttatttataaaggtatcagttccaggctacttcttggattccagttcataaaccgtttgtcctgaatccctgaccttcagacaaatcagaaggtgccaatgcagaagagacactaaatcttggtttgttttcatcacctccaagaaacagaaaattctcctataaaaccgaagtgatcactctcctcccgagctcgaaggagcaaca

SEQ ID NO: 1824 - DNA, 2000 bp, Oryza sativa
ttgccgtcaccacggccgcgcctgaaaccgccgccgcgtccgccgttgttgccgccttgtcccctgccaccgccaccaccgccgcgccctcctcgcgacacggtgttggcagaaggggaggagttgttctgaagcagatccaggcgtgtctcaaagccaacgagcaaagcatatagctcgctgactgagattgaatctgcacgcccagcaacggaggagacaaccgagttgtagtcgaagtcgaggccgacgaggatgtaggagacgagatcctcctcgtccagtggattcctgcagaagacatctcatctgctaaagctttcatcttacccacatattcagcgacagttttgttccctttcttggtggtggagagcgccatgcgggtgttgatgacgcgagctcgagactgcgacgcaaagaggctttcaatggcctcccagacttctgtggccttgccgagcgtggccacctgggtgaggacgtcgcgagagagcgacgacagcaagtaactcaggacttgttgttcctgcgcaacccattgcgcaagagcaggatttgccaccttctcagtggtcttcccatcgtccttggtgatgacgatggtggcttcaggcgccttgttgctcccgtcaaggaagcccgccatctgagcgccgcgcaacgtcgctaggacctgcgccttccagagcacgaagttgctcttcgtcagcttctcagagactgattgcccatggagagcaaatggaatggagctggacgaagatgccattgatttcggagagattggatgcgatggagggtggaggctctgataccatgtgcggtgaaacgatgcccttcctctaggctcgcttacgtgttatataggcacgggaaaaacccccggcgtggtgtttacatctcaacagaatacatccttatctcaagtgtttagttacaacaaactcctaagaagattcggttctatctatcctaatagaaccaatattatctaacatgccaaactactggggccggggttaccgtgccccagcggtaagcatggttaccgcatggtaaccgtggcaaaccgtaaaaagtttatcaaaattttaaattattttttaaatttatttaaatttaaggagctaggttaccgcggttttccttataccatactctctccgttaaaaaaaaactaaccgtggaggggtgctcctaggttggcttttttttggatggaggaagtactcccgcggtaagcgcggtaaccggtggtttgaggaaccctgatcatcataactagtcaaagaagcctattcgagcagaaatgatcgatatactccgacaatcctactcacactcgacactgtcactgtgcaagagacatggatttaacaccgggcaacgcttgagcttgagagacggctagtatgagctagctgagaagaccgatggtgtcatgtccgtcgtgcaacacgtaacagtgacgatagcaactggatgatcctctccatcgatcgctagtcacctatctatagctaggccagccatgggctagctgctgagaaacaaagtaaagtagggtcccgtgtctcccagtcgagttgatcgatcgatcggccattcctcgcaaatgtgtgtatacgatgccattcaagttcgcaaggcgcatcatgtctctgatccactgattatgcttacgcgatcgatcgctaattcgctagccaagccaccagggcgcgcacgcaccggccagccaccctcgcgggcgcggcatctccttggcgtcggcgtgcgtgcatgcaattacacgcaaggaagttaacgtacagaaaaaacacatcggtcgatcggtacgagccgggcgcatgtggtgaggccggcccggcgctcgtacgttcgctcgtcgggcgagactaccgtgagtgcgtgcgtgacagatcagcgcggccccgccctagctatagctagcccttttcacgcacggtacggctgagtcgacgttggatcgatcg

SEQ ID NO: 1825 - DNA, 2000 bp, Oryza sativa
  misc_feature (375)..(375): n = any nucleotide
  misc_feature (387)..(387): n = any nucleotide
  misc_feature (411)..(411): n = any nucleotide
  misc_feature (418)..(418): n = any nucleotide
  misc_feature (833)..(833): n = any nucleotide
tactatgagtgataaaacaactcataacaaaataaattataattacgtaaattttttgaataagacgaatggtcaaacatgtgagaaaaggtcagcggcgtcatctattaaaaaacggaggtagtatttcaaaagaagttcaaataaaaaagacgaccaatttgatcatctcgtccatcggagtataggcatcattttgttttgcagaaagacttcaggtcaaactcagtcccatcttaacttaagaaaaaaaggactaataatctccttaacccaccatcccatcactcaaactaaagaatcctagaaggctagaatttactttgacagtaacaacggaatggttatgctctcttgaagtcatgctggggtcantcaacttggttngcaacttatatatgtcagtatacntttctanggttctagatagccacatggggcatattaaatctattcaaacaatctaatggcacaatgatatgcctatcacatagctgtgctcaccattttcaagtaatacatggttagttccattacaaaccattggttttcccctcaaattccaaacaaattaacctattctaaacaaattatatccagtggttcacagaaaatcaaattgagtaatcacatggcagtaccaaagtccctaaaagataaagtagtgaaaccctcagaatatgatatgatccccacagctctcaatgaagataatatcactaaattcaaccttctgtttcactgcatgacaaaaacaagcctattccaacatgaatgctgaaatccatgctaattttggggaaatcaaccacatagatgaaccccatgaatgnctgcaggaaatttgcataccaaaatgctaaacatgaaatgtgaggtggtttgttttgtagctaggaggttttgctttgtgcttgagcacaatctgaacctttgataaaccacaaaaaggaaaaaaaaactaaaaacagttgagatgatgtgacttcacaagataagagagaattaacaataacttagtggcttctaagtgtataagatattgagatttggactaaactccacttggtggatgcaatttcagtctcaggaaagtccaaacctactatgcaattaaggtactaaggttaatgttgaggctagaggtgactgaagttgacctgcaaacaggctccgcaatagcgatcaagaaatcgtaggcttgtttgtataggggcgaaaacgtctccaggaagatgcggccatcggcgcaggcccagagcggcctgttcgcgtgatccggcttcagctctagcttggtgaagtccctcttcttcacctccctatcggctgcaccgaatcaaagttccaacccccacaaaacaaaaatccccaatcagttcaatgttccgtgcaaaccctcatacattgggggaggggcggtgagtttagggcggattcgagcgcgcggtgttaccatcgcggacgtcgtcatcgacgtcatcggtgtagtccagttcggcggtctcgtcaatcgacctcgacggcgccgaggacttgtgccgcttcggcgcgcgggcgcgatcgcctgcagaggggagaggggggaacggtgtaagggagatgcggtatataggacagaacgggggggcgccggtgccggggatggtgccgcttagggtttgcttcctcaccgtcgccgccggccatggccggaagccctggagcgaggagcgaggagcgcggcggcgcgttggcggcggtagccggagaggggagatgttggcggcgcacggggcagtttcgtcttctcgtcgccgcgacccgctcgggctgggaaatgctttatcgatcgatctgggaattctggagtcctctatctgtctcttaaatctgacgagtgggcccaggggcaaaatcgtccgatgggaagaccgatcaaacggttcagccggccagaggcgtaaagggaaccggacaaattcctccgtcgtctggtagcttcttctcgcggctgcgcg

SEQ ID NO: 1826 - DNA, 2000 bp, Oryza sativa
  misc_feature (419)..(419): n = any nucleotide
  misc_feature (423)..(423): n = any nucleotide
aacatcgtccaggaatcagccgaggtacacaaattgacaatttaatatacagattcatcaaattaactaaaacgataaatacttacttaagaggcacttagtcctcaccatgaagaaaactgcagcggaaaataaaatctagcgaagctctggctccactcccacaggcagctcaactggggtataagccaaacgtcttctccttctggattctttttcttcaactgaggttgattgattattgcaagaatgagcatatgacatactcagcaagccacacagcaaatatgcaaagtgcacgaggataccaaaggatggcataatataggctcatttgcaaaagcagcatttagcaaaacatttaagagaagtaaaaacagtggagtaattaatcagaaattttaatcaacactgaacancacncccatgctgcacaggcccaaccattctgcagcaggcccaaccattctgaacagatccatcaccacggctgtacagatctaactccaaaccaggagctaaacaaattattaccagttatagcatccataattattgtgagaggtgtgagactaatcacgaaaaacattgctcaacccgcccataaccgcgggcacggctattcgaatagttttactctggccagaggtgtaccactgtacccagaagacacagccccacatcatgtcaccatgtgcctcagtaccaccacggtacctcggaaaggagctgtgacattacccctcgcacaacacaatccaccacagtgcaccattcctggatcataatcacccccctcaaaaaccagaggcatggactccccagcgacccccgtgggcttatctccgccacttctcagtctggtgctctgcaatgaaccatgctatacgaaaggtaaagccgttgcccatgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccaccattaaataatagtgaataataagttatcccaatagtgtgctaatgtttctaagcatggctaagcaattatatctaatatctagttgaaccaatatatatatagcccaactagtcaagttataatcacccaaggtatcaaggaataaagtaatcaagtacaaaagggccataacaaagaataggttcacaccacccagtgacattcaaaaataaatgcacagttgaaataaatagagaatttgaatataggatcaacatgctcaaaggaattgtgtttgggatctgtgtgacttgccttgcaataatcggtcttcaattaatcttcttgaacacttccggtgcactcgcgaaccttcgcaacgatggaaacgacaagctaacacgcaaaaccaagaaaaagactaataaacaccaaataaacaatacataaaaagtaaacaaacatgtagattataattttagatgaattatgagacttgaacggcctcattctgacttcatatgaatttattatgaattttacaagattaaatctaattaaagcccatttaaaaagaattaaataaatttaattcaatttatggacaattttaatatgtagatctttattttataaaatttttgcaacttgaaccacattaaactgagttcaaatgaattagttatgaatttttaaagattaaatcggattaaaacacttatatggattttaattgaattatgacgcaataatgaattatttttgaaaaggaaaaagggatttattgcgtcagcggctagggtttgcggtggactgggcgcacggcagcggttcacgggaacggacggccgagatcaaccctatccaaaacggacggccgagatcaaacggtccacgaccggctcacggggaacggcaacgatgacgtcag

SEQ ID NO: 1827 - DNA, 66 bp, Oryza sativa
ttttttttcccccccccccccccccttctcaccacaacctgctagcaagctcagagctagcagcag

SEQ ID NO: 1828 - DNA, 2000 bp, Oryza sativa
  misc_feature (50)..(50): n = any nucleotide
  misc_feature (179)..(179): n = any nucleotide
  misc_feature (212)..(212): n = any nucleotide
  misc_feature (215)..(215): n = any nucleotide
  misc_feature (474)..(474): n = any nucleotide
ttttgcccggttttgctgacgtgccatcctagtcagcaaaaaaaaaattnaaaaaacacatagggcccacatgtcagcttcacatcttttttctcctattttcttctccttctctcctcttctcttttcttactctctcttctcttctccttcaggctgcaggcggagcagccgcgctncgctgccgccgtcgtcgtcggctctccaccgtngtngtcgccgtgggtaaggctatgcggcgcggccgtctggcggcggagcggaggcagcggaggcagcgggcggagcggcgagcacggatgcgggcggcgcagcggagggcgagcgcggcaacggagcagcggaaggcgcgagcacggcggtgggccgagcagtggagcgcgagcaggccgcggacagagtagcggagcgcgagcgcatcggcggagcagcggccagcgagtttgggagagagggggaggcggccggcgaccnaggaaacaatctcttcctctgcctcttccccttctcccgctggtggtgcctctcctagcatcgtcggccacccgcgggggcacgacggtggtagcggccgatcacggggagctcctcgtcccatccactgtcttccgcttcgcctagctcgccttccgctgctttgcccaccgccgcgactcgccccgccgccaactcctccaccgcaactcgccttccgctgcaccccccgcatccgtgctcctccgctgcacgtaatagcatatatacatgtgagtgtgcttagccatatacacatgcttggctaatatatacgtctgcatgttatcgggcggcaaaccaacaagaagctagctaggctatagctggtcgtctccatgcatgcatatatatgctcgtatgaagacgcatgtactacatgcggccgtctgtacccggcgtatatgcgtatgagctacgacgtcaagtgctaccgcgacgtcagcgaagacgacgagggtcaccgcgcccgcgccgaccaccgtccatgacgccgatggcacgccgagcgtggacacgctcctactgcagctgcgcgagctgggcgtccgggaggaccatgggatcaggccggcgacgctgccgccgtcaccactaccgctgccgcggcacaggaggagcgcgagcgactggggtgcatcgtcagccagcacttcgagccacctatgcacggcaactgcgacgcctggccgatgccgccgaacagccgcgccgtgtagcctcgcccacggcgacgacgacggtggagagccgacgacgacggcggccacggcgcgcggctgctccgcccgttagcctccgctccgccgccgcgcttcgctgccttcgctccgccgccgggctcgcccgccgtccgctctgctgccgcgctcggccatcgcggctgcgcccgccgccagcctgaaggagaagagagagaggagagaagagaaaagagaagagaaggagaagaaaagagaagaaaaaaatatgtgcagctgacatatgggccctatgtactttttaatttttttttgttgactaggatgccacgtcagcaaaaccgggcaaaaatactgtcaagggacctccggtgaatggtttgagtaagtttaggggtagacgtttctggttttgtggttaagggacctcaaaaaatctctctgttaaattgagggacctccggggaacttattccaagaaaaaaaatccaactcggcccaatatccaaacctaatgggcctcctcctccagcggagcccaaaaggtgagaagaacccggcccgacccgacccattacccaataaccaggcgggttggctaggaatatcctcgcgtcgcgtcctcttccgcatcggcccaatccacccgcggcggcgatctctctctaccccgatctcctctcgccgtcggcgtcgcccgggtcgccgccgccctccgccgcgcagtccgcagctagtaggtgggggggttagccttagcgtgagaggcctttgccgccggctgcg

SEQ ID NO: 1829 - DNA, 1328 bp, Oryza sativa
ggctggaaagatttaggcaattgcccgtgtaagcttagagaagaaagagagggatcagattgagacatcactgaaggtcggaagagaacttcctgcatctcaaagcggagaacgatacgcaaagatacaagagccagatacgtgctctcgagcagcagatttcgcagctgaaggtatccttggactcgttgagggttggtgcccctcccaagtggggagcagacaacagaaccaacgcgttgcgcctttctgaagggagaaagaatggcagcgctcaaattttggccaatatagcagcggtaccccaggatttcgattttgacgacatacagcgtgaccgggagtgcgtcatgtgcctgagcgaggagatgtcggtcgtcttcctcccttgcgcgcaccaggtggtctgcgcgaaatgcaatgacctccatgacaagcaagggatgaaggagtgcccatcgtgccggacccccatccagcgcagggtgtgcgcccgcctcgccggttgctagacttcttcatatacaccattttgttttctctttttatttgttttttttgattgatttgctgagcttgccttggatggatggatggaagattggatggaataatgagtggtggtgagagtggttaaactttgagaataatatacatggttggtcgcacatcaatcaaaaccccgcagagataatggataatgggatgggtgttggttatacatgatgtacagagcgttgtcttctgaatgcttttccttttggtttatctttttttcgctgagcattgcaggcaatcagaactagttcttgtcaggtaagagtatcaaaatgtgtttgaattttgatgcttctgagctattccatttatcctgggaatcctcactgaactgaggtttcggttcatggatgatgttaataagtctggttgtactatgtggctttgtctgattcgccattgacctcattgtgttccaagagctcttctcccaattttggtggtaaataaacaaacagattcctatgaaatttcttatatgaaatactgtgaaatttcctgcgttgcaaatgagagtttgcatcataaacactcaacgcagcagcatcaagagcttcattgtcttcaattttcagacgatctctggcctacgacgaaggcacggtgtcttcctttccatggaccctccaggtgaaccccacatgtcagtggaatggctcacgcgtagtattttccctagtccatttccacccttcttcacatcacagcgagaaaaaaagagcgaattaaaagcaaaaaaaaaaggaaaataaaggagaaaagagtggcgg

SEQ ID NO: 1830 - DNA, 2000 bp, Oryza sativa
aaactgagtaaaagcagggtgttgttagaaacgtgagaagtatgtactaggccttgactaactaaattggagattttgcatctaatggtgcttaatttagcaaattttactttcttattccttgcaagcaaatgactggagttcaaacatgcacactgtgatcagataatagatcaatggtagatatattgtgaaccatgatacttgcattcattttatctctctatttacaaacacccactgttttaacagtttgtcaggtaataaaggcctttgcggggtgcctactttacctgcttgtgcattattttgggagaaaggagggctgaacagaactggtaaaattgcactaggggcctcgcttgggtttgttctacttgtcacactcatagtggtctacatattgtgcatcagaagaggaccgtacgattatgattttgagttcccccaagatttgacttgtgagtataccacatctcaccttcatactgtgggtcaacctcatatatgactttaagattctttagttttgagtgattattgttttccattgtaagttagtggtagccgttcttttcttaaactatacctaaggccattcatatcagttgtcatgtcatttgaaaaaattatcagtgttcctatgttcctattaacgcaagtaacaatgtttcagatatatcaacctagagtttagtatcccttttatgaacaagtaatcactgtttacaaaccaatttcctgtcttcacaaatgtctaccatgtttaaatttgctactttctcatcctacacagcgatatcagcaatctctgcaaaaaggaataggtatcagagggcgaagtctgtaatgcttgccgagatggaggcgcacggcccggacggttattataccaacgggggcgctcactgaattgatgggcaccggaaatggatatcttcacaggttgttgtatttctacttacagagcaaacactcattgacaattgctggcctgaagcaaggacagttgtgacttgtgactcgtgaacacaattcaccagcatcatcaacatgacgtccctgtaacttcagtcaagcatccatggcattattttgcagttacactcacagcttaattacaaatgtaaaatatgtgcatgttttatgtgtactataatacgatgaagtggtggtggggtggtagtagtagtttggtaatagtagtaggggtgccttattttttgcagaggctttgctgtctcgtattagctttagctttaggcgtgtgcactccatcagcaatgtaaatggaaccaggttgggtcaggacagattcaggcgttgaaatgcttggggggtaaaagctggtgtactcataggtgtattctttctgtataaaacctgacttcgttggcactgtctgacttcaggagattgaaaacattagctttggatcagagtgttgttagccacttttgattatctgttgcttacttgcgtgtcatccagagtcatagacgactcaaattctcacctgctagtatttcaattgtcttcagaatgtgctctttaaacttaatttttccttctaatcgaaccatttggtctggatttagatacttgcattatatcgaagttgtactgcatgaaaccttaagcaatgatgtaataatatcgagtcatctgtaatgtctgaaaccttatttagactatgcagtttgcagttcatattaaagcccacgtaaaataattctcagcccaacaaaatacaaagaataattctaagcccaacgagcccaactgcgcttcccaactatcaaatctgcaccatccattcctcatcggatgccttcacgccgccacgtagcggagagcaaagcaaaaccctagctagagccacacccagaggtatagattccccaccccgccgcctccacgcattccttcgcccaccaaaaccctagccgcgccgccgccgccgacgaccaggtaaggaaggagatccgccgccggcgccg

(The sequence listing continues in the following parts.)

What is claimed is:

1. An isolated promoter comprising the polynucleotide sequence of SEQ ID NO: 6078, wherein the polynucleotide sequence is operatively linked to a heterologous nucleic acid.

2. An expression vector comprising a promoter comprising the nucleic acid sequence of SEQ ID NO: 6078 operably linked to a heterologous nucleic acid, wherein the promoter directs expression of the heterologous nucleic acid in a plant cell.

3. A plant cell transformed with the expression vector of claim 2.

4. A transgenic plant comprising the plant cell of claim 3.

* * * * *